United States Patent 9,782,462 (MODIFIED POLYNUCLEOTIDES FOR THE PRODUCTION OF PROTEINS ASSOCIATED WITH HUMAN DISEASE) - sequence listing, part 60

SEQ ID NO: 115101 - DNA, 3594 bp, Artificial Sequence
  Description of Artificial Sequence: Synthetic coding sequence
atgtggatgcattgttgctgggcgtggccgcctcggtcccagtccgagcgaaccatgtgctggctgaagatgtgcggcgtgagcctcagactcagcctgcaagtggtgaactcttggcctctgggcagggggagtgctggcctgccagaaccggacttttggcccggtcctctgaagtttagtaggactgatcatctggcttcttgcctgcaacgaggacgggatctggggctgccatcttacactaaagccagggctgccctcggcctgtccccgatcactcgctggcaggacatcaatcccgctctgagccgctccaatgatacagtcctggaagcaaccgcagcactttataaccaggacctcagctggctggaactgttgccgggaggattgctggagagccacagggatccagggccgttgttcagtaccatcgtgctcgaacagttcgtgaggctgcgtgacggcgatcgctattggtttgagaataccagaaacggtctgttttctaagaaagaaatcgaggaaattaggaacacgacccttcaagacgtgctagtggctgttattaatatcgacccaagcgcccttcaaccaaacgtattcgtgtggcacaagggggatccttgcccccagccgcggcagcttagcactgagggactacctgcctgcgcccctagcgttgttcgtgactattttgaaggttccgggttcggctttggcgtgacaattggaacattatgctgttttccactggtcagtctgttatcagcctggattgtcgctaggctgcgcatgagaaatttcaagaggctgcagggtcaggatcggcagagtatagtgtcagagaagctggttggagggatggaggctctggagtggcaaggccacaaagaaccttgcaggccggtgctcgtgtatctccagcccggacagattcgggtggtcgacggcagacttaccgttttgcgcacgatacaattgcaacctccacagaaggtgaactttgttttgtcctctaaccgcggcagaaggactctgctgcttaagataccaaaggagtacgatctcgtgctgctctttaacctggaggaagagaggcaagctcttgttgagaacctgcggggagctcttaaggagtccggcttatcaattcaggagtgggaacttcgggaacaagaactaatgcgagccgctgttacgagagaacagcggcgtcacctgttggagacattcttccggcatctcttctctcaagtgctggacatcaaccaagctgatgctgggaccctccccctggattcttctcaaaaagtaagggaagccttgacctgtgaactgtctcgggctgaatttgccgagagcctgggactgaagcctcaggacatgtttgtggaatcgatgtttagtcttgcggacaaagacggaaatggctatctcagctttcgggagttcctagatatactggtggtgtttatgaagggcagccctgaggagaagtcacgacttatgttccgaatgtacgattttgatgggaatggcctgatatcaaaggatgaattcataagaatgctgaggtcttttatcgagatctccaacaattgtttgtccaaggctcaactcgcagaggtggttgagtcaatgtttagggagagtggatttcaggacaaggaggagctgacatgggaagattttcactttatgttgcgcgatcataacagtgagctcagattcactcaattgtgtgttaagggggtggaggttccggaggttatcaaagacctttgtagacgagcgagctacattagtcaggacatgatatgtccttccccgagggttagcgcccggtgcagtagatctgatatcgagaccgagttaacacctcagagactgcaatgccctatggacacggatccaccgcaggagattcggcgccggtttggcaaaaaagtgacctcatttcagccactgctgttcactgaagctcacagagagaaatttcagcgctcttgtttacatcagactgttcagcaatttaagaggttcattgagaattatcggcgccatattggatgcgtcgctgtgttttatgccattgcgggagggctctttctcgagcgcgcgtactattatgctttcgctgcacaccacaccggtattactgataccacaagagtcggcatcatattatcaagggggaccgctgcttctataagcttcatgttctcatacatcctcttaaccatgtgtaggaaccttatcacattcctgcgggagacattcctcaacaggtacgtcccattcgatgccgctgttgatttccataggttaattgcaagtactgccattgtccttactgtgttacacagtgtgggccatgtcgtgaatgtgtacctgttcagtataagccccctgtcagtgctgtcgtgcttgtttcctgggttatttcacgatgacggctcagagctcccacaaaaatattattggtggttcttccagacagtgcccggactaactggggtggtgctactgctgattctggccataatgtacgtgtttgcaagccatcattttcggaggcgctcctttaggggattttggttgacacatcacctatatatcttactctatgtattgctcattatccacggatccttcgcccttatccagctccccaggttccacatcttttttctggttcctgctataatctatggcggcgataaactggtgagtttaagccgaaaaaaggttgaaatctccgtagtgaaggccgagttgctaccctctggggtgacgcatctgaggttccagcggcctcagggtttcgagtacaagtcaggtcagtgggtgcgcattgcatgtctggctcttggcacaacggagtaccatccgttcaccttgacatcagctccacatgaggacacactatccttgcacatcagggccgcagggccctggacgacccgactcagggagatctacagcgcgccaaccggtgatcggtgtgctcgctaccctaaactgtatctggacggcccattcggagaaggccaccaggaatggcacaagtttgaggtgagtgtgctcgtggggggcgggattggcgttacaccctttgcctcgatcttgaaagacttagtgttcaaaagctccgtctcatgccaggtcttttgtaagaaaatatactttatatgggtcacacgtactcaaaggcagtttgaatggttggctgatatcatccgcgaagtagaagaaaatgatcatcaggatttggtctcagtgcacatttacatcacccagctggccgagaaatttgatctcagaaccactatgctctacatttgtgagagacacttccagaaggtgttgaatcggtctctcttcacaggcctgcgctccataactcactttgggagaccaccgttcgaacctttttttaacagtttacaggaggtgcacccacaggtacggaagataggagtgttcagttgcggcccccccggaatgactaagaatgttgagaaggcatgtcagttgataaatcggcaggatcgcacccatttctcacaccattatgagaacttctag

SEQ ID NO: 115102 - DNA, 4647 bp, Artificial Sequence
  Description of Artificial Sequence: Synthetic coding sequence
atgctgcgtgccaggcccgaggcccttatgctgctgggcgctctactgacaggatctctggggccctccgggaatcaggatgccctcagcctcccttgggaagtccaaaggtatgacggatggtttaacaatttacgtcaccatgaaagaggcgccgtcgggtgtcgccttcagcggcgagtccctgccaactacgctgacggcgtctatcaggctctcgaagaacctcagttgcctaacccacgtcgactgagcaacgcagcaactagaggcattgccgggctgccatccctgcataacagaactgtcctgggagtgtttttcggctatcatgtcctatccgatgtggtctccgttgaaactcctggctgccccgcggaattcctgaacattcggattcctcccggtgaccctgtgttcgaccccgaccagagaggtgatgtcgtgctgcccttccagcggtctcgctgggatcccgagacaggaagatcacccagtaatcctcgagatcttgcgaaccaggtgaccggctggctggacggttctgccatatatggttcctcccactcatggtcagatgccctacgctcatttagcgggggccagctggcgtcgggcccagaccctgcttttccacgtgacagtcagaacccgctactgatgtgggccgctccagatccagctacagggcagaatgggcctcgcggattgtacgccttcggagctgagcggggaaatcgcgagcctttcttgcaggccctaggactcctgtggttcagatatcataatctgtgggctcaaagattggcaaggcagcacccagactgggaagatgaagaactatttcagcacgcccggaagcgggtgattgccacgtaccaaaacatagccgtctacgagtggttacccagttttctgcaaaaaactctgcccgaatacacaggataccgcccctttttagacccaagcatttcccccgaatttgttgttgcctccgagcagtttttttctactatggtccctcctggggtatatatgcgaaatgctagttgccacttcaggaaagttcttaataaaggattccagagctcacaggccctccgcgtgtgcaataattactggatccgggagaatcccaatctgaactccacacaggaggtcaacgagctgctacttggtatggccagtcagatcagcgagctggaggacaacatagtagtggaggaccttcgtgattactggccagggcctggaaagttctctcggacagactatgtagcctcttcgattcagcgcggtagagatatgggcctgcccagttacagccaagcactcctggcctttgggctcgacattcctaggaattggagcgacctcaatccgaacgtggatccacaggttctcgaggcaaccgccgcactctacaatcaggacttgtcccagttagagctactactaggcggcttgctcgagtctcatggtgatcctggacctctgttctctgctatcgtgctggaccagtttgtgaggctgcgagatggcgatcgatactggtttgaaaacacgaggaacggtcttttcagcaaaaaagagatcgaggatatccgtaacacaactctgcgggacgtactagtcgcggtgataaacatcgatccatccgcactacagcctaacgtgtttgtgtggcacaaaggggcaccctgcccccaacccaaacagctcacaactgatgggctgcctcagtgtgcccctctgacagttttagacttcttcgaagggagcagccctggtttcgccatcaccatcatcgccttgtgctgcctgcctctggtgtccctgctcctgtctggcgtcgtagcatactttaggggacgtgaacacaaaaagctccagaagaaactcaaagagtccgtgaagaaggaggccgcaaaggacggagtgcctgccatggagtggccaggtcccaaggaaaggtcctcccccatcatcatccaattgctgagcgaccggtgtcttcaggtgttgaaccgccatcttacagtcctgcgcgtggtacagctccagcctctgcagcaggtgaacctaatcttgtctaataatagggggtgtcgaacgttactcttgaagatcccaaaggagtatgacctggttctgttgttcagcagtgaggaggaacgcggcgcattcgttcagcagctgtgggacttctgcgtcagatgggctctcgggctgcatgtcgctgagatgagtgaaaaggagctctttcggaaagccgtgaccaagcagcaacgggagcgaattttagaaatcttctttaggcacctcttcgcccaggtcttagatattaaccaggctgacgcaggcacacttcccttggatagtagtcagaaggttcgtgaagcgctaacttgcgaactgtcccgcgcagagttcgccgagtccctcggactcaagcctcaggatatgttcgtggagagcatgttttctctggctgataaagacgggaacggctacctgagcttccgggagtttctggatatactggtagtttttatgaaaggatcgcccgaggacaaatcacgtctgatgtttaccatgtatgacctggacgaaaatggtttcctgagcaaagatgagtttttcaccatgatgagaagcttcatagaaatatcaaataactgcttgagcaaagcccagctggctgaggtggtggaatctatgttccgggaaagcggattccaagacaaagaggagttgacatgggaagactttcatttcatgctgcgagatcacgactctgaactgcggtttacacagctgtgtgtcaagggaggagggggcggtgggaacggcatcagggatattttcaaacaaaatattagttgtcgggtgtccttcatcacacgaacaccgggagagcgttctcatccccagggccttggccctcccgcccccgaagctcctgagttaggcggccctggcctgaaaaaacgatttggcaagaaagccgctgtcccaacaccaagactctacactgaggccctacaagaaaaaatgcagcggggattcctggcccagaagctccaacaatataaaaggtttgttgagaactatcggcggcatatcgtctgcgttgccatctttagtgcaatatgtgtcggtgtgttcgctgatcgcgcttactattacggatttgcatctccaccatccgacatcgcacagaccacactggtgggtatcatcctgagtagaggaacagccgcctccgtgtcctttatgtttagctatattctgctgacaatgtgtagaaacctgatcacgttcctgcgagaaactttcctgaaccggtacgtcccatttgacgccgccgtggacttccacaggtggatcgctatggccgctgtagttctggcaatcctccactccgccggacatgccgtaaacgtctacatcttttcagtgagccccctctccctgctcgcctgtatcttccctaacgttttcgtcaatgacgggtccaaactgccacagaagttctactggtggttcttccagactgtgcctggtatgactggagttctgctattgctggtcttggccatcatgtacgtgttcgcctcacaccatttcagaagaaggagtttccgggggttctggttgactcatcacctgtatatcttactttacgcactcctaattatccatggctcatacgccctcatccagctaccaacattccacatctattttcttgtgcctgctattatctacggtggcgataagctggtgagcctgtcaagaaagaaggtggagatctctgtggtgaaagcagagctcctgcccagcggagtgacctatttacaattccagcgtccacagggcttcgaatataagagcggacaatgggtgaggattgcttgcctggctttgggcaccacagaatatcatccatttaccctgactagcgctcctcacgaagatacattgtcccttcatattagagcagtggggccctggaccacaaggctgagagaaatttattcttcacccaaagggaatggctgtgcaggataccccaagctgtacctggacggcccattcggagaagggcatcaagaatggcataaatttgaagtgtccgttttggtgggaggcggtattggcgttacccccttcgcctccatccttaaagatctggtgttcaagtcctcactgggttctcaaatgctgtgcaagaagatttactttatctgggtgacacggacacagcgacagtttgaatggttggctgacatcattcaagaagtggaggagaacgatcaccaggacctggtttcggtgcacatctacgtgacccagctcgcggagaaattcgatctccgcaccacaatgctctatatatgtgagaggcattttcagaaggtactgaaccggtccctctttacagggctgagatccatcactcactttggacgaccaccattcgagcctttcttcaatagcctgcaggaagtgcacccccaggtgagaaaaattggcgttttctcttgcgggccgccaggaatgaccaaaaatgtagagaaggcttgccaattagtgaacaggcaggatcgcgctcacttcatgcaccactatgagaacttttag

SEQ ID NO: 115103 - DNA, 1452 bp, Artificial Sequence
  Description of Artificial Sequence: Synthetic coding sequence
atggcaacactcggtcacacttttccattctacgccggcccaaaaccaaccttccccatggacactacactggccagcataattatgattttcctgactgcactcgctactttcatcgttattctgccagggattcgagggaagactcgcctgttttggctgttgcgtgttgtcacctccttgtttatcggagcggcaatactcgcggtgaatttctcttccgagtggagcgtgggacaggtaagcaccaatacctcgtataaggctttctctagcgaatggattagtgccgacatcgggctgcaggtgggcctaggaggagtgaatatcacactgaccggcacacccgttcagcagctgaatgagaccatcaattataatgaggagttcacatggcggctcggggagaattacgcagaggaatacgctaaagcactggagaagggactcccagatccggtgttatacctcgcagaaaagttcaccccaaggagtccttgcgggttgtataggcagtacagactcgcgggccattatactagcgcaatgctctgggtcgcatttctgtgttggctgttggcaaacgttatgctatccatgccagtattggtttatggaggatacatgcttttagccacagggattttccagcttttggcacttcttttcttcagcatggcaacctctctgacgtcaccatgcccactacaccttggtgctagtgtgttgcatactcaccatggccccgccttctggattaccctcacaactggcctgctctgcgtcctgctggggttggctatggcggtagcccacaggatgcagccgcataggttgaaggcgttttttaaccaaagtgttgatgaagatcccatgctcgagtggtcccctgaagaaggcggcttgctaagtccgcgctaccgttccatggcggatagccctaaatcacaagacatcccgctgagcgaggcctcttcaactaaagcttactatagacctagaagactctctttggtaccggctgatgtgcgtggattggcacctgccgctctgagtgctctcccaggagccctgctggcgcaggcgtggagggcactactaccaggccttcgatgcccaaaggctggcaaagagagccgacttggtcccccacactcaccttggcgattcggacccgaagggtgtgaggaacgctgggccgagcataccggggacagcccccgaccgttgcgcgggcgcgggaccggtcggctctggcgctggggttccaaggagcgacgggcatgtggggtgcgcgccatgctgcctcgactggtaagtaattcaggcctgaaaaggccttcctgcttagacttgcctaaatgctgggattacagacgagacgcccgtgccttcttccacttactggaacccaccccttgtgttacaagtcggcataccccacttatctag

SEQ ID NO: 115104 - DNA, 1317 bp, Artificial Sequence
  Description of Artificial Sequence: Synthetic coding sequence
atggcgaccctgggccatacatttcccttctacgctgggcccaaaccaactttccccatggatactacgctggccagcatcattatgatctttctgaccgccctggcaactttcatcgtgatcctcccggggatccgtgggaagacacgcctcttctggctcttgagagtggtcacctctcttttcataggagccgcaattctgggcacccccgttcagcaactgaatgagacaatcaactataacgaagaatttacctggagactcggagagaactatgccgaagaatacgcaaaggctttggagaagggtctgccagaccctgtcctgtatctcgccgaaaagtttacaccacgttcgccatgcggtctatatcggcagtatagactcgccgggcattacacaagtgctatgctgtgggtggcgttcctgtgttggctgctggcgaatgtaatgctgtccatgccagtcctcgtctacggcggttatatgctgctggcaaccgggatcttccaattactggccctgttgtttttttccatggccacttctctcactagcccgtgccccctgcatctgggagcctctgtactgcacactcaccacggaccggccttttggattacactcactacagggctcctgtgcgtgttgcttggtctggctatggcagtggcccacagaatgcaaccccatcgactcaaagcgttttttaaccagtcagtggacgaggacccaatgttagaatggtcccctgaggaagggggactgctgtcaccccgctaccgcagcatggcagacagcccaaaatctcaggacatccctctgagtgaagcatcatccaccaaggcatattaccggcctagaagactttcgttagtgccagctgacgttagaggactcgcgccagctgccctgagcgccctgccaggagcactgctggcacaagcatggagagctctcctgcccggactcagatgtcctaaagccggaaaagaatccagacttgggcctccacactctccgtggcgcttcgggccagaaggatgtgaggaaaggtgggctgaacatactggtgactctcccaggcccctgcgtggaaggggaacagggaggctgtggcggtgggggtccaaagagcggcgggcctgtggtgtgagagccatgctgccccgactggtatccaatagtggactgaagcgaccttcgtgcttggacttaccgaagtgttgggattacaggagggacgctagagccttctttcacttgcttgagcctaccccctgcgtgaccagtcggcatacaccactgatctag

SEQ ID NO: 115105 - DNA, 234 bp, Artificial Sequence
  Description of Artificial Sequence: Synthetic coding sequence
atggcaactctggggcacacgtttccattctacgccggaccgaagcctacatttcccatggacactaccctggcctccataattatgatttttcttaccgctctggccacatttatcgtcattctgccgggcattcgcggcaagaccaggctgttctggctcctccgtgtagtcaccagcctgtttattggcgccgcgatccttggcacacctgtgcagcaattgaatgagtag

SEQ ID NO: 115106 - DNA, 219 bp, Artificial Sequence
  Description of Artificial Sequence: Synthetic coding sequence
atggccacccttggccacacttttcccttctacgctggccccaaaccaacctttcccatggatacaactttggccagcataattatgatttttctgaccgccttggccacctttatcgtaatcttgccgggcataaggggcaagacacggctattctggttattgcgggtcgtaacctccctctttatcggggctgccatcctggctgtaaacttttag

SEQ ID NO: 115107 - DNA, 897 bp, Artificial Sequence
  Description of Artificial Sequence: Synthetic coding sequence
atggcaacccttgggcacacattcccattctacgctggcccaaagccaacttttccaatggacacgacattagctagtatcattatgatattcctgacggcactcgccacttttattgtcatactgcccggtattagaggtaagacgcgcttattttggctgttgcgcgtcgtgacttcgctgttcattggggcagccatcttaggcactcccgttcagcagctgaacgagaccatcaattataacgaagaattcacctggcgcctgggtgagaattacgcggaggaatacgcaaaagcgctggaaaagggcttaccagatccagtgttataccttgctgaaaaattcacacccagatctccctgcgggttataccgtcagtataggttggccggacattatacaagcgccatgctgtgggtggccttcctgtgttggctccttgcaaatgttatgttgagtatgccagtgttggtctatgggggatacatgcttctggcgaccgggattttccaactgctggctctgctctttttctctatggctaccagtctcacctcgccatgcccgctgcacctgggagctagtgtgttgcacacacatcatggacccgcattttggattacattgaccaccggcctcctgtgcgtgttactgggcctagccatggcagtcgcccacagaatgcagccgcatcgtctgaaggcattcttcaaccaatcagtcgacgaagaccccatgcttgaatggtcccctgaggaaggagggctgctttccccacgataccgatcaatggccgacagcccaaagagccaagatataccactgtcagaagcatcttctaccaaggcctactgtaaagaggcacacccaaaggatccagattgtgccttgtag

SEQ ID NO: 115108 - DNA, 42 bp, Artificial Sequence
  Description of Artificial Sequence: Synthetic coding sequence
atggccactctcggccacaccttccccttttacgccggttag

SEQ ID NO: 115109 - DNA, 897 bp, Artificial Sequence
  Description of Artificial Sequence: Synthetic coding sequence
atggcgaccttgggacatacctttcccttttacgcgggcccgaagcccacgtttcccatggacacaaccctcgcttctattattatgatatttctcactgcactagcaactttcattgtaatcttgccaggcatcagaggaaagacgcgactgttctggcttctgcgcgtcgtcacttctttgtttatcggggccgctatacttgggacacctgtccagcagctgaacgagaccatcaattataatgaggagtttacatggaggctgggagagaattacgccgaagaatatgcgaaggctctggagaaagggttacccgatcccgtgctttatttggccgagaagtttaccccacgatctccatgcggactgtatagacagtaccgactggctggccactataccagtgctatgctgtgggttgcctttttatgctggctgctcgccaatgtgatgctcagtatgccggttcttgtgtacggagggtacatgctgctggctacagggattttccagctcctggccctcctcttcttctcaatggcaaccagcttaacttccccctgtcccctgcatctaggcgcaagcgtgctgcacacccaccacgggcctgccttctggatcactttgacgaccggactgctgtgcgtactgttgggtctggccatggctgtggcccataggatgcagccccaccgcctaaaggctttttttaaccagagcgtggatgaagatcctatgctggaatggtcccctgaagaaggaggactgctgtctccccgctatagatcaatggctgactcccccaagtcccaggacatccctcttagcgaagcctcatctacaaaggcctactgcaaagaggctcatccgaaagaccctgattgcgctctctag

SEQ ID NO: 115110 - DNA, 1452 bp, Artificial Sequence
  Description of Artificial Sequence: Synthetic coding sequence
atggccaccctcggccacacctttcccttctatgctggccctaaacccacattcccaatggacaccacactggcaagcatcattatgatctttttaacagctctggccacctttattgtaattctgcccggaattcgaggcaaaacccggctgttttggctattgcgcgtcgttacaagcctgtttattggcgccgctattcttgccgtgaatttctcctccgagtggtctgtcggacaggtctctactaatacttcttacaaggccttctcctcagagtggatcagtgccgacatcgggctccaagtcggtctggggggagtcaacattaccctgaccggcacccctgtgcagcagctgaacgaaacaattaattataatgaggaattcacatggagattgggcgagaattatgcagaggaatacgcaaaggccctcgaaaagggcttacccgaccccgtcctctaccttgccgagaaattcacgcctcggtcaccatgcggcctgtatcggcagtatcggttggctggtcactacacatcagcaatgctctgggtagcctttctgtgttggctgctggccaacgtaatgctgagcatgcccgttctcgtttacggaggctacatgctcttggctaccggcatctttcagttactggcgttgctctttttctccatggctacctctctgacttccccatgccctctgcacctgggtgcctcagttcttcatacacaccacggccctgccttctggattacattaactacaggactgctgtgtgtgcttttaggcctggccatggcagtggcccatcggatgcaaccacaccgcctaaaggctttctttaatcaatccgtggatgaagatccaatgcttgaatggtcccccgaggagggcggcctcctgagcccaaggtatagatccatggccgattcacccaaatctcaagatattcctcttagcgaggcatcatcaactaaggcttattaccgtccccgacgtctcagcttagtgccagctgatgtgcgaggcctggccccagcagccctaagcgctctgcctggcgcgctcctggcccaggcttggcgcgccctgttaccaggactgcgttgcccaaaagcaggtaaagagagcagactgggacctccacacagtccttggcgcttcggcccggagggatgcgaggagcgatgggctgagcacacaggcgattcacctcgtccactcagaggccgaggaacagggagactgtggcgatggggctccaaagagagaagagcttgcggcgtgcgagccatgctgccacggctggtgtcgaattccggactcaaacgcccatcctgtcttgatctgcccaagtgttgggactatcggcgtgatgctagagctttctttcatctcctggagcctaccccgtgcgtcacatcacgacatactcctctgatttag

SEQ ID NO: 115111 - DNA, 219 bp, Artificial Sequence
  Description of Artificial Sequence: Synthetic coding sequence
atggccaccctcgggcacacctttcccttttatgccgggcccaaacccacatttccaatggacacgactctggcctctatcattatgatattcctcactgcactcgctacatttatcgttattctgcccggaattagaggaaaaaccaggctgttttggcttctaagagtggtgacaagccttttcataggcgccgcaattctgggcacccccgtatag

SEQ ID NO: 115112 - DNA, 51 bp, Artificial Sequence
  Description of Artificial Sequence: Synthetic coding sequence
atggccacattgggacacacatttcctttttatgcggggcctaaaccttag

SEQ ID NO: 115113 - DNA, 366 bp, Artificial Sequence
  Description of Artificial Sequence: Synthetic coding sequence
atggctaccctaggtcacacgttccccttctacgcaggccccaagcctacatttcctatggacactactctggccagtataatcatgatctttctaaccgccctggccaccttcatagtcatactccccggcatccgaggcaagacccgactgttttggctactccgtgtcgtgacctccttgttcataggcgctgcgatcttagctgttaacttttcgtccgagtggagcgtgggacaggtcagtacaaacacatcctataaggctttcagcagtgaatggatctctgcggacattggcctccaagtgggtctgggcggggtgaatattacgctgaccggaacacctgttcaacagctgaattag

SEQ ID NO: 115114 - DNA, 1032 bp, Artificial Sequence
  Description of Artificial Sequence: Synthetic coding sequence
atggcaaccttgggacataccttcccattctatgccgggccaaagcccacctttccaatggacaccacattggctagtattatcatgatattcctcactgctctcgcaactttcatcgtaatcttgcctggcatacgcgggaagacccggcttttctggcttcttcgtgtagtgacctctctgttcattggggccgccatcctggctgtgaatttcagcagcgagtggtctgtggggcaagtgtctactaacacctcctataaggccttttcttcagagtggatttctgccgatatcggtctgcaagtggggttgggaggcgtgaatatcacactgaccggaacccctgtgcagcagttgaatgaaacaattaattataacgaagagtttacatggcgtctaggcgagaactatgccgaagagtatgccaaggcacttgaaaagggactgcctgatcccgtgctgtacttggccgaaaaattcacacctcgatcgccttgtggtctgtatcgacagtaccgcctcgccggtcactatacatcagctatgctgtgggtggcctttctgtgctggcttctggccaacgtgatgctgagtatgccagtgctcgtctatgggggctacatgctgcttgcaactggcatctttcaactcctggccctgcttttcttttctatggccaccagcctcacaagcccttgtcctcttcaccttggcgcgtctgtcctgcacacccaccacggtcccgccttttggatcaccctcaccactggtctcctttgtgtgctgctgggactcgcgatggctgtagcacaccgtatgcagccccaccggttgaaagccttctttaaccagtctgtagatgaggatcctatgctggagtggtctcccgaggaggggggtcttctgtcacctcggtaccgcagcatggctgacagcccgaagtcccaggatattccgctctctgaggcgtcttccaccaaggcctactgtaaggaggcgcaccccaaagatcccgattgcgcattgtag

SEQ ID NO: 115115 - DNA, 963 bp, Artificial Sequence
  Description of Artificial Sequence: Synthetic coding sequence
atgaccctgtggaatggggtactaccattctatccccagcccaggcacgccgcaggcttttcagttccactactgatcgtgatcctcgtgttcctggccctggccgccagctttctgctgatcttgcctgggattcgcggccacagccgatggttttggttggtaagagtgttgctgtccctgttcattggggctgaaatcgtcgccgtccactttagcgctgagtggttcgttggcactgttaatactaacacgtcgtataaggccttttctgctgccagggttacagcccgtgtgcgtctgctggtgggtttggaggggatcaacataacactcactggaactcctgtgcaccaactgaatgagactattgattacaacgaacagtttacctggagactcaaggagaactacgccgcagagtatgccaacgcccttgaaaaaggcctgcccgatccagtactataccttgccgaaaaatttactcccagctccccttgtggcctttaccaccagtaccatttggcaggacattacgccagtgcgacactatgggtggccttctgtttctggttattatctaacgtcttgctgagcacgccagcccccctgtacggcggcctggccctactgacgaccggtgctttcgcactgtttggggtgttcgctttggcctcaatttctagcgtgccactctgtcccctcagactcggatcctcagctctgaccacgcagtatggtgcagcgttctgggtcacgctggccactggcgttctttgtctatttctggggggagctgttgtcagtctccaatacgtaaggcctagcgctttgcgcactttgctggaccagagtgccaaagactgtagccaggagcgggggggaagccctctaatattaggcgatccgttgcacaaacaggctgcattacctgatcttaaatgcattaccacaaacctgtag

SEQ ID NO: 115116 - DNA, 1767 bp, Artificial Sequence
  Description of Artificial Sequence: Synthetic coding sequence
atggagggtgacggtgtgccatggggttctgagcctgtcagcgggcctggtccgggtggtggaggcatgatcagagaattatgcagagggttcggccgctatcggaggtacctcggccggctgcgacagaatctccgcgagacccagaagttttttcgtgacattaagtgtagccacaatcacacatgcctctctagcttgacaggtggcgggggagccgaaaggggacctgccggagacgttgcagaaacaggtcttcaggccggccagctgagctgcatctcctttccaccaaaagaagagaagtatctgcagcagattgtggattgtctcccatgtatcctgatcctcggtcaggactgtaacgtgaagtgtcagctcctgaatctgctgttaggcgtacaggtcttgcccaccaccaaactgggctcagaagaaagttgtaagctgcggagattgaggttcacctacggtacacagacgagagtttccctagctctgcccggtcagtacgaactggtgcacactctggtggcccaccaggggaactgggagacaatacccgaagaagacctggaggtgcaggaaaataatgaggacgcagcacacgtcctagccgagcttgaagtgacaatgcaccatgccctgttgcaagaggtcgatgtcgtcgtcgccccctgccagggccttagacctacggtggatgtcctgggagacctcgtgaacgacttcctccccgtgattacttatgccttacataaagacgagctttctgagcgagatgaacaggaattgcaggagataagaaagtatttttcttttccagtctttttcttcaaagtgccaaaattgggatcagagatcattgacagttccacgcggcggatggagagcgaaagatctcccctctataggcagctgattgatctgggttatctgtcctcttctcactggaattgtggagctcccggccaggacactaaggcccaaagcatgttagtagagcagagcgaaaagttgagacacttgtccacattcagccaccaggtcttgcaaacccgtttggttgacgcagctaaggcccttaatttggttcattgccattgcctcgatatttttattaatcaggcgtttgacatgcaacgcgacctgcagattaccccgaagcgtctcgaatacactcgcaagaaggagaatgagctgtacgagagcctcatgaacatagctaaccgtaagcaggaggaaatgaaagacatgatcgttgagaccttaaacactatgaaggaagagctgctagatgatgccacaaacatggagttcaaagatgtgatcgtcccagaaaatggagaaccaataacggatcttggattctgcaaacccgaagcaatgatgtccggcagcattgtggggacccctattcatatggcccctgagctgtttactgggaagtacgacaattccgtggacgtctatgccttcgggatcctgttctggtacatttgctcgggttccgttaaactgcccgaggcattcgagcgatgtgcaagcaaggatcatctgtggaacaacgtgcgccggggagccagaccagaacgactgcctgtgttcgacgaagaatgttggcagctgatggaagcatgctgggatggggacccactcaaacggcctctgctgggaatcgttcagcccatgctacaaggaatcatgaacaggttatgtaagtcaaacagcgagcagcctaaccggggcctggacgattccacttag

SEQ ID NO: 115117 - DNA, 2655 bp, Artificial Sequence
  Description of Artificial Sequence: Synthetic coding sequence
atggagggtgatggcgtaccttggggatctgagcctgtgagtggccctgggccaggcggcggtgggatgattcgggaactttgccgaggatttgggcgatataggcgctatctcggcagacttagacaaaacctgcgcgaaacacagaaattttttcgcgacatcaagtgcagccataatcacacctgtttaagtagcctgacaggaggtgggggagcagaacgaggccctgccggggacgtggcggaaaccggcctccaggctggccagctctcgtgcatttctttcccccctaaggaagaaaaatatctgcagcagatcgtcgattgtctaccatgtatcctgatcctcgggcaggattgcaacgttaagtgccagctgctgaacttgcttctgggtgtgcaggttcttcccacaaccaaattaggctcagaggagagttgtaagctccgaagattaaggtttacctacggaactcagacaagggtatcgctcgctcttcctggccaatacgagttagttcatacactagttgcacatcaggggaactgggagacgatccccgaagaggatctcgaagtccaggagaacaacgaggatgctgcccatgtccttgcagagctggaagtcacaatgcaccacgccctcctgcaagaggttgacgtagtggtggcaccttgccaaggtctccgaccgacggtagatgtgctgggggacctggttaatgattttctcccggtaattacgtatgctctccataaggatgagctgtctgagagagacgagcaggagctgcaggaaatcagaaaatatttctctttccccgtattcttttttaaggtgccgaagctgggcagtgaaataatagacagctcgacccggaggatggagagcgaaagatctcctctctacagacaactgatcgacctgggatatctcagtagctcacactggaattgtggcgctccagggcaggatactaaagcgcaatctatgctcgtggaacagtctgagaaacttagacatctcagcactttcagccaccaagttctgcagacgcgactggtggacgctgcaaaggcactgaacctcgtacactgccactgtctggatatttttataaaccaggcttttgacatgcagcgagatctgcagattacgccaaaaaggctggaatataccaggaagaaggagaacgaactgtacgagtctctgatgaatatcgctaaccggaaacaggaggaaatgaaggacatgattgtggaaacccttaacactatgaaggaggagctcctggatgatgccactaacatggaatttaaggacgtaatcgtaccggaaaacggcgagccagtcggaactcgggagattaaatgctgtatccgccagattcaggagttgatcatatcccggctgaatcaggctgtggccaataaactgatatcttctgtcgattatttaagagaatcctttgtgggaaccctggagagatgtctgcaaagcctggaaaagtcacaagatgtctcggtgcacatcaccagcaattacctaaaacagatattgaatgccgcctaccatgtggaggtcaccttccacagcggatcctcagtgacccgcatgctgtgggagcagatcaagcaaatcatccagcgcattacatgggtctcacctcctgcaattacgctggagtggaagagaaaagttgcacaggaagcaatcgaatctttaagcgcatcaaaattggccaaatccatttgtagccaatttcgcactcgtctgaattcttcgcatgaggctttcgctgcttcgctgcgacagctagaagcaggacactccgggcggctggagaaaactgaggacctgtggttaagagtgcgcaaggaccacgccccccgcctggcccggctcagcctggagtcatgctctttacaggatgttcttctgcaccggaagcccaaactgggccaagaactggggcgaggccaatatggagtggtctatttgtgcgataactgggggggacacttcccatgtgctctgaaatctgtagtcccgccagatgaaaaacattggaacgatctagctctcgaattccattacatgagaagcctgcccaaacacgagaggctggtcgacctgcacggaagcgtgattgattataattatggaggcggttcttctatagcggtgctgctaatcatggaaagacttcacagggacttgtatacaggactcaaagcaggcctgacattggagacccggctgcaaatcgcgttggacgtggtcgaggggatacgttttctgcacagccaggggctggtccacagggatattaagctcaaaaacgttctgctggacaagcagaatcgggccaagattacagacctagggttttgcaagcctgaagctatgatgtcaggaagcatcgtggggacccctatacacatggccccagagctgtttactggtgcccgcccagaacgactgcctgtgttcgacgaggaatgctggcagcttatggaggcctgctgggatggtgaccccctgaagaggccgctgctgggaatcgtccagccgatgctccaagggataatgaatcgactgtgtaaatctaattccgagcagcctaacagggggctggatgatagcacatag

SEQ ID NO: 115118 - DNA, 2790 bp, Artificial Sequence
  Description of Artificial Sequence: Synthetic coding sequence
atggaaggtgatggagtgccttggggatcagaaccagtatccggcccagggccaggcgggggaggcatgattcgagagttatgccggggcttcggccggtatcgcaggtatctgggtcgcctgcgccagaatttgcgcgagacacagaaattctttcgcgacatcaagtgtagccataatcacacatgccttagttcattgacgggaggaggcggcgcggagcgaggacctgctggcgatgtggcagaaaccggactacaggcagggcagctcagttgtatctcattcccacccaaggaagagaaatacctccagcaaatcgtggattgcctgccctgcatcctgatcctaggccaggattgcaacgtgaaatgtcagctgttaaatttactcctcggtgttcaggtactccctacaacaaaattgggcagcgaggagagctgcaaacttcgacggctgcggttcacgtacggaacacagaccagagtgagtcttgccctcccaggccagtacgaactggtgcacacactggtggcccatcaaggcaactgggaaaccatccctgaggaggatctggaagtccaggagaacaacgaagatgccgcacatgtcctggcagagttggaagtcactatgcaccacgcactgttacaggaagttgatgtggtagtggccccatgccaaggtctgagaccaaccgtggacgtccttggcgatctggtcaacgacttccttccggttataacctacgccctccataaggacgaactttcagaacgggacgagcaggagctacaggagatccgaaagtatttttcttttcccgtgttctttttcaaagtgcccaagttgggtagcgagatcattgatagcagtaccaggcggatggagtcggagaggtcaccgctctaccgccagctgattgatctggggtatttgagcagttcccactggaactgtggcgctcccggccaagataccaaggctcagagcatgctggttgaacagtccgaaaagctccgacaccttagtaccttcagccaccaagtgctccagacaaggctcgttgacgcagctaaagctctgaatctggtgcactgtcactgtttggacatttttatcaatcaggcctttgacatgcagagggacctgcagattacccccaaacgcctcgagtataccaggaagaaggagaacgagctgtatgaatcactcatgaatattgcaaatcggaaacaggaagaaatgaaggacatgattgtggagaccttgaacacaatgaaggaggagctcctggatgacgccaccaatatggagtttaaagatgtgatagtgcccgagaacggagagcctgtaggaacacgcgagattaagtgctgcataagacagatccaagaattaattatctcccggctcaatcaggccgtggctaacaagctgatctcatcagtcgactacctacgagaatcctttgtcggcactctcgagaggtgcctccagtcgctggagaagtctcaagatgtctctgttcacattacttctaattacctgaagcagatcctgaatgccgcatatcacgtggaggtcacatttcacagtggtagctcagtgaccagaatgttatgggagcagatcaagcagataatccaacgaattacttgggtttccccacctgcaatcacactggagtggaaaaggaaagtagctcaggaagcaattgagagtctctcagcttcgaaattggcaaagtcgatctgtagccagtttcggaccaggctgaactcatcccacgaggctttcgctgcttcactgcgccaattggaggccggccacagcgggaggctggaaaaaacagaggatctttggcttcgggtgcgtaaggaccatgcacctcgtctcgccagactgagcctcgagtcatgtagtctgcaggacgtcctcctgcatcgcaagccaaaattggggcaagagctcggaagggggcaatatggtgtggtctacctctgcgataattggggcggccactttccctgcgcactgaagagtgtggtgcccccagacgaaaaacattggaatgatctcgcactcgagtttcactatatgagatctctgccaaagcatgagagacttgttgacttgcacggctcagtcatcgattataactacgggggtggatcaagcatcgctgtattgctcatcatggagcgtctgcacagagacctgtacaccggtctgaaagctggtctgacattggagacacggttgcagatcgccttggatgtggtggaggggattcgcttcctccactcccaaggtttagttcacagggacatcaaattgaagaacgtgctgttagataagcagaatagggcgaagattaccgatctcgggttttgcaaacctgaggcaatgatgtccggctccattgtgggcacccctatccacatggctcctgagctgtttaccggtaagtatgataacagtgtcgacgtttatgcgtttgggattctgttctggtacatttgctcgggcagcgtcaagctgccagaggcctttgagcggtgcgcaagcaaggaccatttgtggaataatgtccggcggggcgcccgccccgagagactgccggttttcgacgaagagtgttggcagcttatggaggcttgctgggatggagatcccctgaaaaggcccctgctgggcatcgtgcagcccatgctccagggaatcatgaacagactttgtaaatccaattcggaacagccgaaccggggtttggacgatagcacttag

SEQ ID NO: 115119 - DNA, 1104 bp, Artificial Sequence
  Description of Artificial Sequence: Synthetic coding sequence
atggtgatggaggttggaactctcgacgccgggggtttgagagctttgctaggggagcgggcggcacagtgcctcttgttggattgcaggtccttcttcgctttcaacgccgggcacatcgccgggagtgttaacgtccggttttcaactatcgtgaggaggcgcgccaaaggagcgatggggttggaacatatcgtccccaatgcggaactcagaggcaggctcctggctggagcttatcatgccgtcgttcttctcgatgaaaggtccgctgcccttgatggcgccaagcgggatgggacgctggctctggccgcaggtgcactgtgtcgagaagcaagggctgcccaagtattctttctcaagggagggtatgaggccttttctgcatcttgtccagagctgtgctccaagcagagcaccccaatgggactgtcgctgcccctttccaccagtgttccagattccgccgagagcgggtgtagttcatgtagcacacctctgtacgatcagggcggtccagtagagattctgcctttcctgtacttaggctccgcctaccacgcgtcccgcaaggacatgctggatgctctggggattaccgctctgatcaatgtaagcgctaattgccctaatcacttcgaggggcattaccagtacaaaagcatccctgttgaggacaaccataaggccgatatctcatcctggtttaacgaagcaatcgattttatcgattctattaagaatgccggcggtcgggtatttgtccactgccaggcaggcatcagccgcagcgctacaatatgcctggcctacttgatgcgcacgaaccgcgtcaaactggacgaggccttcgaatttgtcaagcagaggcgaagcatcatcagtcctaatttctcattcatggggcagttattacagtttgagtcgcaggttctcgccccccactgctcggcagaggccggatctccagcaatggccgtcttagatcgcggcacatctacaactaccgtgttcaattttccagttagtatcccagttcactcaactaattccgcgctgtcctatctgcaatctcctatcacaactagcccatcctgttag

SEQ ID NO: 115120 - DNA, 909 bp, Artificial Sequence
  Description of Artificial Sequence: Synthetic coding sequence
atggtaatggaggttggaacattagacgcaggaggcctgcgtgctttgctgggagagagggctgctcaatgtctgcttctagattgtcgaagttttttcgcctttaacgcaggacacattgcgggcagtgtgaatgtgaggttttccgccgctcaggtgttttttctcaaaggaggctacgaggctttctccgcttcctgtccagagctatgttcaaagcagagcacgccgatggggctctccctaccactgtctacgtcagtgccagactctgccgaatctggctgttcctcatgcagtactcctctgtacgaccaagggggacctgtcgaaatcctgccattcctctatctcggatcagcctaccacgcttctcgcaaagatatgttggacgctctgggcatcaccgcacttatcaatgtctccgcaaattgccccaatcacttcgaagggcactaccagtataagtctatccccgtggaagataatcataaggcagacatctccagctggtttaatgaggccatagactttattgatagtatcaagaacgccggagggagagtcttcgtgcattgccaggctggaatatctagaagcgccactatttgtctggcatacctaatgaggaccaacagggtgaagctggacgaagcattcgagttcgtcaagcaaagacgcagcattatctcccctaatttttcttttatgggccagctgctgcaattcgagtcccaggtgctggccccgcactgttccgcggaagccggctcccccgccatggcggtgctcgataggggaacgagcaccacgaccgtgttcaactttcccgtgagtataccagttcactccaccaatagcgccctgtcatatttacagtctcccattacaacatctccctcatgttag

SEQ ID NO: 115121 - DNA, 1023 bp, Artificial Sequence
  Description of Artificial Sequence: Synthetic coding sequence
atggtgatggaagtcggaacactggatgctggcggcttaagggccttgttgggagaacgggcagctcagtgccttctgctcgattgccgttcctttttcgcattcaacgccggtcacatcgctggaagcgtcaacgtcagattctccacaatcgttcgaagaagagctaaaggcgccatgggcctggaacacatagttcccaacgctaaaagggatggtacactcgcccttgcagcaggagccctgtgtcgcgaggcacgggctgcacaagttttctttttaaagggaggctacgaagccttctccgctagctgtccagagctgtgctcaaagcagtccacccccatggggctgtctctgccgctctcaacctctgtgcctgactcagccgaatccggatgtagctcttgctctactcctctttatgatcagggaggccccgtcgagattctgccattcctgtacctaggaagcgcgtaccacgccagccgcaaagatatgctggatgccttgggaatcaccgcccttatcaacgtctctgcgaattgccctaatcactttgagggccactaccagtacaaaagcatacctgttgaagacaaccacaaggcagatatctcttcttggttcaacgaagccattgatttcattgattccattaagaacgcaggcgggcgggtctttgtgcactgccaggcaggaatcagccggtccgccaccatctgtctcgcctacttaatgcggactaacagggtcaagctggatgaggcgttcgaatttgtaaaacagcgccggtccattatatcgccaaattttagctttatggggcagctgctccagttcgagtcacaggtactggctccccattgctctgcggaggcaggctctcccgctatggctgtcctggatcgcgggacaagcactacaactgttttcaacttcccggtgtctattccagtgcactccaccaactccgctctttcatatctgcagtctcctattactacctcaccatcttgttag

SEQ ID NO: 115122 - DNA, 1134 bp, Artificial Sequence
  Description of Artificial Sequence: Synthetic coding sequence
atgaggaactcagaaacactcgagagaggagtaggagggtgtagagttttctcctgtctggggagctacccaggtatagaaggcgccgggttggcccttttggccgaccttgccctaggtggtagactgctgggcactcatatgtctcagtggcaccacccccgatccggttggggccggaggcgggacttttctggaaggtcgagcgcgaaaaaaaagggaggaaatcacatccccgagaggtggaaggattatctgcccgtcggccagaggatgcctggcacccgctttatcgcttttaaagttcctctccagaagtcgtttgagaagaagctggctccagaagaatgtttcagcccgttagatctgttcaataagatcagggagcagaacgaggagctgggtctgattatcgacctgacatatacccagcgttactacaagcctgaggacctgcccgagaccgtcccttatctgaagattttcacagtgggacaccaggtccccgacgatgaaactattttcaagtttaagcatgcggttaatggctttcttaaggaaaataaggataacgacaagctgatcggtgttcattgtacacatggcctaaaccgcaccggttatctaatttgtagatacctgatagatgttgaaggtgtaagacccgatgacgcgatcgagttgttcaatcggtgtcggggacattgcctcgagcgccaaaattacatcgaggacctgcagaatggtccaattcgcaaaaactggaatagcagcgtgcccagaagtagtgattttgaggactccgctcacctaatgcaacctgtgcacaataaacctgttaaacagggacctcgctataatctgcaccagatccagggtcactcagcccctcgccacttccatacacagacccaatcgctacagcagtctgtgcggaaattttctgagaacccccacgtgtaccagcgccatcaccttccacctccaggaccacctggcgaagattactcgcatcgcaggtacagttggaatgtgaagccaaatgctagcagagccgcacaagacagacgacgatggtatccttacaactacagccgcttgagctatccagcatgttgggaatggacccagtag

SEQ ID NO: 115123 - DNA, 681 bp, Artificial Sequence
  Description of Artificial Sequence: Synthetic coding sequence
atgtcccagtggcatcacccacgcagcggttgggggcggcgccgggatttttcgggacggtccagcgctaaaaagaagggaggtaatcatattccagagcgctggaaagactacctccccgtcggtcaacgcatgccaggcacacgcttcattgccttcaaggttccgctgcaaaagtcgtttgagaagaagcttgcacccgaggagtgttttagtccgttagatctattcaataaaatccgcgagcagaacgaagaactgggcctgatcatcgacctaacttatacccagcgctattataaacccgaagatcttcctgaaaccgtaccctaccttaaaatctttacagttggtcaccaggttccagatgatgagaccatcttcaaattcaagcatgctgtgaatgggttcctgaaagagaataaagataatgacaaactgattggagtccattgcactcatgggctgaaccgtacaggatacttaatatgtagaagaagtctggcgctctccccgcgccttgaatgttcaggcacaatctcgacccacagtaagttctgtttcccgggctctcgtagatcgcccgccagtgcgagtcaagtggccggaacgacaggggcccgacatcatgcccgtctcatcttctgtattttcagcagggacgtagttagtccttgctag

SEQ ID NO: 115124 - DNA, 822 bp, Artificial Sequence
  Description of Artificial Sequence: Synthetic coding sequence
atgcggaatagcgagaccctggagcgtggcgtgggaggctgtcgcgtattttcttgtctgggcagctatcctgggatagagggcgcgggcttagccctgttagccgatctagctctgggaggcagacttctgggcactcacatgtctcagtggcaccacccgcggtctggctggggcagacggcgggatttctccggccgcagctcagctaagaaaaagggcggtaatcacattcccgaaaggtggaaggactacctgcccgtgggacaacgcatgccaggaacgcggtttatcgcattcaaggtgccactgcagaagtccttcgagaaaaagttagcaccagaagaatgtttcagccccttagacctcttcaataaaatccgagagcagaatgaggagctcggactgataatagacctcacctatactcagcgctattataaacctgaagatctgcctgagaccgtaccttacctgaaaattttcacagtcggccatcaggtaccagacgacgaaaccatcttcaagtttaaacacgccgtcaacggtttcctaaaagaaaataaagacaatgataaactgatcggcgtgcattgcacccatggtctcaacagaacaggctatctgatctgtcggagatccctggcgctgagccctagactggagtgcagtggaactatttccactcattcaaagttctgtttccccggttctagacgaagccctgccagtgctagccaggttgccgggactacaggcgcccgacatcatgccagattgatattttgtatcttctcgcgcgacgttgtgtcaccctgctag

SEQ ID NO: 115125 - DNA, 597 bp, Artificial Sequence
  Description of Artificial Sequence: Synthetic coding sequence
atggatagcctgcagaagcaagatctccgaagacccaaaatacacggggcagtgcaagctagcccatatcaacctccaacgctcgcaagcttgcagaggttgctctgggtgagacaagccgcaacgctgaatcacatcgacgaagtgtggccgtcactcttcctgggagatgcttatgccgcccgagacaagtccaaactgattcaactcggcataacacatgtggtaaacgccgctgccggcaaatttcaagtcgacacgggtgcaaaattttaccgaggaatgtcactagagtattatggaattgaagccgatgataacccctttttcgacctgtccgtgtattttctgccagtcgctcgctatatccgcgccgcactttctgtgccgcaggggagagttcttgtgcattgtgcaatgggcgtctctaggtcggccaccctcgtgcttgcctttctaatgatttgcgaaaacatgaccctcgtagaagcaatccagacagttcaggcacaccggaacatttgtcctaatagcgggttcctgcgccagctacaggtgctcgacaacagactaggcagggagaccggtcgcttctag

SEQ ID NO: 115126 - DNA, 747 bp, Artificial Sequence
  Description of Artificial Sequence: Synthetic coding sequence
atggcagagacaagcttgccggaattaggaggagaagacaaagccaccccctgtcctagcatcctggagctggaggaactattgagggccgggaaatctagctgctctagagtagatgaggtgtggccaaacctctttattggagatgcgatggattcgctgcagaaacaagatctgcgtcgtcctaagatccacggcgctgttcaggcatccccctaccagcctccaacccttgccagccttcagaggcttttatgggtgcggcaggctgctaccctcaaccatatcgacgaggtgtggcctagtttgtttctcggcgacgcctatgccgcaagagataaatctaaactgatacagcttggtattactcacgttgtgaacgccgcagcggggaaatttcaggtagatacgggggccaagttctaccgggggatgagcctggagtattatggcatcgaggccgacgataacccatttttcgacctctccgtatatttcctgcctgtggcacgatatattagggccgctctgagtgttccacaggggcgcgtgcttgtccactgcgcaatgggtgtctcccgtagcgctacactcgtgctggctttcctcatgatttgcgagaatatgactctggtcgaggctattcaaacagttcaggcgcacaggaacatttgtccaaactcagggttcttgcgccagctgcaagtgctggacaaccgactaggccgtgagaccgggaggttttag

SEQ ID NO: 115127 - DNA, 567 bp, Artificial Sequence
  Description of Artificial Sequence: Synthetic coding sequence
atggccgaaacctcattaccagagctcggcggagaagataaggcaacaccttgcccatccattctagagctcgaggagttgctcagagctgggaaaagcagctgtagtagagtcgatgaggtatggcctaatttattcattggtgatgctgcaactgcaaacaaccgattcgaactctggaaattgggcatcacccatgtgctgaatgctgcccataagggtctctactgtcaaggcggccccgacttttatggtagttcggtgtcttacctgggggtgcctgcccacgacctgccggactttgatatatctgcttatttttcgtcagccgccgattttatccaccgtgcactgaacaccccaggggcgaaggtacttgttcattgtgtagtgggggtctctagaagtgccaccctagtgcttgcatacctgatgctgcatcagagactgagcctgcgccaggctgttataacagttagacaacatagatgggtctttccaaacaggggattcctacaccaattgtgtcgcctggatcagcagctgcgcggcgctggccagtcctag

SEQ ID NO: 115128 - DNA, 876 bp, Artificial Sequence
  Description of Artificial Sequence: Synthetic coding sequence
atgggactgtgtcattttgcaaccttggccctcattttgctggtgctactggaagcgcttgctcaggcagatacgcaaaagatggtcgaagcccagcggggcgtagggcctcgcgcatgctactcaatctggctgctgctcgcacccacccctcctctctcccactgcctgcagagcccgcagaagcagcaccaagtatgcggagaccgcaggttaaaagccagtagcactaactgccccagtgagaagtgtacagcttgggcgaggtatagccatcgcatggactcactgcaaaagcaggacctgcgcaggccgaaaatccacggcgccgtacaagcgtctccttaccaaccccctactctcgcatccttgcagcggctcctgtgggtcaggcaagcggctacactcaatcacattgatgaagtatggccctcgctgttcctaggagacgcttatgccgcaagggacaagtcaaaacttatacagctgggcataacccacgtggtgaatgcagcagccgggaagttccaagtggacactggagcaaagttttacaggggcatgtctctagaatactatggcatcgaggccgacgataaccctttctttgacctgagcgtgtacttcctccccgtggcccggtatatccgtgccgccctgagtgtgcctcaaggacgcgtactcgtacactgcgccatgggcgtgtcccgcagcgccactctggtgctggcattcctgatgatttgcgaaaatatgaccctggtggaggccatacagaccgtgcaggctcatagaaatatatgtcccaacagcggtttcctgcgacagttgcaggtcctggataatcgtctcggacgcgaaacaggacgattttag

SEQ ID NO: 115129 - DNA, 597 bp, Artificial Sequence
  Description of Artificial Sequence: Synthetic coding sequence
atggattcgctacagaaacaggatctcagacggcctaagattcatggtgccgtgcaggcctcgccttatcagccgcctacattagcctcgcttcagcgtctgttgtgggttcgccaagctgcgacactcaatcacatagacgaggtgtggccatccttgttcttgggggacgcatacgccgcccgtgacaagtccaaactgattcaacttggtataacgcacgtagtcaacgccgctgcgggcaagttccaagtagacacaggtgctaaattttatcgagggatgagcttggaatactatggcattgaagcagatgacaaccctttcttcgatctgagtgtttactttctgccagtcgcaaggtatattagggccgcgcttagtgtgccacaggggagggtcttagtgcactgtgcaatgggggttagccgctccgccaccctcgtccttgcgttcctaatgatctgcgaaaacatgactctggtggaagcgatacagacggtacaggctcacagaaacatctgtccgaatagcggatttctcagacaattgcaagtactagataacaggttggggcgggagactggtaggttctag

SEQ ID NO: 115130 - DNA, 984 bp, Artificial Sequence
  Description of Artificial Sequence: Synthetic coding sequence
atgggattgcctcaacccaggcttcctgcccccgccttacaagcgggtcctgccacagccggatgcagaccagagctgcgggggcagtcctggtcactgctcccagccatgggcctgtgccacttcgctaccctggctttaatactcctcgtactgctggaggcattggctcaagcagacacccagaagatggtggaggcccagcgcggggtgggtcccagggcatgctacagtatctggttactactggcgccaactccaccgctatctcattgcctgcagtctcctcagaaacagcatcaggtctgcggcgacaggcgccttaaagcatccagcaccaattgtccgagcgaaaagtgcacagcctgggctcggtattcccatcgcatggatagtctgcagaagcaagacttacggcgcccaaagattcacggcgccgtacaggcgagtccgtaccagcccccgaccctggcatctctccagcgacttctgtgggtacgacaggccgccacactgaaccacattgatgaagtctggcctagcttgtttttaggtgacgcttacgctgcccgggacaagtctaagctaattcagctcgggattacacacgtggtcaatgccgcggcgggaaaattccaggtcgacaccggagcgaagttctaccgggggatgtcactggagtactacggcattgaggccgacgacaacccctttttcgacctatctgtttattttttgcccgtagcaaggtacatcagagcagccctgagcgtgccgcagggtcgggttctcgtgcactgtgccatgggagtgagccgatccgccactctcgtcttggccttcctgatgatctgtgaaaacatgaccttggtggaggctatacagaccgtgcaagcccatcggaatatttgtccaaattccggattcctgagacagctgcaagtcttagataatcggctggggagagagaccggacgcttttag

SEQ ID NO: 115131 - DNA, 597 bp, Artificial Sequence
  Description of Artificial Sequence: Synthetic coding sequence
atgtcctctaggggccattcgacactgccacgaactcttatggcccccaggatgattagcgagggggacattggcggcatagcccaaatcactagtagcctgttcctcgggagaggctccgttgctagcaaccgacacctcctgcaggccagaggaattacctgtatagtgaatgccacgattgaaattcccaactttaactggccgcagttcgagtacgtgaaggtgccgcttgctgatatgcctcacgcacctatcggtctgtacttcgacaccgtggccgacaagattcactccgtctcacgcaagcatggagcaacactggtgcattgcgccgccggggtgtcccgcagtgccactctctgtatcgcatacctgatgaaattccataatgtatgtctgttagaagcctataattgggttaaagcccggcggccagtcatacggcccaacgtcggattctggagacagctcatcgactatgagcggcagctgttcggaaagagcactgtcaaaatggtgcagactccatacgggattgtccctgacgtgtacgaaaaagagtcgcgccacctaatgccctattggggtatttag

SEQ ID NO: 115132 - DNA, 597 bp, Artificial Sequence
  Description of Artificial Sequence: Synthetic coding sequence
atgtcatctaggggtcactccacactgccaagaaccctaatggccccacgaatgatctcggaaggcgatatcggaggcattgcgcagatcacatcatccttgtttcttggccgcggtagcgtggcttccaaccgacatctcctgcaggcgaggggaatcacttgcatcgtgaacgcgaccatcgagatccccaattttaattggcctcagttcgaatacgtaaaggtgcctttggccgatatgccgcatgcgcccatcggtctgtactttgacaccgtggccgataaaattcacagcgtttccagaaaacatggagccactctcgtgcattgtgctgccggcgtgtctagatccgccactctgtgcattgcatatctaatgaagtttcacaatgtctgcctgctcgaggcgtacaattgggtcaaggccaggaggcctgtgattcggcccaacgtgggtttctggaggcagctaatcgactacgagcgacagctcttcggcaagagcacagtgaagatggtccagacaccctatggaattgtgccagatgtatacgaaaaggagtctagacacctgatgccttattggggtatctag

SEQ ID NO: 115133 - DNA, 945 bp, Artificial Sequence
  Description of Artificial Sequence: Synthetic coding sequence
atgggactggaggcagctcgtgaactcgagtgcgccgcgctgggaactctcctccgcgaccctagagaagcagagcgcaccctgctcctggattgcaggccgtttctagccttctgcaggcggcacgtccgagcagctcgcccagtgccctggaacgcactactgagaaggcgcgcacgcggccccccagctgcagtgctggcctgcctgctgcctgatagggcacttaggaccaggctagtccgtggagagctggcgagagcagtggtgcttgacgagggctcggcctccgtggcggaactgaggccggactctccagcgcatgtgcttctagctgcactgctacatgaaactagggccggccccaccgccgtttactttctccgggggggcttcgatgggtttcagggctgctgcccagacctgtgttctgaggctcctgctcctgcactgccccctacaggcgacaaaacctcccgctctgactcccgcgcccccgtctatgatcaaggaggccccgttgagattctgccctacttgtttctggggagctgctcacacagcagcgatttgcagggtctccaggcctgcggaattaccgcggttttgaacgtcagcgcatcttgtccaaaccatttcgaaggtttgtttcggtacaaaagcatccccgtggaggataaccaaatggtcgagatctctgcgtggtttcaggaggctattggcttcatagattgggtgaagaattcaggaggacgggttctggtacattgccaggctggcatctcccggtcggcaactatctgcctggcatacttgatgcaatcacgccgcgtgcgcctcgacgaagccttcgattttgtgaaacaacggcgaggagtgatcagcccgaattttagcttcatgggacagttgttgcagttcgaaacccaggtactgtgccattag

SEQ ID NO: 115134 - DNA, 288 bp, Artificial Sequence
  Description of Artificial Sequence: Synthetic coding sequence
atggccgccgcccggttgtgcctgagtctgctgctcctctccacttgtgtggctctactgctgcagccgcttctgggagcccaaggcgcccctttggagcctgtgtaccctggagataacgcgacgccagagcagatggcccagtacgcagcggatttgcgccggtatattaatatgctcactcgaccgagatacggtaagagacataaagaggataccctggctttctctgaatggggctctcctcatgccgctgtgcccagagagttaagtccactagatttgtag

SEQ ID NO: 115135 - DNA, 435 bp, Artificial Sequence
  Description of Artificial Sequence: Synthetic coding sequence
atgtctgtggcccaggacattccaaagctccagaagctaggcatcacccatgtgctgaacgcggctgagggcagaagcttcatgcatgtgaatactaatgcaaatttttacaaggattcgggcattacatatctcgggattaaggccaacgatacccaggaattcaacctgtccgcatactttgagagagccgccgactttatcgatcaggctctggcacagaaaaacgggcgagtgctggtccactgtcgcgagggctactctcggtcaccgacgctggtgattgcctatctgatgatgcggcagaaaatggacgttaagtccgctcttagcatcgttcggcagaaccgggaaatagggccaaacgacggcttcctagctcagctatgccagctgaatgatcgcttagccaaagagggcaaacttaaaccttag

SEQ ID NO: 115136 - DNA, 1185 bp, Artificial Sequence
  Description of Artificial Sequence: Synthetic coding sequence
atggtgacgatggaggaactacgggagatggattgtagcgtactcaagcgcctgatgaatcgggatgagaacggcggcggcgccggcggatccggctcccacggtacgctcgggcttccctcgggcggcaagtgtttactcctggactgccgacccttcttagcccattcagccggctatatcctcggatccgtgaatgtacgctgcaacacaatcgtgaggcgacgggccaagggctccgtttcactggagcagattctgcctgccgaagaggaggttagagcacggctacgatccggcctgtattcagccgtgatcgtgtacgatgaacggtcccctcgcgcagagagcctgagggaagattcgacagttagtctggtcgtccaagccctgcggcgcaatgcagaacgcaccgacatctgtttgttgaaagggggatatgagaggttttcaagtgagtatccagaattctgcagtaagactaaagctttggccgccatccctcccccggtccctccctctgccacagaaccacttgacttgggatgtagttcatgtggaacacccctgcacgaccaaggggggcccgttgaaattctaccattcctttacctgggctcagcataccacgccgctagacgggatatgcttgacgccctgggtatcaccgcacttctgaacgttagctcagactgtcccaaccatttcgagggacattatcagtataaatgtatcccagttgaggacaaccataaggctgacatttcctcctggttcatggaagcaatcgagtatatcgatgcggtgaaagactgcagaggtagagtcttggtgcattgtcaggccggtattagcaggagtgcaacgatttgtctagcctaccttatgatgaagaagcgtgtgcgtctggaagaggcatttgaattcgttaagcagcgtaggtctatcattagtcctaacttttcattcatgggccagctgctgcagtttgagagtcaggtgctcgccacctcatgcgctgcggaagctgccagcccatccggaccgctaagagagagaggcaaaacccccgccacacctactagccagttcgtcttctccttcccggtgagcgtgggcgtgcacagtgccccaagtagcctcccttacctgcacagcccaattactacttcaccaagctgttag

SEQ ID NO: 115137 - DNA, 912 bp, Artificial Sequence
  Description of Artificial Sequence: Synthetic coding sequence
atgggcaggaaggtgcactctaacggttcgcagttcgccgaacattcacggagtccccggcggaccggccgagactgtaaaccagtgcgggcccccagtatggccttgggggtgagtcaactcgctggaagatcccggtgcctttgctcagagtcccaaggcggatatgaaaggttctccagcgagtacccagagttttgcagcaagacaaaggctctagccgccataccccccccggttccgccatccgctacagaaccactcgacctcggatgtagctcttgcgggactccactccacgatcaggggggaccagtggagattttgccctttctctacctgggcagcgcgtaccatgccgcgagacgcgatatgctggatgcccttggaatcaccgcactgctgaacgtttcaagcgactgccctaaccatttcgaaggtcattaccaatacaagtgtatccctgtggaggataaccacaaggccgacatttcctcttggtttatggaagctattgagtatatagacgcagtaaaagattgccgtggccgcgttcttgtccattgccaggcgggcataagccggagcgccaccatctgtctagcatacttgatgatgaagaagagagtaaggctcgaagaagcgtttgagttcgtcaaacagagacggtctatcatttcacccaattttagtttcatgggtcagctactgcagtttgaatcacaggtgctagctacaagctgcgccgctgaagcagccagcccatcgggtcccctgagagagcggggaaaaacacccgcgacacccacgtcgcagtttgtcttttccttccccgtgtccgtaggcgtgcatagcgcaccctcatctctcccatacctgcattccccaattaccacaagtccaagctgctag

SEQ ID NO: 115138 - DNA, 1155 bp, Artificial Sequence
  Description of Artificial Sequence: Synthetic coding sequence
atgaaggtgacatcgctcgacggcaggcagctgcggaagatgttacgcaaggaagccgctgctcgctgcgtggttctggactgcagaccatacctcgcttttgcagcatctaatgttagaggcagtcttaacgttaatctgaactccgtcgtgctgagaagagcccggggcggagctgtctccgccagatatgttttgccagatgaagccgcaagggctaggctccttcaagagggaggcgggggagttgctgcggtagtcgttttagatcagggttctaggcattggcagaagttaagggaggagtcagctgctcgtgtggtgctcacctcccttcttgcatgtctaccagcaggccctagagtgtacttcctgaagggcggctatgagactttctacagtgagtatcctgaatgttgtgtggacgttaaaccaatatcccaggaaaagatcgagtcagaaagagcgcttatctcccagtgcgggaaacccgtggttaacgtgtcataccgccctgcttacgatcaggggggcccggtcgagatccttccctttctctaccttggcagtgcctaccacgcatcgaagtgcgaattcttggccaatctacatatcacagctttgctcaatgtgagcagacgtacaagtgaggcctgtgccacccatctacattacaaatggatacccgtggaagacagtcacactgcggacatatcatctcattttcaggaagctattgattttatcgactgcgtcagagagaagggcggcaaagtcctggtgcattgcgaggccggcatctcacgctcacccaccatctgtatggcctacctgatgaaaaccaaacagttcaggctgaaggaagctttcgactatatcaaacagcgccggagcatggtgtcccctaacttcggctttatggggcagctcctgcagtatgagtccgagatcctcccttccacgcctaacccacagcctcctagctgtcagggagaggctgcaggttcctcattgattgggcacttgcagaccctatcccccgacatgcaaggcgcatactgcactttcccggcatcagtcttagcacccgtgcccacccactcgacagttagcgagctgagcagatctcccgtggctactgccacaagctgttag

SEQ ID NO: 115139 - DNA, 1107 bp, Artificial Sequence
  Description of Artificial Sequence: Synthetic coding sequence
atgccctgcaagtctgcagagtggctacaagaagaactggaggccagaggcggggcctccttgttgctactggactgcaggcctcacgagctctttgaatccagccatattgaaaccgctatcaacctcgcaatccctggactcatgctccgtagactgaggaaaggcaatctgcccatccgcagtattatccctaatcatgccgacaaagaaaggttcgccacaaggtgcaaagcagcgaccgtgttgctttatgatgaggccactgccgagtggcagcccgagccgggtgctccggcgtcagttcttggcctacttctccaaaagcttagggacgacggctgtcaggcttattacctccaggggggctttaataagttccaaactgagtatagtgaacactgcgagaccaacgtcgacagtagttctagtccaagcagctctccgccaacgtcagttctcggacttggcgggctcaggatctcatccgactgcagcgatggcgaatctgaccgagagttgccatcctctgcgaccgagtctgatgggagcccagttcccagttcacagccagctttccctgtgcagatcctgccctatctctacctcgggtgtgcaaaggattcaaccaacttggacgtcctcgggaagtatggaatcaaatacattctgaacgtcactcccaaccttcccaatgctttcgaacacggaggggaatttacctataaacagatcccgatctctgaccattggtcgcagaatctgtctcagttttttccggaggccatatctttcatcgacgaggcacggtcgaaaaagtgcggggtgctggttcactgcctagccggaattagcaggagtgtcacagtgactgtggcataccttatgcaaaagatgaatctgtccctcaatgacgcatatgattttgtgaaaaggaagaagagtaatatctcaccaaactttaatttcatgggccaactgttagacttcgaacgcaccctcggactgagctctccatgcgataatcatgcgagcagcgagcagttatatttttccacacctactaaccataatctgttccccttaaacacactggaatccacctag

SEQ ID NO: 115140 - DNA, 1260 bp, Artificial Sequence
  Description of Artificial Sequence: Synthetic coding sequence
atgaaaaaccagctacggggccctccggccagagcccacatgagcacttccggggccgctgcagctggcggaacacgggccggcagtgagccgggggccggctctggcagcggagcagggaccggggctggggctgcgacaggagctggagctatgccctgtaagagcgcagagtggctgcaagaggagctggaagcccgcgggggcgcgtctctgctcctgctcgactgccgcccacatgaattatttgaatcctctcacattgaaaccgcaatcaaccttgccattcctggcctgatgctgagacgcctaaggaaggggaacctcccgattcgctctatcattccaaatcacgccgacaaggaacgctttgccacccgctgcaaggccgcaactgtgctcttgtatgatgaagcaaccgcggaatggcagcctgagcctggcgctcctgcctctgtgctcggcctcctgttacagaagctgcgggacgacggttgtcaggcatattatctgcagggtggcttcaacaagttccaaacagaatactctgagcactgcgagacaaatgttgattcttcttcatctccgagcagctccccccccacttccgtactcggcctcggcgggcttaggatctcctcagattgtagcgacggcgagtctgacagagagctgcccagctctgctactgagtccgacgggtcccccgttccatcctctcagccagcttttccagtccagatactgccatacttgtacctcgggtgcgctaaagactccactaatctcgatgtgttgggcaagtatggcattaagtacatcctcaacgtgacgccaaatcttcctaacgcattcgagcatggtggcgaatttacgtacaagcagattcccatatctgatcactggagtcaaaatttgtctcaatttttccctgaggcgatttcatttatagatgaggcccggagcaaaaagtgcggagtgctggtgcactgtctggccggtatttcccgatcagtgaccgtgacagtggcatatcttatgcagaagatgaacttgtccctgaacgatgcttacgacttcgtgaagcggaaaaagtccaatatctcccctaattttaactttatgggacagctgcttgatttcgaaagaactctgggactgagcagtccatgcgacaatcacgcgagttcagaacagctgtatttcagtactcccacaaatcacaatctctttcctctaaatactctcgaatccacatag

SEQ ID NO: 115141 - DNA, 1878 bp, Artificial Sequence
  Description of Artificial Sequence: Synthetic coding sequence
atggccggggataggttacccagaaaggtgatggatgccaagaaactggccagtctactcagaggaggtcccggagggcctcttgtgatcgattctcgttcgttcgtcgagtacaactcctggcacgtgctgtccagtgtaaatatctgttgctctaagcttgtgaaacgtagactgcaacagggaaaagtgactattgccgagcttattcagcctgcagctagaagccaggttgaggcgactgaaccacaggatgtcgtggtgtatgaccagtccactcgggatgcatctgtgctggctgccgatagtttcctctcaatattgttgtccaaattggatggttgtttcgattccgttgctatccttacggggggatttgctactttttcctcttgcttcccagggttgtgcgaggggaagcctgcggcacttctgcccatgtctctgtcacagccttgtctccctgtcccatcagtcggacttacccgaatcctacctcatctgtacctcggcagtcagaaggacgtccttaataaagacctcatgacacagaacggcatctcttacgtgctgaatgcctctaattcctgccccaagcctgacttcatctgtgagagccggttcatgcgggtccctatcaacgataactactgtgaaaagttattgccatggctagacaagtcaattgagttcatagacaaagcaaagctttcatcctgccaggtgatagtccactgtttagccggcataagtcggagcgcgacaatagccatagcttacatcatgaagaccatgggtatgagttccgacgacgcctaccgctttgtaaaggatcgcagacctagtattagccctaacttcaattttctgggccagctactagagtacgaacggtcactgaagctgttggcggccctgcagggagatcctgggacccccagcggaacccccgaaccacctcctagtcccgctgcaggtgcgccattgccaagacttccacctcccacatccgaaagcgcagccacaggtaatgccgcagcccgtgaaggagggctctctgccggcggggagccccctgcaccccccacacccccggcaacatctgccctccagcagggattgaggggattacatctgagtagcgatcggttgcaggacacgaatcggctaaagcgctccttctcgctcgacataaagagtgcttacgctccctcaaggaggcccgatgggcctgggcccccagatccaggcgaagcaccaaagctctgtaagctggactctccgtccggcgctgccctggggctatcctccccttccccagattcgcctgatgccgcccccgaagcgaggcctaggccgcgacgaaggccgcggccccccgccggatcacctgcacggagtcctgcgcacagccttggcctgaacttcggtgatgctgcccgacagacaccccggcacggcctgtcagccttatctgcacctgggctgcccggtcctgggcagcccgctggccccggtgcatgggcccctcctttggattcccctggaaccccttcccccgatggaccctggtgcttctcacccgagggggctcagggagctggtggcgtcttgtttgccccttttggccgcgccggggccccggggcccggaggggggagtgatctacgccggagagaggcagctcgcgctgagcctagggacgctaggactgggtggcccgaggagcctgccccagaaacccagttcaaaaggaggagttgtcagatggaattcgaagagggcatggtggagggcagagcgaggggcgaggaactggctgcactggggaaacaagcttcttttagcggatcagtggaagtaatcgaggtgtcctag

SEQ ID NO: 115142 - DNA, 1878 bp, Artificial Sequence
  Description of Artificial Sequence: Synthetic coding sequence
atggctggagaccggttaccacgaaaggtgatggacgccaagaagctcgcatcgttgctgcgcggcggcccaggtggtccccttgtcatcgattctaggagctttgtggaatataattcttggcacgtacttagctccgtgaacatctgttgcagtaagctagtcaaaagacgactgcaacaaggcaaagtgaccattgccgaactcatccagccagccgcccgctctcaggtagaagctacagagccccaggacgtggtggtgtacgaccagagtacccgggacgccagcgtactcgcggccgacagttttctttcaatcctcttaagcaagcttgacggctgttttgacagtgtcgccatcctgaccgggggttttgccacctttagttcctgctttcccggcctgtgtgaaggtaaacctgcagcccttctccccatgtccctgtctcaaccgtgtctgccagtccccagtgtgggactgaccaggattcttccccacctttacctcgggtcccagaaggacgtgctgaataaggacctgatgacccaaaatggaatcagctatgtgctgaacgcctcaaactcctgtcctaagccagactttatctgcgagagtaggtttatgcgggttcccatcaacgacaattactgtgaaaagctcctgccctggctcgacaagtcaatcgagtttatcgataaggccaaactctcctcgtgtcaggtcatcgttcactgtctggccggcatcagcagaagcgccaccatagcaattgcctatataatgaagaccatggggatgtcttcagatgacgcctataggttcgtaaaggatcggagaccaagtatctcgcctaactttaactttttgggacagctgttggagtacgaaagatccttgaagctgctggcggcgttacaaggagatcccggcaccccgtctgggacaccagagcctcctcccagtccagctgcgggcgcgccactccctagacttcctccccctacgagtgagtccgcggccacaggaaacgccgcagccagggaggggggattgtccgcaggcggcgaaccgccagcgccgccaacaccacccgccacaagcgcactgcaacagggtctgcggggtctgcatttgagctccgaccggctccaggacactaatcgactaaagcgaagtttttcccttgatattaaaagcgcctatgccccctctagaagacccgatggccccggccctcccgacccaggtgaggctcccaaactttgtaaattagactctccatccggagcagccctcgggctctcctccccgagtcccgacagtcccgacgcggccccagaggcccgccccaggccacgaagacgacctagacctccagctggctcaccagcacgatccccggcgcattccctcggactgaatttcggggatgctgccagacagaccccccggcatggtttgtcggcattaagtgctcccggtctgcccggccccggacagccagccggtcccggtgcatgggctcccccactcgattcaccaggaaccccttctcccgacggaccatggtgtttttctcctgagggagcacaaggggccggtggcgtgttgttcgcgcccttcgggagggccggggcgccaggtccaggtggcggctctgatttgcggcgccgggaggcggcgcgggcagagccgcgagatgcccgcaccgggtggcctgaagagcctgctcccgaaactcagtttaaaagaagaagttgtcaaatggaattcgaagaaggaatggtagagggccgcgcccggggcgaagagcttgccgccctcgggaaacaagcctcatttagcggttctgtggaggtgatcgaagtatcatag

SEQ ID NO: 115143 - DNA, 1626 bp, Artificial Sequence
  Description of Artificial Sequence: Synthetic coding sequence
atgcatactgggggcgaaacgagcgcttgcaagcccagtagcgtccgtttggcaccaagtttttctttccatgctgccggacttcagatggccgggcagatgccccatagtcaccagtacagcgacagaaggcagccaaatatcagcgaccaacaggtgagtgctctgagctatagtgatcagatacagcagccattaaccaaccaagtgatgcctgatatcgtgatgctgcagcgaaggatgccacaaacatttcgggacccggctacggctccgctccgcaagctttccgttgacctgataaagacttataaacatataaatgaagtttattatgccaagaaaaagcgtcggcatcagcaggggcagggcgatgattcctctcataaaaaggaacggaaagtctacaatgacggatatgatgatgataactatgattacatcgtgaaaaacggggaaaagtggatggatcgctacgaaattgactcactcattgggaaggggtctttcggacaagttgttaaggcttacgacagggtcgagcaggaatgggtggctataaaaatcattaaaaacaagaaagcttttctcaatcaggcacagatcgaggtgcggctgctcgagctgatgaacaaacacgacaccgaaatgaagtactatatagtccatttgaagagacacttcatgtttcgtaatcatctctgtcttgtgtttgagatgttatcatacaatctgtacgaccttctgaggaacactaacttccgaggagtatcactgaacctgacacggaagttcgcccagcaaatgtgtaccgctctgttattcctggccacgccagaactatcgattatacactgcgacttgaaacctgagaacatactgctgtgtaaccccaagcgcagcgctatcaagatcgtcgatttcggatcaagctgtcaactgggacagagaatctatcaatacatccagtcacgcttctatcgttcacctgaggtgttgcttggaatgccatacgacctggccattgatatgtggtctcttggatgcatattagtggagatgcatacgggcgagcccctcttcagtggggccaacgaagtggaccagatgaacaagatcgtcgaggttctcggaattccgccagcgcatatacttgatcaggcacctaaagcccgcaagtttttcgagaaactgcccgacgggacctggaatctaaagaaaacaaaggatggaaagcgggagtacaagcccccagggactagaaagttgcataatatactgggggtggagaccggagggcccggaggccggcgtgcaggcgagtccggacatacagtcgcggattacctcaaatttaaggatctgatcctccggatgctggattacgatcctaagacacgcatacagccctattatgctctccagcatagtttttttaagaagactgccgatgaagggaccaatacaagcaactcagtgagtacatcgccagctatggaacagtcacagtcgtcagggactacctcatccacatcttcttcttccgtggtggagcagcactggatgccgggcgcattccgaatgacagtctcctttaccctcgaggtgcacgacgtgcccgtgtag

SEQ ID NO: 115144 - DNA, 1755 bp, Artificial Sequence
  Description of Artificial Sequence: Synthetic coding sequence
atgcacactggcggggagacatccgcctgcaaaccaagctctgtcagacttgctccctcattctctttccatgctgccggactacagatggccgggcaaatgcctcattcgcaccaatattctgatcgccgacagccgaatatcagcgatcagcaggtgagcgcactgagttacagcgatcagatccagcagcccctgacgaatcaggtgatgcccgacatagtcatgctgcagagaagaatgccacagactttcagggacccagctactgcacccctcagaaagctcagcgtggacctcattaaaacttacaaacatatcaacgaggtctattatgccaagaaaaagcggagacatcagcagggacagggggacgactcatctcacaaaaaagaaagaaaagtttacaacgatggatacgacgatgacaactatgattacattgtgaagaacggggagaaatggatggaccgatacgagatcgacagtcttattggcaaaggttcttttggacaggtcgtgaaagcctatgatagggttgagcaagaatgggttgccattaaaatcatcaaaaataagaaggctttcctaaatcaggcccaaatcgaggtccgtcttctagaacttatgaataagcacgatacagaaatgaagtactatattgttcacctcaaacgacatttcatgtttaggaaccacctctgtctggtgtttgagatgttgagctacaatctgtatgacttattaagaaatactaattttagaggcgtgtcactgaacctgacgcgcaaattcgcccagcagatgtgtaccgcgctgctcttcctggcaactcctgagctttccatcatccactgcgacctcaagcctgagaatatcctcctgtgtaatccaaagaggagtgcgatcaaaattgttgactttggctccagctgtcagttgggccaacggatctaccagtacatccagtcacggttttaccgttctccagaagtgctgcttggtatgccctatgatctcgctatcgatatgtggagtctgggctgcattttagtcgagatgcacactggagagcctttgttttctggtgcaaacgaggtcgaccagatgaacaaaatcgtcgaagtattaggcattccaccagctcacattctcgatcaggcacctaaagccaggaaattctttgaaaaactgccagacggcacatggaatctgaaaaagaccaaagatggaaagagggaatataagcccccgggaaccagaaagctccataatatcttaggcgtcgagacaggcggacctggcggtcgaagggccggcgaatccggacacaccgtagcggactacctcaagttcaaggacctgatattgagaatgcttgactacgaccccaaaacccgtatccagccatactatgccttacagcactccttttttaaaaaaacagctgatgagggcaccaacacaagcaacagtgtctcgacatcaccagctatggagcagagccagtccagcggtaccaccagtagcacaagcagttcctcaggtgggagctctgggactagtaatagcggacgagcacggtctgaccccacacatcagcaccggcattctggcggccactttacggccgccgtacaggccatggactgcgaaacgcactccccacaggtgtcctctcacgtcgtgcacctgttagtaagccctgccattctcagatggtcgagtaccgggtgccaggtcccactagaatag

SEQ ID NO: 115145 - DNA, 2265 bp, Artificial Sequence
  Description of Artificial Sequence: Synthetic coding sequence
atgcacactggtggggagaccagtgcttgcaaaccctccagcgtgcggctggcccctagcttttcattccacgccgccgggcttcaaatggcaggtcagatgcctcattcacatcagtactccgatcgtaggcagccaaacattagcgatcaacaggtgtcggctctgagttatagtgatcagatacaacagccactcaccaaccagcggagaatgccccaaacattccgggaccccgctaccgccccattgagaaagctgtcagtcgacctaattaagacttacaaacatattaatgaggtctattacgcaaaaaagaagagaagacaccaacagggccagggcgatgacagctcccacaagaaagagaggaaggtatataacgacgggtacgatgacgataattacgactatattgttaagaatggcgaaaagtggatggatagatacgaaatcgacagcttaatcggcaagggttctttcggccaagtggtgaaggcctatgatcgggtcgagcaagagtgggtggccattaaaataataaagaataaaaaggcattcctgaatcaagcccagattgaggttcgccttctcgaactgatgaacaaacatgatacagaaatgaaatattacattgtccatttgaagaggcacttcatgttccgaaatcacttatgcctggtttttgaaatgctgagctacaacctatatgatctgctgaggaacactaatttccggggtgtgtcccttaatctcacccgcaagttcgcccagcagatgtgtacagccttactcttccttgccactccggagctcagcatcatccactgcgatcttaaaccagaaaatatattgctgtgcaacccaaaacggtctgcaatcaagatcgttgatttcggatcttcttgtcagctcgggcagagaatctatcagtatattcaatctagattttatcgcagccccgaggtactgctgggcatgccttatgatctggccatcgacatgtggtccctgggctgtatcctcgtggaaatgcataccggagaaccactcttcagtggtgccaacgaggtagaccagatgaataagattgtggaggttttaggaatcccccctgcccacattctggaccaggctccgaaagctaggaaattttttgaaaagctgcctgacggaacatggaatctcaagaagacaaaggatggaaagcgggaatataagccccctggcactcggaaacttcacaacattctgggcgtggagaccggagggccaggcggacggcgtgcaggtgagtctggacacactgtcgccgactatttaaaatttaaggaccttattctgagaatgctagactacgaccctaagacacgcatccagccttactacgctcttcaacactcattcttcaaaaagaccgctgacgagggaactaatacctcaaactccgtgtccacctctcctgcaatggaacagtcgcaatcctctgggactacatctagcacctcctcctccagtggagggtctagtggcaccagtaactccggccgggctagatctgatccaacccaccagcatcgccactctggtggacacttcacagcagccgtgcaggcaatggactgcgagacccactctcctcaggtcagacagcaatttccagcacctttgggatggagcggtactgaggcccctactcaggttacagttgaaactcacccagtgcaggaaactaccttccacgtggccccccaacaaaacgctctgcatcatcaccatggtaatagcagtcaccaccatcatcaccaccaccatcaccatcaccatcacggccagcaggctctgggcaatagaacccgccctcgcgtgtacaattcaccgaccaattcttcatctactcaggattcaatggaggtgggccacagccatcactccatgacgtcattgagttcttccactacgtcctcctcaactagcagttcatccactggaaatcagggaaaccaggcttaccaaaatagaccagtggccgctaacactttagatttcgggcagaatggagccatggatgttaatctgaccgtgtattccaatcctcgacaggagactgggattgccggccaccctacatatcagtttagtgccaacacaggtccagcccactatatgacagaaggccacttgaccatgcgacaaggcgccgaccgagaagaatcccctatgaccggcgtctgcgtgcaacagtcgccggttgcatcctcgtag

SEQ ID NO: 115146 - DNA, 1590 bp, Artificial Sequence
  Description of Artificial Sequence: Synthetic coding sequence
atgcacacgggaggcgaaacttctgcctgcaaaccttcgtccgtgaggctggcaccaagcttttcatttcacgcagccggcttgcagatggctggccaaatgccgcattcacatcagtattctgaccgccggcagccgaacatttctgaccagcaagtatcagccctttcatacagtgatcagatccagcaacccctgactaaccaggtgatgcccgacatagttatgcttcagaggagaatgccccaaacatttcgcgatcctgccaccgctcctttgagaaagttatctgtcgaccttatcaagacctataagcatatcaacgaggtatattacgcgaagaagaaacgcagacaccaacagggtcagggcgacgactcctcacataagaaagaaaggaaggtgtacaatgacggctacgacgatgacaattatgactatatcgttaaaaatggagagaagtggatggaccgctacgagatcgactcactgataggcaaaggaagctttggccaggttgttaaggcatacgaccgagtcgaacaagaatgggtggctataaaaattatcaagaacaaaaaggctttcctgaaccaggctcaaatcgaagtgagactcctggaattaatgaataaacatgacacggagatgaaatactacatcgtccaccttaagagacattttatgttccgaaatcatttgtgtctcgttttcgaaatgctcagttacaatctctacgaccttctcaggaacactaactttagaggcgtgagtctgaatttgaccaggaaattcgcccagcaaatgtgtacggctctgcttttcctggccaccccagaactcagcattatacattgcgacctgaaaccggaaaacatcctgctctgcaaccccaagagaagcgccatcaagattgttgatttcggaagctcatgtcagttgggacagcgaatctaccagtatatccaatctcgcttctatcggagtcctgaggtcctgctagggatgccttacgatctggcaattgacatgtggtcattaggctgtatcctggtcgagatgcatactggcgagcctctgttcagcggagccaatgaggtggatcaaatgaataaaatcgttgaggtgctcggtatcccgcccgcgcacattttagatcaggctcccaaggcccgcaagttctttgagaagttaccagatggcacctggaatctcaagaagacaaaggacggtaagcgggagtataaacccccaggtacaagaaaactgcataatattctgggcgtagagaccggcgggccaggggggagaagggcaggggagagtggacatacggttgcggattacctgaagtttaaagatttgatccttcgaatgttggattacgatccaaagacccgcattcagccttattacgctctccagcatagcttcttcaagaaaacggctgacgagggaacaaacacatcaaacagcgtgagcacttcgccggccatggagcaatcccagtcaagcgggacaacctcaagcacttcaagtagcagtggagcttctgcaatctcctgcagctcatggctggtacgccattag

SEQ ID NO: 115147 - DNA, 2292 bp, Artificial Sequence
  Description of Artificial Sequence: Synthetic coding sequence
atgcacacgggtggagaaacatctgcttgtaaaccctctagcgtgagactcgcccccagctttagctttcacgccgcagggctccagatggctgggcagatgccccattcccaccagtactctgacaggcgacagcccaacattagtgaccagcaggtgtctgccctgagttactccgatcagattcagcagcctctgaccaaccaggtgatgcctgacattgtgatgcttcagcggaggatgccccagaccttcagagatccagccacagcgcctctcaggaagctatccgtcgatctgattaaaacatataaacacattaacgaggtatactacgctaagaaaaagcggaggcaccagcaggggcagggcgacgactcaagtcataagaaggagcgcaaggtctacaatgacggatatgacgacgacaattacgactacattgtcaaaaacggagagaaatggatggatcgatatgagatcgattcgctcattggcaaagggtctttcggccaggtggttaaagcatatgatagggtagagcaggaatgggtggccatcaaaatcatcaagaacaagaaggcttttttaaaccaggcacagattgaggtgcgtctgttagagcttatgaacaagcacgacacagagatgaagtactacattgtccatctcaagcggcactttatgttccgcaaccatctctgcctcgtgttcgaaatgctgtcttacaatctatatgatcttttgcgcaatacgaactttagaggcgtgtcactcaatttaacccggaagttcgcacagcaaatgtgcactgcgctgctttttttagcaacacccgagctgagtatcattcattgtgaccttaagcccgaaaatatcttactatgcaaccccaaaagaagcgcgatcaaaattgtagacttcggatcatcatgtcaattgggacagagaatctaccaatacatccagtccaggttctaccggtctcctgaagtgcttttagggatgccatacgatctggccatcgatatgtggagcctgggctgtatactggtggaaatgcatactggcgagccactgttcagtggagccaatgaggttgaccagatgaacaaaattgtggaagttttagggattccacctgcccacatcctcgaccaggctcctaaggctcgcaagttctttgagaaactcccagacggtacttggaacttgaaaaagaccaaggacggaaaacgagaatataaaccccccgggaccaggaaactgcacaacattctgggagtcgaaactgggggacccggcggccggagagctggggagagcgggcacaccgtggcagattatctaaagttcaaggatttgatcctgaggatgcttgactatgatcctaaaacacgaattcagccatattacgctcttcagcacagtttctttaagaaaacagccgatgaggggaccaacacgtccaattcagtgagcacaagcccagctatggaacagagtcagtcctctgggacaacatcgtccacttcatcatctagcggaggatcctccggaaccagcaattctggccgtgctcggagcgacccaactcaccagcataggcattcagggggtcatttcacggctgcagtacaggcaatggactgcgagactcattcaccccaggtgcgtcaacagttccctgccccactaggttggtctggaaccgaggcccctacacaggttactgtagagacacaccccgtacaggagaccaccttccacgtcgcaccccagcagaatgctctgcaccaccaccatggcaactcctcacatcaccaccaccaccatcatcaccaccaccaccaccatggccagcaggccctgggtaatcgcacacggcctagagtttacaacagccctacaaattcctcatctacccaggattccatggaagtcggtcacagccaccatagtatgacgtcattgtccagtagcactacttcctccagcacaagttcctccagtaccgggaatcagggaaaccaagcctatcaaaacaggccagtagctgcaaacacactcgacttcggtcaaaatggagctatggacgtaaacctgaccgtttattcgaaccctagacaggagactggcattgccggccaccccacttaccaatttagtgccaataccggccccgcccactatatgaccgagggccatcttaccatgcgccagggtgcagatcgtgaagagagcccaatgaccggcgtgtgcgtgcagcaatcaccagtagccagtagctag

SEQ ID NO: 115148 - DNA, 396 bp, Artificial Sequence
  Description of Artificial Sequence: Synthetic coding sequence
atgcatactggcggtgagacgagtgcttgcaagccctctagtgtgagacttgccccctctttcagctttcatgccgccggactacagatggccggccagatgccccactctcaccagtatagcgataggaggcagccaaacatatcagatcagcaggtgagcgccctctcctacagcgatcagatccagcagcccctgaccaaccaggtgatgcccgatatcgtgatgttgcagagacgcatgccccaaacttttagagacccagccactgcgcccctgaggaagttgtccgtcgacctgatcaagacatacaaacatattaacgaggtgtattacgctaagaaaaaaagaaggcatcagcagggccaaggagatgattcatcccataaaaaatag

SEQ ID NO: 115149 - DNA, 1755 bp, Artificial Sequence
  Description of Artificial Sequence: Synthetic coding sequence
atgcacaccggcggcgagacctccgcatgtaaacctagctccgttcggctcgctcccagcttctcttttcacgccgcgggactgcagatggcgggccagatgccacattcccatcaatatagcgaccgccggcaaccaaacattagcgaccagcaggtgtctgcattgagctattcagaccagatccagcagccgcttactaatcaggtgatgccagacatcgttatgctgcaacggagaatgcctcaaactttcagggaccctgccacagccccactgcgtaagctgagtgtggacttgatcaagacttacaagcatattaatgaggtatattacgccaaaaagaaacgccggcaccaacaaggtcagggggacgacagctcccacaagaaagaacgaaaagtgtacaatgacgggtacgatgacgataactacgattacattgtgaagaacggggaaaagtggatggacagatatgaaatcgattccctcattgggaaaggatcttttggccaggtggtgaaagcctatgacagagtggagcaggagtgggtcgccattaagatcatcaaaaataaaaaagctttcttgaatcaggctcagatcgaggtgcgactcctagaactgatgaataaacacgatacagagatgaagtactacattgtgcacttgaagagacattttatgttccgcaaccatctctgcttggtcttcgaaatgctatcatataatttgtatgacctgctacggaatacgaatttccgaggcgtgagcctcaatctcacgcgcaaatttgcacagcagatgtgcaccgccctgctctttttagccactccagagctgtctatcatccattgtgacctgaagccagaaaatatactgctctgcaaccccaagagatcagccattaaaattgtcgacttcggttcgtcctgccagttgggccagcggatctatcaatacattcaatctagattttatcgaagccccgaggtgctactagggatgccctacgatctggcaatagatatgtggagtctcggatgcatcctcgtggaaatgcacacaggtgaaccccttttcagtggcgctaacgaggtcgatcagatgaataaaatagtggaagtcctgggcattccccccgcccacatcctcgaccaggcccccaaggcccggaaattttttgagaagctccctgatggcacttggaatctgaagaagacaaaggatggcaaacgagaatacaagcctccgggtacgcgcaaactccataatattctgggagtggagacgggggggcctggaggtcggcgcgctggcgagtccgggcatacggtggccgactacctgaaattcaaagacctcatcttgcgtatgctcgattatgaccccaagactcgcattcaaccctactatgccctgcagcacagctttttcaagaaaacagctgatgagggaactaatacgagcaattctgtgtctacttctccggctatggaacagtctcaatcctctggcaccaccagctctacatcatccagctcaggaggaagttccgggacaagtaattcggggcgggcccgctctgatccgacgcaccagcacaggcattccggcggccacttcactgctgcagtccaagccatggattgtgagactcactctccacaggtgtctagtcatgtcgtgcacttacttgtgagccccgcaattctgcggtggtcatctacaggctgtcaagtcccgttggaatag

SEQ ID NO: 115150 - DNA, 141 bp, Artificial Sequence
  Description of Artificial Sequence: Synthetic coding sequence
atgcatactgggggagagacatctgcttgtaagccaagttctgtgcgcctggcgccctcatttagtttccacgcagccggcctgcagatggcaggacagatgcctcactctcatcaatactcagatcgcaggcagccatag

SEQ ID NO: 115151 - DNA, 1608 bp, Artificial Sequence
  Description of Artificial Sequence: Synthetic coding sequence
atgttcagaaatcatctttgtcttgtctttgagatgctctcttacaacctatacgacctgctgcggaatacaaatttcaggggggttagtctcaacctcactcgtaaattcgcacagcagatgtgtaccgccttattgttccttgcgacaccagagctttccatcattcactgtgacttaaaacctgagaacattctgctgtgtaacccgaaaaggtccgctattaagattgtggattttgggtcctcatgccagctgggccaaaggatctatcaatatattcagtctcgcttctatcgtagccctgaagtactgctggggatgccctacgacctggctattgatatgtggagtctgggctgcatccttgttgagatgcataccggcgaacctctgttttccggggccaacgaggtagaccagatgaataagatcgtggaagtgcttgggataccacctgcacacattctggaccaggccccaaaggccaggaagttctttgaaaagcttcccgatgggacctggaatctgaaaaagactaaggatggcaaaagggaatacaaacctcccggcaccaggaagttacataatatccttggagttgagaccggcggcccaggaggcagacgagcaggcgagtcaggtcacacagtcgccgattatcttaaatttaaggatctgattctcagaatgctggattacgacccaaagactcgtatacagccgtattatgcgctgcagcactcatttttcaaaaagactgcggatgaaggcacaaacacatccaatagtgttagcacctcccccgcgatggaacagagtcagtcatccgggacaacaagttctacctcaagctcgagtggagggtcgagtgggactagcaatagcggacgggcacgatccgacccgacccaccagcatagacatagcggaggtcactttactgctgccgtccaagctatggactgtgagacacactcaccacaggtgcgccagcagtttcccgcgccattaggttggtccgggaccgaagcaccgacacaggttaccgtcgaaactcatcccgttcaggagacgacctttcacgtcgccccacagcaaaatgccctccatcatcaccacgggaactcctcccatcatcatcaccaccatcatcaccatcaccatcaccacgggcagcaggcattggggaatcggacccgaccccgggtctacaacagccccacgaacagcagttcaacgcaagattccatggaggttggtcattcccatcatagcatgactagtctatcttcctcaactactagctccagcacatcctcctcatcgaccggcaatcaggggaatcaagcttaccagaacaggcccgtggcagccaatacactcgattttggtcagaacggggcaatggacgtgaacttgacagtgtactctaacccccggcaggagaccgggatagctgggcatcccacatatcagttctcagccaacactggacccgctcactatatgacagagggccatctgacaatgcgccagggcgcagaccgcgaagagtccccaatgacaggagtgtgcgtccagcagtccccagtagcctcatcctag

SEQ ID NO: 115152 - DNA, 1890 bp, Artificial Sequence
  Description of Artificial Sequence: Synthetic coding sequence
atggcagtccccccaggccacggccccttctcagggtttcccgggcctcaggagcatacacaggtcctccccgacgtgcgacttcttcccaggcgattgccactggcatttagggatgccacttccgctcccctgcggaagctgtcagtggatctgatcaaaacttataaacacattaacgaagtctattacgctaagaagaaacgccgcgcgcagcaagcacccccacaggattcctcaaacaaaaaggagaagaaggtgctcaatcatgggtacgacgacgacaatcatgactatattgtgcggtccggtgagcgttggcttgaacgctacgagatcgatagcctgataggcaaagggagtttcggccaggtcgtcaaggcctatgatcatcaaacacaggaactggtcgccatcaagattataaagaataaaaaagcgttcctaaatcaggctcagattgagctcagactgctggagttgatgaaccagcacgataccgaaatgaaatactacatcgtgcacctgaagagacatttcatgttccggaaccatctgtgtctcgtgttcgaactacttagctacaatctgtacgatttactacgaaatactcatttccgcggcgtgtctctgaacctaacacggaagctggcccagcagctgtgcaccgcactcctttttctcgcaacaccagagctgagtattattcattgcgacctaaaaccggagaatattctgctgtgcaaccctaaaagatcggccatcaaaattgtggactttggttctagctgccaactaggccaacggatatatcaatacatccaaagtcgattttacaggtcaccggaagtgcttctcggaactccatacgacctggcgatagatatgtggagccttgggtgcatattagttgaaatgcataccggggaacctttgttctctggatcgaacgaggtggatcagatgaatcgcattgtcgaggtgctgggcatcccaccggccgcaatgctggaccaagccccaaaagcccggaagtactttgaacggcttcctggggggggctggacactgagaagaaccaaagagttgcggaaagactaccaggggcccggcacaaggcgattgcaggaggtgctcggcgtgcagactggcggtcctggcggaaggcgggctggggaaccaggacactccccagcagactacttgaggtttcaagacctcgtgttaaggatgttggagtacgaaccagcggcgcgcatttcccccctgggagccctgcagcatggattctttcggagaactgctgatgaggcgaccaacaccggtcctgctggctccagcgcttctacctctccagctcccctcgacacatgcccatcctctagcaccgcctcatcgatttcatcttctggcgggtcaagcggctcctctagcgacaacagaacgtatcgttactcaaataggtactgcggaggaccaggcccaccaatcaccgattgcgagatgaacagtcctcaggtgcccccatctcagcctctgcgcccctgggcaggtggcgatgttcctcataaaacccatcaggcccccgcaagcgcctcgtctttacctggaaccggggctcagcttcctccccaacctaggtatcttggccggccaccttctcccacaagcccccccccgcccgagcttatggacgtgtccctggtggggggacctgccgattgtagccccccccaccctgccccagcaccccagcaccccgctgctagtgccctgcggaccaggatgactggcgggagacctcccctgcccccgcccgatgaccctgctacccttggtccccacctcgggctgaggggagtgccacaatctactgctgcctcgtcatag

SEQ ID NO: 115153 - DNA, 1806 bp, Artificial Sequence
  Description of Artificial Sequence: Synthetic coding sequence
atggccgtcccacccgggcacggacctttttccggcttcccaggtcctcaggagcacacccaagtgttgccggatgtgcgattgctcccaaggcgcctgcctctggccttccgcgacgcgactagtgcaccactacgcaagctgagcgtcgatttaataaagacctacaaacatattaatgaggtgtactacgccaagaaaaagcgcagggctcagcaggcacctccgcaagactcttcaaacaagaaggaaaagaaagtcttgaaccatgggtacgatgacgataatcatgactatatcgtacgatcgggcgaaagatggctggagcgctatgaaattgattccttgatcggaaagggctccttcggccaggttgtgaaggcttacgatcatcagactcaggaactggtggcgatcaagatcattaagaataaaaaggccttcctcaatcaggcgcagatagagctgcggctgctagaactgatgaatcaacacgatacagagatgaagtactatattgtgcacctcaaaagacactttatgttccggaaccacctttgcctggttttcgagctactgtcctataatctctacgatctccttaggaatacacattttaggggtgtgagtcttaatttaaccaggaagctggcacaacaactgtgcactgccttgttgtttctcgccacaccggagctgtccattattcactgtgatctgaagccagaaaacatccttctgtgcaatcctaagcgcagtgctattaagatcgtggattttggaagctcatgccaattggggcagcgtatataccaatatatccaatctagattctacaggtcaccagaggttctcttgggaacaccgtatgacctagcaatagatatgtggagtctggggtgtattctggtcgagatgcacacaggcgaaccgttgtttagcgggtcgaatgaagttgaccagatgaaccggattgtggaggtgttagggattcctcccgctgcaatgcttgatcaggcaccaaaagcaaggaaatatttcgagagactgcctggcggaggctggaccttgcggcggactaaggaattaagaaaggattaccagggtcctggtacgcgcaggctccaggaggatcttgtgctgcggatgctagagtacgaaccggccgctcggatttcgcctctcggcgctctgcagcatgggtttttccggcggacagccgacgaggccacgaataccggccctgccggatccagtgcgagtacctcaccggcgcctctggacacctgcccatcttctagtaccgcctccagcattagctcgtccggcggcagcagcgggtcctctagtgataacagaacctatcgctactctaaccggtattgcggcggcccaggccctcccatcactgattgcgaaatgaacagccctcaagtgccaccctctcaacctttacgcccttgggcgggtggcgatgtcccgcacaagacccaccaggcccctgcgagcgcttcaagcctgcctggcaccggtgcacagttgccaccccagcctcgctacctgggacgacctccctcacctacatccccacctccgccagaactgatggatgtgtccctggtgggggggccagctgactgtagccctccccaccccgcaccagctccgcagcaccctgccgcatccgccctacgcacacggatgaccggtggacggcccccactacccccgcccgatgaccccgcgacactaggcccacatttaggcctccgcggagtaccccagagtactgccgccagttcctag

SEQ ID NO: 115154 - DNA, 1770 bp, Artificial Sequence
  Description of Artificial Sequence: Synthetic coding sequence
atggctgttcctccaggacacggccctttctccggctttccaggacctcaggagcatacacaggtgctgccagacgtccgtctacttcctaggagattgcccctcgcatttcgggacgcgactagcgcccctttgcggaaattgtctgtggaccttatcaagacctataagcatattaacgaagtgtattacgctaagaagaaaagacgcgcgcaacaggcgccaccacaggactccagcaacaagaaagaaaagaaagtactgaaccacggctacgacgatgataaccacgattacattgtgcgatctggagagagatggctcgagaggtacgaaattgacagcctgatcggcaaggggagctttggacaggtggtgaaggcttatgaccatcagacacaagagcttgtggccattaagatcattaagaataagaaggctttcttgaatcaggcacaaattgaattacgacttctagagcttatgaaccaacatgacaccgagatgaagtactacatcgtgcacctcaaacgtcatttcatgtttcggaaccatctgtgcctggtgttcgaacttctttcctataacctatacgatctgctgagaaacactcacttcagaggtgtatccttgaacctgaccagaaaactggcccagcagctatgtaccgccttactgttccttgcgactccagagctgagcattattcactgtgatctcaaaccagagaacatactgctctgcaatcccaaaaggtccgccataaaaatagttgactttggcagcagctgccagctgggccagagaatttaccaatacattcagtcccggttctataggagcccggaagtgttactcggtactccttatgatctagcaattgatatgtggtccctcgggtgcatcttggttgaaatgcacactggggaacctttattcagcggatccaacgaggtggatcagatgaatcgcatcgtcgaagtgctggggatcccgcccgccgctatgttagaccaagcgcctaaggcaaggaagtacttcgagaggctcccgggcggcggctggacacttcggcggaccaaagaattacgcaaagatctcgtgctccggatgctcgagtatgagcccgctgcacgaatatcccctctgggcgcactccagcacggctttttccgcagaaccgcagacgaggcaacaaatactggacctgccggaagtagcgcctctacctctcccgctcccctggacacctgtccaagcagttctacagcatccagtataagttccagcggcggctcgtcaggcagcagcagcgacaatcggacatatcgttacagtaacaggtactgcggaggaccaggaccaccgatcactgactgcgagatgaactccccacaggtccccccttctcagccacttcgcccctgggccgggggagacgtcccccataaaactcaccaggcccccgcctcagcttccagtttgccagggacaggcgctcagctgccacctcaaccaaggtacttaggccgtccaccctccccgacatctccacccccccctgagctgatggacgtttcgctggtgggaggccctgccgactgtagcccccctcacccagcccctgctccacagcacccagctgcctccgctcttagaacgcggatgacaggcggccgaccccccctacctccaccggatgaccccgcaacattggggcctcacttagggctcaggggtgtgccccagtctaccgctgccagtagctag

SEQ ID NO: 115155 - DNA, 285 bp, Artificial Sequence
  Description of Artificial Sequence: Synthetic coding sequence
atgaatgaccacctccacgtcggcagtcacgcccatggccaaatccaggtacagcagcttttcgaggataattccaataaacggactgttctgaccacacaacctaatgggctcacaaccgtgggaaagacaggcttgcccgtagtgcccgagcgacagctggattcaatccaccgaaggcaaggttcatctacgagcttgaaaagcatggagggcatggggaaggtgaaagccacccctatgaccccagagcaagctatgaagcaatacatgcaaaaactctag

SEQ ID NO: 115156 - DNA, 1806 bp, Artificial Sequence
  Description of Artificial Sequence: Synthetic coding sequence
atgctgaccaggaaaccgagtgccgctgcacccgccgcctacccaaccggtcgggggggcgactccgcggtccgccaacttcaagcttcccctggccttggagccggtgctacccgatctggagtcggcaccggcccaccatcacccatagcccttcccccactgcgcgccagcaacgctgcagccgccgcacataccataggcggttcgaagcacactatgaatgatcacctgcatgtcggctcacatgcccatggacaaatccaggtgcagcagctgtttgaggataatagcaacaaaaggacagttctgactacccagccaaacggccttacaacggtgggaaagacaggcctgccagtggttcctgagaggcaactggactctattcaccgtagacaaggatcctcaaccagtctgaagtctatggaggggatggggaaggtgaaagccaccccaatgactccggagcaagctatgaaacaatacatgcagaagctgacagccttcgagcatcatgaaattttctcttaccccgagatctactttctgggcctgaatgctaaaaaacggcagggaatgactggcgggccaaataatggcggttacgacgacgaccaggggagctacgtccaagtgccacacgaccatgtggcctatcgatacgaggtgctgaaggtcatcggcaaagggagttttgggcaagtggtcaaagcctatgaccataaagtccaccagcatgtcgctctgaagatggtcagaaatgagaagagatttcaccgccaggctgccgaagagatccgaatcttagagcaccttagaaagcaagataaagataatacgatgaacgtcattcacatgctggaaaactttacttttaggaaccacatctgcatgacatttgaactgctgtcaatgaatctctacgagctgatcaaaaagaacaagtttcaggggttctctctgcccctcgtacgcaagttcgcccactccattttgcagtgcctcgacgctctgcacaaaaacagaatcatccactgtgatctcaagccagagaatatcctcctaaagcagcagggaaggtctggcataaaggtaatcgattttggttcatcctgttacgagcatcagagagtttacacctatatccagtcccgtttttaccgagcacctgaggtaatcctcggtgcccgatacggcatgcctatagacatgtggtcccttggctgtatccttgccgaactccttaccgggtaccctttgctgccaggggaagatgagggggaccaactcgcgtgtatgatcgagctactgggcatgccatctcagaaacttctggatgcttctaagagggccaaaaatttcgtatctagcaaagggtacccgcgctactgtacagttaccactctttccgacgggtctgtcgtgctgaacggggggagatccaggcggggtaaactgagagggccacccgagtcgagagagtggggcaacgccctgaagggctgcgacgaccccctttttttggactttcttaagcagtgcctcgaatgggaccccgcagtaagaatgacccctggacaggcgcttaggcacccgtggctgcgccggaggctcccgaaaccccctactggggagaaaacgtcagtgaaacgtatcaccgagagtaccggagccattacatccattagtaagcttcctccaccatcgagctcggcctccaagcttagaacgaacctggcccaaatgaccgacgctaacggcaacatccagcagcgcacagttctccccaaactggtctcgtag

SEQ ID NO: 115157 - DNA, 1587 bp, Artificial Sequence
  Description of Artificial Sequence: Synthetic coding sequence
atgaacgatcacctgcacgtgggatcgcacgcacacggtcagatacaggtgcaacagctgttcgaagataattccaacaaaagaacggtgttgacaacccaaccaaatgggctgacaactgtaggcaagaccggcctccccgttgtccctgaacggcagctggattccattcataggcgccaaggtagcagcacatctttaaagtcaatggaaggcatgggaaaggtgaaagccactccgatgacccccgagcaggctatgaagcagtacatgcaaaagttaacggcattcgaacaccacgagatcttctcatacccagaaatttatttccttggccttaacgctaagaaacgacagggtatgactggcggccccaataacggtgggtacgatgatgaccagggatcctatgtgcaggtcccgcatgaccacgtggcttataggtacgaagttctcaaagtcatcgggaaaggctccttcggccaggtcgtgaaggcctacgaccataaggtgcaccaacatgtggctctcaaaatggtgagaaacgagaaacgattccataggcaagctgccgaggaaatacggattctggagcacctgcgtaagcaggataaggataacaccatgaacgttatacacatgctggaaaatttcacttttcgaaatcatatctgtatgacattcgagctattgagcatgaatttatatgagctgataaagaaaaacaaattccagggcttctccctcccactcgtccggaagttcgcacactcaatcctgcagtgtttggatgcgctccacaagaaccgaatcatacactgcgatttgaaaccagagaatatcctcctaaagcagcagggcagatccggcatcaaagtaattgacttcggtagttcttgctatgagcatcaacgcgtttacacttatatccagagccggttttacagagcgcctgaagttatcctcggcgctagatacgggatgcccatagacatgtggtctcttggctgcattttggctgagctccttacgggctatcccctacttcctggcgaagacgagggggaccagcttgcttgcatgattgaattactgggcatgccatcccagaagctgctggacgcctcgaagcgggcgaagaacttcgtgtctagtaaggggtatcctaggtactgcaccgttacgacacttagcgatggttcagtagtgctgaacggcggtcggtcccgacgagggaaactgcggggtcctcctgagagccgagaatggggaaatgccctgaaggggtgcgacgatccactctttttggatttccttaaacaatgcctggagtgggatccagctgtccgcatgacacccggtcaggctttacggcatccctggctgcgtagacgcctcccgaagccccctaccggtgagaagacctctgtcaagcgaataaccgagtccacaggcgccatcacatctatctctaaactgcctcctccatcctcatccgcgtcaaagcttaggactaacctcgcccaaatgacggatgccaacggaaacatccagcagcggaccgtcctgcctaagctcgtgtcatag

SEQ ID NO: 115158 - DNA, 471 bp, Artificial Sequence
  Description of Artificial Sequence: Synthetic coding sequence
atgaatgatcacctgcatgtcgggagtcatgcccatggtcagattcaagttcagcagctcttcgaggacaatagcaacaagcgaactgtgttaacaacacagccgaatgggctgacaacagtcggcaaaaccggattaccggtagtgccggagcggcagctcgactctatccatcgacggcagggatcaagtacctcactgaagtccatggaagggatgggaaaggtgaaggcgactccaatgaccccagagcaagcaatgaagcagtacatgcaaaaattgaccgcatttgaacatcatgaaatcttctcatacccagagatctattttcttgggctcaatgcgaagaaaagacagggcatgactgggggccccaataacggtggctatgacgacgatcagggttcttatgtgcaggtgcctcatgatcatgtggcatatcggtatgaggtcctgaaggtaattggatag

SEQ ID NO: 115159 - DNA, 1707 bp, Artificial Sequence
  Description of Artificial Sequence: Synthetic coding sequence
atgaagtggaaggaaaagcttggcgatggagtgtacgatacttttatgatgatagacgaaacaaagtgccccccatgttcgaacgttctgtgtaatccatccgagcctccaccaccacgccggctcaatatgactactgaacagtttaccggagaccacacacagcactttctcgatggtggtgaaatgaaagtcgagcagcttttccaggagtttggcaatcgcaaaagcaataccatacagtcggacggcatctctgactctgaaaagtgttcccccactgttagtcaggggaagagttccgactgtttaaatactgtgaaatctaatagcagcagcaaagcccccaaagtggtgccactcactcctgaacaggccttgaaacagtataagcatcatctgactgcctacgagaagctcgagataatcaattacccagagatctatttcgttgggcccaacgctaagaagcgccatggtgttattgggggtccgaacaacggtgggtacgacgatgctgacggggcatacatccatgtcccacgggatcacttggcttatagatacgaggtgctgaagattatcggaaagggctcttttgggcaggtggcccgggtttacgatcataagctcaggcagtacgttgcgctgaagatggtgaggaatgaaaaaagatttcacagacaggcggctgaggagataagaatcctggagcacctgaaaaagcaggataagacaggcagcatgaatgtgatccacatgctggagtcttttacatttagaaaccacgtgtgcatggcatttgaactgctgtccatagacctgtatgagcttattaagaaaaataaattccaaggcttcagtgttcagctggtgcggaaatttgcccagtctattctgcaaagcctggacgcactgcataaaaataaaatcatccactgtgatctcaagccagaaaacattctgctcaaacaccacggaaggtctagcaccaaggttattgacttcgggtcatcgtgcttcgaataccagaagctttacacatacatccagagtaggttttatagagccccagaaatcattctggggagtcgctacagtacccccattgatatctggagcttcggatgcatactagctgaacttcttaccggacagccgctgttcccaggggaggacgagggcgatcagctggcctgcatgatggaactgttgggcatgccaccccctaagcttctggagcaatctaagcgagcgaagtactttatcaattcaaagggcatccctagatactgctccgtgacaacccaggctgacggccgagtggtcctagtcggggggagatctcgccggggaaagaagcgtggcccacctggaagcaaggactggggaaccgctcttaagggctgcgatgactacttgttcatcgagttcctcaagagatgtctgcattgggacccatcggctaggctcactcccgctcaggccctccgacacccctggatttctaagagtgttccaaggcctttaacaacaatcgataaggtctccggcaagcgagtggttaaccctgctagcgcctttcagggattaggctcgaaacttcctcccgtcgtaggaattgcaaacaagctgaaagctaatttgatgtcagagacaaatggatccatccccctgtgttccgtgttgcctaaactgatctcttag

SEQ ID NO: 115160 - DNA, 1707 bp, Artificial Sequence
  Description of Artificial Sequence: Synthetic coding sequence
atgaaatggaaagaaaaattaggtgacggcgtctacgatacgttcatgatgattgatgagaccaagtgccccccctgctccaacgtactgtgcaatccttctgagcctcctccccctaggcgactcaacatgacaaccgagcagttcacaggcgaccatactcagcactttctggatggcggagaaatgaaagtggaacagctgtttcaggaatttggcaaccgcaaaagcaacaccattcaatctgacggtatcagcgactctgagaaatgtagccctaccgtgagtcaggggaaaagctccgattgtttgaacacagtgaagagtaattcctcttctaaagctcccaaggtggtgccactgactcccgagcaggccctcaaacagtacaagcaccaccttactgcctatgaaaaactcgagattattaattacccagagatttacttcgtcggcccgaatgctaagaagcgtcacggagtgattggcgggcctaataatggcggatatgatgatgcagatggagcctatatccacgtgcctcgcgaccatcttgcctatcggtacgaggtgctcaagattatcgggaagggttcctttggccaggtggctagagtgtatgaccacaaactcagacagtatgttgcacttaagatggtgcggaatgagaaacgttttcacagacaggcagccgaggagatccgcattttagaacacttaaagaagcaggacaagacaggatccatgaacgtgatccatatgttggaaagtttcacctttagaaatcacgtctgtatggccttcgaattactgagcatagatttgtatgaattaattaagaagaataaattccagggctttagcgtccagcttgttagaaaatttgcccaatccattctgcagtctctggatgccctgcacaaaaataaaataatccattgcgatctgaaacccgagaatatcctgctgaagcaccacggtcgctccagcaccaaagtgatcgacttcgggtcctcttgctttgagtaccagaaactatacacatacatccagagtaggttctaccgagcccccgagataatcttagggtcaaggtacagcacgcctattgacatctggtctttcggttgcattttagcagaattactcaccgggcagcccttgttccccggggaggacgaaggggaccaactggcgtgtatgatggagctcttaggaatgccgcctcctaaactgcttgaacagagtaagagagcaaagtactttatcaattctaagggaataccgcggtactgcagcgtcacaactcaggctgatggcagggtggtactggtcgggggccgcagtcggaggggaaagaagcgagggcccccaggaagcaaggattggggcactgccctcaagggttgtgacgactatttgtttattgaattcttgaaaagatgtttgcactgggatccatcagcgcgccttactcctgcacaagcattgagacatccctggatttccaagagcgtccctagaccccttaccacaatcgacaaagtgtctggtaaacgtgttgtgaatcccgcgtccgcttttcagggactaggctctaagctgcctcctgttgtgggcatcgccaacaagcttaaggctaaccttatgagcgagaccaatggctcaattcctttgtgttctgtattgccaaagctgatatcatag

SEQ ID NO: 115161 - DNA, 1767 bp, Artificial Sequence
  Description of Artificial Sequence: Synthetic coding sequence
atgggaggcaccgctcggggtcctggccggaaggatgcgggccccccaggagcgggtctgcctcctcagcagcggaggctcggagacggtgtgtatgataccttcatgatgattgatgagacaaagtgccctccttgttctaatgttctctgtaacccttccgaacctcctccccctaggagacttaatatgacaacagaacagtttactggagaccatacccagcactttcttgacggtggagaaatgaaagtggagcagctcttccaggaattcggcaataggaaatccaataccatccagtctgatggtattagtgactctgaaaagtgttctcccactgtcagccaaggcaaatcttcggattgccttaatactgtcaaatcaaattcctcctccaaagcccctaaggtcgtccccctaaccccagaacaggctcttaaacagtacaaacatcacttaactgcatatgagaagcttgaaatcataaattaccccgagatctacttcgtgggcccaaacgcaaagaagcggcatggtgttattgggggcccaaataatggagggtatgacgacgcagacggtgcctacatccatgtgccgcgggaccatttagcgtaccgatatgaagtcctcaagattataggcaagggtagtttcggccaggtggcccgcgtgtatgatcacaagttgagacaatacgttgccctcaagatggtgcgcaacgaaaagcgatttcacagacaggctgccgaagaaatcagaatactcgagcatctgaaaaaacaggacaagacaggcagtatgaatgtgatacatatgcttgagtccttcacctttcggaaccatgtatgcatggcctttgagctactatccattgatttgtacgaactcatcaagaagaataagtttcaggggtttagtgtgcagctcgtgcggaaattcgcccaatccattctgcagtctctggacgccctgcacaagaacaagataatccattgtgacctcaagccggaaaatatcttactgaagcatcatggtcgcagcagcactaaagtgatcgattttggctcaagttgcttcgaatatcagaagctgtatacctatattcaatccaggttctaccgggcaccagagataatccttggatcaagatactctaccccaatagatatctggagcttcgggtgcatccttgcggagctgctaacaggccagccactgttccctggggaggatgaaggtgatcaacttgcatgcatgatggagctgctcggaatgcctccacccaaattgctcgagcagagcaaacgggccaagtatttcatcaattccaagggaattccaaggtattgcagtgttaccacccaggcagacggcagagtggtgctagtgggtggtaggagtagacgtgggaaaaagcgcggacctccaggatccaaggactggggaaccgctctaaagggctgcgacgactacctgtttatagagttcctgaaacgatgcctgcactgggatccttcggcaaggctaacacccgcgcaggcactgaggcacccttggatcagtaagagtgttccacggccactgacgacaatcgataaggtgtccgggaagcgagtggtaaatccagcatctgccttccaaggcctgggcagcaaactgccccccgttgtggggatcgctaacaagctgaaggccaatctgatgtccgaaacaaatggtagtatccctctctgtagtgtgctgcccaaacttattagctag

SEQ ID NO: 115162 - DNA, 732 bp, Artificial Sequence
  Description of Artificial Sequence: Synthetic coding sequence
atgaagtggaaagagaagctgggagatggggtttatgacaccttcatgatgatcgatgaaaccaaatgtccaccatgttccaatgtgctgtgtaaccccagtgagcctcctccacccagacggctaaacatgactacagaacagttcactggagatcatacccaacacttcttggatggaggcgagatgaaagttgagcagctcttccaggaatttggcaacagaaagtcgaatactatccagtctgatggcatttccgactcagagaaatgctcaccaactgtatcccaggggaagtcaagtgactgcctgaacaccgtgaagagtaactcaagcagtaaggcaccaaaagtcgttcctctaacccctgagcaagcgctgaagcagtataaacaccatttgaccgcttacgagaagctcgaaattatcaattaccccgagatctatttcgtcggacccaatgctaagaagcggcatggggtcatcggcgggcctaacaacggcggatatgatgatgccgatggagcatatattcacgtgcctcgtgatcaccttgcctacagatacgaggtacttaagataatcggcaagggctctttcggccaagtagcgcgagtctacgatcacaagctccgccagtatgttgcactgaaaatggtgagaaacgagaagagatttcatcggcaggcagcagaagagatcagaattttggaacatctgaaaaaacagtag

SEQ ID NO: 115163 - DNA, 1563 bp, Artificial Sequence
  Description of Artificial Sequence: Synthetic coding sequence
atgccagcctccgagcttaaggcatcagagattccattccacccttcaatcaaaacgcaagaccccaaggcagaagagaaatcccccaagaagcagaaggtgacactcactgcagcggaggcccttaagctgttcaagaatcagctgagcccctatgagcagagcgaaatcctgggctacgccgaactgtggtttcttggcttggaagccaagaaattagacacggcacccgagaagttttccaagactagctttgatgatgagcatggcttttatctgaaggtcctacatgaccacatagcttatcgctatgaagttctggaaaccatcggtaagggatcatttggccaggtcgccaaatgcctggatcataaaaataatgagctagtagcactgaagataattaggaataagaagagatttcatcagcaagccctcatggagttgaaaattctggaggcactacgaaagaaggacaaagacaatacttataatgtcgtccatatgaaagacttcttttattttcgaaatcatttctgtataacattcgaactcctgggcataaatctgtacgagctaatgaagaacaacaatttccagggctttagcctatcgatcgtccggcgtttcacattgagtgtgcttaagtgtctccagatgttgagcgtcgaaaaaatcatccactgtgatttgaaacccgagaacatcgtcctgtatcagaagggtcaagcctctgtgaaggtgattgactttggaagttcctgttacgagcaccagaaagtatacacgtacattcagagtcgattctacagaagcccagaagtaatcctcggccatccttacgacgtggccatcgatatgtggagtctcggttgtattacagccgagctctacaccgggtatcctctttttccaggcgaaaacgaggtggagcagctggcctgcattatggaagtcctggggttgccacccgccggatttatccaaaccgcttcacgaagacagacgttctttgattccaaggggtttcctaaaaatattacaaacaatcgtggaaaaaagaggtacccggactccaaggatcttactatggtgttgaaaacctatgacacaagcttcctcgacttcctcaggcggtgccttgtttgggaacccagtttacggatgacccccgatcaggccctcaagcacgcgtggatacatcagagccggaatctgaagccccagcctagaccacagacgctgcgaaaatctaacagtttttttcctagcgaaactcgcaaagataaagtgcagggctgccatcattcatccaggaaagcggatgagattaccaaggagaccacggaaaagaccaaagattcacccaccaaacacgtacagcatagcggggatcagcaggattgtctgcagcacggcgccgataccgtccagttgccgcagctcgtcgatgcgccaaagaaatccgaagccgctgtgggcgctgaggttagcatgaccagccctggacaatcaaagaattttagccttaaaaatacgaacgtcctgcccccgatcgtttag

SEQ ID NO: 115164 - DNA, 1563 bp, Artificial Sequence
  Description of Artificial Sequence: Synthetic coding sequence
atgcccgcttcagagctcaaagctagcgagatccccttccatcccagcattaagacacaagatcccaaggcagaagagaagtcaccgaagaagcagaaggtgacactgacggcagctgaggctctcaaattgtttaagaaccagctgagcccctacgagcagtctgaaatcctaggatacgcagagctttggtttctgggcctggaagccaagaaactcgatactgcccccgagaaattcagcaagacttccttcgacgacgaacatggtttctacctcaaagtgctgcacgaccacattgcctaccggtacgaagttctggaaacaattggcaaaggatcgtttggtcaggtcgctaagtgcctggaccataagaataacgaattggtggctctgaaaattatcagaaacaaaaaaagatttcatcagcaggcactaatggagctcaagatcttggaggccctaaggaagaaggacaaagacaatacatataacgtagtacatatgaaggactttttctactttcgaaaccacttctgcataaccttcgagctgttgggtataaacctgtacgaactgatgaagaataacaattttcaaggattctctctttctattgttcggcggttcaccctctccgttttaaagtgcctgcagatgctctctgtggagaagattattcactgtgacctgaagcctgagaacattgtgctctaccaaaagggacaagccagtgtaaaggtcatagactttggcagttcctgttatgagcatcaaaaagtctatacctatattcagtctcgcttttatcgctctcccgaagttatcctagggcatccatacgacgtggcgatcgatatgtggagcctgggatgtatcaccgccgagttatacaccgggtatccgcttttccccggggagaatgaagtcgaacagctggcctgcattatggaagtgctcggtttgccaccggcaggctttatccagaccgcatcccgtagacaaacttttttcgactcgaagggctttcccaagaacataacgaataacagaggcaagaaacggtacccggattctaaggatctcaccatggtgctgaagacctacgatacttcttttctggatttcctgcgccggtgcttggtctgggaaccttccctgcgaatgacacctgaccaagcactcaagcatgcctggatccatcaaagtcggaaccttaagcctcagccaagacctcagacactgcgcaaatctaattcattctttccttcagaaacacgcaaggacaaggtgcagggctgccaccattccagccgcaaagccgatgaaatcaccaaagaaaccaccgaaaaaacaaaagactccccgaccaagcatgtgcagcactctggggaccaacaggactgccttcagcatggagccgacacagttcaactccctcaattggtcgatgcacccaaaaagtcagaggcggccgtaggagccgaggtgtctatgaccagcccgggacaaagcaaaaatttcagccttaaaaacaccaatgtgttacctcctattgtctag

SEQ ID NO: 115165 - DNA, 1560 bp, Artificial Sequence
  Description of Artificial Sequence: Synthetic coding sequence
atgccagcctcagagttaaaggcctcagaaattccctttcatcccagcataaagacccaggatcctaaagcggaagaaaagtctccaaaaaaacagaaagtcactttgaccgcggcagaggctctcaagttgtttaagaatcagctcagtccctacgaacagagcgagatcctgggttacgccgaactgtggtttttgggtctcgaggctaagaaactggataccgctccggaaaagtttagcaagacatccttcgacgatgagcacggcttttatctgaaagtactgcacgatcacatagcgtaccggtatgaagttctcgagacaattggtaagggatcattcggccaggtggctaagtgcctagatcacaagaataacgagctggttgctctgaaaattattagaaacaagaagcggttccatcagcaggcgttgatggagctgaaaatcctcgaagccctgcgcaaaaaggacaaggataatacgtacaacgtggtccatatgaaagacttcttctacttcagaaaccacttctgcatcacctttgagttgttgggaattaatctatacgagctgatgaagaataacaactttcagggattcagtctgtccattgtccgtagattcacactgtccgtgttgaaatgcctgcagatgttatcggttgagaagatcatccattgtgacctcaagcctgagaatatcgtgctttatcagaaaggacaggctagcgtgaaggttattgatttcgggtccagctgttacgaacatcaaaaagtgtacacatatattcagagcaggttctatcgttctcctgaagtaattctgggccatccctacgatgttgctatcgatatgtggtcgctcgggtgcatcactgctgagctatatactggctatccccttttccctggggaaaatgaagtggaacagcttgcctgtatcatggaagtgcttgggctaccgcctgctggctttatccagactgcctcgaggaggcaaaccttcttcgattccaagggtttccccaagaacatcactaacaacaggggaaagaaaaggtacccagacagcaaggacctaaccatggtccttaagacgtacgacaccagctttcttgacttcttgagaaggtgtttggtctgggagccatctctgaggatgaccccagaccaagccctgaaacacgcatggatccatcaatcaaggaatctgaagccacaaccaagaccacagaccttgcgcaaatctaactcctttttcccctctgagacacggaaggacaaggtgcaggggtgccaccacagtagtcggaaagatgagataaccaaagaaaccaccgaaaagaccaaagacagtcctaccaagcatgtgcagcattcaggggatcagcaggactgtctgcagcacggggccgacacagtgcagctaccacagttggtggatgctcctaagaagtctgaggctgccgtgggcgctgaagtcagcatgacctcccccgggcaaagcaaaaatttttctctcaagaacacgaacgttcttccgcccattgtttag

SEQ ID NO: 115166 - DNA, 474 bp, Artificial Sequence
  Description of Artificial Sequence: Synthetic coding sequence
atggtgctgaaaacatacgataccagtttccttgattttctgagaaggtgcttggtgtgggagcccagcctccgcatgacccccgatcaggccctgaagcacgcttggatacatcagtctcgaaatttgaaaccccagccccggccccaaacgctgcggaagtccaacagtttcttccctagtgagacccggaaagacaaggtgcagggctgccaccactcgtctaggaaggctgacgaaattacaaaggagacaactgagaaaaccaaggattcccccactaaacacgtgcaacatagcggtgaccaacaggattgccttcagcacggcgccgataccgtccagttacctcaacttgtggacgccccaaagaaatcagaagccgcagtcggagccgaagtcagcatgacttcccccggccagtcaaagaacttctctttaaagaacacaaatgtgttgccgcctatcgtgtag

SEQ ID NO: 115167 - DNA, 1011 bp, Artificial Sequence
  Description of Artificial Sequence: Synthetic coding sequence
atgggcaactgtcttcaccgagctgagctgtctccttccactgagaacagctctcagttagacttcgaggacgtctggaactcgagttatggggtgaatgattcttttcccgatggggactacggggccaacctcgaagccgcagcaccatgtcactcttgcaacctcttagacgactctgctctccctttcttcatactgaccagtgtgttgggtatcctggcctcttcaaccgttttatttatgctgtttaggcccctgttccggtggcaactgtgtcccggctggccagtattggcacaactggctgtgggcagtgccttgttctcaattgtggttcccgtgcttgcccctggcctggggtcgacacggagttcagctctctgcagtctgggatactgcgtgtggtacgggtcagcgttcgcacaagccttattgctggggtgtcacgctagcctgggccatagactgggagccggccaggtacccgggctgacactgggcttgactgtcggaatctggggggtggccgccctgctgaccctgcctgtgactcttgccagtggagcgtcaggcggtttatgtactttgatatatagtacagaactcaaggccctacaggctacacacacggtggcctgcctcgccatcttcgtgttattacccttgggcctcttcggagccaagggtctgaagaaggcgctagggatgggcccgggcccctggatgaacatcctctgggcctggttcatattctggtggcctcatggcgtggtgctgggtctggactttctcgtgcgttcaaagctgctcctgcttagcacctgtttagcccagcaagccctggacttacttctgaatctggctgaggccctcgccatcctgcactgcgtagcaacacccctcctgctcgccctcttctgccaccaggcaacacggacactgctgccaagccttccattacctgagggatggtccagtcaccttgacactctcggaagtaaatcctag

SEQ ID NO: 115168 - DNA, 1017 bp, Artificial Sequence
  Description of Artificial Sequence: Synthetic coding sequence
atggcctcctctgggtacgtactacaagcagagctatctccaagcacagagaattcctctcaactcgattttgaagacgtttggaacagtagctatggggtgaatgacagcttccctgatggggattatggcgccaacctggaagccgcggccccctgccattcctgtaatttactcgacgattctgcgctacctttcttcatcctgacttccgtgctggggatccttgcaagttcaactgtgctgttcatgctttttagaccactgtttcgatggcagctttgtccaggatggcccgtcctcgcccagctggccgttgggagcgccctattctccatcgttgtgcctgtgctggctcctgggctagggtccacgaggagtagcgcactctgtagtttgggctattgcgtctggtacggtagcgcatttgcccaggcattgctgttggggtgtcatgcctctctcggccaccggctgggggccggacaggtacctggcctcaccctggggctgaccgtagggatttggggagttgccgccttactcacccttccggtgacacttgcttcaggcgcgagtgggggactctgcacgctgatatattctacagaattaaaggcacttcaggctactcataccgtggcttgtctggcaattttcgtgctccttcctctcgggctcttcggggccaagggcttaaaaaaggcactgggcatgggaccgggaccctggatgaacattttgtgggcgtggtttattttctggtggcctcacggcgttgtgttgggtttggatttcctggttagaagcaagctgctactgctgtctacctgtctggcccagcaggccttagatttgctgctgaatctcgctgaggctctggcgattctgcactgcgtagcaaccccgttactgctggcacttttttgccatcaggcaacccgcacgctgctcccctcgctgccgctaccagaaggctggtccagtcacttagatactctcgggagtaagtcttag

SEQ ID NO: 115169 - DNA, 1011 bp, Artificial Sequence
  Description of Artificial Sequence: Synthetic coding sequence
atgggaaactgtcttcacagggccgagctgtctccatcaacagagaattccagccagcttgactttgaagacgtatggaacagttcctatggggtgaacgactccttcccagatggcgattatggagcaaacctcgaggccgcagccccttgccactcttgcaacctactcgacgacagtgctctgcctttctttatcttgacgagtgtgctcggtatactggcgtcctctaccgtactgttcatgttgtttagaccactgtttcggtggcagctgtgcccgggctggcctgttctagcccagttggcggtcggttccgcactcttctctattgtggtgcctgtgctggctccgggcctgggttcgactagatcgagcgccctctgtagcctaggctactgcgtgtggtacggctcagcgttcgcccaagccctcctcctgggttgccacgccagcttaggccaccgcctaggagctggtcaggtccccggccttaccttggggctgaccgtgggcatctggggcgtcgccgccctcctgacactgcccgtgaccctagcctccggtgcatctggaggactttgtactctgatatactcaacagagttgaaggctctccaggctacccatactgttgcttgtctggccattttcgttcttctgcctctgggacttttcggagccaaagggctgaagaaagcactgggcatgggccccggcccctggatgaacattctgtgggcatggtttatcttctggtggcctcacggtgtcgtgctgggcctcgatttcttggtcaggagcaaacttctcttattgtcgacctgtctcgcacaacaggctttggaccttctcctaaacctagccgaggctctggccattctgcactgtgtagcaacccccctgttgctggcattgttttgtcaccaggccactaggactctgctgcccagtctgccgctgcctgaaggatggtccagccatcttgacaccctggggtctaagtcctag

SEQ ID NO: 115170 - DNA, 468 bp, Artificial Sequence
  Description of Artificial Sequence: Synthetic coding sequence
atggcctcttccgggtatgttttgcaggctgaactgtccccttcgacggagaatagttcccagctagactttgaggacgtgtggaattcatcctacggagttaatgacagcttcccagatggggattatggcgccaatctggaggctgccgccccttgtcatagctgtaatctgctggacgatagcgctttgccattcttcatcttgacatcagtcctgggcatcctcgcatccagcacagtgctctttatgctgtttaggccactttttagatggcaattatgcccaggttggccagtgttggctcagttagccgtcgggtcagctctttttagcatcgtggtgccagtcctggcacctgggctgggctctacacggtccagtgcactgtgtagcctgggatactgcgtgtggtatggatccgcttttgctcaggcactgctgctggggtgtcacgcaagcttatag

SEQ ID NO: 115171 - DNA, 1011 bp, Artificial Sequence
  Description of Artificial Sequence: Synthetic coding sequence
atggggaactgcctgcacagagccgagttgagccccagtaccgagaactccagccagctcgactttgaggatgtgtggaacagttcttacggagtgaacgactcctttccagacggggactatggagcgaacctcgaagccgcggcaccatgccactcttgcaatctgcttgatgattccgcactcccatttttcatattaacgagtgtgctggggattctggcatcctctacagtgctgttcatgctcttcagacctctattcagatggcaattgtgtccaggctggccagtgctggctcagctggcagtgggatcagctttgttttctattgtagtcccagtcttggcccctggcctgggttctacccggtcctccgccctgtgttcgctgggctactgcgtttggtatggatcagccttcgcccaggcgctgctgctaggatgccacgccagcctcggccaccgccttggggcaggccaggttccagggctaaccttgggacttactgtggggatttggggggtggctgcgctccttacactgccagtgacgctggcgtctggggcatctggcggactttgcacgctgatttactctacagagctgaaagccttgcaggccactcatactgtcgcctgccttgccatctttgtattactccctctgggtctgttcggcgccaaaggcctcaagaaagctcttggaatgggtcccgggccctggatgaacattctctgggcctggtttatcttttggtggccacacggggttgtcctcggccttgattttctcgtgcgtagtaagttactgctgctgtccacgtgtttggcccagcaggccctggatctgctcctgaatcttgccgaagcactggcaattctgcactgtgtcgccacacctctgctgctagctctgttttgtcatcaggcaactcgcacattattgccaagcttgcccctgccagaagggtggtcttctcatcttgacacccttggctccaaatcttag

SEQ ID NO: 115172 - DNA, 2010 bp, Artificial Sequence
  Description of Artificial Sequence: Synthetic coding sequence
atggggagcaactcttcgcggatcggagatttgccaaaaaatgaatacctaaagaagttatctgggaccgaatctattagtgagaatgatccattctggaaccagctccttagctttagcttccccgcccctacctcgtcatctgagttaaaactgctagaggaggccaccatctctgtctgccgatccctggtggaaaacaacccccggacaggcaacctgggagccctgatcaaagtgtttctgtccagaacgaaggagctgaagctgtctgcagaatgccagaaccacatattcatatggcagacgcacaatgccctgttcataatctgctgtctgctcaaggtattcatctgtcagatgtctgaggaagagcttcagctgcactttacatacgaggaaaagtccccgggcaactatagctctgattccgaagatcttctggaggaactgctgtgttgtttaatgcagctgatcacagacattccgctcctggatatcacgtatgagatttctgtagaggcaataagtacaatggtggtgtttctttcttgccagctgtttcataaggaagtgttacgacagagcatttcacacaaatatctgatgaggggcccctgcctcccttacacatctaaactcgttaagactctgctttacaactttatacggcaggaaaaaccaccgcctccaggtgcccatgtctttccccaacaatctgatggcggtggattactctacgggcttgcgtcaggtgtcgcaaccgggctgtggactgtttttactctcggaggcgtggggagtaaagcagctgccagccccgagttatccagccctctggctaaccagagcttgctgctcctgttggtgctggcaaacctgacggatgcatccgatgcacccaatccctatcggcaggccattatgagtttcaagaacacccaggatagcagtccattcccttcctcgattccccacgcttttcagatcaactttaattccctgtacactgctctctgtgagcagcaaacctcggatcaagccactctgctgttgtacacccttcttcatcagaacagtaacatccgaacttatatgcttgccagaaccgatatggagaatctggttcttcctattctggaaattctgtatcatgtggaagaaaggaattcacaccacgtgtatatggctctcatcatcctcttgatcctgactgaagacgatgggttcaataggtccattcatgaagtcattctcaagaatatcacctggtacagcgaacgggtgctcaccgaaatttcgctcggtagcctgctcattctggtggtcataaggactattcagtacaacatgacccgcaccagagacaaatatcttcacacaaactgcttggccgctttggcgaatatgtctgcccagttccggtcactccaccaatacgctgctcagcgcatcatctccctttttagcctgctgtcgaagaaacacaacaaggtgctggaacaggcaacccagagtttaagggggtccctgtccagtaacgatgtgcccctcccggactatgctcaggacctgaacgttatagaagaagtgatccggatgatgcttgagatcataaacagttgtctcacgaattcacttcatcataacccaaacctggtatacgccctactttacaagcgagatttattcgagcagttcagaacacacccctccttccaggatattatgcagaatatcgatctggtgatttccttcttctcatctcggcttctccaagcaggagctgagctcagtgtggagagggttctggagataatcaaacaaggcgtcgtggccctgcccaaggacagactcaagaagttccccgaactgaagttcaagtacgtggaagaggaacaacccgaagaattctttatcccgtacgtgtggtcgttggtctataattccgccgtgggcttgtattggaatccccaggacatccagctgtttactatggactcggactag

SEQ ID NO: 115173 - DNA, 519 bp, Artificial Sequence
  Description of Artificial Sequence: Synthetic coding sequence
atggctctgatcatactcctgattttaaccgaggacgacgggttcaaccggtctattcatgaagtaatcttgaagaatattacttggtactctgaacgggtgcttacggaaatctcccttggctccctcctgattttggtggtgattaggacaatccaatataacatgacccgaacacgtgacaagtatttgcacactaattgtctggcagccctggcaaatatgagtgctcaattcaggtccctccaccagtacgccgcacagcgaataatctcctacacatgtcggcacttgcggcgatacgtttatgtcttggacaagctctacttcccccactctcattgttccaccctgcaacactgtttcagcactctgtcagataacggtgaagaactgttgtctctgacatgtagccacattctgaggtcatacgctagctcacttttcagtttgctatcaaagaagcataataaggtcctggaacaggcaacgcaaagcctgcgcggatctctaagctag

SEQ ID NO: 115174 - DNA, 1440 bp, Artificial Sequence
  Description of Artificial Sequence: Synthetic coding sequence
atgggatctaattcgtcaagaattggagacctccccaagaatgagtacctaaagaaattgagtgggaccgaaagcatcagtgagaatgaccccttctggaaccagttgctatcattttcgtttccagcgcccaccagttctagcgagctcaagttgttagaggaggccaccatcagcgtgtgccggtcgttggccggcctttggacggtttttactctgggaggtgtcggctcgaaagccgcggcatctcccgaactgtcaagccccctggcgaatcagagcctgctgctgctccttgtgttagccaacctcacggatgcaagcgatgcacctaacccttacaggcaggctatcatgagctttaagaacacacaagactcctcacccttcccaagcagcatccctcacgcttttcaaattaactttaatagcctttacaccgctctttgtgagcagcagacttctgaccaagctacactgctgctgtatactctgctccaccagaatagtaacatccgcacgtacatgctcgcacgaacagacatggagaacctggtgctgccaatcttagagatcctgtatcacgtcgaggaacggaattctcaccacgtttacatggcgctcataatactgcttatcctgaccgaagacgacgggttcaacaggtcaatccacgaggtcatacttaagaacatcacctggtactcagagagagttcttaccgagataagccttggctccttgctgattcttgtggtcatccgtaccattcagtacaacatgacccgcacccgtgataaatatttgcacactaattgtctcgccgccttggccaacatgagtgcccagtttcgatcccttcatcaatatgccgctcaaaggataattagtctgttctctctcttatcaaaaaagcataataaggtactggaacaggcaacgcaatcactccgagggtctctgtcctccaacgacgtgcccttacctgattacgctcaggacctgaacgttatcgaagaagtcatacgaatgatgttggaaattatcaattcatgtctgactaattctctccatcacaatccaaatttggtgtatgccctgctatacaagagggatcttttcgaacagttccgcacccaccctagcttccaagatatcatgcagaatatcgacctggttatctcctttttcagtagtcgcttattgcaagcaggggccgaactttccgtcgaacgcgtgctggagattataaagcagggagttgtggccttacctaaagatcgcctgaaaaaatttccagagctgaaatttaagtacgtcgaagaagaacagccagaggaattctttattccctacgtgtggtcactggtttacaatagtgctgtgggcctctattggaatccccaggacattcagttattcactatggatagtgactag

SEQ ID NO: 115175 - DNA, 3837 bp, Artificial Sequence
  Description of Artificial Sequence: Synthetic coding sequence
atggcccaatctaagaggcacgtatatagcagaactccttctggtagtagaatgtctgcagaagcctcggctcgccctctccgagtgggcagccgcgtcgaggtgatcggaaaaggtcaccggggaacagtcgcctacgttggcgcgacattgtttgcaaccggcaaatgggtaggggtgattcttgatgaggctaaaggcaagaacgacggtaccgtgcagggacggaagtatttcacttgcgacgagggtcatgggattttcgtgcggcaaagccaaattcaggttttcgaggacggggcggataccactagtcccgagacccctgattcctcagcttctaaggtgctgaaacgagagggcaccgacactactgcaaagactagtaagcttcgtggcctgaaacctaagaaggcacccacagcgcggaagacaactactagacgaccaaagccaacaaggcccgcaagtacaggtgtggccggtgcttcttcctcgttgggtcccagcgggtcagccagtgctggagagttgtcgtcgagcgagccatccacaccagctcaaacaccactcgccgcccccataattcctacccctgttctgacaagtcctggcgccgttccacctcttcccagccctagcaaggaggaggaggggctccgcgctcaggtccgcgaccttgaagaaaaactggagacccttcgcctgaaacgcgctgaggataaggcgaagttgaaggagcttgagaagcacaagattcagctcgagcaagtgcaggagtggaaatccaaaatgcaggagcagcaagccgacctgcagcggcgtcttaaggaggctcgtaaggaagctaaggaagcactggaggccaaagaaagatatatggaggaaatggctgataccgctgatgctatagaaatggcgaccctggacaaagaaatggccgaagaaagggccgaatccctgcagcaggaagtggaagctttgaaagaacgtgtcgatgagcttactacagatctggagatcctgaaggctgaaatcgaggaaaaaggcagcgatggggccgcgagttcctaccagctgaagcagctcgaggagcagaatgcccggctcaaggacgccttggtcaggatgcgggacctgagttcttccgaaaaacaagaacacgtgaagctccagaaactgatggagaaaaaaaatcaggaattggaggtcgtccgacagcaaagggagcgcctgcaagaggagctgagccaggcggagtccaccatcgatgagctcaaggaacaggtcgacgccgcattaggagcagaggaaatggtagagatgctgaccgaccggaacctcaacctggaggaaaaggtgagagagctgcgtgagaccgtgggagacttggaggccatgaatgagatgaatgatgaactgcaggagaacgctcgggagacggaacttgagctgagggaacagttagatatggctggggcacgcgtacgcgaggctcaaaaaagggtggaagccgcccaggagaccgtagcagattaccagcaaaccatcaaaaagtacaggcaactcaccgctcacctgcaggacgtcaaccgggagctgactaatcagcaagaggcaagcgtggagcggcagcagcagcccccacccgagacatttgattttaagataaaattcgccgaaaccaaagctcacgccaaagcaatcgagatggagttacgtcagatggaagtggcccaagccaatcgtcacatgagcttactgacagcgtttatgcccgattccttcctgcggccagggggagatcacgactgcgtgttggtcctgctcttaatgcccagactgatctgtaaggccgagctcatcagaaaacaagcccaggagaaattcgaattatccgagaattgcagtgaaaggccaggcctgaggggggctgcaggtgagcagctcagctttgcagccggcctggtttattccctgagcctcctccaggcgacactccaccgctacgagcacgcactatctcagtgctctgtggacgtgtacaaaaaggtcggctccctctacccagagatgtcagcgcacgagcgatcactcgattttctgatcgagttgctgcataaagaccagttagatgaaacggttaatgtggagcctcttacaaaagccatcaagtactaccagcatctttactccatccacctggctgagcaaccagaggactgtaccatgcagctggctgaccacatcaaattcactcagagcgcacttgactgtatgagtgtcgaagtaggaagactgagagcatttctacaaggggggcaggaagcaacagatatagcacttttgcttcgggacttggagacgtcatgctctgacattagacagttctgcaagaagatcaggaggcggatgcctggcactgacgcaccaggcatccccgccgccctggccttcgggcctcaggtatccgacacactactcgattgcagaaagcacctgacttgggtggtggccgtgctgcaggaagtcgccgccgccgctgcccagttgatcgcccccctcgctgagaacgaaggccttcttgttgcagctcttgaggaactggctttcaaggcctccgaacagatttacggtacgccctccagcagcccttacgagtgcttacggcaaagttgcaatattttgatctccaccatgaataagctggcgaccgcgatgcaggagggcgagtacgacgccgagcgccctccgtcaaagcctccgcccgtggagctcagggccgcagctctccgagcggagataacagatgccgagggtctggggctgaagctggaagaccgcgagaccgtgatcaaggaattgaaaaagagcctgaagatcaaaggagaggagctgtcggaggctaacgttcggcttagtctgctcgagaaaaaactcgattctgcagctaaggacgccgacgagcgtatcgagaaagtacagacgaggttggaggaaactcaagccctgctgagaaagaaggagaaggagttcgaagaaacgatggacgctctacaggctgatattgatcagttggaagcggaaaaagcggagttgaaacagaggttgaatagtcagtccaaacgcaccatagaagggctgagaggccctcccccgagcggaatcgccaccctggttagcggcattgccggcgaagagcagcagcgcggcgcaatacctggacaggctcccgggagtgtccctgggcctgggttggtaaaagatagtcccctgctgctgcagcaaatttctgcgatgagactgcacatctctcagctgcagcatgaaaactccatcctcaaaggagcccagatgaaggctagtctggcctccctgcccccccttcatgtcgccaagctgtcccatgagggccctggaagcgagctgcccgccggcgccctctacaggaaaaccagccagttgctggagaccctgaaccaactatcaacacatacccacgtggtggatataacccggacgtctcctgcggccaaaagtccctcagcacagctgatggagcaagttgctcagctaaaatccctgagcgatactgtcgagaagctgaaggacgaggtcctgaaagagacagtgtcgcagagacccggagcaactgtgccaaccgacttcgctactttcccctcatctgcattcctgagagcaaaagaagaacaacaggacgacacggtgtatatgggtaaggtcacattctcatgcgctgccggcttcggccagcgccacagactggtcctgacccaggagcagttgcaccagttacacagcaggctgatctcttag

SEQ ID NO: 115176 - DNA, 3786 bp, Artificial Sequence
  Description of Artificial Sequence: Synthetic coding sequence
atgtctgcagaagcctccgcgaggccactcagggttggatcaagggtcgaagttatcggcaaggggcaccgcggaactgtagcctacgtcggcgccacactatttgccaccggtaagtgggttggcgtcatccttgacgaggcgaaagggaagaatgatggtactgtacagggacggaaatatttcacctgtgatgaagggcacggcatctttgtgaggcagagtcaaatacaagtgtttgaggatggggccgacacgacgtcccccgaaaccccagattctagtgccagcaaagtgctgaaaagggagggtacagacaccacagccaagacctctaagctacgaggtctgaagccaaagaaagcacctaccgcccggaagggtaggagggtgcgaacgaagccaacccggcccgcttccactggtgtggcgggagcttcttcatctctcgggcctagcggatccgccagtgcgggggagttgagtagtagtgaaccgagcactccggcacagacgcctctcgccgctcccattataccaacccctgtcctgacctcaccaggcgctgtgccacccctgccttccccctccaaggaagaggaaggactcagggcccaggtgcgggatctggaggaaaaattggagactctccggcttaagcgcgccgaggacaaagccaaattaaaggaactggagaaacacaaaatccagttggaacaggtgcaggaatggaagtccaagatgcaggaacaacaggcagatctccagcggcgcctgaaagaagcccgaaaagaggccaaggaggccctcgaggcaaaggaaagatatatggaagagatggccgacaccgcagatgcgattgagatggctacactggacaaggagatggctgaggagagagcagagtcccttcagcaggaggttgaagctctgaaagaaagggtggacgagttaacaaccgatctggagattctcaaagccgaaatcgaggaaaaagggtccgacggggctgccagctcttatcaattgaaacagctggaggagcagaatgcacgtctgaaagatgcgttggtgagaatgagagatctttccagttcagagaagcaggagcacgtaaaactgcagaaacttatggaaaaaaagaatcaggaactcgaagtggtgaggcaacaaagagagaggcttcaggaggagttatcacaggctgaaagcactatcgatgagctgaaagagcaggttgatgccgctctgggtgccgaagaaatggtcgagatgttgactgacagaaatctcaaccttgaggaaaaggtgagagagctgcgagagactgtgggagatctggaggccatgaatgagatgaacgacgaattacaggaaaatgcccgagaaaccgaactagaattgagggagcagttagacatggcaggggcgcgagttcgcgaagcccaaaaaagagtggaagctgcacaggaaaccgtcgccgactaccaacagacgatcaaaaagtaccgtcagctgaccgcccatctgcaggacgtgaatagagagctcacaaatcaacaggaggcaagtgtcgaacgccaacagcagccaccacctgaaactttcgactttaaaattaagtttgctgagacaaaagcccatgcaaaagcaattgagatggagctccgccagatggaagttgcccaagccaaccgccatatgtcccttctgactgctttcatgcctgactcgttccttcgccccggcggagatcatgactgcgtacttgtgcttctgctaatgcctcgcctgatctgcaaggcggaattaattaggaaacaggcgcaggagaagttcgagctgtccgaaaactgttcagagcggcccggcctgcggggcgccgctggagagcagctgtcatttgccgcagggctggtttacagcctatctctgctccaggccacgttgcacaggtatgaacacgccctctctcagtgttcagtggacgtctataaaaaggtaggctccctttacccagaaatgtccgcccacgaaagatccctggattttctgatcgagctgttgcacaaggaccagcttgacgagacagtcaatgtggagcccctaactaaagccattaaatattaccagcacctctactctatccacttagcagagcagcccgaagactgcacaatgcagctcgccgaccacatcaagtttactcagtcggcacttgactgcatgtctgtggaggtgggcagactgcgtgcctttctgcaaggtggacaggaagcaacagatatcgctctgttgctgcgcgacttggagacatcttgcagtgacataaggcaattttgcaaaaagattcgaagacggatgcctggaacggacgccccgggaattcctgctgccttagcgtttgggccccaggtaagtgacacactgcttgattgtagaaagcacctcacgtgggtcgttgcagttctgcaggaagtcgccgctgccgctgctcaattgatcgctcctctggctgagaacgagggcctgttggtcgccgctctggaagagcttgccttcaaggcctccgaacaaatttacggtacgccgtcttcctctccgtatgaatgcctcagacagagctgtaatattttgatcagtaccatgaataaacttgctactgccatgcaggaaggggagtacgacgccgagaggccaccaagtaagcccccacccgtggaactgcgcgctgcagcgctgcgggctgagattactgatgccgagggactgggccttaagcttgaagaccgcgaaaccgtgatcaaagagttgaagaagagcctaaaaattaagggagaggagctgagcgaggcaaacgtgcgcctgagtctgttggagaagaaactggattccgcagccaaagacgcggacgaaaggatcgaaaaggttcagacgcggttggaggaaacccaagcccttttgcgcaagaaagaaaaggagtttgaggagaccatggatgcgctgcaggccgatatagaccaattagaagccgaaaaggcagagctgaagcagaggcttaacagccagtctaaacgtaccattgagggtttgagaggcccccccccgagcggcattgcaaccctggtgagcggcattgctggagaggaacaacagagaggcgcaatcccaggccaggctcctgggtccgtcccaggaccggggctggtgaaggacagccccctacttcttcagcaaatcagcgccatgagactccatattagtcaactccagcacgaaaactcaatcttaaaaggagcccagatgaaagcatcccttgccagcctccctcccttgcatgtggctaaattatcacatgaagggccaggtagcgagttgcccgccggcgctttgtaccgtaagacttctcaattgctggagacgctgaatcagctctcaactcatacccatgtggtagatataactagaacctctcctgccgccaagagtccatccgcgcagctgatggagcaggttgcgcagctgaaatccctgagcgacaccgtagagaagctgaaggatgaagtcctcaaggaaacggtatcgcagcgacctggcgctacagtgccgacagacttcgccacatttccctcttcggctttcttgagagctaaggaagagcagcaggatgatacagtatacatgggcaaggtgacctttagttgtgccgccgggtttgggcaacggcataggttagtgttaactcaggaacagcttcaccagttgcatagccgcttgataagctag

SEQ ID NO: 115177 - DNA, 3816 bp, Artificial Sequence
  Description of Artificial Sequence: Synthetic coding sequence
atggcccaatcgaaacgtcacgtgtattcccggacaccgtcagggtcccgcatgtccgcggaggcaagcgctagacccctgagagtagggtcgcgcgtcgaagttatcggaaagggccaccggggaactgtcgcctatgtgggcgctactctgtttgctaccgggaagtgggtgggggtaatcctggatgaggccaagggtaagaatgatggaactgtgcaaggtagaaagtacttcacctgtgacgaagggcacggcatcttcgtgaggcagtctcagatacaggtgttcgaagatggcgctgatacaacctctccagagacgccagattcatcagcatcaaaagtgcttaagcgagaagggacagacacaaccgcgaaaacctctaaattggcccccacagccaggaaaaccaccacaagacggccaaaacccactcgtcctgcatctaccggtgtggccggtgccagttcatctctgggacccagtggttctgcttccgctggggagctctcatccagcgagccctccacccctgctcagactcctctggctgcacccatcattcctacccctgtgctgacttcgcctggggctgtgcctccattaccctctcccagtaaagaagaagagggcctaagggcgcaggttagggatcttgaagaaaaacttgaaaccctgcgcctgaagcgggctgaggataaggcaaagctgaaggagcttgagaaacataaaatccaactagaacaagtacaggagtggaaatcgaagatgcaggaacagcaggccgaccttcagagacggctgaaggaggctcgcaaagaggctaaggaggctctggaagctaaggagcgatatatggaagagatggccgacactgccgatgccattgagatggctactttagacaaggaaatggccgaggaacgcgctgaaagcctacaacaggaggtcgaggcgctgaaggagagggtagacgaactgacaactgacttggaaattttgaaagcagagattgaagagaagggctccgatggcgcagcctcctcataccagctgaagcagctggaagagcagaacgctagattgaaggacgcgctggtccgtatgagggatctttcttcttctgaaaaacaggaacacgtcaaattgcagaagctgatggaaaagaagaatcaggaacttgaagtggtccgccagcagagagaacggctacaggaagaattaagtcaggcggagtcaaccattgatgaacttaaggaacaggttgatgcagccttgggggccgaggagatggtggaaatgctcaccgaccgtaacctaaacctagaggaaaaagtacgcgagttgcgcgaaaccgtgggagatttagaagcaatgaacgaaatgaacgatgaactgcaggagaacgccagggagactgaactggagctgcgcgaacagctcgatatggcaggtgccagagtgcgagaagctcagaagagagtcgaggctgcacaggagaccgtggccgactaccaacagacaatcaagaaataccggcagctgacggcccacttgcaggatgtaaaccgcgaactgactaatcaacaagaggccagtgtcgaaagacagcagcaacctccccctgaaacatttgactttaaaataaaattcgccgagacaaaggctcacgcaaaagccattgagatggagcttcggcaaatggaggtagcccaagcaaaccgacatatgtcattattaaccgccttcatgcctgacagcttcttgcggcctggcggcgatcatgattgcgtcttagttttgctgctgatgccaaggctcatctgtaaagccgagctgatcagaaaacaagcacaagagaagtttgaactgtcggagaactgcagcgaaagacccggtctgcgtggcgccgctggtgagcagctttccttcgctgctgggctggtgtatagcctgtcactcctgcaggcaaccttacaccggtatgagcacgctctctcccagtgttcagtcgacgtgtacaaaaaggttggttccttgtaccccgaaatgtctgcgcacgagcgatcactggactttcttattgagctgctgcataaagaccagttggatgagaccgtgaacgttgagccgttgaccaaagctataaaatactaccagcatctctatagcatacatctcgccgaacagcctgaagactgcaccatgcaattagccgaccatatcaagtttacccagtctgcactcgattgtatgtctgtggaagtggggcgcctgagggcctttctccaaggcgggcaagaggcgaccgatattgccctgcttctgcgagatctcgagacttcgtgttccgacatcaggcagttttgcaagaaaattcgccgcaggatgcccggtaccgatgctcccggcatccctgcagcactcgctttcggaccacaagtgtcagatactttgttggactgtcgcaaacacctaacttgggtcgtggccgtgttacaggaggtggcggccgccgctgcccagttgattgctcctctcgccgagaacgaaggccttctcgtagctgccctagaggagcttgccttcaaggcaagcgaacaaatttacgggacacccagctcctccccttacgaatgtctcagacagagctgtaatattctaatttccacaatgaacaagctggctacagctatgcaggaaggtgagtatgatgcagaacggcccccaagcaaacctccacccgtggaactacgtgccgctgcgctgcgggcggagataacagatgccgaagggcttgggctgaaactggaggatcgggaaacggtcatcaaggagctgaagaagtccctaaagattaaaggagaagaactctccgaagccaatgtgcggctgagtctattagagaagaaattagactccgctgccaaggacgccgatgaacgcatcgaaaaagttcagacaagacttgaggaaacacaggccttgctcagaaaaaaggagaaggaattcgaggagacaatggatgccctgcaggctgacatcgatcaactggaggccgaaaaagcagaactaaaacaacggctgaacagccagtctaaaagaactatcgaaggcctcaggggacccccaccttccggtatcgccacccttgtatctggaatcgctggcgaagagcaacagagaggcgctatccctggacaagcccccggatcagtgcccggacccggtctggtgaaagatagtcctctcctgctgcagcagatttcggctatgcgcttacacatctcccagctccagcatgagaattcaatcctgaagggcgcccagatgaaagcttccctggcaagccttccacctctccacgttgccaagttatctcacgagggtcccggaagtgaacttcctgccggcgccctataccggaaaacaagtcagctgttggagacactaaaccagctgagcactcacactcatgtcgttgatataacacggacgagcccagctgctaaatcccctagcgctcaacttatggaacaagtcgctcagcttaagagcctttctgacacagttgaaaagttaaaagacgaggtgctaaaagagaccgtcagtcagagacccggcgcaactgtcccaaccgattttgccactttccctagctccgcctttctgcgagctaaggaagaacagcaggatgacaccgtgtacatgggtaaggttaccttttcctgtgctgcaggattcgggcagagacatcgtctggtgcttacccaggaacagctacaccagttgcactcgcgcctgatatcatag

SEQ ID NO: 115178 - DNA, 3435 bp, Artificial Sequence
  Description of Artificial Sequence: Synthetic coding sequence
atgatgcgacaagcgcccactgcgaggaaaaccacaacccgtcggcctaagcccacaagacccgctagcaccggagtcgctggggcttccagctctctgggcccgtcagggagtgccagcgccggcgagttgagcagcagcgagccctccacccccgcacaaactcctctggccgccccaatcataccaactccagtgctgacgtccccaggtgccgtgcccccattgccctctccctcaaaggaggaggaggggttgcgcgctcaggtgagagatttggaagaaaagcttgagaccctcaggctcaagagagccgaggacaaagccaaattgaaggaactggagaaacacaaaattcagctggaacaagtgcaggagtggaaatcaaagatgcaggaacagcaggcagacttgcagaggcggttgaaggaagctcggaaagaagctaaggaggcactggaggccaaagaacgctacatggaggaaatggcggataccgccgacgcaattgagatggcgaccctggataaggagatggctgaagaacgagctgagtcattgcagcaggaggtagaggccttgaaggaacgcgtggatgaactcaccactgacctggagatccttaaggccgaaattgaggaaaagggctcagatggagctgcaagttcctatcagttgaagcaactggaagaacagaatgcccgattgaaagacgctctggtgaggatgcgcgatctgagctcgagcgaaaagcaagagcacgtgaagctgcagaaactcatggagaaaaagaatcaggaactcgaagtagttcgccagcagagggaaaggcttcaggaagaactcagccaagcggaaagcactattgatgagctgaaggagcaagtcgatgctgccttaggtgcagaggagatggttgaaatgctgaccgatagaaatctgaatctggaggagaaggtgcgggagttgcgcgagacggtgggggatttagaggccatgaatgaaatgaacgatgagctgcaggagaacgctagagagaccgaactggaactacgagaacaactcgatatggctggcgcaagggttcgagaagcccaaaagcgggtagaggccgcccaggagaccgtcgccgactaccaacagacaattaagaagtaccggcaacttaccgcccacctgcaggatgtgaaccgggagctaactaaccagcaggaggctagcgtggagagacagcagcaaccaccaccagaaaccttcgattttaagataaaatttgccgaaactaaagcgcatgctaaggcgatcgaaatggaactgagacagatggaagtggcacaagcaaatcggcatatgtcactccttacggccttcatgccagactcgtttctcagaccagggggtgatcacgattgtgtcctggtgcttctgctgatgcccaggttgatttgcaaggcggaactgattcgtaagcaggcccaggaaaagttcgaactttcagagaactgctcggagcgaccaggcctgcggggagctgctggagagcagttgagcttcgcagctgggcttgtgtactccctatccctgctacaggccacccttcacaggtatgaacatgcgttatcccagtgctcagtcgatgtctacaaaaaagttggctccctctatcctgaaatgtctgcacatgaacgctcactggattttctgattgagctcctccataaagatcaattggatgaaaccgtgaacgtcgaaccgttgacaaaagcgattaaatattatcagcatctgtattcgatacacctggcagaacagcccgaagattgtactatgcagctcgcagaccatattaaattcacccagagcgccctggattgtatgtcagtcgaagtgggtcgactgagggcctttctccagggcggtcaagaggcaactgatatcgccctgctgctccgcgatcttgagacatcatgctccgatatcaggcagttctgtaaaaagattaggcgcaggatgccaggcaccgatgcacctggcattccagctgcactcgctttcggtccccaggtgagcgacacactcttggactgtagaaaacacctgacctgggtggttgctgtcctgcaggaagtggcagcagctgccgcccagcttattgcacccctggcagagaatgagggacttctggtagcagcacttgaggaattggcgttcaaagcctctgaacagatttatggtacaccctcctcatctccatacgagtgtttacggcagtcgtgtaacattctgatctccacgatgaataaactcgctactgctatgcaagagggggagtacgatgccgagaggccaccctccaaaccgccccctgtggaactcagagcggcggccttgagggccgagattacagatgcggaaggcctcggactgaaactggaagatcgggagacggtcataaaggaattgaagaagtccctgaaaataaagggagaggaactgtccgaagctaatgtgcgcctctctctcttagagaagaagttggactcagctgcaaaggacgctgatgaaagaattgaaaaagtacagacccgtctggaggaaacacaggcgcttctccggaagaaggagaaggaattcgaagaaacaatggacgctctgcaggctgacattgaccaactcgaggctgagaaagctgaactgaagcaacgtctcaacagtcagtccaagaggacaatcgagggtttgcgggggccgccacccagcggcattgccaccctcgtcagcggcatcgcaggcgaagagcagcagagaggcgcgattcccggtcaagcacctggaagcgtgccaggacctggcctcgtcaaagattcacctctcctgctgcagcagatcagcgctatgaggctgcacataagccagctgcagcacgagaacagcatacttaagggggctcagatgaaggcttctttggcatccctccctccactgcacgtcgccaaattatcccacgagggaccggggtcagagctccccgcaggggccctgtataggaaaacctcccagctgctggagaccttgaaccagctgtctacgcatacgcatgtggtggatatcacccgcacctcccccgcagccaagtcaccttcagctcaattgatggaacaagttgcccagctcaagtccctgagcgacactgtcgagaaactcaaggacgaggttctgaaagagacagtatctcagagacctggcgccaccgtcccaaccgatttcgctactttccctagttctgcgttcctgcgtgctaaggaggagcagcaggacgacactgtgtacatgggtaaagtgaccttctcatgcgcagccgggtttggacagcgtcataggttagtactgactcaggaacaattgcatcagctgcactcgcggctgatttcatag

SEQ ID NO: 115179 - DNA, 3771 bp, Artificial Sequence
  Description of Artificial Sequence: Synthetic coding sequence
atgtccgcggaagcctctgcgagacctcttcgcgtgggatcaagagtagaggtgatcggcaagggccacagggggaccgtggcttacgttggcgccacattgttcgctacagggaaatgggtcggggtgattctggacgaggcaaagggtaagaacgacgggacagtgcaaggtcgcaagtactttacttgtgatgaaggccacggaattttcgtgcggcagtcacagattcaggtgttcgaggacggagctgacactacttctcctgagacgcccgactcttctgccagcaaagtcctgaagcgcgaaggcacagacacaacggccaagacctcaaagctgagaggattgaagccaaagaaggcaccaacagccaggaagaccacgacacgcaggcccaaaccaacgcgccccgcgtctactggcgtggccggtgcctccagttccctcggtccctctggtagtgcctcggccggtgaactcagctcgagtgagccctccacccccgcacagactcccctcgcagcccctatcatacctacacctgttctgacttctccgggcgctgtgccacctctgccatcaccatctaaggaggaggagggcctgagagcacaggtgcgggatttggaagagaaactggaaaccttgcgcctgaagcgtgccgaggacaaggcaaagctgaaggaacttgaaaagcataagatccagcttgagcaggtgcaggagtggaaatctaagatgcaggagcagcaagcagacctgcagcgaagactcaaggaagctcgcaaagaggctaaagaagcgttagaggccaaagagagatacatggaggaaatggccgacacagcagatgccatcgagatggcgactctggacaaggagatggctgaggagcgggccgagagcctccagcaggaggtggaagcgctaaaagagcgtgtcgacgaattgaccacagacttggaaattctgaaggccgaaatagaggagaaaggaagtgatggagcagcctcttcttaccagcttaagcagctggaagaacagaacgctaggctgaaggatgccttggttcggatgcgtgatttaagcagctctgaaaaacaggagcacgtgaaattacagaagcttatggagaagaagaaccaggaactggaagtagtgcggcagcagagagagcgtctccaagaggagctgtcccaggctgagagcacaattgacgagctcaaagagcaggtagacgccgctttgggggcagaggagatggtggagatgctgacagaccgaaacctgaacctggaagagaaggtgcgggaacttagggagacggtcggagatctcgaggccatgaacgaaatgaatgacgagcttcaggagaacgcccgcgaaacggagttggaactgcgcgagcagttagatatggccggggcccgagtgcgtgaagcccagaagcgagttgaagccgcacaggaaacagtggccgactatcagcagactattaagaagtaccggcagttgacggcacatctgcaagatgtaaatcgtgagctcaccaatcagcaagaagcatccgtggagcgccagcagcagcccccccccgaaaccttcgacttcaaaatcaagtttgctgagacaaaagcacacgccaaggctattgaaatggaacttaggcaaatggaggtagctcaggcaaatcgtcatatgtccttacttaccgcctttatgcccgacagtttcctccggcccggcggggaccacgattgcgtgttagttctgctgctcatgcctcggctgatctgcaaagcagagcttatcaggaaacaggcacaggaaaagttcgagctaagtgaaaactgttctgagcggccaggcctgaggggcgcagccggggagcagctgagctttgccgctggacttgtgtactctctgtctctgcttcaagctacactgcacagatatgagcacgccctgtcacagtgctctgtcgatgtgtacaaaaaagtcggcagtttatatcccgaaatgtctgcccatgaacggtccttagactttctgatcgagctgctgcataaagaccaactggatgaaaccgtgaacgtggaacctctcactaaggccatcaaatactaccaacacctgtattccatccacctggcagagcaacccgaggactgcacgatgcagctcgccgaccatatcaaattcacacagagtgcgctagactgcatgtctgtggaggtgggtcgtcttcgggctttccttcagggcgggcaggaggccacggacatcgcactgttgctgcgggatcttgagacttcctgtagcgacattcgacaattctgcaaaaagattaggagaaggatgcctggaaccgacgctcccggtattcccgccgcactggccttcggcccgcaggtgtcagatactctcctggactgtcgtaagcatctgacctgggtggtggctgtgctgcaggaagtagccgctgctgcggcccagctgatcgcccccctagcagaaaatgaaggcctcttggtggcggctttagaagaactggccttcaaggcatcagagcaaatatatggcactcctagttccagcccctatgagtgtctccggcagtcttgcaatattcttataagcaccatgaataagctcgctaccgcaatgcaggagggcgaatacgatgccgaacggcctccttccaaaccgccaccggtggaactcagggcagccgcactgcgggccgagattacagatgcagagggattaggcctaaagcttgaagacagagagacggtcatcaaagaattaaaaaagtctctcaaaataaagggcgaggaattgagtgaggcgaacgtcaggctctcacttctggagaaaaagttggacagtgccgccaaggatgccgatgaaagaattgaaaaagtccagaccaggctagaggagacccaggcactactaagaaagaaagaaaaggaattcgaggaaactatggatgcactgcaggctgacattgaccaactggaggctgaaaaggccgagcttaagcagagactcaattctcaatccaagaggaccatcgaaggactccggggacctccaccttcaggtattgcaaccctcgtctctggcatcgccggcggcgcaattcctggacaggccccaggcagcgttccgggacccgggttagtaaaggactcacctttgctcctccaacagattagcgctatgaggctccatatctcgcaattacagcatgagaactcaattttgaaaggcgcccaaatgaaggctagcctcgcatcattacccccgcttcacgtcgcaaaactctctcacgagggcccgggctccgaactccctgcaggcgccctgtatcggaaaacgtcccaactgctcgaaaccttgaatcagctcagcacgcacactcacgtcgtcgacattacacgcacaagcccagccgcaaagagtccatccgcccagctaatggagcaggtggcccaactgaagagcctgtctgacaccgttgaaaagcttaaagatgaggttctcaaagagaccgtaagtcagcggccgggagcaaccgttccgaccgattttgctaccttccctagtagtgcgtttctccgcgctaaggaagagcagcaggacgacacagtctacatggggaaggtaactttcagctgcgccgcagggttcggacagaggcaccggctcgtcctgactcaggagcaactccatcagctgcattcccggctcatttcctag

SEQ ID NO: 115180 - DNA, 2673 bp, Artificial Sequence
  Description of Artificial Sequence: Synthetic coding sequence
atgtctgctgaggctagcgctcggcccctcagggttggctcccgcgtggaggtcattgggaagggtcaccgtggaaccgtcgcttatgttggcgcaacactgtttgccactgggaaatgggtaggagtcattcttgatgaggcaaagggtaaaaatgacggaacagtccagggacggaagtattttacttgcgacgaaggacacggaatatttgtgcggcagtcccagatccaagtttttgaagacggggccgacacaacatctccagagactcccgattcatctgcaagtaaagtgttgaagcgggagggtaccgatacaactgcaaagacgagcaagctccctacccgcccagctagtacaggcgtcgcaggggcctcttcctctctgggaccctcaggctccgccagcgccggagaacttagctcctctgagcctagcacccctgctcagaccccccttgctgcccctatcattcctacacctgtgctcacctcacctggtgctgtgccgccgctgcccagcccttctaaggaagaggagggattgcgagctcaagtacgggatctggaggagaagctcgaaacccttcggctcaagagagcagaggacaaagctaagttgaaggaactggagaagcacaagattcagctggagcaggttcaagagtggaagtccaaaatgcaggagcagcaagcagacctgcagcggcggctgaaagaggctagaaaagaggccaaagaggccctcgaagctaaagaaaggtacatggaggaaatggccgatacagctgatgccatcgaaatggcgacactggataaggaaatggcagaagagagagcagagtcccttcaacaggaggtggaggctctcaaagaacgcgtcgatgagcttacaacggatctggaaatccttaaggcagagatcgaagagaaaggatccgacggcgccgcatcttcttaccaactaaaacaacttgaagagcagaacgctcgactcaaagatgctctcgtgcggatgcgagatctcagcagcagcgagaaacaagaacacgtgaagctacaaaagttaatggaaaaaaagaaccaagagctggaggtcgtcaggcagcagcgtgaaaggctccaggaagagctgagccaagccgaatctactatagatgagttgaaagagcaggtcgacgccgccctgggtgcagaagaaatggttgaaatgctgacggataggaatctgaatttggaggaaaaagtgcgagaattgagagaaacagttggggacctagaggccatgaacgaaatgaatgacgaactgcaggagaacgcgcgagaaacggagcttgaacttagagagcagctggacatggccggtgctagggtccgggaggctcagaagagagttgaggccgcccaggagacagtggccgactatcagcaaaccatcaagaaatacagacagctcacagctcacctgcaggacgtgaatcgcgagctgaccaatcagcaagaagcttctgttgaaagacagcagcagccaccacccgaaacctttgactttaaaatcaaattcgccgaaaccaaggctcacgctaaggccatcgagatggaactgcgccagatggaggtcgcacaagccaataggcatatgtccttgctgactgcattcatgcccgacagctttcttagaccaggaggcgaccacgattgcgttttagttcttcttctgatgcccagactaatttgtaaggctgagctgatccggaaacaggcccaggagaagtttgaactgtctgaaaactgcagtgaacgaccgggcctgaggggtgccgccggcgagcagctgtctttcgcagccggccttgtatactccctctccctcctacaggccacactgcaccgatatgagcacgccctgagccaatgttcagtggatgtatataagaaggtaggaagtctgtaccccgagatgagtgctcatgaaaggtctctcgatttcctcatagaattgctccacaaagaccagttggatgaaaccgtgaacgtggaaccactgactaaagctataaaatattatcaacacctgtactccattcacctcgcggagcaacccgaggactgtaccatgcagctggctgaccacattaaatttacgcaatccgcattagactgtatgagcgtggaggtaggacggctgcgggcttttttacagggcggtcaagaagctaccgacattgcactgctgttaagggatctagaaacatcatgttctgacatcagacagttctgtaagaagattcgacgccgcatgccaggaacagatgcccccggcattcccgcagctctcgcctttggtccccaagtgagcgacacgctcttggattgccgaaaacaccttacatgggtagtggccgtcctgcaggaagtggccgcagcggctgcgcaattgatagcgcccttagccgagaatgaaggccttctggtggctgccctggaggaacttgcctttaaggccagtgagcaggtcgggcttgacggctgggtcgaaggtgtgggacgagtcagcgaccaatgcggagccttcacatctgccctcggctcatgcaggagtatgggcccccccccggccgccccaatgagtgtgtgcgcatctcatgcaacttccagctctgtgccttag

SEQ ID NO: 115181 - DNA, 561 bp, Artificial Sequence
  Description of Artificial Sequence: Synthetic coding sequence
atgctgatgggactcttacgaccctacatcttaggagaacgaggaactgtcatgaccccgagcggatcccgcatgtcggcagaggcctccgcacggccattgagagtgggtagccgcgtggaagtgatcgggaaggggcaccgcggaaccgtcgcatacgtgggggccacactgtttgccacagggaaatgggtgggcgtcattttagacgaagccaaaggaaagaacgacggcactgtccaggggcggaagtactttacgtgcgacgaggggcatggcatttttgtgcgccaatcacaaattcaggtgttcgaggatggagccgatactacctcaccagagacgcctgatagcagcgcctctaaagtgttgaagcgcgaaggcacagatactaccgccaagacgtccaagctaagaggcctcaaaccgaagaaagctcctactgctaggaagactaccactcgacgccccaagcctacccggccagcgtcaactggcgtggccggggcctcttcaagccttggaccatctggctccgcatcagctggcgaactgagctag

SEQ ID NO: 115182 - DNA, 3711 bp, Artificial Sequence
  Description of Artificial Sequence: Synthetic coding sequence
atgagcgcggaggcaagcgcaagacccctccgggttggctctcgagtagaggtgatcggcaaaggccatcgaggcactgttgcttatgtcggcgccaccctgttcgctaccgggaaatgggtcggtgtgatactcgatgaagcaaaagggaagaatgatggaacagttcaggggcgaaagtattttacgtgtgatgagggccacggaattttcgtgagacagagccagattcaggtctttgaggatggtgccgacaccacgagccctgagacccctgattcgtctgccagcaaagtgctaaagagagagggcacagataccaccgcaaaaacctccaaacttcctactcggcccgcctccacaggcgtggctggcgcctcgagcagcctggggccttccggctctgcatctgcaggagaactatcttcaagcgaaccatcgactccggcccaaaccccactggccgcacccatcattccgactccagttttgactagtcctggtgctgttccccccctgccttcacctagtaaagaagaggagggactaagggctcaggtgcgggatctcgaagagaagctggagactttgcgattaaagcgggcggaggataaggccaaattgaaagagctggaaaagcacaagatccagttggagcaggttcaagaatggaaatccaaaatgcaagagcagcaggcggacctgcaaaggagactaaaagaggctcgcaaagaagcaaaggaagccctggaggccaaggaacggtatatggaggagatggctgacactgccgatgccatcgagatggccacactcgataaggagatggcagaggagagagccgaatctctccagcaggaggtggaggctcttaaggaaagagtagacgagttgaccaccgatctggaaattcttaaagcagaaatagaagagaagggatcagatggagccgctagtagctaccaactgaaacagttagaggagcagaatgctcgcctgaaggacgcactcgtgaggatgcgggatctctcatcatcggagaagcaagaacacgtgaaactccagaagctgatggagaagaagaaccaggaacttgaagtggttagacagcagagggaaagactgcaggaggagcttagccaggcagagtcgacaattgacgagctcaaagagcaggttgacgccgcacttggtgccgaggagatggtcgagatgttaacagatcggaatctgaatctcgaggagaaagtgagagagctccgcgaaaccgttggggacttggaagctatgaatgaaatgaacgatgaactacaggaaaacgcccgcgagacagagctcgagttgcgtgaacagctcgacatggccggggctcgagttagggaggcacagaagagggtcgaggcagcgcaggaaacagtcgcggactaccagcagaccataaagaaataccgacagctcacagctcacctgcaggacgtcaacagggaactcaccaatcagcaggaggcctctgttgaaaggcagcagcagccgcccccagagactttcgatttcaagatcaaatttgcggaaacgaaagcccatgcaaaggccattgagatggaattacgacagatggaagtggcacaggccaaccgccatatgtctctactgactgccttcatgcctgactctttcctgagacccggaggggaccacgactgtgtactggtcttactccttatgccacggctaatttgtaaggccgaactcatccgaaaacaggctcaggagaagttcgagctgagcgaaaattgttctgagcgcccaggactgcgtggcgcggcaggggaacagctgtcattcgccgccgggcttgtgtacagcctttcactgttgcaagccaccctgcatcgctacgaacacgccctctcacagtgttccgtggacgtttataagaaggttggcagtctgtatcctgagatgagtgcgcatgagcgctccttggatttcctgatcgagctattgcacaaagaccagttggacgagaccgtcaatgtcgagcccctgactaaagctattaagtattaccagcacctgtacagtatccacctcgctgaacagccagaggactgtacgatgcagcttgccgaccacattaaattcactcagagcgccctggattgcatgtccgttgaagtcggtcgcctgcgggccttcctgcaggggggtcaggaagccacggacatcgccctcctgttgagggacctggagacctcctgctcagatatccgccagttttgcaaaaagattcgccggcgaatgccaggcacggacgcccctggcatccccgccgcactggctttcgggccgcaggtaagtgacaccctgttagattgtaggaaacatcttacatgggtggtcgcagttttacaagaagttgcggctgccgctgcccagctgatcgccccgcttgctgaaaatgaagggttactggtggctgccctagaagaactagcattcaaagccagcgaacagatctacgggacacctagctcttccccttatgagtgtctgcgacagtcttgcaacatcctgattagcaccatgaataagctcgctaccgccatgcaggagggggaatacgatgcggaaagacccccctcaaagccaccacctgttgagctgcgtgctgccgctctccgcgctgagatcacagatgccgaaggcctcggcctgaagcttgaagatcgggagactgtgatcaaagaattgaagaagtctttgaagatcaagggcgaagaactaagcgaggctaacgtgcggctgtcactgctcgaaaagaaactagattccgccgctaaggacgcagatgaacgtatcgagaaggtgcagactcgcttggaagagacacaggctctcttgcgcaagaaggagaaggaatttgaggaaacaatggatgccctgcaagcggacattgatcagctagaagcagaaaaggccgaacttaagcagcgcctaaactctcaaagcaagagaacaatcgagggactcagaggacctccaccgagtgggatagcaacccttgtgtctgggatcgccggcggcgcaatccccggccaagctccaggatccgtgcctggtcccggtctggtgaaagactcaccccttctactacagcagatcagcgctatgcgtttgcacatttcccaattgcagcacgaaaactcaatcctgaagggggcacaaatgaaagctagtctagctagcctgcctccactccatgtagctaagctttcacacgagggcccgggctcagagttgcccgccggcgccctgtaccggaagactagccaactcctcgaaaccttaaaccagctgtccacccatacccacgtggtggatataaccaggactagtcccgccgcaaagtcaccatctgcacagctgatggaacaggtggcacaattaaagtctctttcggatacggtcgagaagctcaaggatgaagttttaaaggagacagtgagtcagcgaccaggagctacagtgcccacagattttgccactttcccttcttcagcatttctccgcgctaaggaggaacagcaagacgatacagtgtatatgggtaaagtgacgttctcgtgcgcggctggcttcggccaacgccatagactggtcctgacacaggaacagttgcaccagttgcatagcagactcataagctag

SEQ ID NO: 115183 - DNA, 3420 bp, Artificial Sequence
  Description of Artificial Sequence: Synthetic coding sequence
atgatgaggcaggcacccactgcacgtaagacgaccaccagaaggccaaagccgacacgacccgccagcactggggtcgctggggcgtcttcatcactcggtcccagcggatctgcaagtgcaggagaactttcctcctccgagccttctacaccagcacagactccgctggcagcgccaattattccaactcctgtgctgacgtctcccggcgcagtgcccccgttacctagtcccagtaaagaggaagaggggctgcgagctcaggtcagagacctggaagaaaagctcgaaacgctcaggctgaagcgtgcggaagacaaagctaaactcaaggagctcgaaaagcacaaaatacagctcgaacaggtacaggaatggaagtccaagatgcaggagcagcaggctgacctccagcgaaggctgaaggaagcccgaaaggaagcaaaggaagccctcgaggctaaggaacgctatatggaggaaatggctgatacagcagatgcaatcgagatggccactctggacaaggagatggccgaggaacgtgcggaaagcctacagcaagaggtggaggcacttaaggaacgggtggacgaattgaccacagatttagaaattttaaaagccgagatagaagagaaaggctcagacggtgccgctagtagctatcagcttaagcagctggaggagcagaatgctagactcaaagacgctctggtgagaatgcgggatctcagctcttcagaaaaacaggagcatgtgaaattgcagaaactgatggagaagaagaaccaggagctcgaggtggttcgccagcagagggaacggcttcaggaggaactatcccaggccgagtcaaccatagacgagctgaaagagcaggtcgacgccgcacttggtgctgaggaaatggtggaaatgttaactgatcgcaatctgaatttagaggaaaaagttagagagcttagagagactgtcggggatctcgaagccatgaacgagatgaacgacgaactacaggagaatgcccgagaaactgagctggaactcagagaacagctggatatggccggtgcccgagtcagggaggcacaaaagcgcgtcgaggctgcccaggaaactgtcgccgactatcagcagacaatcaaaaagtacagacaattgactgcacacctgcaggatgttaatcgtgaactaacaaatcaacaggaggcaagtgtcgaaagacagcagcagccacctccagagactttcgatttcaaaattaaatttgccgaaaccaaggctcacgctaaagccatcgaaatggagctgcgtcagatggaggtagctcaggccaatcggcacatgagtctgctcacggcctttatgccagactccttcctccgccctggaggggatcacgattgtgttttggtactcttgctcatgccaagattgatttgtaaggccgagttaataagaaaacaagctcaggagaaatttgaactgtccgaaaactgcagcgagaggcccggcctgcgcggcgccgccggcgaacagctttcgtttgctgcaggccttgtgtacagtctctctctgctgcaggcaacattgcacaggtatgagcacgcactgagtcagtgctcagtcgacgtttacaaaaaagtgggtagcttgtatccggaaatgagcgctcacgaacgcagtcttgacttcctgatagaactgctgcataaagatcagctggacgaaacagttaacgtcgaaccactaactaaggctatcaagtactaccaacatttgtactccatacacctggccgaacagcccgaagactgcacgatgcagcttgccgaccatatcaagttcacgcaatctgccttagactgtatgagcgtggaggttgggaggcttagggccttcctgcaggggggtcaggaagcgacagacattgcactgctcctgcgggatctcgagacttcatgtagcgatatccgccagttttgtaagaaaattagacgtagaatgcccggcaccgatgctcccggcattccagctgcattggctttcggaccgcaggtgtcagatacactgctggactgccgaaagcatctaacttgggtagtggccgtgctgcaggaagtggccgctgccgcggcccaactgatcgcccccttagccgagaacgagggcctgctagtcgccgcccttgaggagctcgcctttaaagcttcagagcaaatatacggcacacccagctcttcaccttacgagtgcttgaggcagtcctgcaatattcttatctcaaccatgaacaaattagccacagctatgcaagaaggagaatatgatgctgaacgccctccaagtaagcctcccccagtcgagctaagggcagcggcactacgtgcagaaataacagacgctgagggtctcgggctaaaattggaagaccgcgaaaccgtcatcaaggaattgaagaagtcattaaagatcaaaggagaagagctctcagaagccaacgtgagactgtctctcctcgaaaaaaaattagactccgccgctaaagacgccgatgagcggatcgagaaagtacaaactaggctggaggaaactcaggccttgcttagaaagaaagagaaggagttcgaagaaactatggatgcccttcaggctgatatagaccagcttgaggccgaaaaagctgagctaaagcaacgcctgaacagccaaagcaagcgaacaattgagggtctgcggggtcccccacctagcggaatcgccacgttggtgagcggaatcgccggtggtgcaatccccgggcaggctccaggctccgtgcccggccccggactggtgaaggactcacccttactgctgcagcagattagtgccatgcgactgcacatttcacagctgcagcacgagaatagcattctgaaaggagctcaaatgaaagcctccttggcttcgctgcccccactacatgttgcgaagctgagccacgaggggcctggaagcgaattgccagccggtgcactttacagaaaaaccagccagctattagagaccttaaaccagctgtccacccacactcatgtggtggatataactcgcacaagtcccgcagctaaatctcctagcgcacagttaatggagcaagtggcacagctaaaaagtctgagcgatacagtggaaaagttgaaagatgaggtactgaaagagacagtttctcagcggcctggcgcaactgtgccaacagattttgccacgttcccgagcagtgccttcctgagggcaaaggaagagcagcaggatgacaccgtatatatggggaaagtgaccttctcatgtgccgcaggattcggccaacgccaccgcttggtgctgactcaagagcagttgcatcagctccattcccggctaatctcatag

SEQ ID NO: 115184 - DNA, 3762 bp, Artificial Sequence
  Description of Artificial Sequence: Synthetic coding sequence
atggctcagtctaagcgccacgtgtactctcgcacaccctctggctcacgcatgtctgccgaagcctccgctaggcccctgagggtgggtagtagagtggaggtgatcggaaaggggcatcgtggcaccgtcgcttatgtcggggccacgctgttcgccaccgggaaatgggtgggtgtgatccttgatgaggctaagggcaagaacgatggtacagttcaaggacggaagtatttcacctgcgatgagggccacggtattttcgtgaggcagtcacaaattcaagtctttgaagatggcgccgacaccaccagcccggaaacaccggacagctctgcgagcaaggtcctgaaacgagagggaacggatactactgcaaagacttccaaactgcccacccgacctgctagtaccggagtcgctggagcttccagtagcttggggccctctgggagtgcatcagccggggagctcagttctagcgaaccctcgacccccgcacaaaccccacttgccgcgccaatcattcctacaccggtgttgacaagtcccggcgcggtgccaccgctcccttccccttcgaaggaagaggaaggcttgcgcgcccaggtaagagacctcgaggagaagctggagaccttgcgactgaaacgggcagaagacaaggctaaacttaaagaattggaaaagcacaagatccaattggaacaggtccaggagtggaaaagcaagatgcaggaacaacaggcagatctgcaaaggcggctgaaagaagcacggaaggaagctaaggaggcgctggaggctaaagagaggtatatggaagagatggcggacaccgcggatgcaatcgagatggctacattggataaggagatggcagaggaacgggctgagtcactgcagcaggaggtcgaggccctaaaggaacgggtcgacgagctcaccacagacctcgagattctaaaggcagagatagaagagaaagggagtgatggcgccgcatcaagctaccagttaaagcaattagaagagcagaacgcacgcttgaaggacgcgcttgttaggatgagagacctgagtagctcagagaagcaggaacacgttaaattgcaaaagctcatggaaaagaaaaatcaggagctcgaggttgtccgccagcagagggagaggcttcaggaagagctcagccaggctgagagtacaatagatgagctgaaggagcaggtggatgcagcacttggggcagaggagatggtcgaaatgctcaccgatcggaatctgaacctggaggagaaggtgagggaactgagagaaactgtcggcgacctcgaggcaatgaacgagatgaacgatgagttacaggagaacgctagggagacagagctcgaactacgagagcaattagacatggcgggggcccgagttagggaggctcagaagagggtggaggcagcccaggaaacagtagccgattatcaacagaccatcaaaaagtatcgacagttgaccgcacatcttcaggatgtcaacagagagcttactaatcagcaggaagcttcagtggaaaggcaacagcagccaccccccgagacattcgattttaagattaagtttgccgaaacaaaggcccatgctaaggccatcgaaatggagcttcggcagatggaggtcgctcaagctaataggcacatgagcctgctgaccgccttcatgccagacagctttctacgccccggcggagaccacgactgtgttctggtactgttacttatgcctcgcttaatttgtaaagctgaactgataagaaagcaggcccaggagaaatttgagctcagcgagaattgcagcgaaaggcccggcctaagaggagcagcaggcgaacagttgagttttgctgccgggcttgtgtattctctatcgctcctccaggccaccttgcaccgttacgagcatgcactgagtcagtgttccgtggacgtgtacaaaaaggttgggtccctgtacccggagatgtcggcacacgagcgaagtctggactttttaattgagttgctgcacaaagatcagctagacgaaaccgttaatgtggaaccattgacaaaagcgatcaagtactatcaacacctttattcgattcacctcgcggagcagccagaagactgtacaatgcaattggccgatcacattaaatttacccaatctgctctggactgcatgtcagttgaggtaggcagattacgggccttcctccagggaggccaggaggctaccgacatagccctcttgttacgggatctggagaccagctgttccgacataagacaattttgtaagaagataagacgcaggatgcccggcaccgacgcccccggtatccctgccgctctggcgtttggtcctcaggtcagcgacactctgctcgattgcagaaagcaccttacatgggtggtcgccgtgctacaggaggtggcagccgcagccgctcaactcattgccccgttggccgaaaatgagggcttgctcgtggcggccctcgaggaattggccttcaaagcctcggaacagatatatggaacgccaagcagctccccctatgaatgccttcgccagtcctgtaatattctgattagcacaatgaataaattagctaccgctatgcaggagggtgagtacgatgcagaacgcccccctagcaaacctccgcccgttgaattgcgtgctgctgcacttagagccgagattaccgatgccgaagggttggggctgaagctcgaagatcgagagactgtgattaaggagctgaaaaaatcactgaagatcaaaggggaggagctgtccgaggccaatgtgcgattgagtctgctagaaaaaaagctggacagcgccgccaaagacgcagatgaaaggattgagaaagtgcaaacgagactggaggagacgcaagccctgcttcgtaagaaagagaaggaattcgaggagaccatggacgcactacaggccgacattgaccaattagaggcagaaaaagccgagcttaagcaaagactcaattcccaaagtaagcgcactatcgaagggctgcgaggacccccaccttcaggaatcgcgaccctggtgagtggtatcgcaggaggggctatccctggccaggcgcctggctccgtccccggtccaggccttgttaaggatagtccattgctccttcagcagatatccgccatgagattacacattagtcaactccagcacgaaaactcgatcctcaaaggagcccagatgaaagcatcactggccagtcttccacctctgcacgtggccaaactgagccacgagggacccggaagcgagttgccagctggtgcactctacaggaagacttcacagctactcgagactcttaaccaactctcaacccatacgcacgtggtggacattacccgcaccagtccggccgccaaatcccctagcgcccagttgatggagcaggtagcgcagctcaaatcactctcagacaccgtcgagaagctcaaagatgaagtgttaaaggagaccgtgtctcagcgcccgggtgccacagtcccgacagactttgccaccttccctagcagtgcgtttctcagagccaaggaggagcagcaggacgatactgtgtacatgggtaaagtaaccttctcctgcgctgccggttttgggcagagacatcggcttgtactgacccaggagcagctgcaccagctgcattcgcggttaatcagctag

SEQ ID NO: 115185 - DNA, 1221 bp, Artificial Sequence
  Description of Artificial Sequence: Synthetic coding sequence
atggccgatccaaaatacgccgaccttcctgggattgccaggaacgagcccgatgtttacgagaccagtgatttaccggaggacgaccaggccgaattcgacgctttcgctcaggaactggaggaactgacttccacgtccgtggaacacattatcgtgaatcccaatgccgcatacgataaatttaaggacaaacgcgtcggcacgaaggggctcgatttctccgaccgaatcggtaaaaccaaaaggaccggttacgagtctggtgagtatgaaatgttgggcgaagggttaggcgtgaaggagactccacagcaaaagtatcaacggctgctgcacgaagtgcaggaactgactactgaggtcgagaaaatcaagactaccgttaaagagtctgccaccgaggaaaaactgacacctgtccttctagccaaacagctcgctgcattgaagcagcagctcgtcgcttctcatcttgagaagttgctggggccggatgctgccatcaatttgaccgatcccgacggcgctctggctaagagactgttactgcagctggaagccaccaaaaacagcaaaggcggctcaggcggaaaaaccactggcacgccacccgattctagcctcgtgacatacgagttgcactcccgaccagaacaggacaagttctcacaggctgcgaaagtggccgagttggagaagcgcttaactgagctggagaccgccgtgaggtgtgatcaagatgcgcaaaatcccctgtcggcaggtctccagggcgcttgcctgatggaaactgtggagctgctgcaagctaaggtttccgccctggacttggctgtgctagaccaggtcgaggcccgattgcagagcgtgctgggcaaggtgaatgaaattgccaaacacaaagcatcagtcgaggatgccgacacccagtccaaagtgcaccagctgtatgagaccattcagcggtggtctccaatcgcatccaccttacccgagcttgtccagagactagtgaccataaagcagctgcacgaacaggctatgcaattcggtcagctgttaacacatctggacaccactcaacagatgatcgctaactctttgaaagataacaccacattactgacccaagttcagacaacaatgcgcgaaaatttggccaccgtcgaaggcaattttgcgagtatcgacgaaagaatgaagaagctgggaaaatag

SEQ ID NO: 115186 - DNA, 1137 bp, Artificial Sequence
  Description of Artificial Sequence: Synthetic coding sequence
atgtacgctcagggaaccgaagacagccggacgctcgaggaattaacctcaacatccgtggagcacataattgtgaatccaaacgcagcctatgacaagtttaaagataaaagagtgggcacaaagggcctagattttagcgaccgcatcggaaagaccaaacggaccggctatgaatccggagagtacgagatgctcggggagggtctgggggtgaaagaaacaccacagcagaagtatcagcggctccttcacgaagtgcaggaactcactaccgaggttgaaaaaatcaaaacaacagtgaaggaatccgcgaccgaagaaaaacttacccctgtgcttctggcaaaacagctagccgctctgaaacagcagctggttgcatctcacctcgaaaaattgctcggacccgatgccgcaataaatctgacagacccagacggtgctttggcaaagaggctgctcctccagctggaggcaaccaagaactccaaagggggtagcggcggcaaaacaacagggacaccaccagacagctccctggtcacttacgaattacactctaggcccgagcaggacaagttttcacaagccgcaaaagtggctgagctggagaagcggctgacggaattagaaactgcagtgagatgcgaccaggatgcccagaatcccctgtccgccggccttcaaggggcctgtctgatggagactgtggagttgctacaggcaaaagtgagcgccctggatttggcagtactggaccaggtggaggcccgcttacagtcagttcttggaaaagtgaacgaaatagctaaacacaaggcctcagttgaagacgccgatacacaaagtaaggttcaccaactttacgaaactatccagcgatggtccccaattgcctccaccctgccagagctggtacaaaggctggtgactattaagcaactccatgaacaagctatgcagtttggacagttattgacccatctcgacacgacacagcagatgattgccaactcactgaaggataataccactcttctgactcaagtacagacaacgatgagagaaaacctcgctacagtcgagggcaacttcgcctcgattgacgagaggatgaagaaattggggaagtag

SEQ ID NO: 115187 - DNA, 945 bp, Artificial Sequence
  Description of Artificial Sequence: Synthetic coding sequence
atgctcggggagggcctgggagtgaaggaaacaccccagcagaaatatcaacggttgctgcacgaagtgcaagagctcacaaccgaagtggaaaaaatcaaaactaccgtgaaggagtccgccactgaggaaaagctgacaccagttctcctcgccaaacagctcgccgcattaaagcaacaactggtggcctctcacctggaaaagcttctcggccctgacgcggccattaatctgaccgatcccgatggcgctctggctaagcgcttactgttacagctggaggccactaaaaactcaaagggtggaagcggcggaaaaaccactggtaccccccctgatagcagtctcgtgacatacgaattgcatagcaggcctgagcaggataagttctcccaggccgccaaggtggctgaattagaaaaaagactgaccgagcttgagaccgccgtccgctgcgatcaggatgcgcagaaccccctctccgctggactccagggagcgtgtcttatggaaacagtcgagctcctccaggccaaggtgtcagccctggatctggccgttttggatcaggtagaggctcgactccagagcgtgctcggcaaggtaaacgagatcgccaaacacaaggcttctgttgaggatgcagatacccaatcaaaagtacatcagttatatgagacaatccagaggtggagtccgattgcttcaacactccctgagttagtccaacgcctggtgaccattaaacagctccacgagcaggccatgcagtttggccagctgctgactcatctggacacgacccagcagatgatcgcgaattccctcaaagacaatacgaccctcctgacacaggtgcaaaccacgatgcgtgagaacctcgcaacagtcgagggaaacttcgcatctattgatgaaagaatgaagaaacttggaaaatag

SEQ ID NO: 115188 - DNA, 1221 bp, Artificial Sequence
  Description of Artificial Sequence: Synthetic coding sequence
atggccgaccccaagtacgctgacttgccaggcatcgcacgcaacgaacctgatgtgtatgagacttccgatctcccggaggacgaccaggccgagttcgacgcgaccgtgcaacatttggaagagctgactagtactagtgttgaacacattattgtgaaccccaacgcggcgtacgacaagtttaaagacaaacgggttggcactaaaggtcttgacttttccgacaggattggtaagacaaagaggacggggtacgagagcggggaatacgagatgcttggcgagggcctgggagtgaaagaaaccccccagcaaaagtaccagcggcttctgcacgaggtgcaggaactgaccacagaggtggaaaagatcaagacaacggtcaaggagagcgcaacggaggagaaattgactccagtgctgcttgccaaacagctggccgccctgaagcagcaattggtggctagccacttagagaagttgttggggcctgatgccgccatcaacctgaccgatcctgacggggccctggccaagagactactgttgcagctcgaagccactaaaaattccaagggagggtcaggcggaaaaactaccggtacgccgcccgatagcagtttggtcacctacgagctgcacagcagaccagaacaagacaagttctctcaggcagctaaagtcgcggaactggaaaagcgccttacagagctggagactgcagtgcggtgtgaccaggacgcacagaaccctctgagtgcagggctccagggggcgtgtttgatggagacagtagaactgctccaagcaaaggtttctgcccttgatctcgctgtccttgaccaggtcgaggcgaggctgcagagcgtgctggggaaggtgaatgagatagcaaaacataaggcttccgtggaagacgcagatactcagtctaaggtgcatcagctgtatgaaacaatccagaggtggtctccaatagcgagcacccttcctgaattagtccagcgcttggtgaccattaagcagttgcacgagcaggcgatgcaattcggccagctactcacgcatctggacaccacccagcagatgatcgcgaattcccttaaagacaatacaaccttgctgacacaggtccagaccacaatgagggagaacctggcaactgtcgaaggtaacttcgcttcaattgatgagcgcatgaagaagttgggaaaatag

SEQ ID NO: 115189 - DNA, 1206 bp, Artificial Sequence
  Description of Artificial Sequence: Synthetic coding sequence
atggcagaccctaagtatgccgatttgcccggcatagcacggaacgagcccgacgtatacgaaacatctgacctgcccgaggacgaccaggcagagtttgacgctgaggagctgacttccacctctgtggagcacatcatcgtgaatccaaatgccgcgtacgacaagttcaaagacaagcgggtcggaacgaagggactggacttctctgaccggattggcaagactaagagaacagggtacgagagcggtgagtacgaaatgctcggcgagggtcttggtgtcaaggaaacgccacagcagaagtaccagcggctgcttcatgaagtgcaggaactgaccaccgaggtcgagaaaatcaagacaaccgtgaaggaaagtgcaacagaggagaaattaactcctgtgttgcttgcaaaacagctcgcagcattaaagcagcagttagtcgcatctcacctcgagaagctcctgggccctgatgctgcaattaacctgactgaccccgacggcgctttggcgaagcggctccttctgcagctcgaagcaaccaagaactccaaagggggcagtggaggaaagacaactgggactccccccgacagttcactcgttacatatgagctgcattctagaccggagcaagacaagttttctcaggctgccaaagtggcagagctcgaaaagcgccttacggagctggagactgccgttcgttgtgatcaagatgcgcagaacccactttctgccggtctgcagggagcttgtttgatggaaaccgtcgagctccttcaagctaaggtctcagctctggatcttgctgtgctggaccaggtggaggccaggctgcagtctgttctcggcaaggtgaacgagatcgccaaacataaagccagtgttgaagacgcggacactcagtctaaggtgcatcaactctatgaaacaatccagaggtggtctccaattgcaagtacactccccgagctggtgcagcgtctcgtgacaattaagcagctgcacgaacaggccatgcaattcgggcagctccttacccacctggatacgacacagcaaatgattgccaatagcttgaaggataatacaacactgctaacccaagtgcaaacaactatgcgcgaaaacttggccacagtcgaggggaactttgcctcaatagatgagagaatgaaaaagttgggcaagtag

SEQ ID NO: 115190 - DNA, 561 bp, Artificial Sequence
  Description of Artificial Sequence: Synthetic coding sequence
atggcgggcctgacagacctccaacgtctgcaggctcgtgtggaggaactggagcgctgggtgtatggccccggaggagctcgcggatcccgcaaggtggccgacgggctagtcaaagtccaggtcgcccttggaaatatttcctccaaaagggagagggtgaagattctttataagaagatcgaagatcttattaagtatctcgacccagaatatattgatcgaatcgccattccagacgcttctaaattacagtttatcctagcggaggaacagtttattctgtcccaagtggctttactggaacaggtgaacgcgttggtgcccatgctggactccgcccatatcaaagctgtaccagagcatgcggcaaggctgcagcgcctggcccagatccacatccaacagcaagatcagtgtgtcgaaatcacagaggaatctaaagctctgctggaagagtataacaaaacaaccatgctgctgtccaagcagttcgtgcagtgggatgaactcctttgccagctcgaagcagcaacccaagtcaaacccgcagaagagtag

SEQ ID NO: 115191 - DNA, 531 bp, Artificial Sequence
  Description of Artificial Sequence: Synthetic coding sequence
atggctggcctgacagacttgcagaggctgcaggcacgagttgaggaactcgagagatgggtgtacggccccggtggcgccagggggtcgaggaaagtggcagacggcctggtaaaggtccaggtggctctaggtaatatatcatctaaacgcgagcgagtgaagatcctctacaaaaaaatcgaagatctcatcaagtacctggatccggagtacattgacaggatcgctatcccggatgctagtaagctgcaattcattctggcagaggagcagtttattctgtcccaggttgccttgttggaacaagttaatgcattggtacccatgctcgactccgctcacattaaggccgttcccgaacatgctgcaagattgcagcggctggcgcagatacacatccagcagcaggcgccatggggcgtgggagtacgagacgaagccggcagcctggtggaagacgtgggtttcgcccagtttctgtcagtactgcactttgggcccacaggccctgtctgtggcaatcactag

SEQ ID NO: 115192 - DNA, 486 bp, Artificial Sequence
  Description of Artificial Sequence: Synthetic coding sequence
atggccggactcacggacctccagaggctgcaggctcgtgtagaagaactggaaagatgggtgtacggcccaggcggcgcccgcggtagcaggaaggtggctgatggtctcgtgaaagtgcaagtggctctaggcaatattagcagcaagcgtgagagagtgaaaatattatacaagaagattgaggatctcatcaaatatcttgatcctgagtacattgatcgtattgctattccagacgctagcaaactccagttcattttggccggaaacgcagggctgcacgtctatatgcatctccggatgtgggtggtcggcgaagtcaagcaccgggatggtctgagcatccagtcttcaggcggatacaaaccctggatgttgctgagtggtattgtggcttggttttgggtggaggatcctatggacccactcgtggatattgagtactctatcccattacatcaactccaggcaatggtcccatag

SEQ ID NO: 115193 - DNA, 315 bp, Artificial Sequence
  Description of Artificial Sequence: Synthetic coding sequence
atggccggtctgacagatctccagaggttgcaggctagagtggaagaactggaacgctgggtgtacggacctggaggggccagagggtctcggaaagtggctgatggactcgtcaaggtacaggtggcgctaggcaatatcagttccaaaagagagagagtgaagatcctttacaagaaaatcgaagatctgattaaatacctggaccccgaatacattgacaggattgctatccccgacgccagcaaactgcaattcatcctagccgaaaggagctccctaagtttcccacgcctacactcgtggagcagatag

SEQ ID NO: 115194 - DNA, 477 bp, Artificial Sequence
  Description of Artificial Sequence: Synthetic coding sequence
atggccggactaactgatctccaaaggctgcaagcacgagtggaggagctcgagcgctgggtgtatgggccggggggcgcccgaggctcccggaaagtggctgacggtctcgtgaaagtgcaggtcgctcttggtaatatatcaagtaaacgcgagagagtgaaaatcctgtataagaagatcgaggatctgataaaataccttgacccagaatatatagaccggatcgccattccagatgcaagcaaactccagtttatcctcgcagctgtaccagaacacgctgcccgacttcaacgcctggcacagatccatatccagcaacaggatcagtgtgtcgaaattactgaagagtccaaagctctcttggaggaatacaacaagactaccatgttactctccaagcagtttgtccagtgggatgagctgctctgtcagttagaggcagccacccaggtgaaacccgcagaagagtag

SEQ ID NO: 115195 - DNA, 456 bp, Artificial Sequence
  Description of Artificial Sequence: Synthetic coding sequence
cagcggttacaagctagggtagaggaactggaacgatgggtgtatggtccgggtggcgcgagggggtcacgcaaagtcgcggacggtctagtgaaagtgcaggtagcgctggggaacattagctctaaacgcgaacgcgtcaaaatactgtataaaaagattgaagacctgattaaatacctcgaccccgaatacatagatcggatcgcgatcccagatgcctccaaacttcagtttatcctggcggctgtacccgaacatgcggcaaggttgcagagactagcccaaattcacattcaacaacaggaccagtgtgtggagatcaccgaagaaagcaaagccctgttagaggaatacaacaagacaactatgctactgagcaagcaatttgtccagtgggacgaactgttgtgtcagctcgaggccgccacccaggttaagccagccgaggaatag

SEQ ID NO: 115196 - DNA, 519 bp, Artificial Sequence
  Description of Artificial Sequence: Synthetic coding sequence
atggctgggctgactgacctgcagaggcttcaggctagagttgaggaactagaaaggtgggtgtatggtcccggaggcgctagggggtctcgtaaagtggcagacggccttgtgaaagtgcaggttgccctggggaacatcagcagcaagcgtgagcgcgtgaaaattctctataaaaaaatcgaggacctcattaaatacctggatccagagtacatagacagaatcgccattccagacgcctctaaattgcagtttattctggccggcaacgctgggcttcatgtttacatgcatctgaggatgtgggtagtgggggaagttaagcacagagacggcctgtctatccaatcctccgggggatataagccgtggatgctcctgagtggaatagttgcatggttctgggtagaggacccaatggatcctctggtggatatcgaatactccattccattgcatcaactgcaggccatggtccctgctactgtcggggcgagccctgtattctaccagtag

SEQ ID NO: 115197 - DNA, 549 bp, Artificial Sequence
  Description of Artificial Sequence: Synthetic coding sequence
atggagctgggcgagctgctttacaataaatccgagtacatcgagacagcctccggcaataaggtctctaggcaatctgtgttgtgcggctcacagaatatcgtgctgaacggaaagaccatcgttatgaacgattgtatcatcagaggcgatttagccaacgtgagggtcggacgccactgcgtggtcaaatcccggtctgtgatacgcccacccttcaaaaagttctcaaaaggtgtggccttcttcccacttcacataggagatcatgtatttatcgaagaagactgcgtcgtcaatgcggcccagatcggatcgtatgtgcacgtggggaaaaattgcgtgatcggacggaggtgtgttctcaaggactgctgcaaaatacttgacaatactgtgttgcctccagagacggtagtgccaccctttacagttttctctggctgcccgggactgttcagcggcgagcttccagaatgcacccaggagctaatgattgacgtgacgaaatcatactatcagaaattcctgcccctgacacaggtgtag

SEQ ID NO: 115198 - DNA, 255 bp, Artificial Sequence
  Description of Artificial Sequence: Synthetic coding sequence
atggaactcggagagctcctgtacaataaatctgagtatatagagactgcttccggtaacaaggtttcacgtcagtctgtgctgtgtgggtcacagaacattgtcctgaacggaaaaaatttcgtaattagcgtctttctctccccctacatacgatgccattcagcctgccgggaccggaaaaggtcagatgagtcagttcgcctgtccgttaacaatcgtgagtggtgggggctcgttaattggaggatgtag

SEQ ID NO: 115199 - DNA, 1650 bp, Artificial Sequence
  Description of Artificial Sequence: Synthetic coding sequence
atggagttcgctgagctgatcaagacaccccgcgtggataacgtagttcttcatcgacccttctaccccgctgtagagggtacgctctgtttgaccggacaccatttgattctctcttctaggcaagataataccgaggaactgtggcttctgcactccaacattgacgcaattgacaagcgtttcgttggctccctaggcacaatcatcattaaatgtaaggacttccgcatcatccagctggacatacccggcatggaagaatgcctaaacattgccagcagcattgaagccctgagtaccttggacagcatcactctcatgtaccccttcttttataggccaatgttcgaggtgatcgaagatgggtggcattcttttctgccggagcaggaattcgagctctactcttctgccacttcggagtggcgcttgtcttatgttaacaaggagtttgccgtgtgccccagttatcctcccatagtcaccgtcccaaagagtatcgatgatgaagcgcttcgtaaggtggccaccttcaggcatgggggacgctttcctgtgctctcttattatcataagaagaatgggatggtgatcatgcgttcgggtcagccgcttacagggacgaatgggcgtcgctgcaaagaggatgaaaagcttattaatgccacattgcgggcaggaaagcgaggctatatcatagatacccggtccttgaacgtcgctcagcagacaagggcgaaaggcggaggattcgagcaggaagcacactacccacaatggcgacgaattcacaaatctatcgaacgctatcacatcctacaagagagcttgatcaagctggttgaagcctgcaatgatcaaactcataatatggatcgctggctctccaaactcgaagctagcaactggctcacacacatcaaggagattctgacgacagcctgtcttgcagctcagtgcattgaccgggaaggcgcaagcattctgattcatggtaccgaaggaaccgactctactctgcaagtcacttctctggcccagattatcctggagccaagaagccgcacaatccgtggatttgaagcactcatcgagcgtgagtggctgcaggccggacaccccttccaacagcggtgcgcacaatccgcctactgcaatactaaacagaagtgggaggcccccgtctttcttctcttcctggattgtgtctggcagatactgcgccaatttccctgctccttcgaattcaacgaaaacttccttatcatgctgttcgagcacgcctacgcaagccaattcggaacctttctcgggaataacgagtcagagcggtgcaagcttaagcttcaacagaagacaatgagcctttggagctgggtaaaccagccctcggaactgagtaaatttacgaatccgttgttcgaggccaacaatctggtaatctggccatcggtggcaccacagagtctgcccttgtgggaggggatattcttgcgctggaatcgaagtagcaaatacctggacgaagcatatgaagagatggtcaatattatcgagtacaataaagagctgcaggctaaggtcaatattctgcgaagacagctcgcagaattggaaacggaggatggaatgcaggagtccccctag

SEQ ID NO: 115200 - DNA, 2556 bp, Artificial Sequence
  Description of Artificial Sequence: Synthetic coding sequence
atggggaaccgtggtatggaggacttgatcccgttggtaaaccggctccaggatgccttcagcgcaataggccagaacgcagacctggacctcccacagatcgccgtcgtgggcgggcagtccgcaggcaagtctagcgttttagagaacttcgtagggagagatttcctacctaggggaagcggtatcgtgacgcgcaggcctcttgttctgcagctggtaaacgcaaccaccgagtacgccgagttcctgcactgcaagggcaaaaagtttaccgattttgaggaggtaaggctagaaatcgaggcagagaccgatagggtaacagggacaaacaagggaattagcccagtgcctatcaacctgagggtgtactccccgcatgtgctcaatctgacacttgtggacctgccggggatgaccaaagtcccggtgggcgatcagccacccgacatcgaatttcagattagggacatgctcatgcagttcgtgaccaaagaaaactgtctcatcctggctgtgagtccagccaattctgatttggctaattcagatgcactcaaggtggctaaagaagtggatccccagggccagcgtaccattggggttataactaaactggacctcatggatgagggcaccgatgcccgagacgtcctcgagaataaactattgccactgcggagagggtacattggagtagttaaccgctcccagaaggacattgacggaaagaaagatatcaccgccgcactcgctgcggagcgtaaattttttctctcccacccttcctatcggcatcttgctgatcgtatggggacaccttatttacagaaagtgcttaaccagcagttgactaaccacattcgtgatacgcttccagggctgaggaataagctccagagtcaactcttgtccatcgaaaaagaggttgaggaatacaagaattttaggcctgacgaccccgcccggaaaacgaaggccctcctccaaatggtccagcaatttgcagttgacttcgagaagagaatcgaagggtcaggcgaccagatcgatacttatgagctgtctggcggcgcccgcatcaacaggatattccacgagcgctttccatttgagctcgtgaaaatggagttcgacgaaaaagagctgcgcagagaaatatcttatgcaattaagaacatccacggcatccgtacaggactgtttacccccgatatggctttcgagacgattgttaagaagcaggtgaaaaagatccgggaaccttgtctgaaatgtgtggacatggtgatctcagagctgatctcaaccgtaaggcaatgtactaagaaactgcagcagtaccctaggctcagagaagagatggaacggatagtcaccacgcatatacgagaacgggagggcaggacaaaagaacaagtgatgttgttgatagacatcgaattggcctatatgaataccaaccacgaggatttcatcggcttcgccaacgcccaacagagatccaaccagatgaataagaaaaaaaccagtggcaatcaggacgagattctggtgattaggaaaggatggcttaccattaataacatcggaatcatgaagggcggcagtaaagagtactggtttgtgctgaccgctgaaaacctgtcctggtataaggatgatgaagagaaggagaagaagtatatgctgtctgtggataatctcaaacttcgcgatgtagagaaaggatttatgtcttctaagcacattttcgccctgtttaacactgagcaacgcaacgtgtacaaggattataggcagcttgaactggcctgtgagacccaggaggaggtggacagctggaaggcctctttcctgagagccggagtctatcctgagcgagtcggggacaaggaaaaagcttctgaaacagaggaaaacggaagtgactcttttatgcactccatggaccctcagcttgagcgacaggttgagacaatccgaaatttagtagatagttacatggcgatagtgaacaagaccgtgcgtgatcttatgcccaagactatcatgcatctgatgattaacaataccaaagaattcattttcagtgaactgctggccaacctgtactcctgtggggaccaaaataccctaatggaggaaagcgctgaacaggcacagcgaagggacgagatgctgcggatgtaccatgctcttaaggaagccctgtctattattggtgacattaacacaacaacggtgtcaacccctatgcctcctcccgtcgatgacagttggctgcaggttcaaagtgtcccagcagggcgtcggtccccaacgtcttctcccacacctcaaaggcgcgcaccagccgtgcctcccgctcggcctggcagtagaggacccgctccaggccccccccctgcaggtagtgcgttggggggcgcccccccggtcccgagcaggcccggggcatcaccggatcccttcggcccccctccgcaggtaccgtcccggccaaacagggcgccaccaggagtccctagaatcaccatctccgacccttag

SEQ ID NO: 115201 - DNA, 2595 bp, Artificial Sequence
  Description of Artificial Sequence: Synthetic coding sequence
atgggcaaccgcgggatggaagacttaatccccctggttaataggctgcaggatgccttcagtgcaataggacagaatgctgacctggatctccctcagatcgctgtggtcggtggccagtctgctggaaagtcctcggtccttgaaaacttcgtggggcgggattttctgccccgcgggtccgggattgtaaccagaagacccctggtcctgcagctagtgaatgctaccacagaatatgctgaatttctccactgtaaggggaaaaaatttactgactttgaggaagtccggttggaaatcgaggctgagacagaccgtgtaacgggcacgaataagggaatctctccagttcctatcaatctcagggtttacagcccccatgtgctgaatctaacattagtagacttgcccgggatgacaaaggtcccagtaggtgaccaaccgccggacatagagttccagattcgggacatgttgatgcagtttgtgacaaaagagaactgcctgattttggctgtgagccctgcaaattctgacctcgcaaacagcgacgccctgaaggtggccaaagaggtggatcctcaaggtcaaaggaccatcggagtgattaccaagctggatctcatggatgagggtacagacgctcgggatgtgctcgaaaataagttactgcctcttcggagaggatacattggagtggtgaatcgatctcagaaagacattgacggtaaaaaggatatcactgcagccttggcagcagagaggaagttcttcctgagtcacccctcatatcggcacctggccgatcggatggggacgccttatttacagaaggtcctgaatcagcagctcacaaaccatatccgcgataccctaccaggcctccggaacaagctgcagagccagttgctgtcaattgagaaggaggtcgaggaatataagaatttccggcctgacgatcccgcacgaaagacgaaagcccttttgcagatggtgcagcagttcgcggttgacttcgaaaagagaatcgaggggtctggggaccagatagacacttacgaactctcggggggcgccagaatcaacaggatcttccacgaaagattcccatttgaactagtcaaaatggaattcgatgagaaggagctgcgccgggagatcagctatgctatcaaaaatatccacggaatccgtacaggactgtttactccagatatggccttcgaaaccatcgtcaaaaagcaggtcaagaaaataagagagccatgcctcaagtgtgtggacatggtgatcagtgaactgatctccactgttaggcaatgtactaagaagctccaacagtacccaaggctgagagaagagatggaaaggatagtgacaacccacatccgcgagcgcgagggtaggactaaggaacaggtgatgctcctgattgacatcgagcttgcctatatgaacactaaccacgaggacttcatcgggtttgccaatgcccagcagcgaagcaaccagatgaacaagaagaagacaagcggtaatcaggacgagatcttagtaatccgtaagggctggctgaccattaataacattggaattatgaagggtgggtctaaggaatattggtttgttctcactgcagaaaatttgagttggtataaggatgacgaggaaaaggagaagaagtatatgttaagcgtggataatcttaagcttcgtgatgtggagaaggggtttatgagtagcaagcatatctttgcgctgttcaatacggaacagagaaacgtatataaagattaccgccaactggagctagcctgcgaaacacaggaggaagtcgattcttggaaagccagctttttgcgagcaggggtttaccctgagagggtaggggataaggagaaggcctcagaaaccgaggaaaacggctccgacagttttatgcactcaatggatcctcagcttgagcggcaggtggagacaatcaggaatctggtggattcatatatggccatcgtgaataaaaccgtgagagatctgatgcccaagaccatcatgcatcttatgatcaataacaccaaggagtttatattttcagagctccttgccaatctgtacagctgtggggatcaaaacaccctgatggaggaaagcgccgagcaggcgcaaaggagagatgaaatgctcagaatgtatcatgcactgaaggaggcactgagtatcataggggatattaacactaccacagtgtctactcctatgccgccccctgtggacgattcttggttacaggtgcaatctgtaccagctgggcggcgttctcctacctcctcccctactccacaaaggcgcgcacccgccgtgcctcccgcaaggcccggttctaggggcccggcgccggggcctccaccggctggaagtgctctcggtggggcccctcccgttccaagccgacctggggcctcgccagaccccttcggccctccaccacaagtcccgtctcgacctaaccgtgcaccaccaggcgtgccgtcccggagcggccaggcgtctccatcccgccctgagtcgccccggccaccatttgatctgtag

SEQ ID NO: 115202 - DNA, 1989 bp, Artificial Sequence
  Description of Artificial Sequence: Synthetic coding sequence
atggaggacttaataccattggtcaaccgtctgcaggatgctttcagtgccatcggtcaaaacgcagatctggacctgcctcagattgctgtggtaggcggacagagcgccgggaaatccagcgtgttggagaatttcgtgggtcgagacttcttgcctcgggggtccggtatagtcacaaggcgacccctcgtgctgcagttagtcaatgcaactactgaatacgccgagtttctccactgtaagggaaagaagtttacggattttgaggaggtgaggttggagattgaggcagaaacggatcgtgttactggtactaataagggtatcagtcccgttccaattaacctcagagtgtactctccgcacgttctcaacttgacattggtggacctgcccgggatgacgaaggtaccagttggcgaccaacccccagacatagagtttcaaatcagggatatgctcatgcaatttgtgacgaaggaaaactgcctcattttagcagtgtccccagccaactcagatttggctaactccgatgctcttaaggtagcaaaagaggtggaccctcaggggcagcggaccataggggtaatcactaaactggacctcatggatgagggtactgacgcccgggatgtgctcgagaataagctgttacccctgagacgcggttacattggagtagtgaaccgctctcagaaagatatagacggcaaaaaagacataacggcagccttggccgctgagagaaagttttttctctcacatcctagctaccgacatctggcagacaggatgggaaccccctacctgcaaaaagttctgaatcagcagctgaccaaccacattagggataccctccccgggctgcgcaataagcttcagtctcagctattgtccatagaaaaggaagtggaagagtacaagaatttccgccccgacgaccctgctaggaaaaccaaggcattactgcaaatggtccaacagtttgccgtggactttgaaaagcgtatcgaggggagtggtgatcaaatcgacacctatgagctgagtgggggcgctagaatcaaccgtatattccatgagcgcttcccgtttgagctggtaaaaatggagtttgacgagaaagagcttcgtcgggagattagttatgctattaagaatatacatggaatccgtacgggcttatttacgcctgacatggctttcgaaaccatcgttaaaaaacaggtgaagaagatccgggagccatgcctcaagtgtgtggacatggttataagcgaactcatttcaaccgtccgccagtgtaccaagaaactccagcagtatcctaggctccgcgaagagatggagcgaatcgtaactacccacattcgggaacgtgaggggaggacgaaagagcaagtcatgctactcatcgacatagaactagcatacatgaacactaaccatgaggatttcattgggtttgcaaatgcacagcagcggagtaaccagatgaacaagaagaagacatcagggaaccagatcacgctgcaagtaatccgtaaaggatggttgaccatcaacaacattggcataatgaaagggggatcaaaggaatactggttcgtgctcacggccgaaaacctgtcatggtacaaggatgatgaggagaaagaaaagaagtatatgctctccgttgacaatctcaagttaagggacgtggaaaaagggtttatgtcctctaagcatatcttcgcattgtttaacactgagcagcggaatgtgtataaagattacaggcaattagagcttgcctgcgagacccaggaggaggttgattcctggaaggccagttttcttagagctggcgtatacccggaacgggttggcgataaggaaaaggtgtctgtcccattttcatgtctcctgccaggaatctgctctcttgcacccgctccagctcgattctccagcaaaggacctggcgacgtgctgttctag

SEQ ID NO: 115203 - DNA, 2556 bp, Artificial Sequence
  Description of Artificial Sequence: Synthetic coding sequence
atggggaaccgcgggatggaggacctgatacctctagtcaatagacttcaggacgctttttctgcaatcggccaaaacgccgacctggatctccctcaaatcgcggttgtcggagggcagtccgccggtaagtcctctgtgctcgaaaacttcgtcggccgcgactttctccctcgcgggtccggaatcgtgacccgacgcccactggtgctgcagctggtaaacgcgactaccgaatatgctgagtttcttcactgcaaagggaaaaaattcaccgatttcgaggaagtgcgattggaaatcgaggcggagaccgatcgcgtcacaggcactaacaaaggcattagtcctgtgccaatcaatcttcgggtatactctccccacgtattgaacctgaccctggtggatcttcctggcatgacaaaagtccccgttggagatcaaccacctgacattgagttccaaatcagagacatgcttatgcagttcgttacaaaggaaaactgcttaatcctggccgtatccccagcaaactccgatttagccaattccgacgccctcaaagtagcaaaagaagtggacccgcaggggcagagaacaatcggagtgatcaccaagctagatctgatggacgaaggaaccgatgctagggacgttctagagaataaacttctgccccttcgaaggggctatattggcgtggtgaatagaagtcagaaagacatcgacggcaaaaaggacatcaccgctgcgcttgctgctgaaaggaaattctttctgagccatcccagctaccggcacctggctgaccgaatgggtacgccatatctccagaaagtgctaaaccagcagctaacaaatcatattagagacaccctgcccggactccggaacaaactgcagagccaactgttgagtattgagaaagaggtggaggaatataagaattttagaccagacgatccagctaggaagaccaaggcccttctgcagatggttcagcaatttgcagtggactttgagaaaaggatcgaaggttcaggggaccagatcgacacctacgagttgagcggcggggcccggatcaacagaatcttccatgaacgatttccattcgaactggtgaagatggagtttgatgaaaaggagctgcggagggagattagttatgcgataaagaacatccatggcattaggaccggcttatttacccccgatctggcttttgaagctaccgttaagaagcaagtgcagaagctgaaggagccatctatcaaatgtgtcgatatggtggtgtctgagctgacagcaaccatccgtaagtgctctgagaaacttcagcaatatccaagactgagagaagagatggagcgaatcgtcacaacccatatcagggaacgcgaggggcggaccaaagaacaggttatgttgctgattgatatcgagcttgcgtatatgaacaccaaccacgaagacttcatcggctttgccaacgctcagcagcggtcaaaccagatgaataagaaaaaaacctcggggaaccaggatgaaatccttgtcataagaaaaggctggctgaccattaataatatcggtatcatgaagggtgggtccaaggagtattggttcgttctcaccgcagaaaatttgtcgtggtacaaggatgatgaagaaaaggaaaaaaagtatatgctatcagtggataatttaaaactgcgtgacgtcgagaagggattcatgtctagtaagcatatattcgctttgttcaacactgagcagagaaatgtgtataaggattatcgacagcttgagctcgcctgtgagactcaagaagaagtagattcctggaaggcctcgttcctgagagcgggcgtttatcccgaacgggttggagacaaagagaaagcatcagagacagaagagaacggatccgactcttttatgcatagcatggacccccagctggagcgacaggtagaaactattcggaaccttgtagattcgtatatggccatcgttaacaagacagtcagggacctcatgcctaagacgatcatgcatctgatgattaataatacaaaggagtttatatttagcgagctgctggccaacctctattcttgtggcgaccagaacacactaatggaggaatccgccgaacaggcccagcgacgcgatgagatgcttcgaatgtaccatgctctgaaggaggctttatctatcataggggacattaataccactaccgtgagcacaccaatgccccctcctgtggatgattcttggctccaggtacagagtgtgcccgccggacggcgtagccccacatctagtccaacacctcagcgtcgggccccggccgttcccccggcacgcccaggcagccgcggcccagctccggggcctccacccgccggatccgctttggggggtgctcccccagtgcccagccggcccggcgccagtcctgatccatttggacctccccctcaagtgccttcacgccccaatcgcgcgccacctggagtaccccgcataaccatcagtgatccctag

SEQ ID NO: 115204 - DNA, 2556 bp, Artificial Sequence
  Description of Artificial Sequence: Synthetic coding sequence
atggggaacagaggcatggaggatttaattcctctggtcaacagattgcaagacgccttttcagctatcggccagaatgccgatcttgacctgccgcagatcgctgtagtaggcgggcagtctgccggaaagtcatcagtgttagagaatttcgtcggcagagatttcctccctcgtggttctggtatcgtaaccaggcgacccctggtcctgcaacttgtcaatgctactacagagtatgcggagtttttgcactgcaaagggaaaaaattcactgactttgaggaagttaggcttgaaattgaggccgaaacagaccgcgtgacaggtactaataagggcatcagtcctgtaccaattaaccttcgcgtgtatagtccgcacgtattgaacctgaccctggttgaccttcccggtatgacgaaggtgcctgtgggggaccagccaccggatatcgagttccagatacgcgatatgttgatgcagttcgtgaccaaggagaattgtttaatcctggcagtgtctcctgcaaactcagacctggctaactccgacgctcttaaagtcgctaaagaggttgatccccaggggcagcgtacaattggggtcatcactaagctggacttgatggacgaaggcaccgatgcccgggacgtactagaaaataaactactgcctctccgaagagggtatattggtgtggtcaacagaagccagaaggacatcgacgggaagaaagacatcactgctgcactggccgccgagcgcaaattttttctgtctcaccccagttacagacacctagcagataggatgggcacgccctatttacaaaaggtgctgaatcagcagttgaccaaccacataagagatacattgcctggtctgcgcaacaaacttcagtctcagctgttgtcgattgagaaagaggttgaggagtataaaaacttccgacctgatgatccagcacggaaaacaaaggccttattacagatggtgcagcagtttgctgtggactttgagaagagaatagaaggaagcggtgaccagatcgatacctatgaactatcaggcggcgcgcgcatcaaccgaatttttcacgagcgattcccctttgaactggttaagatggaattcgacgaaaaggagcttagacgtgagatttcctacgccatcaaaaacatacacgggatcaggaccggtctgtttaccccagatctggctttcgaggccaccgtgaagaaacaggtgcagaaactcaaggagccctcaatcaagtgtgtggatatggtggtgagcgaactgacagctaccatcaggaaatgtagcgagaaacttcagcagtatccgagattgcgggaggagatggaacggattgtcactacccacattagagagcgtgaaggtcgaactaaggagcaagtgatgctgctcatcgatatcgaactggcctacatgaacacgaatcatgaagattttattggattcgccaacgcacagcagaggagcaatcagatgaacaagaaaaagacaagtggaaatcaggacgagatcctagtcatcagaaaaggttggctcaccattaacaatatcggaataatgaaagggggtagcaaggaatactggttcgtgcttaccgcagagaatctgtcttggtataaggatgacgaagaaaaagagaagaaatatatgctcagcgtcgataatctgaaattacgcgacgtggaaaagggcttcatgtcttcgaagcacatcttcgcccttttcaatactgaacagaggaatgtttacaaggactatcgacaactcgaactcgcctgtgaaacacaggaggaggtagatagctggaaagctagtttcttgcgagcaggtgtctacccagaaagggtgggtgacaaggaaaaggcttccgaaacggaagaaaatggcagcgactcatttatgcacagtatggatcctcagctcgaacgtcaggtggaaacaatcaggaatttggtcgactcttatatggcgattgtgaataaaactgtgagagacctgatgccaaaaactataatgcaccttatgatcaacaacactaaagaattcatattttccgaactcctggctaacctctactcatgcggcgaccagaacacattgatggaagagagcgccgaacaggcacagcgacgggacgagatgctgcgcatgtatcatgcgctgaaggaggctctctcaattattggtgacattaatacgacaaccgtcagcacgcccatgccgccaccagtggacgactcttggctccaggtgcagagtgtccctgcaggccgccgaagccctacatcctctcccactcctcagcggcgagcaccagctgtaccaccagccaggccgggttccagaggtcctgccccagggcctcctcccgcagggtccgccttaggcggcgctccacccgtgcccagcagacccggtgcctccccggacccatttggacccccaccccaagtcccgtcacgacccaacagggcgccgcctggtgtccccaggataaccatctcagacccctag

SEQ ID NO: 115205 - DNA, 2595 bp, Artificial Sequence
  Description of Artificial Sequence: Synthetic coding sequence
atgggcaaccgcggcatggaggatctgattccgctggtgaaccgtttgcaggacgccttcagtgcaatagggcaaaacgccgacctcgaccttcctcagatcgctgtcgtcggtgggcaatcagcggggaaaagtagcgtactggagaacttcgtgggacgggattttctgccacgtgggtcaggtatcgtaacccgcagaccattggtcctgcaattggtgaatgccactactgaatacgcagaattcttgcactgtaaagggaaaaagtttacagacttcgaagaggtgcggctcgaaatagaagctgaaaccgatagggtaaccggcacaaataaagggatcagcccagtgcctattaatttgcgcgtgtattctcctcacgttttgaatctgacactggttgacctgccaggcatgactaaggtgccagtcggagaccaaccacccgacatagagtttcagataagagatatgcttatgcagtttgtgacaaaggaaaactgcctcattctggcagtttctccggccaattctgaccttgcgaactccgatgctctgaaggtcgcgaaggaggttgacccccaaggccagaggacaatcggagtgattaccaaattggacctcatggatgaaggaacggacgctcgcgacgtactcgagaacaaactgctgcccttgcgccgaggatacatcggcgtagtcaatagaagtcagaaagacattgacgggaagaaagacattacagctgccctcgccgctgaacggaagtttttcctatcccacccgagttaccggcacctggctgaccgcatggggacgccctatctgcagaaggtactcaatcaacagctgacaaaccacatcagggataccttgccgggtttacgtaacaagctgcagtcccagctgttatcgatcgaaaaggaagttgaggagtataagaacttccggcccgacgaccctgcccggaagaccaaagcgttgctgcaaatggtacaacaattcgcagtggattttgagaagcgtattgaagggagtggggaccagatcgatacatacgaactctctggcggtgcccgaataaatcggatatttcacgaacggtttcccttcgaacttgtgaaaatggagttcgatgagaaagaactgcgtcgcgagatctcctatgccattaagaacattcacggcatccgcacagggctgtttacccccgatctcgcttttgaagccacagttaagaaacaagtccagaagttgaaagagcccagtattaaatgcgtcgacatggtggtctctgaacttacggccacaatacgcaagtgcagcgaaaagcttcaacagtacccgcgccttcgcgaggagatggaacggatagtgacaacgcacatccgcgagcgcgaaggacgcaccaaagagcaagtgatgttactcatcgacatagagttggcatatatgaataccaaccacgaggatttcatcggttttgccaatgcacagcaaagatccaatcaaatgaataagaaaaaaactagcggaaatcaggacgagatccttgttatccggaaagggtggttgactatcaacaacatagggatcatgaaaggaggcagtaaggagtactggtttgtcctaacggctgagaatctgagttggtacaaagatgatgaagaaaaggagaagaagtacatgttgtctgtcgacaatcttaagctcagggacgtggaaaaaggttttatgtccagtaagcatatatttgctctgttcaacactgaacagaggaatgtttacaaagattatcgacagctagagcttgcctgtgaaactcaggaggaggtcgactcatggaaagccagcttcctgcgggcaggcgtgtacccagagcgggtgggcgataaagaaaaagcttctgaaacagaggagaacgggtccgatagttttatgcattccatggatccgcagttagagcggcaggtggaaacaattagaaacctggtggattcatatatggccattgtgaataaaactgtgcgcgacctgatgcctaagactattatgcatttgatgatcaataacactaaagaattcattttctccgagctgctggctaatctgtattcctgtggggaccagaacaccctgatggaggaatccgcggagcaggcccagaggcgagacgaaatgctgcggatgtaccatgccctgaaggaagccctcagcattatcggtgacatcaatactaccaccgtctccacacctatgccacccccagtggacgattcgtggctgcaggtccagtcagtccctgcaggacgacgcagccccacctccagtcccacccctcaaagacgcgcccctgctgtacctccagccagaccgggttcgaggggccctgcgcctggccctcctcctgccgggtcagccttgggtggagcaccaccagttccttccagacccggagcttctcccgatcccttcggcccacccccacaggtcccaagtaggccaaatcgagcccctccaggagtgccttcccggtccgggcaggcctcaccctccagacccgagagcccgagaccgccctttgatctgtag

SEQ ID NO: 115206 - DNA, 1191 bp, Artificial Sequence
  Description of Artificial Sequence: Synthetic coding sequence
atggagaggatcgtcaccactcacatacgcgaacgagaaggaagaactaaggagcaggtaatgttgctgattgacattgaactcgcctacatgaatacaaaccatgaggactttatagggtttgccaacgcccaacagcgaagcaaccagatgaacaaaaagaagacctccgggaaccaagatgaaattcttgtgattcgcaaagggtggctgactattaataatatcggcattatgaagggaggctccaaagagtactggttcgtgctgaccgccgaaaacctctcatggtataaggacgatgaggagaaggagaagaaatatatgctaagcgtggacaaccttaaacttcgagacgtggagaagggctttatgtcaagcaagcatatcttcgccctgtttaatactgaacagaggaatgtgtacaaagactatcggcaactggaactagcttgtgaaacccaggaggaggtcgactcttggaaagcctctttcctgcgggccggggtgtaccctgaaagggtgggagacaaagagaaggcctccgagaccgaagagaacggatccgacagttttatgcacagcatggacccacaactagagagacaggtggagaccatccgaaatctggtggactcttatatggcgattgtgaacaaaacagtcagagacctaatgcccaagacgattatgcacctaatgataaataacaccaaggagttcatctttagtgaattattggccaacctgtacagctgcggtgaccaaaacaccttgatggaagaaagcgccgaacaggcccagcgtagagatgaaatgctgaggatgtatcatgccttaaaggaggcccttagtatcatcggtgatattaatacaacaacagttagcacccctatgccaccacccgtagatgattcttggctacaggtgcagtctgttcctgccggccgcaggtcccccaccagctctcctactccacagcgtcgagcaccagctgtgcctccagctaggccagggtcccgaggccccgcgcctggcccccccccggcagggagcgctctaggtggagcccctcctgtgccttccaggcctggagcttcacccgacccatttggcccacctccccaagtgccgtccaggccaaacagggcccccccaggggtcccgcgaattactattagcgatccttag

SEQ ID NO: 115207 - DNA, 1728 bp, Artificial Sequence
  Description of Artificial Sequence: Synthetic coding sequence
atggaggctctgattcccgtgatcaacaagctgcaggacgtattcaacaccgtgggggcggatattatacagctgcctcagatcgtggtggtcgggactcagtcttctggtaaatctagtgtgctagagtcacttgtgggcagagatctgctcccccgtgggactgggatcgtgactcgccgcccactgattctccaactagtccacgtctcccaggaagacaagcgcaaaactactggcgaggagaacggggtggaggctgaggaatggggcaagttcctgcacaccaaaaacaaattgtatactgactttgacgaaattcgccaggagatagaaaatgagactgagaggatctccggaaacaataaaggagtgtcaccggagccgattcatttgaagattttcagtcccaatgtggtcaatctgactctggtcgatctacccggcatgaccaaagtgccagtcggcgatcagccaaaggatatcgagttgcagatccgggagcttatcttgcggttcattagtaatccgaattccatcattctagccgttaccgctgcaaacaccgatatggctacctcagaagccctgaagatttcacgcgaggttgacccagatggtcggcggacactggctgtcatcactaaactcgacttaatggatgctggcacagatgctatggatgtgttgatgggcagggtgattccagtgaagcttggaattattggcgtggtcaacaggtcccaactggacatcaataataagaagtccgtgaccgactctatccgagatgaatatgctttcttgcagaaaaaatatccctccctagcaaaccggaacgggacaaagtacctggccagaacccttaatcgcttactcatgcatcacataagagactgtttgccagaactgaagacgcgcatcaatgttctcgctgcgcaatatcagtctctgctgaactcatatggagagccagttgacgacaagtctgccacactgctgcaactcatcactaaattcgccactgagtactgcaacactattgagggtacagccaagtacatcgagacatctgaactgtgcggcggcgctcggatttgctatatctttcacgagacatttggacggacactcgagtctgtcgatcccttaggggggcttaacacgatcgacatccttacagcaattcgtaatgcgactggcccacgccccgccctctttgtgcctgaagtgagcttcgagcttctggtgaaacgccagatcaaaagactggaagaacccagcctacggtgtgtggaactggtgcatgaggagatgcagcgtattatccagcattgcagcaattacagtacacaggagttgttgcgctttccgaagttgcatgacgctattgtggaagtggtgacttgtctcctaagaaagcgcctgcccgtcacaaacgaaatggttcataacttagtggctatagagctcgcctatatcaataccaagcatcccgactttgcggatgcctgcggacttatgaacaataatatagaggaacaaaggcgcaacaggctggcgcgggagctacccagcgccgttagccgtgataaagttgcgtcgggaggcggtggcgtgggcgacggggtacaggagccaaccaccggcaactggagaggtatgcttaagacctccaaggccgaagagttgttggccgagaaaaagaagaagaagaagaagaagtag

SEQ ID NO: 115208 - DNA, 2100 bp, Artificial Sequence
  Description of Artificial Sequence: Synthetic coding sequence
atggaagccctcatcccagtaattaataagctgcaagacgtgtttaataccgtgggtgccgatattatccagcttccccagatcgttgtcgtcggaacccaaagctcaggcaagtccagcgtcctggagtctctcgttggaagagacttattacccagaggcaccggcattgtcacccggcgaccattaattctccaactggtgcatgtgtcacaggaggacaagcgaaaaacgaccggtgaagaaaatggagtagaggcagaagagtggggcaagtttttgcacacaaaaaataaactctataccgattttgacgaaatccggcaggaaatcgaaaatgagacagaaagaataagtggtaataacaagggtgtgtctcctgagcccattcacctgaaaattttctcgccaaatgttgtgaacctgactctggtagacctccccggcatgacaaaggtacccgtgggagatcaaccaaaagatattgagcttcagataagggagcttattctgagatttatatctaatccaaacagtattatcctggctgtcactgctgctaataccgacatggcaactagtgaggcgctgaagatttctcgggaggtcgacccagatgggagacgtaccctggctgttatcacgaaacttgacctgatggatgccggaactgacgcaatggacgtgcttatggggcgggtgattcccgtgaagctgggaatcatcggcgtggtgaatcgatcccagctggacatcaataataagaagtcagtgacagactcgattcgggacgagtatgccttccttcagaagaagtacccttctctggccaataggaatggcaccaagtaccttgccagaaccctgaacagattactcatgcaccatattcgtgattgtctgccggagctcaagaccagaatcaacgtcctagcagcccagtaccaatctctcctgaattcgtacggcgaacccgtcgacgacaagagcgcgacactcctgcagctaatcaccaagtttgcaacagaatattgtaacaccattgaaggaacagcaaagtatattgagacttctgagctgtgtggaggcgctaggatctgctacatctttcacgaaacctttggaagaactttagaaagtgtggatcctctgggggggctgaacacaattgacatcctaacagctatccgaaatgcaaccgggccaaggcctgcactgttcgtgcctgaagtgtccttcgaactgttagtgaaaagacaaattaaacgtctcgaagagcccagtttacgatgcgtggaattagtccatgaggagatgcagaggataattcaacactgcagtaactatagtacccaggaattacttcgattccccaaactccatgatgctattgtagaggtggttacttgtttgctgcgtaaaagacttccagtcactaacgaaatggtgcacaacctcgtggcgatcgaactcgcatacatcaataccaagcatcccgactttgctgacgcgtgcgggctgatgaataataatatagaggagcaacgtcggaatcgccttgctcgtgagttgccaagcgcggttagccgtgacaaggtggcctctggaggtggtggtgtgggtgatggggtccaagagcctaccactggtaactggagagggatgttgaaaacttccaaagcagaagaactcttggcagaagaaaagtctaagcccattcctatcatgcctgcttcaccacagaaaggccatgccgtgaacttacttgacgtacccgtgcccgtagcaagaaagctgtcggcaagggaacagcgagactgcgaggtgatagagcgcctgataaaatcatacttcctcattgtgagaaaaaatatccaggattccgtcccaaaagctgtgatgcacttccttgtgaaccacgtcaaggacacccttcaatctgagcttgtgggccaattatataaaagcagtcttctcgatgacctactcactgaaagtgaggatatggcacagcggcggaaagaggcagctgatatgttgaaggcactacagggagcctctcagatcatagcagaaattagggagacacatctgtggtag

SEQ ID NO: 115209 - DNA, 2376 bp, Artificial Sequence
  Description of Artificial Sequence: Synthetic coding sequence
atggcatgtcgggaaggcgctggcagtaggcgcgcacgctccaatggctgtcgcttaccccgaagaggtcggagacgcggcggtcgccgtcggacggtgggccctggacctattcattgtcgagggaggagagccctgggaccccgcgtattccgcgtcatggaagccttgatccccgtgattaataagcttcaagacgtcttcaacactgttggggctgacatcatccaactgcctcagatcgtggtagttggcacccagtccagtgggaaatcttccgtcctcgagtccctcgtcgggagggacctcctgcccagaggaactgggattgtcacacggcggcccttgatcctccaactggtgcatgttagccaagaagacaagaggaagaccactggggaggaaaatgaccctgcaacctggaagaactccaggcacttaagtaaaggagtagaggctgaagaatggggaaaatttttgcatactaagaataaactgtatactgattttgatgagatccggcaagaaatcgaaaatgagacagaacggatttcgggcaacaataagggtgtttccccggaacccatccacctgaaaattttcagtcctaacgtggtgaatcttactctcgtcgacctgcccggaatgactaaggttcccgttggcgaccagccgaaggatatcgagctccagatcagagaactaatcctccgatttattagtaatcctaactcaataattctcgccgtgactgccgctaacaccgatatggccacctcagaggcgctgaaaattagccgggaggtggacccagacggtagaaggactctggccgtcatcactaagctggatttaatggatgccgggacggatgctatggatgtgctaatgggtcgcgtcatcccagtcaagttggggatcataggtgttgtgaaccgttctcagcttgatatcaacaacaaaaagtctgtgacagatagtattagggatgagtatgccttcctgcaaaagaaatacccttccctggcaaataggaacggaacaaaatacctggctaggacactgaatcgcttgctaatgcaccatattagggattgtttacctgagctaaaaacacggatcaatgtgctcgccgcacagtatcagtctctactgaactcctatggcgaacccgtggatgacaagtcagcgactcttttacagctgatcacgaagtttgctacggagtattgcaacaccatcgaggggacagccaaatatatcgagacatctgaactgtgcggtggagcacgaatctgttacatctttcacgagactttcggcaggactctggaaagcgtcgatcccttaggcgggctcaacaccatcgatatcctgacagccatcaggaatgctacgggccctcgtcccgcacttttcgtgcccgaggtctccttcgaactgctggtgaaaagacaaattaagcgtctagaagaaccttccctcaggtgcgtagagcttgtccatgaggagatgcagagaattatacagcactgcagcaattactctacccaggagctcctgcgcttcccaaagctgcacgacgccattgttgaggttgttacatgcctattgcgcaagcgtctacccgtcaccaatgagatggttcataatttggtggcaattgaacttgcttatataaataccaagcaccccgatttcgccgatgcttgtggcctcatgaacaataacatcgaagagcagaggaggaatcggctggccagggagttgccatcagctgtaagccgggataaaagcagtaaagtgccttccgctctggcgcccgcttcacaggaacccagccctgccgccagtgccgaggctgacggcaaagtcgcctccggcggcggcggcgtcggcgacggggtccaggagcctacgaccggcaattggcgaggaatgctgaaaacctccaaagccgaggagctcctcgctgaagagaagagcaaacccatccctattatgccagcctcccctcagaaagggcacgctgtgaacctcttggacgtgccggtgccagtcgctaggaagctgagcgccagggagcaacgcgactgtgaggttatcgagcgtctgataaagagttatttcctgattgtacgcaaaaacatccaggacagcgtacctaaggctgtgatgcatttcctggttaatcacgtcaaagacaccttacagtccgagctggtcgggcaactctacaaaagtagtctgctagacgatctgctcacagagtcagaagacatggcccagagaagaaaagaagcagcagacatgttaaaggctctccagggcgccagtcagattatcgcagaaatcagagaaactcacctctggtag

SEQ ID NO: 115210 - DNA, 1602 bp, Artificial Sequence
  Description of Artificial Sequence: Synthetic coding sequence
atgttccacaaaaaaataaatggaaaacagcaagagaagaaaatgaccctgctccacggaaagactcaggacactttcctgaagggatggaagcagaaaaatggggttaattttttcacgccgaagattaggtcccagctggatatcaataacaaaaagagtgtcaccgactctattcgagacgagtatgccttcctgcagaagaagtacccatccctggcgaataggaacggtaccaaatacctggccagaacactgaacaggttgctcatgcatcatattagggactgccttccagaactgaagaccaggatcaatgtcttggccgcacagtatcagagcttgctaaactcttatggcgaaccagtggatgacaagagcgccacattacttcagcttatcacaaaattcgccacagagtattgtaacaccattgagggaacggctaagtacatcgagacctcagaactctgtggcggagcccgcatctgctatatctttcacgaaactttcgggcgcactctcgagtccgtggatccactgggcggcctgaatacgatagatatattgacagcgattaggaatgctacaggtccccgaccagcactgttcgtgcctgaagtctcctttgagctgctggtgaagcggcagattaaacgattagaggaaccaagtctgagatgcgtcgaactggtgcacgaagagatgcaaaggatcatacagcattgtagtaactatagcacccaggagctgctcagatttcctaagctgcatgacgcaattgtggaggtggtgacctgcctgctcaggaagcgcttaccggttactaatgagatggtccataacctcgttgccatcgaactcgcttatattaataccaagcatcctgatttcgctgatgcttgtggcctgatgaacaataatatcgaggaacagaggagaaatagactcgcccgagagctccccagtgcagtgtcgagagacaagtccagtaaggtgccgtccgcgctcgctcccgccagccaggagccctctcccgctgctagtgccgaggccgatggaaaactcattcaggacagtcggagagaaaccaaaaacgtggcctccggcggcgggggagtgggagatggagtccaggagccgactacaggtaactggcgtggtatgctgaagaccagcaaggcagaggaactgcttgctgaggagaagagcaaaccgatccctatcatgcctgcttctccccagaagggccacgcagtcaacttactggacgtaccagtgccggtcgcgcgcaagttgtccgcgcgcgaacagagagattgcgaagtgatagagcgacttatcaagtcctattttctgatcgttaggaaaaatatacaggactctgtgccaaaggcggttatgcattttctcgtgaaccatgtaaaggacactctacagtcagaattggtcggacaactgtacaaatcaagccttctcgatgatttattaactgagtccgaggacatggcccagaggcgaaaagaggcagctgacatgctaaaggctctgcagggggcttctcagattatagctgagatcagagaaactcatttgtggtag

SEQ ID NO: 115211 - DNA, 2133 bp, Artificial Sequence
  Description of Artificial Sequence: Synthetic coding sequence
atggaggccttgattcctgtgatcaataagctccaggatgtcttcaacacggtcggcgccgatattatccaattgccccaaatcgtcgtggtgggaacacagtcatctggaaagagcagtgtgctggagagtctcgttggccgggatctgctccccagaggcacagggatagtcacccgccgcccactgatattacagcttgtgcatgtctctcaggaggataaaaggaagaccacaggggaggagaatggggtcgaggccgaagaatggggaaagtttttacatacaaaaaataaactgtatacagattttgacgagattcgacaggaaatagagaacgagactgagagaataagcggtaacaataaaggggtctctcccgaacccatacatctgaaaatttttagtccaaatgttgtcaacctcacacttgtggacttaccaggcatgaccaaggtgccagtaggtgaccagcctaaagatatcgagctgcaaattcgggaactgattctgagatttatctctaaccctaactctatcatcctggctgtgactgcggcaaacaccgatatggcaaccagcgaagccttaaaaatatcgcgtgaggtcgatcctgacgggaggcgaaccctggcagtgatcaccaagctcgatctgatggatgctggcactgatgctatggatgtccttatggggagggtgattcctgtaaagctcggcattataggagtggtaaatcgcagtcagctcgatatcaataataagaaatccgttacggacagtatcagagatgaatatgcttttttgcaaaagaagtaccctagcctggctaatagaaacgggactaagtatctcgctagaactctgaacaggttgctcatgcaccatatccgggactgcctccccgagctgaaaactcgcatcaatgtgctcgccgcccaataccagtcactgctgaattcctatggagagcccgtggatgataagtctgctacccttctccagctaatcaccaagttcgcgaccgaatactgcaacaccattgagggaactgctaaatatattgaaaccagcgaactgtgtggaggggctcgaatttgttatatctttcacgagacttttggccgtacgctggagagtgtggatcctcttggtggattgaacaccatcgacatcttgacagcgatccgcaacgctactggcccccggcccgcactcttcgttcctgaagtgagctttgaactgttagttaagcgccaaattaagcgtttagaagagccttccctgcggtgcgtagagctcgtgcacgaagagatgcagagaatcatccagcattgctccaattattctacccaggagcttctgcgcttcccaaagctccacgatgctattgtggaggtcgtcacttgcctgctgcgtaaacggctgcctgttacaaatgagatggtgcacaatctggtggcaatcgaactggcttacatcaacacgaagcaccccgacttcgcagatgcctgcgggctgatgaacaacaacattgaggaacagcgaaggaaccgcctggcacgtgaactcccaagtgccgtgagtcgcgataaactcatccaggattcgagaagagagaccaagaacgtggcctctggtggagggggtgttggcgacggagtacaggaacctactactggcaattggagggggatgttaaaaacgtccaaagctgaagaactgcttgcagaagagaaaagcaagcctatcccgatcatgcctgcaagcccgcaaaaagggcacgctgtgaatctgctggatgttcctgtacccgtcgcccggaagttatcggcgagagagcaaagggactgcgaggtgattgaaaggctgattaagtcttacttcttgattgtcagaaagaatatccaggattccgtgccgaaggcggttatgcacttcctggttaatcacgtgaaggacacactacagtctgagcttgtggggcagctttacaagagctcactcttggatgacctcttaaccgaatcggaggatatggctcagcgtagaaaggaagccgctgacatgctgaaggccctccaaggcgcctctcagatcatcgcagaaatcagggagacccacttgtggtag

SEQ ID NO: 115212 - DNA, 2178 bp, Artificial Sequence
  Description of Artificial Sequence: Synthetic coding sequence
atggaagccctgatccccgtgattaataaattgcaggatgtgttcaatacggtaggagcagatataatacaactcccacaaattgtcgtagttggtacccaatcaagtgggaagtcaagcgtactcgaaagcctggtgggtcgtgacctgctaccacgaggcaccggcatcgtgacccgccgaccactgatactccaacttgtacatgtgagtcaggaagacaagcgcaagactactggggaggagaatggggtggaggcagaagaatggggaaaattcctgcacacaaagaacaagttatacacagacttcgatgaaatccgccaggaaatcgagaacgagaccgagcgcatttccggcaacaacaagggtgtctcaccagagcctattcacctgaagattttctctcctaacgtggtgaacctgacactggtggatctgccgggcatgactaaggtgcccgttggggaccagcccaaagatatcgagctccagattcgggaactgatactgagatttatatcaaacccaaattccataatccttgccgtaacggcagccaacaccgatatggcgacatccgaggcgttgaaaattagccgcgaagtagatcctgacggtcggcggaccttagccgtcataacgaaactggacctcatggacgccggaactgacgcaatggatgtgttgatgggccgggtcatacctgtcaaattgggcattatcggcgtggtcaatcgctctcagttagacatcaacaataagaagtctgttactgactccatcagggacgagtatgcctttttgcagaaaaagtacccgtccctggccaaccgcaatggaacaaaatatttggcccgcaccctgaatcggctcctgatgcaccatattagagattgtctgcccgaattaaaaacgcgcattaacgtgctagctgctcagtaccagtctctgctgaactcctacggggaacctgttgatgacaagagcgcgactttgttacaactgattactaagttcgctaccgagtattgtaataccatcgaaggaactgctaagtatatagaaaccagtgagctctgcggcggagccagaatttgttacatctttcacgagacctttgggcgaactctggagagtgtagaccctctgggcggactcaatacaattgatatccttaccgccatccgaaacgccactggcccccggccagcattgtttgttcctgaagtgtcttttgaacttctggtgaagcgccagatcaaacgcctcgaagaaccgagtctgagatgcgtcgagcttgtgcacgaagagatgcagcgcatcatccagcattgcagcaattattctacccaggagttgctgcgctttccaaagcttcacgacgccatcgtggaagtggtcacctgcctcctccgcaaacgcctgcctgttacaaacgagatggtccacaacttagttgccatcgagcttgcgtatatcaatacgaagcaccctgacttcgcggacgcttgcggtctgatgaacaacaatatcgaggaacagagacgaaatagacttgctagagagctcccttcagcggtttcaagagataagtcctccaaagtgccctcagcacttgctcccgcgagtcaggagccctcacctgcagcttctgcggaggcagacggcaaagtcgctagtggaggaggcggagtcggggatggcgtgcaagagcccacaaccggaaactggaggggaatgctcaaaacgtcgaaggcggaggaactgctggctgaagaaaaaagtaaaccaatccctattatgcccgccagtcctcaaaagggccatgccgtgaacctgctcgacgtgcctgtgcctgtcgcccggaaactgagtgcacgcgagcagagagactgcgaggtgatcgaacggttaattaagagctattttctgatcgttagaaagaacatccaggacagcgtacctaaggcggtaatgcacttcctcgtcaatcacgtcaaggacaccctccagtctgagctagtgggacagctgtataaatcaagcctcctcgatgacctcctcaccgagtcagaggacatggcacagaggcggaaggaggcggcagacatgctgaaggcgcttcagggggcctcccagattatcgctgagatcagggaaacccacctctggtag

SEQ ID NO: 115213 - DNA, 2211 bp, Artificial Sequence
  Description of Artificial Sequence: Synthetic coding sequence
atggaggccctcatcccagtgattaacaaacttcaggatgtttttaacaccgtcggagccgacattatccagctgccccaaatcgtcgtcgtgggcacccagtctagcggaaagtcgtccgttcttgagtccttagtcggacgagacctgctgccccggggaacggggatcgtaactcgtagacccctcattctgcagctcgtacatgtgtctcaagaggataagagaaagaccaccggggaagagaacggcgtcgaggcagaggaatggggcaagttcctacacacgaagaataagctgtacacagactttgatgagatcaggcaggaaatcgaaaacgagacggagaggatttcaggaaataataagggggtgagcccggagcctatccatctgaagatcttctcacccaacgtggtgaatcttacactggtcgatctgcccggtatgactaaagtgcctgtgggagaccagcctaaggatatcgaactgcagatccgtgaattaatcctgcggtttattagcaaccccaactctataatcctggctgtgaccgccgctaacaccgatatggccacttcggaggctctcaaaataagtcgtgaagtggaccccgacgggcgtagaactttagctgtgattactaagctggacctgatggatgccggaaccgacgccatggacgtgttaatgggtcgggtgattccagtgaaactgggcattatcggggttgtgaatcgctcccaactggatatcaataataagaagagcgtgaccgattcgatccgggatgagtatgctttcctgcagaagaaataccccagcctggcaaacaggaacggcacaaaatacctcgcccgaactctgaatagactactgatgcaccacatcagagactgtttgcccgaactcaagactagaattaatgtgctcgctgcacagtaccaaagcctactgaactcttacggcgaaccagttgatgacaagagtgccacgcttcttcagctgattacgaagtttgccaccgagtattgtaatacaatcgaaggaactgctaagtatattgagacctccgagctttgtgggggtgcccgcatctgttacatctttcacgaaacttttggcaggacactcgaatcggtggacccactcggaggcttgaacaccatcgacatcctcaccgccattcggaacgctacaggacctagacccgcactgttcgtgcccgaggtttcattcgagctgctcgtgaagcggcaaattaaacgcctggaggaaccttcactcagatgtgttgagcttgtgcacgaagagatgcagcggatcatccagcactgttccaattactccacgcaggaacttttgcggttcccgaaactgcacgacgccattgtggaggtggtaacctgtttgttacgaaagcgactgcccgtaacaaatgagatggtccacaacctcgtcgccatcgagcttgcttacataaacactaaacaccccgattttgctgatgcctgcggcctcatgaacaataatattgaggagcagcgccggaaccgattggctcgagagctcccttcagccgtgtcccgcgacaagtcttctaaagtgcctagcgcgcttgcaccggcgtcccaggaaccctcccccgctgcaagtgccgaggccgacggaaaactgatccaagattccaggcgcgagaccaagaacgtcgcttctggtggcgggggggtgggcgacggcgttcaggaaccgactaccggaaattggaggggcatgttaaagacaagcaaagcggaggagctcctcgcggaggagaagagtaagccaatacctatcatgccagcatcgcctcagaaaggacacgccgtgaacctcctggacgtgccagtgccagttgctcgaaagctgagtgccagggagcagcgggactgcgaagtgatcgaaaggctcattaagagttacttcttaattgtgcgaaagaacattcaggattctgtacctaaagccgttatgcatttcttggttaatcatgtgaaggacaccctgcagtctgaattggtgggacagctgtataaaagcagcctcttggatgacctgcttaccgagtcagaagatatggcacagcgccgcaaggaggcagccgacatgcttaaggcactacaaggtgcctcacagattattgctgagatacgcgagacacacctctggtag

SEQ ID NO: 115214 - DNA, 2250 bp, Artificial Sequence
  Description of Artificial Sequence: Synthetic coding sequence
atggaggccctgattccagtcatcaataaattgcaagatgtgtttaacactgtgggtgccgacatcatccagctgcctcagatagttgtcgtgggcactcagagtagcggcaagagtagcgtgcttgagtcccttgtggggagagatctgctaccacggggcactgggatcgttacccgtcgcccactgattcttcagctggtgcatgtgtcgcaggaggacaagcgcaagacaacaggcgaggaaaacgatcccgccacttggaaaaactccaggcacctgagtaaaggagtggaggccgaggagtggggcaaatttctccatactaaaaacaagctctacacagattttgatgagatacgccaagagatagaaaatgagacagaacgtataagtggcaataataagggcgtgagccccgagccaattcatctcaagattttctcaccgaatgtggttaatctgacgctggtcgacttaccaggtatgactaaagttccggtgggtgaccagccaaaggacatcgagttgcagattcgcgagttaatcctccgttttataagcaaccctaattccataattcttgcagtgactgcggcaaacactgatatggccacctctgaagctttgaagatttcccgcgaggttgaccccgacgggagacgcactttggctgtgatcacaaaacttgatttaatggatgctggcacagatgccatggatgtgctcatgggcagggtcattcccgttaagttaggaattatcggcgtcgtaaaccggtctcagctggatatcaataacaagaaatccgttactgactctatcagggacgaatacgcttttctgcagaagaagtatccttcccttgcaaacagaaacgggactaagtacttggcaaggacattgaaccgcttgctgatgcaccatatccgcgattgcttgccagaattaaaaacgcgcatcaatgtactcgctgcgcaataccagagcctgctgaactcttacggcgaaccagtggatgacaagtctgccactctgctgcagctgattacgaagttcgccacagaatactgcaatacgatcgaaggcacagcaaagtacatcgagacctctgagctctgcggcggagcccgaatctgctacatatttcacgagacttttggcaggactctggaatcagtcgaccccctcggaggtcttaatacaatagatatactgacagcgatccgcaatgcgaccggtcctcgacccgctctctttgtgccggaagtgtccttcgaacttctggtgaaacggcaaatcaagcggctggaagaacccagcctaaggtgtgtggaattagtgcatgaggagatgcagcggattatccagcattgcagtaactatagcacacaggagctcctgaggtttcccaagcttcatgatgccatcgtggaagtcgtgacatgtcttctgcgtaaacgcctacccgtgacaaacgaaatggtccacaatctcgtggccatagagctggcttatatcaacacgaagcatcctgactttgctgatgcctgtggcctgatgaataataatattgaagagcagcgcaggaaccgactcgcaagggagctgcccagcgccgtgtccagagataagtcctcaaaggtcccctctgctcttgcccctgcaagtcaggaaccatcacccgctgcgagcgccgaggcggacggaaagctcatacaggattcacggagggaaaccaaaaatgtggccagtggcggagggggggttggggatggcgtccaggaacctacaacgggtaattggcgggggatgctgaaaacctctaaagccgaggagctgctggccgaggaaaagagcaaacccataccaatcatgcccgcctccccgcagaaagggcatgccgtgaacctgctggatgtcccggtgccagtggcccggaagctcagtgcccgagaacaaagggactgcgaagtgatcgagcgcctgattaaatcctactttctgattgtacgcaaaaatattcaagatagcgtgcccaaggcggttatgcacttcctggtaaatcatgtgaaagataccctccagagcgaactcgtcggacagctgtataaaagctcccttctggacgatttactcaccgagagcgaagatatggctcagaggcgaaaagaggccgccgatatgcttaaggcactgcagggggcatcgcagattatagcagagatacgagagacacacctgtggtag

SEQ ID NO: 115215 - DNA, 2613 bp, Artificial Sequence
  Description of Artificial Sequence: Synthetic coding sequence
atgggaaatcggggcatggaagagctgattcctctagttaataaattgcaggatgcattttcctcaatcgggcagtcttgtcacctggatctcccccagatagcggtcgttggcgggcaatcagcgggtaagtcttctgtcctggagaattttgtggggagagacttcctgccacgggggtccggcattgtaacacgccgcccccttatcttacagctcatcttcagcaaaacagagcatgcagagttcttgcactgcaaatcaaagaagttcacagattttgacgaggtaagacaggagatcgaggctgagactgatagggtcaccgggaccaacaaagggataagccctgtgcctattaacttgagggtgtactctcctcatgtcctcaacctcaccttgattgatctccccggcatcaccaaagttcccgtaggagaccagccccctgacatcgagtatcaaatcaaagatatgatactgcagttcatctctcgagagtcctcgctcatactggctgtgacccctgcaaatatggacctcgccaacagtgatgctcttaaactggcgaaagaagtggatcctcaaggcttaaggacaattggggtcataaccaagctggaccttatggacgagggcacggacgcccgagacgtcctcgagaacaaactgctccctctgcgccgcggctacattggggtggtcaatcgctctcaaaaggacatagaggggaagaaggacattcgggcagcgcttgccgccgaaaggaagttctttctttcgcatcccgcctaccggcacatggccgatagaatggggacaccacacctgcaaaagacgcttaaccagcagcttactaaccatataagagaaagcttgcctgcattgcggtctaagcttcaaagtcagctgctgagtctggaaaaggaagtcgaggaatataagaatttccgtcccgatgacccgacccgaaagacgaaggctcttctgcagatggtccaacaatttggggttgatttcgagaaaagaatcgagggatccggcgaccaggttgatacgttagaactgtccggaggagctaggattaaccgtatattccatgagcgcttccccttcgagttagtgaagatggagttcgacgagaaagacctgcgaagggaaatctcttatgccatcaaaaatatccatggtgtgcggaccggactgtttacccccgacatggctttcgaggctatcgtcaagaaacagatagtgaaactgaaggagccttctctgaagtgtgtggacctggtggttagcgagctcgcgaccgttatcaagaagtgcgcagagaagcttagtagttaccccaggcttagggaagaaacagagaggattgtcaccacttacatacgcgagcgcgagggacggaccaaagatcagatcctcctgctgattgacattgaacagagttacatcaacacaaatcacgaggactttattggcttcgccaatgcccaacagaggagcacacagctgaataaaaaaagggccatccccaaccagccagagacgctcgtgatccggaggggctggctcactatcaacaacatctctttaatgaagggcggcagcaaagaatactggttcgtcctgaccgccgagtcactaagctggtataaggatgaggaggagaaagagaaaaaatatatgttacccctcgacaatctcaaaattagggatgtcgagaagggttttatgagtaacaaacatgtgttcgccatattcaacacagagcagagaaatgtctacaaggacctgcggcagatcgaacttgcttgcgactctcaagaggatgtcgatagttggaaggcttctttcctacgtgcaggggtctatcctgagaaagaccaagcagagaatgaggacggggctcaggagaacacgttctctatggacccccaattggaacgacaggttgaaaccattaggaatttagtagactcttatgttgccattattaacaaaagcattagagatttaatgccaaagaccattatgcatcttatgatcaacaacaccaaagcctttattcaccatgagttactggcttatttgtattcttctgctgatcagtcctccctcatggaggagtcggcagatcaggcacagagaagagacgatatgttacgcatgtatcatgccctcaaggaggctttaaacataatcggcgatatttctacaagtacagtgtccacacccgtacccccacccgtggatgatacatggctacagtcggcctcctctcactctcccacaccacagcggcgtcctgtttcatccatacatcctcctgggaggccccccgccgtaaggggtcctacccccggcccgccgctaattccagtgcccgtcggcgcagccgcctccttttcggcccccccgataccatcacgaccagggcctcaatccgtcttcgcaaattcagacttatttcctgcacctccacagataccctctaggcccgtgagaatcccacccgggattccacccggcgtgccttccagaaggccacccgcagcccctagccgcccaaccataatccggccggctgagcctagcctcctggattag

SEQ ID NO: 115216 - DNA, 2601 bp, Artificial Sequence
  Description of Artificial Sequence: Synthetic coding sequence
atgggtaaccgggggatggaggaactgatacctctggtcaacaaacttcaggatgcattttcctcaatcggccagtcttgccacctggatttaccacagattgccgtcgtcggtggtcaaagcgctggtaaatctagtgtcctcgaaaatttcgtggggagagacttcctcccacggggtagtgggatcgtcaccaggcggccgctgattctccagctcatttttagcaagacagagcatgcagagttcttgcattgcaagtcaaaaaaatttacggactttgatgaagtgagacaggagattgaagctgagacagacagagttaccggcaccaacaaagggatatcccctgtgcctataaacctgcgcgtttactcccctcacgtccttaatctgaccctgattgacctgcctggcattaccaaagtcccggtcggagaccagcccccagacatcgagtaccagattaaggacatgatcttacaattcatctcgcgggaaagcagcctcatactcgctgttacccccgccaatatggatctcgccaatagtgatgcattgaagttagcgaaggaagtcgacccacagggactgcgaactatcggggttatcactaagctggatctgatggacgaggggactgacgcccgcgacgtgctcgaaaataagctgcttcccttgagacgggggtacattggagtggtaaaccgctctcaaaaggacatagagggaaaaaaagacatacgtgcggcactggctgccgagcgtaagttctttctgagccaccccgcatataggcatatggctgaccggatgggcactccccatttacagaagacactgaaccagcagctaacaaatcatatcagagaaagcctgcctgcgctgagatcgaagctgcagtcccagcttctgagcctcgagaaagaggtggaggaatacaagaacttcaggccggacgatccaacccgtaagacaaaggctctgttgcagatggtccaacagttcggtgtcgacttcgagaagagaatagaaggatcaggcgatcaggtcgatactctggaactcagtggaggagctcggatcaatagaatctttcacgagcggttccctttcgagttagtcaagatggaattcgacgaaaaagaccttcgacgcgagatctcctacgcaattaaaaatatccatggggtgcggacaggtttgtttacacccgacctcgccttcgaggccatcgtgaaaaagcaagtggtgaaactcaaagagccctgcctgaaatgtgtggacttggttatccaggaactgatcaacactgtccggcagtgcaccagtaagctgagtagctatccccgcttgcgcgaagagactgaacggatcgtgaccacttacataagggagagggaaggacggacaaaagaccagatcctcctgctgatcgatattgaacagtcttatataaacaccaatcacgaagatttcattggatttgccaacgcccaacagcgcagtactcagctgaataaaaagcgcgccatcccaaaccaggtcattcgccgcgggtggctgaccatcaataatatttccttaatgaaagggggctctaaggaatactggttcgtgcttacggccgaatctctgtcgtggtataaggatgaggaagagaaggagaaaaaatatatgctgccactggacaacctgaagatcagggatgtcgaaaagggttttatgagcaataaacatgtgttcgctatattcaatacggaacagcggaatgtgtacaaggacctccggcagattgagcttgcctgtgactcccaggaggacgtggattcttggaaggcgagttttctgcgtgctggcgtgtacccagagaaggatcaggctgaaaatgaagacggagcccaggaaaacacatttagcatggacccacagttggaaaggcaggtcgagacgattcgaaatctggttgattcctatgtagccatcatcaataagtctattcgcgatttaatgcctaagaccatcatgcatctgatgatcaataacacgaaagcctttattcatcatgagctgcttgcttatctatattccagcgcagatcagagctcactgatggaagagagtgcagaccaggcccaacgtagggacgatatgctgaggatgtaccatgctttaaaagaagcactaaatatcataggagacatctccacatctaccgtgtcgactcctgttcccccaccagttgatgacacctggctacagtccgcctccagtcattctccgactccccagcggcgcccagtctctagtatccacccgcccggacgtccccccgctgtcagaggaccaactcctggaccaccgctgataccagtgccagtgggagccgccgcctcatttagtgctccccccatcccgtccagaccgggtccacagtctgtgtttgcaaattctgatcttttccctgccccaccacagattccctcgcgcccagtgaggattccgccagggatcccgcctggagtaccttccaggagaccacctgccgcacccagcagaccaaccatcattagacctgcagagcctagcctcctggactag

SEQ ID NO: 115217 - DNA, 2613 bp, Artificial Sequence
  Description of Artificial Sequence: Synthetic coding sequence
atgggcaatagaggcatggaagaacttataccccttgttaataagctgcaggacgcgtttagttcgatcggccaatcatgccatcttgatctgccccagatcgccgtggtgggaggccaaagtgcgggcaaaagttccgtgcttgaaaattttgtgggccgggacttcctgcctcgcggctctgggattgttacaaggaggccacttatactgcagctgatcttcagtaagactgagcatgccgagttccttcattgcaaatcaaaaaaatttacggatttcgatgaggtgagacaggaaatcgaggccgaaacggatcgggtgacaggcactaacaaagggatttctcctgtcccaattaatctgcgcgtttacagcccccacgttcttaatctcaccttgatcgatcttccggggatcacgaaagtccccgtgggggaccagccgccagatatagagtatcagatcaaggacatgatcttacaatttatttcaagagaaagcagtttgatcttggccgttactcccgctaatatggatctcgccaactctgatgcactgaaattggctaaggaggtggatccccaggggctacgtacaattggcgttatcacaaaacttgacttaatggacgaagggaccgacgctagagacgtgctggagaataagcttctgccccttaggagaggctacatcggagtggtaaacagaagccagaaagacatcgagggcaagaaagacatcagagcagcgctcgccgccgagcggaaatttttcctgtcccacccagcttatcggcacatggcagaccggatgggcacaccccacctgcaaaagacactaaatcagcagctaacaaaccatattcgcgaaagccttcccgccctgcgctccaagctccagagccagttgctttcgttggagaaagaggtggaagagtataagaattttaggcctgatgaccccactagaaaaaccaaagccctgcttcaaatggtgcagcaatttggtgtggattttgagaagagaattgaaggaagcggcgatcaagttgatacactggagttaagtgggggggcaagaatcaacagaatcttccacgagcggttccccttcgagctggtgaagatggagtttgacgagaaagatcttcgcagagagattagctacgcaataaagaatattcacggggtacgaacaggcctctttactccagacctcgcgtttgaggccatcgttaaaaagcaagtcgtcaaactgaaggagccttgcctaaaatgcgtcgatctggtgatacaggagttgatcaacacagttcgacagtgcacatcaaaactgtcgagctacccccggctcagggaggagaccgagcggatcgtcaccacttacatcagagaaagagaggggcggaccaaagaccaaattctcctgctaattgatattgaacaatcttatatcaacaccaaccatgaggactttattggttttgccaacgcgcaacagagaagcactcagctgaataagaagcgcgcaattccgaaccagggtgaaattctcgtgatccggcgggggtggctgacgatcaacaatattagcctaatgaaggggggttctaaggagtactggttcgtgcttaccgcagagtctctgagttggtataaggatgaagaggaaaaggagaagaaatatatgctacccctggataaccttaaaattcgggacgtggagaagggcttcatgtccaacaagcacgtttttgctatctttaatactgagcagcggaacgtctataaggatctgagacagattgagctggcctgcgacagccaggaggatgtagacagctggaaggcaagcttcctgcgggccggggtttatcccgagaaagatcaggccgagaatgaagatggcgctcaggagaacacattctctatggaccctcaactcgagcggcaggtggagactattcgaaatctggtcgattcttatgtggccattatcaacaagtcaatccgcgatctgatgcccaagacaattatgcacttgatgattaacaacactaaggcgttcatccaccatgaattactagcgtacctgtatagcagcgccgaccaaagctccctgatggaagaatctgccgatcaggcccagagacgcgacgatatgctgcggatgtaccatgctctgaaagaggcgctgaacattatcggggatatttctacctctacagtgagcacacccgtgcctccgcctgtagacgatacttggctgcaaagcgcatccagtcattcacctacaccacagaggcggcctgtgtcatcaatccacccgccaggtagaccaccagctgtaaggggaccaacacccggtccaccactgattcccgtgcccgttggcgctgcggcatcgttttctgctcccccgattccttctaggcccggcccccagagtgttttcgccaactcagacctgtttccagcccctccccaaattccttctaggcctgttagaatcccccccggtataccgccaggtgtaccatctagacgaccccctgctgctccctctcgccctactattatacggccagcagaaccctcactgttagactag

SEQ ID NO: 115218 - DNA, 1461 bp, Artificial Sequence
  Description of Artificial Sequence: Synthetic coding sequence
catgttacagtggccgctgccgacagctggaaaccccctgccagtgctcagcacgtcggaagggcgccgagagccggagcagccacttgctttctgggccctcggcctccttctcacctagggggacgggacttcctccctagggggtctggcatcgtgacacgaagaccactaattctccagcttattttttccaaaacagaacacgccgaatttctgcactgcaaaagcaagaaatttaccgatttcgacgaggtaaggcaggagatagaggcggaaacagacagagtgactggcaccaataagggcattagtccagttcccattaacctcagagtgtattcaccgcacgtgttgaaccttaccctgatcgatctgcctgggatcacaaaggtccccgtgggggatcaacctccagatattgagtatcaaataaaagatatgatcctgcagttcatttcccgggaatcctccttgattttggccgtgacgcctgccaacatggatctggctaactctgatgctttgaaattggccaaggaggtagaccctcaagggctgcggaccataggggtgataacgaagctcgatttgatggatgaaggcactgacgcaagagacgtgctggaaaataagcttcttcccctaagacgagggtacatcggtgtggttaacaggtcacagaaggacatagaggggaagaaagatatcagggctgcattagcagccgaacggaaatttttcctgtcgcacccagcctaccggcacatggccgataggatgggcacaccacatcttcagaagaccctaaatcagcagctaaccaatcacatccgagaatcactgccagctctgaggtctaagctccagtcccaactcctctctctggagaaagaggttgaagagtacaagaacttcaggcctgatgatcccacgcggaagaccaaagccttgctccaaatggtccagcagtttggcgtcgattttgagaagcgaattgagggcagcggggaccaggttgacaccttggaattgtccggaggggcacgcattaatcgcatcttccacgagagattccccttcgaactcgtgaagatggagtttgatgagaaagatctgagacgggagatctcttatgccataaagaacattcacggcgtcagaactggcttattcacccctgatatggccttcgaggccatcgtgaagaaacagatcgtgaagcttaaagagccatccctgaaatgcgttgatctcgtggtgtctgaactggccaccgtcattaaaaaatgtgccgaaaagctctccagctaccctaggctaagggaagagacggagcgtattgttaccacttatattagagaaagggagggaaggacgaaggatcaaatacttctcttaatagatattgaacagtcatacatcaatactaaccatgaggactttatcggcttcgcctag

SEQ ID NO: 115219 - DNA, 2613 bp, Artificial Sequence
  Description of Artificial Sequence: Synthetic coding sequence
atgggcaaccgcgggatggaagaattaattccccttgtcaacaagctgcaggatgccttcagcagcatcgggcagtcctgccatctggacctccctcagattgcagttgttggagggcaaagcgcaggaaagagcagcgtgttagagaatttcgtggggagagactttctcccaagaggaagtgggatcgtgacccggcggcccctgatacttcagttaattttctctaagaccgaacacgccgaatttttacactgcaagtctaaaaagttcacagattttgatgaggtgcgacaggagatcgaagctgaaacagaccgcgtcactgggaccaacaagggtataagcccagtgcccattaacttaagggtgtacagcccccacgtcctgaatctcactctcatcgatctcccaggtatcacgaaggtacctgtaggggatcagccgcccgacattgaataccagattaaggacatgatactgcagttcatcagcagggagtcatccctcattctggccgtcacacccgcaaacatggacctcgcaaattcagacgcactaaaattagcaaaggaggtcgatccccaagggttgcggactattggcgtgattacaaaattggatttgatggacgagggcacagacgcacgcgacgtactagagaataagcttctgcctctgcggaggggctacataggtgtggtgaaccgatctcagaaggacattgaaggaaagaaggacatcagagctgcccttgccgcagagcggaagttttttctctcacaccccgcgtatcggcatatggccgatagaatggggacaccacatcttcaaaagacactcaatcagcagttgaccaaccacatccgggagtcgttgcccgctcttcgctccaagctccaaagccagctgctttctctggagaaagaggtagaggagtataaaaatttccgaccggacgacccgaccagaaagacaaaagctttgttgcagatggtccagcagtttggcgtggattttgagaagcggatcgaggggtcaggcgaccaggttgacactctggaactcagcgggggagctaggattaacagaatcttccacgagagatttccattcgagcttgtgaagatggaattcgatgagaaggacctccgacgggagattagttacgctatcaagaacattcatggagtgagaaccgggctcttcaccccagacatggcttttgaggcaatcgtcaaaaaacagattgttaaactgaaggagccatcattgaagtgcgtggatctagtcgtgtctgaacttgcaactgtcatcaagaagtgcgctgagaaactgagcagctacccccgcctacgagaagagacggaacggatcgtgaccacctacatccgggagagagagggacgtaccaaggaccagattctgcttctgatcgacatcgagcagtcctacatcaatactaaccacgaggattttatcggattcgcgaacgcccagcagcgcagtacacagttgaacaagaagagagcaattccaaatcagggggaaatactcgtcatcagaaggggatggctgactatcaacaacatctcactcatgaaaggggggagtaaggagtactggttcgtccttaccgctgagtctcttagctggtacaaagatgaggaagagaaggagaaaaaatacatgctccccttggataatcttaagatccgagacgtagagaagggatttatgagcaacaagcacgtgttcgcaatttttaacactgagcagcggaatgtgtataaagatctgagacagattgaactggcctgtgactcccaggaggacgttgactcctggaaagcatctttcttacgtgctggtgtgtaccccgagaaggatcaggccgaaaatgaggacggcgcacaggagaataccttttcaatggacccgcagctggaaaggcaggttgagaccatccggaacctggtggactcctacgtggctatcataaacaaatcaattcgtgatctcatgcccaaaaccattatgcatctcatgatcaacaatacgaaagcctttatccatcatgagctgctcgcatacctatattcgtctgccgaccagtctagcctgatggaagaatctgccgatcaggcgcagaggcgcgatgacatgctgagaatgtatcatgccctcaaagaagctctgaatattattggcgacatcagcacatccactgtgtccacacctgttccacctcccgtcgacgatacatggctccagtcggctagtagccacagcccaacgcctcagcgcagaccagtgagttctatacatcctccaggacggcctcccgcagtgcgaggaccgacaccaggccctcccttaattccagttccggttggcgccgccgcaagtttttcggcaccccccatccctagccgtccaggccctcagagcgtgtttgccaattccgatctgttccctgcacccccgcaaatccctagcaggcccgtcagaataccccccggcatccccccaggggtgcctagccggcgaccaccagctgctccttcccgaccaacaatcatcaggccggctgagccctcccttctggactag

SEQ ID NO: 115220 - DNA, 2601 bp, Artificial Sequence
  Description of Artificial Sequence: Synthetic coding sequence
atgggcaatagaggaatggaggagctgattccgctggtgaataagcttcaagatgcctttagttccattggacaatcctgccaccttgacttacctcagattgccgtggtcgggggacagtctgccggcaaaagtagtgtgctggagaacttcgtgggcagggacttccttcctagaggctccggcattgtgacgcggagaccgctgatattacaactgatctttagcaaaaccgagcacgcggagtttctgcactgcaagagtaaaaaattcactgactttgacgaagtgcgacaggaaatagaggctgaaactgatcgcgtcactggcaccaataagggcatttctcccgtgccgatcaatctccgcgtctattcaccacacgtgcttaatctcacattaattgaccttcctggaataaccaaagttcccgtgggggaccagccccccgacatagaataccaaatcaaagatatgattctgcagttcattagtcgtgaaagttctttgatcttagctgttacaccagcaaacatggacctcgcaaactctgacgccctgaaactggccaaggaggttgacccccagggtctacggactatcggggtcatcaccaagctggatcttatggacgagggtactgatgcccgggatgtcctggaaaataagcttctgccattacgccgcggctacataggggtcgtcaaccgctctcaaaaagatatagaagggaagaaagatattagagcggccctcgcagccgaaagaaagttctttctgtctcaccctgcctataggcacatggccgatagaatggggaccccccatctacagaagaccctgaaccagcagcttaccaatcatattagagagagcctccccgcccttcggtcgaagctccagagtcagttgctttctttggagaaagaagtagaggagtacaagaactttcgcccggacgatcctacacggaaaaccaaggccctgttgcaaatggttcaacagttcggcgtagattttgagaagcgaatcgaagggtctggtgaccaagtggatacattggagctctccggtggcgcaaggattaacagaatatttcacgaaagatttccgtttgaactggtgaaaatggagttcgatgaaaaagatcttagaagagagatctcatatgctatcaagaatatacatggcgtgaggaccggactttttaccccagatatggcattcgaagccatcgtgaagaaacagattgtgaaactgaaagagccgtcacttaaatgcgtcgacctcgttgtttcagaattggctacagtaatcaaaaagtgcgccgaaaagctgtctagctacccgcgactgagggaggagacagaacgcattgtgacaacatacatccgggagcgagagggcagaaccaaggaccagatcctcctcctgatcgatatagagcagagttacattaatactaaccatgaggacttcatcggtttcgctaacgcacaacagaggtctacacagttgaacaagaaacgcgccattccaaatcaggtcatccggcggggctggcttacaataaacaacattagtctcatgaaggggggcagtaaggagtattggtttgtccttactgcagagagcctgtcttggtacaaggacgaggaggagaaggagaagaagtacatgctgccactcgataatctgaaaataagggatgtggagaagggtttcatgtcgaataagcacgtgtttgcgatatttaatactgagcaacgaaatgtctataaagatttgcggcagatcgaactggcatgcgattctcaggaagacgtcgattcttggaaagcgtcttttttgagggctggcgtgtatcctgaaaaggatcaggcagaaaacgaagacggggcccaggagaacactttcagcatggatcctcagcttgaaagacaggtggagactatccggaacctcgtggactcctacgtggccattatcaataagtccatccgggatttgatgccgaaaactatcatgcatctcatgatcaacaacactaaggccttcatacatcacgaacttttggcatacctttactccagtgcagaccaatcatctctcatggaggaatccgcagaccaggcccaacgcagagatgatatgctgcgtatgtatcacgcactaaaggaggcactgaacattataggggacatctccactagcaccgtgtcaacgcccgtgcctcctcctgtcgacgatacttggctgcagtctgcctcaagccacagccccacccctcagagaagaccggtgagtagtatccacccacccgggcgacccccagcagtgcggggtcccaccccggggccccccctgattccagtgccagtcggcgcggccgctagctttagtgcccccccaatcccaagtcggccggggccacagtctgtgttcgcaaattcagacctgttccccgctcctcctcagattccttcgagacctgtgcggatccccccgggcataccacctggtgtcccgtctcgtaggccccctgcagccccaagcagaccgactatcattcgcccggctgaaccatctctgttagactag

SEQ ID NO: 115221 - DNA, 1200 bp, Artificial Sequence
  Description of Artificial Sequence: Synthetic coding sequence
atgttaccattagagccatatctcacacagacaagcgctgtccctcaaatgtcacactttatgtgtcacagccccacacataagccccagggtctgctcccatgggccccatttcatcaggcgagcgtaagtctttatcctataagtccctggccctccgagtccgtgtgcccccctacttgcccaggaggggctagttgttggtttccagcgggtaatgcctgggatcgggtggagttgggattcttaggatttggagctggcggagtgtccatagcagttccaggctttcccctgtcttgtgggcagggttgttgtgcaggggggtggctgggacacggcgctagatttccagctaagctgcgagcatttcctcaggttattagacgaggatggctgacgatcaataacatttctctaatgaaaggcggaagcaaagaatactggtttgttctgacggccgagtctttgtcgtggtacaaggatgaggaggagaaggaaaaaaagtatatgctaccgctggacaatctcaaaattagagacgtggaaaagggtttcatgtcgaataagcacgtcttcgcaatcttcaacacagagcagagaaacgtgtataaggacctccgtcagatcgagctggcctgtgattcccaggaagatgtagactcctggaaggcgtctttcctccgagccggggtctatcccgagaaagatcaagcagaaaatgaagatggagcccaggaaaacacttttagtatggaccctcaacttgaacgccaggtggagactattcggaaccttgttgattcatatgtcgccattatcaataagtcaatcagggatcttatgccaaaaaccattatgcacctcatgatcaacaatacgaaagcgtttattcaccatgaactcctcgcgtatctgtatagctccgcagatcagagcagtctgatggaagagtctgctgatcaggcccaaaggagagatgacatgctgcggatgtaccacgcgttgaaggaagcactcaatattatcggagatatttctacctccacagtgtctacccctgttccaccacctgtggacgatacctggctgcaatctgcttcttctcattcccccaccccacaacgccggcccgtgtcctccatccatcctcccgggaggcctcccgctgtgcgtggccctacgcctggacccccctag

SEQ ID NO: 115222 - DNA, 13284 bp, Artificial Sequence
  Description of Artificial Sequence: Synthetic coding sequence
atgagctctaaggccgagaagaagcagcggctctccggtcgggggagttcccaagcaagctggtccgggcgtgctacgagagcagccgtagccactcaggaacaggggaacgcccccgccgtgtctgagccagagctccaggcggagctgcctaaggaggaacccgaaccgaggctggaaggcccgcaagcccagagcgaagagagcgtggaacccgaggctgacgtgaaacctttattcctgagccgagccgcactaaccggtctggctgacgcggtctggacccaggagcacgatgccatcttagaacactttgcccaagaccctaccgagtccatcctgactatcttcattgatccttgttttggtctgaaactggagctgggaatgcctgttcagactcagaaccaactggtctacttcattagacaggcccccgttccaatcacctgggagaacttcgaagctaccgtgcagtttgggactgtacgtggcccttacatcccggctctcctgaggcttttaggtggcgtattcgcaccccagatttttgctaatacaggctggcccgaatctatcaggaaccactttgcctcccacttgcataagttcctagcatgtctgacagatactagatataaattggagggacacactgtgctctacatcccagctgaagccatgaatatgaagccggaaatggtgatcaaagataaggagttagtgcagaggctggagacaagcatgatacattggaccagacagataaaagaaatgctgtccgcccaggagactgtggaaaccggcgaaaatctcggacctctggaagagatcgagttttggcggaataggtgtatggatctaagcggcatcagcaagcagctggttaaaaagggcgtaaagcacgttgaatccattctccatcttgcaaaatccagctatcttgccccattcatgaaactggcacagcagattcaggacggaagccgtcaggcccagagtaacctgacctttctctcaatactgaaggagccttaccaggagcttgcctttatgaagcctaaagacatttcatctaagctgccaaagctgatcagtctgattcggataatctgggtgaattcaccccactacaatactcgggaaaggcttacaagtctgtttcgcaaggtctgcgactgccagtaccactttgcacggtgggaagatggcaagcagggtcctctgccttgtttttttggcgcccagggacctcagatcactcggaacctgctcgaaatcgaggacatctttcataaaaatctccacactctccgggctgtccgcggcggtattctggatgtaaagaacacttgctggcacgaggactacaataagttccgcgcaggcattaaggatctggaggtgatgactcaaaacctgattacatctgctttcgaacttgtgcgagacgtgccacacggtgtgctcttactggacacatttcacagactggcatctcgtgaagcgataaagcgcacatacgacaagaaggcggtcgacctctatatgctgttcaacagcgagttagctctggtgaaccgtgagcgcaataagaaatggcccgacctcgaaccatacgtagcccagtactctggtaaagcgcggtgggtacatatcctgcgaaggagaatcgatcgagtgatgacttgcttagccggcgcccattttctccctcggattggcactggcaaggagtccgttcatacatatcagcagatggtccaggccattgacgagctagtacggaagactttccaagaatggacctcttccctggataaagactgcattcgtagacttgacactcccttgctcagaatatcccaagaaaaagccggcatgttggacgtgaactttgataagtccctgctaatcctgttcgctgaaatcgattactgggagcggctcctgttcgagactcctcattatgttgtgaacgtggctgaaagagcggaagacttacgcatcctgagagagaatctgttgctggtggccagggactataatagaatcatcgcgatgttatcccccgacgagcaggcactttttaaggaacgcatcagactgctggacaagaagattcaccctgggctcaaaaaattacactgggccttgaaaggagcatctgctttcttcatcactgagtgtagaattcatgcctcaaaggtgcagatgattgtcaatgaattcaaagcatccacgctgactattgggtggcgggcacaggaaatgagcgagaagctcttggtccggattagcgggaagagggtataccgtgacctggaattcgaagaggatcagagggagcaccgggccgcggtgcagcagaaactgatgaacctacatcaggacgttgtcacgataatgacgaacagttatgaagtattcaagaacgatggccctgagatccagcagcagtggatgttgtacatgatacgactggaccggatgatggaggacgccctgagactgaacgtgaagtggagcctgctagagctgtctaaagccatcaacggagacggaaagactagccctaaccccctgtttcaggtccttgtaatcctaaaaaatgatctccagggctcggtggcgcaggttgagttctcaccaaccctgcagactttagccggcgtagtcaatgacatcggaaaccacctgttcagcaccatatcggtgttctgtcacctcccggatatactgactaaacgcaagttgcacagagaacccatccagacggtagtcgagcaggacgaggacatcaagaaaatacagacccaaatatctagcggcatgacgaataacgcatcactgctgcagaattatctcaagacatgggatatgtatcgggagatttgggagatcaacaaggattcatttattcacaggtaccagaggctgaatccccctgtctcatctttcgtcgcagacattgcccgatacaccgaagttgccaacaacgtccaaaaggaggagactgtgacaaacattcaattcgtgctgctcgattgcagccaccttaaattctccttagttcagcactgcaacgagtggcagaacaaattcgccacgctgctgcgcgaaatggctgctggacggctgttggagctacacacttacctcaaggagaacgctgagaagatttcgaggccaccccagacgctggaggagctgggcgttagccttcaactcgtcgatgccttaaagcacgatctggctaatgtagagactcagatcccgccaatccacgagcagttcgccattctagagaagtatgaagtgccagttgaggacagtgtgttagaaatgctagattcccttaacggagaatgggttgtgttccagcagactttgcttgactctaaacaaatgctgaagaaacataaagaaaaattcaagaccggtctcatccacagcgcagacgatttcaagaagaaggcacataccttactggaagatttcgagttcaagggccatttcacaagtaacgtcggttatatgagtgccctcgatcaaattacccaagttagagctatgctgatggctatgagagaggaggagaattctctacgggcaaacctgggcatttttaagatcgaacagcctcccagcaaggacttgcagaatctcgaaaaagagttagacgccttgcagcaaatttgggaaattgcacgagattgggaagagaactggaacgagtggaagacagggcgatttctgatcctgcagaccgaaacaatggagaccaccgcccacgggctgttcaggagactgaccaagctagcaaaggaatataaagaccgaaattgggaaataatcgagacaacccgctctaaaattgaacagtttaaaaggacaatgcctcttattagcgacctgcggaaccctgccttgcgagagcggcactgggaccaagtgcgggatgagatccaacgagagttcgaccaagagtccgaaagttttacactcgagcagatcgttgaactgggaatggatcagcatgttgaaaagataggcgagatcagcgcctccgccaccaaggagcttgcaatagaagtcgcccttcagaatatcgcaaaaacttgggatgttacccagctggacattgtaccatacaaggataagggccaccaccggcttcgaggaaccgaagaggtcttccaggcccttgaggataaccaggtggctttgagcaccatgaaggctagtcggtttgtgaaagccttcgaaaaggacgtcgatcattgggagcgatgtctgtccttgatactggaggtcatcgagatgattctgacagtgcagagacagtggatgtacctcgagaatattttcttaggagaggatatccggaaacagctgcctaacgaatcgactctctttgaccaggtcaacagcaactggaaggctataatggatagaatgaacaaggacaataacgccctgcgatccactcaccatccaggcctgctggataccctgatcgagatgaacacaatcctcgaggatattcagaagagcctcgacatgtacctggagactaagcgacatatatttcccaggttttactttttgtctaatgatgacctgttggagatcctcgggcagagccgcaatccggaggctgtacagccacacctgaagaagtgttttgataacattaagttgctgaggattcaaaaagtcggagggccctcttccaagtgggaagccgtgggcatgttcagcggggacggagaatacatcgacttcctgcactcggtgtttcttgaaggccccgtcgagtcgtggcttggggatgtcgaacagactatgagagtgactctgcgtgatctcctgcgcaattgccacctggcgctgcgcaaattcctgaacaagcgcgataagtgggtcaaggaatgggctggacaggtggtcatcacggcttcccaaatccagtggaccgccgacgtgaccaaatgcttgctgactgcaaaggagcgggccgacaagaagattctgaaggtgatgaagaagaaccaggtgagtattttgaataaatatagtgaggctattaggggtaatctgaccaagattatgaggctgaagatcgtggcactggtaacgatcgaaatccatgctcgggatgtactagagaaactttataaatccggcctcatggacgtcaatagcttcgactggctgtcccagctacgcttctactgggaaaaggacctggacgactgcgtgattagacagactaacacgcagtttcagtacaactatgagtacctgggcaattctggcagattggtgatcaccccacttactgaccgatgctacatgactctgacaactgccctgcatcttcaccggggaggatcacctaagggcccagccggaacagggaaaacggagacagtgaaggatttaggaaaagcacttggtatctacgtcatcgtcgtcaattgctcagagggcctggattataagtccatgggcaggatgtacagcggcctcgcacagacaggggcatggggttgctttgacgaattcaacagaatcaatatcgaggtgctgtctgttgtcgctcaccagattttgtgcatcctctcagcgcttgcagctggcctcacccatttccattttgacggcttcgagatcaatctcgtgtggtcgtgcggaatttttatcaccatgaaccctggctacgctgggcggacagagctgcccgaaaacctgaaatccatgtttcggcccatcgctatggtcgtgccagactcaacattgatcgcagaaataatcctgttcggtgaaggatttggcaattgtaagatactcgctaaaaaggtgtataccttgtacagcctagcagtgcagcaactgtctaggcaggatcactacgacttcggattgcgtgctttaacatctctcctacggtatgctggtaagaagaggagactgcagcccgacctgacagacgaggaagtcctgctcctctctatgagggatatgaacattgccaagctaacttcagttgacgcccccctgttcaacgccatcgttcaggatcttttccccaatattgaattacccgttatagactatggaaaactgagagaaacagtggaacaagaaatccgagatatgggcctgcagtccactccattcactcttactaaggtcttccaactatacgaaaccaaaaactcacgccattcaacgatgatagtgggttgcacaggctctgggaaaaccgctagttggagaattctgcaagcaagcctgagctccctctgtagggcaggggatccaaacttcaatatcgtgagagagttccctctaaatcccaaggccctgagcctcggcgagctctatggggagtacgacctctccaccaatgaatggacagacggtattctgagttcggtcatgcgcaccgcctgtgcagacgagaagcccgacgaaaaatggatcttattcgacgggccagtggatactttgtggattgaaaacatgaatagcgttatggacgataacaaagtccttactcttatcaacggggagaggatcgccatgccagagcaagtgagccttctgttcgaagtggaagatctcgctatggcctcccctgctaccgttagcaggtgcggcatggtgtacaccgattacgcggacctgggctggaagccatatgtgcaaagctggcttgagaagcggccaaaggcagaggtggaacccctgcaaagaatgtttgaaaaactgataaataaaatgctggcttttaaaaaagataactgcaaggaactggtgccgttgcctgagtattccggtattacatccctgtgcaaactgtatagcgctctggcaaccccagagaatggcgtcaaccccgcagatggtgaaaactatgtgactatggtggaaatgacatttgttttttccatgatctggtccgtctgcgctagcgtggatgaggaaggcagaaaacgaattgatagctacctgcgagaaatcgagggaagttttcccaacaaggataccgtgtacgaatactttgttgatcccaaaatccgttcatggaccagctttgaggataaactccccaaaagctggaggtacccccctaatgctcccttttacaagataatggtgcctacagtggacaccgtgcgatataactacctggtgagttcccttgtggccaaccaaaaccccatactgttggtggggcccgtgggcacgggaaaaaccagcatcgctcagtctgtactgcaatccttgccatcctcacagtggagcgtgcttgtagtgaatatgtcagcccaaaccacctcgaacaacgtgcagtcaatcattgaaagcagggtagaaaagagaaccaaaggcgtgtacgttcccttcggaggtaaaagcatgatcacatttatggacgatctgaatatgccagctaaagacatgtttggctcccaacccccattggagctgatcagactatggattgactacgggttctggtacgatcgaacaaaacagacaattaagtatataagggagatgtttctgatggcagccatgggccctcctggaggcggcagaactgtaatttcgccaagattaagatctagatttaacattattaatatgacgttccccaccaaatcacaaattatccgaatctttggaaccatgatcaaccagaaactccaggattttgaagaggaagtcaagccaatcggaaacgtggttaccgaggccacactcgatatgtacaacacagtagtgcagaggtttcttcctactccaacgaagatgcattacctcttcaaccttagggatattagtaaggtgtttcaagggatgctgcgggccaataaggactttcacgacacaaagagcagtattacaagactgtggatacacgaatgctttcgtgtgttcagcgaccggctggtggacgcggcggacaccgaggcattcatgggcatcatctctgacaaactgggatcgttttttgatctcacattccatcatctttgtccttccaaaaggcctccaatttttggggacttcctgaaggaacctaaggtatacgaggatttgaccgacctgaccgttctgaagactgtaatggaaaccgccctcaacgagtataatctttcacccagcgtggtcccaatgcagttagtgctattcagggaggccattgagcacattacaaggattgtgagagtgatcggccaaccgcgaggaaacatgctacttgtcggtatcggcgggtcaggcagacagtctttagcgcgactagccagtagtatttgtgactataccacctttcagattgaggtcacaaaacattatcgtaagcaggagtttcgagacgatatcaagcgactctaccgacaggcaggggtggaactgaagaccacatcctttatattcgtggacacccaaattgctgacgaaagctttctcgaggatataaataatatactatcttccggcgaggtccctaatctttacaaaccggacgagttcgaggaaattcagtcgcacatcatcgaccaagctagggtggagcaggtgccagagtctagcgattcgttgtttgcctatctgatagagcgtgtgcagaacaacttgcacatcgtactttgtctttctcctatgggcgacccgttccggaactggattcgacaatatcccgccctggtgaattgcactactataaattggttctccgaatggccacaggaagcattgctcgaggtagcggaaaagtgtctgattggcgtggacttgggtacccaggaaaatattcaccgcaaagtagctcagattttcgtcaccatgcactggtccgtggctcagtattctcaaaagatgctcttggagctgcgtaggcataactacgtgacaccaactaagtacctggaactgttgtcgggatataaaaagctgctcggggagaagcgtcaggagctgctcgctcaagccaataaactacggactggactgttcaaaatagatgaaacaagagaaaaggtgcaggtgatgagcctcgagctagaagatgcgaagaaaaaggtcgctgagttccagaagcaatgcgaggaatatctcgttatcatcgtgcagcagaagcgcgaggccgatgaacagcaaaaagccgtaaccgctaattccgaaaaaatcgctgtggaggaaattaagtgccaggcccttgcagataacgcacagaaggatctcgaggaggcactgccagccctagaagaggccatgagagcacttgagtccctgaataaaaaggacatcggagaaattaaatcttacggcaggcctcccgcccaggtggagatcgtcatgcaagccgtaatgatcctgcgggggaacgagcctacctgggcagaagcaaagagacaattgggggaacagaactttattaaaagcctcatcaacttcgataaggacaacatttctgataaggtcttgaaaaaaatcggcgcgtattgcgcccaaccagacttccagcctgatataattgggagagtgtcattagcagcaaagagcctgtgcatgtgggtccgcgccatggagctctatggacgtctttaccgagtggtggaacccaagcgcattcgtatgaacgctgctctggcacaactcagagagaaacaggccgccctggcggaagcccaggaaaagctgcgtgaagtcgctgagaaactggagatgctgaagaagcagtatgacgagaagctggcacagaaggaggaactgcgtaaaaaatctgaggagatggagttgaagctggagcgggccggaatgctcgtttcaggcctggctggagagaaagcccgatgggaggagactgtccagggtctggaagaagacttggggtacttggtgggcgattgtcttttggcggcagccttcctgtcctacatgggcccctttctgaccaactatcgggatgaaattgtgaatcaaatttggatcgggaaaatttgggaactgcaggtgccgtgctcccccagtttcgccattgacaactttctgtgcaacccaacgaaggtgcgtgattggaatatccagggtctaccctctgacgcttttagcaccgagaatggcatcatcgtaactcgggggaatagatgggccttgatgattgacccccaggcccaggcgctcaagtggatcaagaacatggaaggcggccaagggctcaaaattatcgatctacaaatgagcgattatttgaggatattagaacatgccatccattttggctaccctgtcttgctgcaaaatgttcaagagtacctcgatcccaccctgaatccaatgctgaataagtctgtcgcaaggatcggtggcaggttactgatgaggatcggggacaaggaggtcgaatataataccaacttcaggttctatataacgaccaaactgagcaatccacactactctccagaaacatcagccaagaccaccattgtcaattttgccgtgaaagagcaaggcctggaggctcagctgttgggtattgtcgtgcgcaaggagcgccccgaactcgaggaacaaaaggactccttagtcatcaacatagccgccggaaaacggaaactgaaggagctggaggatgaaattctccgcctgctgaatgaggcgaccgggtcactgctggacgacgtgcagttggtgaataccctacacacatctaagatcaccgccacagaggtaactgaacaactcgaaaccagcgaaactacagaaatcaataccgacctggcacgagaggcatatcgaccttgtgctcagcgtgctagcattctctttttcgtgctgaacgacatgggctgcatagatcccatgtaccaatttagtttagacgcttatatcagcctgtttatcctgtcaattgacaagagccatcggtcaaacaagctggaggaccggattgattatctaaatgactatcacacttacgctgtgtatcgctacacttgccgcacattgttcgagagacacaagctgctcttctccttccatatgtgtgcaaaaattctcgagacatccgggaagttgaacatggacgaatataattttttcctgcgagggggcgtggtcctggatagggagggccagatggacaacccgtgtagcagctggctggcagacgcttattgggataatatcacagaattggacaagttgacaaattttcatggactaatgaacagttttgagcagtatccccgggactggcacctgtggtacactaatgccgcacccgaaaaggctatgcttcctggcgagtgggagaacgcctgcaatgaaatgcagagaatgctgattgtgcggtccctccgccaggaccgggtggccttctgtgtcacatctttcattattacgaatctggggtctaggtttattgagcctccagtccttaacatgaaatctgtgttagaagactccacacctcgaagccccctggtgttcattctctcccctggcgttgatccgacttcagccctcctgcagctggcagaacatatgggcatggcgcagcgctttcacgctctctcgcttgggcaggggcaagcacctatcgccgccagacttctgagggaaggggtgacacagggtcactgggtgtttctcgccaactgccatctgtcgctgtcttggatgccaaatctggacaaactcgtggaacagctgcaggtggaggacccgcacccttctttcaggctgtggctgtcgagcattcctcatcctgacttcccaatctccattctccaagtgtctatcaaaatgaccactgagcctcccaaagggctgaaagcaaatatgacccggctttatcagctgatgagcgagccacagttcagccggtgtagtaagcctgctaagtacaaaaagctgctgttctcactctgttttttccactcagtgctgctcgaaaggaagaaatttctgcaacttgggtggaacattatttatggctttaatgactcagattttgaagtcagtgagaacttgttgagtctttaccttgacgagtacgaagaaactccctgggacgccctcaaatatctgatcgcggggatcaattacggcggccatgtcactgacgactgggataggagattgctcacgacatacattaatgattacttctgcgaccaatcgctgtccacgccttttcacagactgagcgcactggagacctacttcatcccaaaagacgggtcccttgccagttataaagagtacatatccctgctccccggcatggaccctcctgaagccttcggacagcatcctaacgcagacgttgcgagccagattactgaagcccagacactttttgacaccctgctgtcactgcagccacagattacgcctacacgcgccggggggcagacgcgggaagagaaggtcctggaactggcagcagacgtgaaacagaaaatccctgaaatgatcgactacgaggggacccagaagctgctggcactggaccccagccccctgaatgtggttcttctccaggagattcagagatataacaccttaatgcaaaccatcctgttctcacttaccgatctcgagaagggcatccagggactgatcgtcatgagtacatccctggaggagattttcaactgcatctttgatgcacacgttcctcctctttggggcaaggcataccctagccaaaagccactggcagcttggacaagagacctggctatgcgggtagaacagttcgagttatgggccagtagagccaggccgcctgtgattttttggttatcaggctttacttttcccaccgggttcttgaccgccgtgctccagtctagcgccagacagaataacgtgtcagttgactctctgtcatgggagttcattgtctccactgtcgacgactccaacctggtctacccaccaaaagacggagtgtgggtgagggggctctatttggaaggggccggctgggaccgtaaaaactcctgcttggtcgaagccgaacctatgcagctggtgtgtctcatgcccacaatccacttccgccctgccgagtcacggaagaaatctgcaaaaggaatgtatagttgcccctgttattattaccccaaccgggctggcagctcagacagggctagcttcgtcattggcatcgatctcagaagtggggctatgactcccgatcactggatcaagcgcggtacggcactcctgatgagtctcgactcctag

SEQ ID NO: 115223 - DNA, 1782 bp, Artificial Sequence
  Description of Artificial Sequence: Synthetic coding sequence
atggaaatagtttatgtttacgtcaaaaaaagaagtgagttcgggaagcagtgcaacttttctgacaggcaagcagaacttaacatcgacatcatgccaaatccagagctggccgagcagttcgtcgagaggaacccggtcgatacaggaattcagtgtagcatcagcatgtccgagcatgaagccaactctgaacgtttcgaaatggagacacgaggagtgaatcacgttgagggcgggtggcctaaagacgtcaaccctctggaactcgagcagacaataaggtttcggaagaaagtcgagaaggatgagaattacgtgaatgccatcatgcaacttggcagtatcatggaacattgtattaagcagaacaatgcaatagacatctacgaggagtatttcaatgacgaagaggcaatggaagtaatggaagaggacccctccgctaaaacaatcaacgttttccgggatccccaggagatcaagcgcgctgccactcatctgagctggcatcctgacgggaatcgcaagttggccgttgcttacagttgtctggactttcagagagctcccgtcggtatgtcaagtgattcctatatctgggatttggagaaccccaacaagcccgagttagctctgaagcctagctcccccctggtaaccctggaattcaaccctaaggatagccatgtgttgctcggcggctgctacaacggtcagattgcctgctgggacactcgcaagggcagcctggtagccgagctctccaccattgagtccagccacagagatccagtgtacggcacaatttggctgcaatctaagacaggaacggagtgtttcagcgccagtactgatggccaagtgatgtggtgggatatacgcaaaatgtccgagcctacggaggtggttattctggatatcaccaaaaaggagcaactggaaaacgcactcggtgccatctcactcgagtttgaaagcaccctacccactaagttcatggtgggtacagagcagggcatcgtgatttcttgcaaccggaaggccaagacttcagccgagaaaatcgtgtgtacatttcccgggcaccacgggcctatctacgcccttcaacggaatcccttctaccccaaaaacttccttactgtcggcgattggacggcacggatctggagtgaggattccagagagagtagtataatgtggaccaagtaccatatggcttatctgaccgatgccgcatggtcaccagtaagacctactgtatttttcacaactaggatggacggaaccttagacatttgggactttatgttcgaacaatgcgatcccaccctgtctctgaaagacaacggatgcctgatcgcctgtggatcccagctcgggactactactctacttgaagtttcaccaggcctctcaaccctccaaagaaacgagaaaaacgttgcttccagcatgtttgaacgggagacgcgcagagagaagatcctcgaagcccgccaccgggagatgcgcctcaaagagaagggcaaagccgagggccgagacgaagagcagactgatgaggagctggctgtcgaccttgaggccttggtgtccaaggccgaagaagaattttttgatatcatctttgccgaactgaagaagaaggaggcagacgccatcaaattgaccccagttcctcaacagccgtcccctgaggaagaccaggtggttgaagagggcgaggaggcagccggagaggaaggtgatgaggaggtcgaggaggatttagcatag

SEQ ID NO: 115224 - DNA, 2676 bp, Artificial Sequence
  Description of Artificial Sequence: Synthetic coding sequence
gaaaaagataacggattggacgtcttcaagctgtccgatagggacttcctgcgctccatggagaacgcaattagatttggaaagccatgcctactggagaatgtaggagaagaactggaccccgcccttgagcccgttctcctgaagcagacttataagcagcagggtaacacagtcctgaagttaggagacactgtgatcccttaccatgaggacttcagaatgtacatcaccaccaagttacctaatccccactacacacctgagatttccacaaaactcacattgatcaacttcaccctgtctccctccggactcgaggaccagctgctgggccaagtggtcgccgaagagcggccagatctcgaggaggccaaaaatcagctcataataagcaatgctaaaatgagacaggagctgaaggatatcgaggaccagatcctctaccgcctgtctagtagtgaaggaaatccagtggatgatatggaactgattaaggtgctcgaagcgtctaagatgaaggccgcagaaattcaggcaaaggtgcggattgcagagcagactgaaaaagacatcgatctcacgcggatggagtacatccccgttgctatcagaacacagatcctcttcttctgcgtctctgatctagcaaatgtcgatcctatgtatcaatattcgcttgagtggttcctgaatattttcctgtccggcatcgcaaactccgagcgagccgacaacctgaagaagcggatctccaatataaatagatacctgacttactccctttacagtaatgtctgtcgaagtctctttgagaaacataaactgatgtttgcgttcctcctctgtgttcggattatgatgaacgaaggcaagattaatcagtctgaatggcggtatctgttgagcggcggcagcatttctataatgacagagaacccagctcccgattggctctcagatagggcctggagggatatcctggccctgtccaatctgcctaccttctcctcatttagctccgattttgtgaaacatctgtctgagtttagagtgatctttgactccctagagccgcatagggagcccctgcctggaatctgggatcagtacctcgatcagtttcagaaactgttggtcttgaggtgtctgaggggagacaaagttactaatgccatgcaggacttcgtcgcgaccaacctggagccacgcttcatagaaccccagactgccaacttgagtgtggttttcaaagactcgaactccaccacacctctaatctttgtgctgtcccctggaaccgatcccgcagccgacctctacaaatttgctgaggagatgaagttttctaagaagctcagcgctatcagcctgggccaggggcagggccctcgggctgaagctatgatgagaagttccatagaacggggcaaatgggtcttctttcagaactgccatctggcccctagctggatgcccgcccttgagaggcttattgaacacatcaatcccgacaaggtgcacagagactttcggctctggctgacctctctgccatctaacaagttccctgtatctatcctccagaacgggtccaaaatgactatcgagcccccaaggggtgtgagggccaatttgctgaagagctacagctccctgggagaagacttcctgaactcttgccacaaagttatggaattcaaatcgctcctgctcagtttgtgtttgttccacggaaacgcgctggagagacacaaattcgggcctctgggttttaatatcccctacgaattcactgacggcgacctgcgtatctgtatctcccagctgaaaatgttcctggatgaatatgacgacattccgtataaagtgcttaagtatactgccggagagatcaactacggcggcagagttactgacgattgggaccggcgatgcatcatgaatatactggaagatttttataatcctgacgtgctttcacctgagcactcatattccgccagtgggatctatcaccagataccaccaacctacgacctacacggctacctcagttacatcaaatcacttcccctgaacgatatgccagaaatattcggtcttcatgacaatgcgaatattacattcgcccagaacgaaactttcgctctgctgggcactattattcaactgcagccgaagagttcgtccgccggctcccaggggagggaggagatcgtggaggacgtcacgcagaatatacttctcaaggttcctgaacccataaacctgcagtgggtaatggcgaaataccccgtcttatacgaggagtctatgaacaccgtcctcgtccaagaagtgatccggtataatcggctcctgcaagtgattacacagactcttcaagacctccttaaagccctaaaggggctggtcgttatgtcttctcaactggagctgatggctgccagcttgtataataacaccgtgccagagttatggagcgctaaagcctatccctccttaaagcccttgagctcctgggtgatggatctgctccagagactcgattttctgcaagcgtggattcaggatggcattcctgccgtattttggattagcggtttcttttttccccaggcctttaatcgacatagcgccgagttctgtccgcaaatctgccatctgcattag

SEQ ID NO: 115225 - DNA, 12798 bp, Artificial Sequence
  Description of Artificial Sequence: Synthetic coding sequence
atggaacagcctaacagcaaaggttattctctgggcagaactccacagggccccgaatgttcctcagcccctgccgtccaggtgggcactcatcgcgggctggagtacaacccaggcaagattctgcccggaagtgactatggcttgggaaatcctcctgctcttgatccaaaactccctcacttgccactgcctcccgccccccctacattgtcagatctaggccagccgcgcaagagtcctctgactggaactgacaaaaaatatcctctcatgaaacagcgaggtttctattccgatattctttctcccggcaccctggatcagttaggagaggtctgtcgtggcccacgcatgagtcagaatctgcttcgtcaagccgacctggataaatttacccccagagtggggagcttcgaagtcccagaagatttccaggagagaatggaacagcagtgcattggctcaactactcgcttactcgcccagactgactttccactccaagcctacgagccgaaaatgcaagtcccatttcaggtccttccaggccagcaccctagaaagattgagattgaacgtcgcaagcagcagtacctaagcctggatatcgagcagctcctcttcagccagggtatagatagtaataaattaatgcccagacacctggatcatcagcatccccagaccatcgaacagggtcacgatccaattttcccaatctacctgccactgaaagtgtttgataacgaagacttcgattgtcggacacccagagaatggataaatatggggctggaaccaggaagtctggataggaagccagtgccgggcaaagccctcctccctacggatgactttctgggccacgaagaccctaagtctcagaagctcaagtataagtggtgtgaggtgggtgtgctggactatgatgaagaaaagaagctctatttagtgcataaaaccgatgaaaagggtctcgttcgagacgagatgggccgacccatcctgaacgccggtgtgaccacagaggggcggcccccactgcaagtctgccagtactgggttccccgcatccagctgttattctgtgctgaggacccgtgcatgttcgcccagagagtggtccaggccaatgctctgaggaaaaatactgaggccctcctgttatataacctgtacgtggattgtatgccctccgacggtcagcacgtgatttcagagcagtccctttctaagatcaagcagtgggctctctctaccccccgcatgagaaagggacctagcgtcttggagcatctttcctcgctcgcaagggaggtctccttggattacgaaagaagtatgaataaaatcaactttgaccacgttgtaagctccaaacctgaaacatttagctacgtcacgcttccaaaaaaggaggaagagcaggtgcctgagcgaggcttggtgtccgtgcccaagtaccatttttgggaacagaaagaggattttacttttgtcagtctactcacgcggcctgaagtcatcaccgctctgtctaaagtgagggctgaatgcaataaggttacagccatgagtttgtttcatagcagcctctccaagtacagtcaccttgaggagttcgagcagatacagagccaaactttcagtcaagtccaaatgttcctgaaagattcgtggataagctcgctaaaagtcgccatgcgatctagcctcagagatatgtccaaagggtggtataacctgtacgaaaccaactgggaagtatacctgatgtccaaattacgcaaactgatggagttagtgaaatacatgttgcaggatacattacggtttctggtgcaggactccctggcctccttctcacagttcatatccgacacttgctgctctgtgctgaactgtactgacgacatggtgtggggtgacgatttaattaacagcccctaccggcccaggaagaatcccctgttcattatggacctcgtgctcgattcttccggagttcactactccacaccactcgagcagttcgaggccagcctcctgaatctttttgataagggcattctggcgacccacgccgtcccccagctggagaagctggtcatggaagacatattcattagcggagaccccctcctggaaagtgttggattacatgagcccttggttgaagagctgcgcgccacaatcgcctctgccgtgtctaaggcgatgatcccccttcaggcgtatgccaaggaatacaggaagtatctagagttgaacaataatgatatcgcatctttcttgaaaacctaccaaacgcagggccttcttgcccaagaggttcgggaggttgtgctcacccaccttcgggagaaggaaatactggatagcagtctgccaagttctatcatcatcggtcctttctatatcaacactgacaacgttaaacagtcccttagcaaaaagagaaaggctttggccacctcagtgttagacatcctcgccaagaacttgcataaagaagtagatagcatctgtgaggaatttaggtctattagtagaaagatttacgaaaagcctaacagcatagaggagttggcggagctgcgagaatggatgaagggtatacccgaaaggctggtagggctggaggaacgcatagtaaaggttatggacgattatcaggtgatggatgaatttctgtacaatctgagctctgatgactttaatgataagtggatcgcatcgaactggcccagcaagattctaggacagatcgaactcgtgcagcagcagcatgtggaagatgaggaaaagtttcgcaagatccagattatggatcaaaacaattttcaagagaaactggagggtcttcagctggtggtagccggcttttctattcatgtagagatttccagggcacatgaaatcgcgaacgaagtgcgtcgagtcaaaaaacagcttaaggactgtcagcagctggccatgctgtacaacaatagagaacggattttctctctccctattactaattatgacaagctgtcccgtatggtgaaggagttccagccttacctcgatctttggacaacggcaagtgactggctgcgctggtccgaaagctggatgaatgacccattaagcgccattgacgcagagcagctcgaaaaaaatgttgtggaggcttttaaaaccatgcataaatgtgtcaagcagtttaaggatatgccggcctgccaagaagtggctctggatatacgcgcccggattgaggaatttaagccttacatacctcttattcaggggctcaggaatcctggcatgcgtattcggcactgggaaactctcagcaatcaaatcaatatcaacgtgcgtccaaaggccaacctgactttcgcccggtgccttgagatgaacctgcaggatcacatagaatccatttcaaaggttgctgaagtggccggcaaggagtatgctatcgagcaagctcttgataaaatggaaaaagaatggagtaccattctcttcaatgtgctgccatacaaagccacagatacatacatcttaaagtcacccgacgaggccagccagttactggacgaccacattgtcatgactcagaacatgtctttcagcccttataagaaaccattcgagcaaaggattaacagctgggagaataaactgaagttaactcaggaagttttggaggaatggctgaactgtcagcgttcctggctgtacctggagcccattttttcatctgaagacattaatcagcagctgccagtggagtccaaaagatatcaaaccatggagaggatctggaagaaaatcatgaaaaatgcctatgagaatcgcgaggtgataaacgtgtgcagcgacctcagaatgcttgatagtctcagagattgtaacaaaatacttgaccttgtgcagaaaggactgtcagagtacctcgaaaccaaaaggtcagcctttccgaggttctattttctctctgatgacgagctcttagagatattaagtcagaccaaggaccctaccgcagtacaaccacacctgagaaagtgctttgagaatatagctaggcttctatttcaagaggacctcgagattacgcacatgtactccgccgagggcgaggaggtgcaactgtgtttcagcatctatccgagcagtaacgtggaggattggctgcgcgaagttgagagatccatgaaggcctccgttcatgatattatcgaaaaagcgatccgagcctaccctactatgccccggacacagtgggttctaaactggcccggacaggtcactattgcgggctgtcaaacgtattggacgatggaagttgctgaggcacttgaggccggcaaccttcgatcacagctctttccccaactctgccagcagctgagtgacctggtcgcccttgtacgcggtaaactgagtcgcatgcagcgggcggtgctgagtgctctaatcgtgattgaggtccacgccaaggacgttgtcagtaagctgatccaggaaaacgtcgtcagcgtgaacgattttcagtggatatctcagttaaggtactattggacaaataatgatttatatattagggcagtcaatgccgagtttatctatggatatgaatatctgggaaactcgggtcgattggtcattacacctctgacagacaggtgttatctgactcttactggcgcactccatttgaagttcgggggcgcaccagcaggccccgccggcacagggaaaacagagacaaccaaagacctggggaaggcactggccatccagacagtcgtgttcaattgtagcgaccagctcgacttcatggccatgggcaaattcttcaaaggactagccagcgctggagcttgggcgtgtttcgacgagtttaaccgaattgacatagaagtccttagcgtagtggctcagcagattaccactatacagaaagcacaacaacaaagggtggagcgcttcatgtttgagggagtcgagattccattagtgccaagctgcgcagtattcataactatgaatcccggctacgcaggcaggacggaactgcccgataatctgaaggctttattcagaccagtagccatgatggtccccgattacgcaatgatcacagagatcagtttgtactcattcggttttaatgaggcaagtgtgctggccaagaagattaccaccacttttaagttgagcagtgagcaattgtcatctcaagaccactacgatttcggaatgagagctgtcaaaacagttatctccgccgcaggaaacctcaagagagagaacccatccatgaacgaggagctaatctgcctcagggcgattcgcgacgttaacgttcccaaatttctgcaggaagacctgaagctgtttagtgggattgtatcagacttatttccgactatcaaagaggaagatacggattacggcatcctggacgaagctatccgcgaggcttgtcgcaacagcaacctcaaggacgttgaagggttccttaccaagtgtatccagctgtatgaaacgactgtcgtgcgccatggcctaatgttagtcggaccaacaggcagtggcaagtctacatgctacagagtcctagcggcagccatgacctccctcaagggccaaccttccatctcaggcggaatgtatgaggcggttaattattacgttctgaatcccaagagcatcacaatgggtcagctgtatggcgagtttgatctgttaacgcatgagtggaccgacgggatcttttcttcctttattcgcgcaggcgcaataaccagtgacacaaataaaaagtggtatatgtttgatggacctgtggacgcgatatggattgagaatatgaatacagtcttggatgacaataaaaaactgtgcctctcatctggagaaattatcaaactcaccgaagctatgacaatgatgttcgaagtgcaagacttagccgttgcaagcccagccacagtctctcgatgcggaatggtgtacctcgaacccagtattctgggcctaatgccttttatcgaatgttggctgcgtaaactgccgcctttgttgaagccatacgaagagcacttcaaggcgctatttgtttcctttttagaggagagtatatcctttgtccggtcgtctgttaaagaggtgatcgcctctactaactgcaatctgacaatgtcattactaaaattgctggattgtttttttaaaccgttccttcctcgtgaaggactcaagaaaattcccagcgagaagttaagccgaatcgttgaacttatcgaaccatggttcatcttcagcctcatctggagcgtgggagcaacaggtgactctagtggcaggacatcgtttagccattggctgagattaaagatggagaacgagcagctgacactcttattccccgaagagggcctcgttttcgactaccgtctcgaggacgccggcataagcggaacaaatgattctgaggatgaagaggaagagtacaagcaggtagcttgggtgaaatggatggacagctctgccccctttaccatggtgccagataccaactattgcaacattatcgttcctaccatggataccgttcagatgtcacacctgctggatatgctgcttaccaacaagaagccagttctgtgtatagggccaacaggcaccgggaagaccctgacaatatcagacaagttgctgaaaaatttggctctggattatattagtcatttcttaactttttctgcacggacaagcgccaatcagactcaagactttatcgacagtaaactcgataagcggagaaagggtgttttcggtcccccgctaggccgcaatttcatcttctttatagacgaccttaatatgccggccctagagacatatggagcacagcccccaatcgagctcctgagacagtggatggatcacggtggctggtatgatcgcaaaattattggggcattcaagaatctggtcgacatcaattttgtgtgtgccatggggccgccaggaggcgggaggaataccgtcaccccacggctcatgaggcatttcaattatctgagcttcgctgagatggacgaagtatccaaaaaacgtattttttccaccatactaggtaactggctggacggcctcctaggtgagaagtcctaccgagagcgggtcccgggcgctcctcacatcgcgcacttcactgaacccctcgtagaagccaccatcatggtttatgccacaataactagccagctcctcccaacccccgctaaatctcattataccttcaacctgcgggatctgtccaaggtctttcaaggaatgttaatggctgaccccgccaaggtggaagaccaggtccagttgttacgattatggtaccacgaaaattgcagagtctttagggatcggcttgtgaacgaggaggataggtcctggtttgaccaattgctcaagcggtgcatggagcagtgggaggtcacattcaataaggtttgtccgttccaaccaattctttacggagatttcatgtcgccaggaagcgacgtcaagagctacgagcttattacctccgagagtaagatgatgcaggtgatcgaggagtatatagaggactataaccaaataaataccgcgaagctgaaactcgtattgtttatggacgcaatgtcacacatctgccgcatttcccgaacacttcggcaggctctggggaacgccctccttttgggggtgggcggaagcggcaggagttctcttactcgcctcgcctcccacatggcagaatacgaatgttttcagatcgagctctcaaagaactacgggatgtctgagtggcgcgatgatgtgaagaaagtactgcttaaggccggtctccagaatttacctattacttttctcttctcagacacgcagataaagaacgagtcgtttttagaggacatcaacaacgtcctgaatagcggagacattcctaacctttacactgctgacgagcaggatcagattgtaagtactatgcgaccctatattcaagagcaggggctccaacccacaaaggcaaatctgatggctgcatatactggcagagttaggtccaatatccacatggtactgtgcatgtctcccatcggtgaggtgtttcgggctagactgcggcagtttcccagcttagtaaattgctgcaccattgattggttcaatgagtggccagctgaagctctgaagagtgtagctaccgtgtttctcaacgaaattcccgagctcgagagctcccaggaggagatacagggactgatccaagtgtgcgtctatatccaccaatctgtctcaaagaagtgcattgagtacctggccgaactgacgcggcacaattatgtgactcctaaatcatatctggagcttctccatattttcagcattctgatcggccagaagaaactagaactcaaaacagctaagaacaggatgaagtccggtctagacaagctcctgagaacttccgaggatgtagccaagatgcaggaggacctcgagagcatgcatcccctgctggaggaggccgccaaagacacaatgttgactatggagcagatcaaggtggatacagcaatcgcagaggagaccagaaacagtgtacagactgaggagattaaggctaacgagaaagccaaaaaggcccaggccatcgctgacgatgctcagaaggatctagacgaggcactgcccgctctggatgctgccttagcctcgctcaggaacctgaataagaacgatgtgaccgaggttcgagctatgcagcgtccgccccccggagtaaagctcgtgatagaggctgtctgcattatgaagggtatcaaacccaagaaggtgccaggcgagaagcccgggacaaaagtggacgattattgggagccaggaaaggggctgttacaagaccctgggcattttcttgagagcctgtttaagttcgacaaagataacattggcgacgtagtgataaaagctatccagccctatatagacaacgaagaattccagcccgccaccattgcgaaagttagcaaagcatgcacctcgatttgccagtgggtgagggccatgcataagtaccacttcgtggctaaggccgttgaacctaagcgacaagcccttctggaagcccaggacgaccttggggttacccagcggatcctcgacgaggctaaacagaggcttcgagaagttgaggatggcatcgcaaccatgcaagctaagtaccgggaatgtatcactaaaaaagaggagctcgagctcaagtgtgaacagtgcgagcagagactcggacgagctggaaagcttattaacgggctgtcagacgagaaggtgcggtggcaagaaaccgtcgaaaacctgcagtacatgctgaacaatatatcaggtgacgttttggtggcagcaggatttgtggcgtacctgggcccttttactggccagtacaggaccgtgttgtatgacagttgggtcaagcagctgagatcccacaacgtccctcatacgtctgaaccaacgttgatcggtactctgggaaatcccgttaaaattcgatcttggcaaatcgcaggattgccgaatgataccctgagtgtagagaatggggtcattaaccaatttagtcagcgatggacacattttatcgacccccaatcccaggctaacaagtggatcaagaatatggagaaggacaatgggctcgacgtatttaaacttagcgacagagattttttgcggtccatggagaacgcaatcagattcggtaaaccgtgcttactggaaaatgtaggtgaagaactcgatcctgcactggagcccgtgcttctcaagcaaacttacaagcagcaggggaacaccgtgctcaagctgggcgatacggtcatcccctatcatgaggactttagaatgtacattacaaccaagcttccaaaccctcactacactccggaaattagcacaaagctgactctgattaattttaccctttcgcccagtggcctggaggatcaactcttggggcaggtcgtagcagaggagagacctgatctggaggaagccaagaatcagctgataatctccaatgcaaaaatgaggcaagaacttaaagatatcgaggatcagatcctgtatcgtctgagctcttccgagggtaatcctgtcgacgacatggaattgataaaagtgctggaagcttccaagatgaaggcagccgagatccaggctaaggtgcgcatcgccgagcagaccgagaaagacatcgatctgaccaggatggagtatattcctgtcgctattaggacccagattctgttcttttgtgtctctgatctggcaaatgtggatccgatgtaccagtacagtctggagtggttcctgaacatctttctgtcaggcattgcgaactctgaacgagccgataatctgaaaaagcggatcagtaacatcaaccgctatctgacttactctctgtattcaaacgtgtgtaggtcactctttgagaaacataagctgatgtttgcttttttactttgtgtgcgcatcatgatgaacgaggggaaaattaaccagagtgaatggcggtacctcttgtctggggggtccatctcaataatgacagagaatccagcgcctgattggctgtccgaccgcgcctggagggacatactcgccctcagtaacttgccaacattttcatctttctcatccgacttcgtcaaacatctgagtgagttccgagtgattttcgacagtcttgagccccatcgcgagcccctgcccggtatctgggaccagtatctggaccagtttcagaagttactcgttctgcgatgcttgcgtggtgataaagtaacaaatgcaatgcaagacttcgttgcaaccaaccttgaacccagatttatcgaaccacaaacagccaacctttcggtggtctttaaagactcaaatagtacaacccccttgattttcgtcctgtctcctggcaccgatcctgccgcagatttgtacaagtttgcggaagaaatgaagtttagcaaaaagctgtctgctatatcccttggccaaggccagggacccagagctgaagcaatgatgaggagctccatcgaacgaggaaagtgggtattcttccagaattgtcacctggccccctcgtggatgcctgccctggaaaggttgattgaacatattaacccagataaggtccatcgagacttcagactctggcttacctcattgccatcaaacaagttcccggtgagcattctgcagaatggcagcaaaatgactatagagcctccacgcggcgtgagagccaacctgctgaaatcctactcatcgctcggcgaagacttcctgaactcgtgccacaaagtaatggaattcaaatcccttctcttgtcgctctgtctgttccatgggaacgcactggaaagacataagtttggccctctggggtttaacatcccctacgagtttacggacggggacctgcggatttgcatcagtcaacttaagatgttcctggatgagtatgacgatatcccctacaaagtgctcaaatacacagcaggggagatcaactacggaggtagggtgacggacgattgggatcggcgctgcatcatgaatatcctcgaagatttctataatcccgacgtcctttcccctgaacattcctatagtgctagtggcatctaccaccagattccaccaacctacgacttgcacgggtacttgtcctacatcaaatccttacctctcaacgacatgcccgaaatcttcggattacacgataatgcaaacataaccttcgcccagaacgagacatttgccctgctggggaccatcattcagttgcagccaaaaagctcatcagcagggagccagggaagagaggaaattgtggaagacgtaacgcagaatattttactcaaagtgccggagcctattaaccttcagtgggtgatggctaaatacccggtcctgtacgaggaatctatgaacacagttctggtccaggaagttatccgatataaccgtctgctgcaagtcattacccagaccctccaggacctgctcaaagctctaaaagggttagtggtgatgagctcccagctcgaacttatggcggcatccctgtacaataacacggttccagaactgtggagcgctaaggcctacccatcactgaaaccactttcaagctgggtgatggatttgctgcaacgcctggatttcctgcaggcatggattcaagatggtatacctgccgtgttttggatcagcggcttctttttccctcaggccttcctcaccggcacactccagaattttgcaagaaagttcgtgatcagtatagacaccatttcttttgactttaaagtaatgttcgaggcgcccagcgagctgacccagcgcccacaggtcggctgctacatacatggattgttcctcgaaggcgcacgctgggacccagaggccttccagctcgcagaaagccagcccaaggagttatacacagaaatggccgtcatctggctgctgcctaccccaaatcgcaaggcccaagatcaggatttctacctctgtcctatatacaagaccctgacgagagcggggaccctgagtaccactggacatagtaccaattacgttatcgccgtggagattccaacccatcaacctcaacgccattggatcaagcggggggtcgctcttatctgtgctctggattactag

SEQ ID NO: 115226 - DNA, 13416 bp, Artificial Sequence
  Description of Artificial Sequence: Synthetic coding sequence
atggtccccgaagaggtggaagttgaaattgacgaaatcccagtgctatctgaggaaggcgaagaagaggaggaaacttattctcagaaggtggagagcgttgataaggtaagggccaagagagtgagcttgcggactgaatcactgggacagccactgaatcgagaggacgaggaaatggacaaagagatcagcgagaagctgccttctaaaaggaccgctaagcatatcatggagaagatgcacctccacatgctctgcacgcctctcccagaggaatttttggaccagaatgttgtgttctttttacgtaacacaaaagaggccatctcagaagcgacagatatgaaggaggcgatggagattatgcccgaaacactcgaatacggcatcattaatgcaaatgtcctacattttctgaagaatatcatctgccaggtcttcctgcctgccctgtccttcaaccagcatcgaacttcgactacggttggggtcacatcaggtgaagtaagcaattcctctgagcatgaatccgatctgcccccaatgccaggagaagctgtcgagtatcactcaattcaactcatacgtgatgaattcttgatgaatgtgcaaaaatttgcatccaatattcagcggaccatgcagcagttagagggcgagattaagctggaaatgcccatcatatctgtggaaggggaggtatcagaccttgcggctgaccccgagacggtggatatcttggaacagtgtgtgatcaattggctgaaccagatcagcaccgcagttgaagcccaattgaagaagacaccccagggcaaagggcccctggctgaaatcgaattttggagagagcggaatgccacgctgtcagccctgcacgagcaaaccaaactgccaattgtgagaaaggtgctggacgtcattaaagagagcgattccatgctggtggctaatcttcagcccgtgttcacagagttgttcaagttccatacggaagcctctgataatgtgcggtttctgagtacagtggagaggtacttcaagaatatcacccacggttctgggttccacgtggtgctcgatactatcccagccatgatgtcagccttacggatggtgtggattatctcacgacactacaacaaagacgaacgcatgatccctctgatggagcgaattgcatgggaaatcgccgagcgggtttgtcgcgtggtgaatttacgtacattgttcaaagaaaatagagcatccgctcaatctaagacattagaggcaaggaatactctccggctatggaaaaaagcttacttcgacaccagagctaaaatagaagcctccggccgggaagacaggtgggaattcgatagaaagcggcttttcgagaggacagattatatggcaaccatctgtcaggacttatctgacgtcctccagattctggaagagttttataacatctttggaccagagctgaaggccgtaaccggggatcccaaaaggatcgacgacgtcttgtgtagagttgacgggctcgttacccccatggaaaatctgaccttcgacccctttagtattaagtcttctcagttttggaaatacgtgatggatgagttcaagatcgaggttcttatcgacatcatcaacaaaatctttgttcagaacctggagaatccacctctatacaaaaaccatccacctgttgcaggggctatctactgggagagatcactgttttttcgtatcaaacacacgatcttgcgcttccaggaagtacaggaaatactagacagtgatagggggcaagaggtcaaacaaaagtaccttgaagtggggaggacaatgaaggagtatgaggatagaaagtatgaacagtggatggaggtgacagagcaggttctgcctgccctgatgaaaaagtctctactgacaaagtccagcattgcaaccgaagagccatcaacccttgagagaggggccgtgtttgctataaatttttcacctgcgttaagagaaatcatcaacgagactaaatacttggaacagcttggctttacagtcccggaattagctcggaacgttgcactgcaagaggacaaattcctgaggtatacggccggcattcagcgaatgttggaccactaccacatgctaattggtactctcaatgatgctgagtcagtgctgttgaaagaccatagtcaggagctgctgcgcgtgtttagatcaggatataagagacttaattggaactcccttggtatcggcgactatattacaggatgtaaacaagccatcggtaaatttgagagcttagttcaccagatccacaagaacgccgatgacattagcagcagattgaccctgattgaagccatcaatctgtttaagtaccctgccgctaaatctgaggaggaattgcccggagtgaaagagttttttgagcacatcgaaagggagcgggcctctgacgtggatcacatggtgcgttggtacctagcgatcggacccctcctgaccaaagttgaaggcctggtagtccacaccaacacaggaaaggccccgaaactcgcctcgtactacaagtactgggaaaaaaagatatacgaggtcttgacgaagctcatcttgaagaacctgcagagctttaattcactgattctagggaacgtaccactatttcacactgaaaccattcttaccgcaccggaaatcatacttcatcctaataccaatgagatcgacaaaatgtgcttccactgcgttcgtaattgtgtggagattacaaaacatttcgtgcgttggatgaatggatcctgcatcgaatgcccaccgcaaaagggggaggaggaagaagtggtaatcatcaatttctacaacgatatctccctcaacccacagataatcgaacaagccgtcatgattccccagaacgtgcatagaatccttattaatctcatgaagtatttgcagaagtggaaaaggtatcggcccctttggaaattggataaagcgatcgtgatggagaagttcgcggccaaaaagcccccttgtgtggcctacgatgagaaactgcaattctatagcaagattgcatatgaagttatgagacatccgcttattaaggatgaacactgtattcgcctccagttacggcacctggcaaacactgtccaggaaaatgccaagtcctgggtgatttctctgggcaagctactgaacgaaagtgctaaggaggagctttacaatctccatgaagagatggagcatctcgctaaaaacctgcgtaaaatccctaataccctggaggacctgaaattcgttctggcgacaattgccgagatcaggtcgaaatcactggtgatggaattgcgctaccgagatgtgcaggagcggtatcgcaccatggccatgtataatttgttcccacctgatgccgagaaggaattagtagataagattgagtctatctggagcaacctcttcaatgattcagtgaacgtcgaacatgcactcggggatattaagcgtacctttaccgagttaactagaggggagattatgaactaccgcgtccagatcgaggaattcgccaaacggttttattccgaagggcctggctctgttggtgacgacttggacaaaggagtcgagttactcggcgtctacgaacgggaactggcacgtcacgagaagagtcggcaagagctggcaaacgctgaaaaattgttcgatctcccaatcactatgtacccggagctcctgaaagtgcaaaaagaaatgtctgggctgcggatgatctatgaactgtacgaaggtcttaaggtagcgaaggaggaatggagtcagaccctttggattaacctgaatgtccagatcttacaggagggaatcgaagggtttcttagagctcttcggaaacttccccgaccagtgcgagggctcagcgtcacgtactatttggaggcaaaaatgaaggctttcaaggatagcatccctttgctgttggacctcaagaatgaggctctgagagacagacactggaaggaattgatggaaaaaacatccgtgttttttgaaatgaccgaaacctttaccctggagaacatgttcgcaatggagttacacaaacataccgacgtcctcaatgaaattgtcactgccgccattaaagaggtcgcaatagaaaaggctgtcaaagagatcctggatacttgggagaacatgaaatttaccgtggtgaaatattgtaagggaacacaggagcgcggatatatcttgggcagcgtggatgaaatcattcagtcattggatgataacacttttaacctccagagtatatcaggaagccgatttgtggggcctttcctacagaccgtgcacaagtgggagaaaactctgagtttgatcggagaagtgatcgaaatctggatgcttgtgcaaagaaaatggatgtatctggaaagcatctttatcgggggcgatatcaggtctcagcttcccgaggaagctaaaaagttcgacaacatcgataaggtcttcaagaggataatgggtgaaacacttaaagaccccgtcatcaagcggtgctgcgaggcccccaatagactgtccgaccttcaaaatgtgtcggagggcctcgagaagtgccagaagtctctcaacgactacctggattccaaaagaaatgcctttcccaggtttttctttattagcgatgacgagttactttccattctgggtagttcggatccgctgtgtgtacaggagcacatgataaaaatgtatgataacatcgcatctctcaggttcaatgatggggatagcggcgagaaattggtctctgcaatgatttcagccgaaggtgaggttatggagtttcggaagatcttgcgcgccgaggggcgggtcgaagactggatgaccgccgtgctgaatgaaatgaggagaaccaaccgcttgattaccaaggaagccattttcaggtactgcgaagacaggtcgagagtggattggatgttgctttatcaggggatggtcgtattggcagcctcccaggtctggtggacatgggaagtcgaagatgtgttccacaaagcacaaaaaggagagaagcaagccatgaaaaactacgggaggaagatgcacaggcagatagacgagctcgtcactcgtataaccatgcccctgtctaaaaacgacaggaaaaaatacaacacggtcctcatcattgacgtgcatgcccgcgacatcgtcgactcttttataaggggctccattctggaagcccgagaatttgattgggagagccagttaaggttctattgggacagggagcctgatgaattgaacatcagacagtgtactggcacgttcggatatgggtatgagtatatgggtctcaatggtcggttagtgattacccccctaaccgacaggatttatctcaccttaacacaggctttgtctatgtacctgggtggcgcacccgcagggcctgcaggaaccggaaaaacggaaactactaaagatttagcgaaggcgctgggactgctctgcgtagtgaccaactgcggcgagggaatggattatcgtgccgtcggcaaaattttctcaggcttagcacaatgcggcgcctgggggtgttttgatgaattcaatagaattgacgcctcagtactatccgtgatatcttctcagattcagactataaggaacgccctgatccatcagcttactacttttcaatttgagggccaggaaatcagtctggacagtaggatgggcatatttatcactatgaatcctggctacgctggacggacagaattacccgagtccgtaaaggccctgttcaggcctgtggtcgtgatcgtccccgatctccagcaaatttgtgaaatcatgcttttctcggaggggttcctggaagctaagacccttgctaagaaaatgactgtgctttataagcttgcccgtgaacagctgagcaaacagtaccactacgacttcggcctgcgagccctgaaatctgttttggtcatggctggggagctcaaacgaggctcctccgatctgcgcgaggacgttgtcctcatgagagccttacgggatatgaacctgccaaagtttgtgtttgaagacgttccactctttcttgggttaattagtgatctcttccccggcctcgattgtccacgagtgcgatatccagacttcaatgatgccgtggagcaggtgctggaagaaaatggctacgcagttcttccgatccaggtggataaagtcgtgcagatgtttgagacaatgctcacccggcacacaaccatggtggttggtccaactagaggaggtaagtctgtggtgataaacaccttatgtcaggcacagaccaaactcggactgacaacaaaactttatatcctaaaccccaaggcagttagcgtgattgagctctacggcatcctggacccgacaacaagagactggactgacggtgttctttccaacatcttccgagagatcaataaaccaaccgataagaaggagcggaaatacatccttttcgatggcgatgtcgacgcgctctgggtggaaaacatgaatagtgtcatggatgataacagactgctgacactggcgaatggagaacgtatccgtctgcaggcccactgcgcccttctattcgaggtgggtgacttgcaatacgctagtcccgccaccgtctcccgttgcggaatggtatacgtggaccctaaaaacctaaaatatcggccgtattggaagaaatgggtgaatcagatacctaataaggtagagcagtacaacctgaattctctctttgaaaagtacgtgccgtatctcatggacgtgatagtggagggaatcgttgatggcagacaggccgagaagctgaaaactatcgtccctcaaactgacctgaacatggtcactcagctggcaaaaatgctggacgcattgttagagggtgaaattgaagatctagatctgctagaatgttattttctggaagcgctctattgctcattgggggccagccttctcgaggacggtcgcatgaaatttgatgaatatataaaacgactcgcctccctgtctacggtagacacagaaggggtgtgggctaacccaggagagcttcccggtcaactgccgactctatatgacttccactttgacaacaaacgcaaccagtgggtaccgtggtctaagctggtgcccgagtatatccatgcgccggaacgcaagtttatcaatatcctggtgcacactgtagatacaaccagaacaacttggatcctggaacagatggtcaaaatcaaacagccagtgatttttgtgggggaaagtggaacatccaaaaccgccacgacccagaatttcctgaagaatctaagtgaggaaacgaacatcgtgctcatggtgaacttcagcagccgtaccaccagcatggatatccagcgcaatttagaggcaaatgtcgaaaaaagaactaaggacacctacggtccacccatgggcaaaagactactggtttttatggatgacatgaacatgccaagagtcgatgagtatgggactcaacagccgatcgccctccttaagcttttattggaaaaggggtacctctatgatagaggcaaggaactaaactgcaagtccattcgggacttgggcttcattgctgcaatgggcaaagctggtggggggagaaatgaagtcgacccccgcttcatcagcttattcagtgtattcaacgtgccatttccatcagaagagtctttgcacttgatttactcctccatcctcaagggccatacgtcgaccttccatgaaagcatcgtggcagtgagcggcaaactgacattttgcaccctggccctatacaaaaacatagtgcaggatctgccccctactccgagcaagtttcactacatattcaacctgcgcgatctgagccgggtttttaatgggcttgttctgacaaaccccgaaagattccagactgtcgcacagatggtgcgcgtgtggcggaacgagtgtttacgagtgtttcatgatcggctcatcagcgagactgataagcagctggtacagcaacacatcgggtccttagtggtggagcacttcaaggacgacgtggaggtcgtcatgcgggaccctatcctcttcggtgactttcagatggccctgcatgaaggcgaaccacgaatttatgaggacattcaagattacgaagctgcaaaggcccttttccaggaaatcctggaggaatataacgaatctaacacgaaaatgaacctggttctgttcgacgacgccctggagcatctaacaagggtgcaccgcatcataagaatggacaggggacacgccctacttgtcggtgtgggtgggagcggcaagcagtccctgagtagactggcagccttcactgcctcttgcgaggttttcgaaatcttgcttagccgaggatacagcgaaaattcgtttagggaggatttgaagtctctatatctgaaactcggcattgagaacaaggccatgattttcctgtttacagacgcacatgtggctgaagagggcttcctggaactcattaataatatgttgaccagcgggattgtgccagccctcttttctgaagaggaaaaggagtcaatcctttcccagataggccaggaggctttgaagcagggcatggggccagccaaggaaagcgtgtggcagtatttcgtgaataaaagcgctaacaacctccacattgtactggggatgagtccagtgggcgacaccctgaggacctggtgtcgcaactttccaggaatggtaaataataccggaatcgattggttcatgccctggcccccacaggctttacacgcagtggccaaaagttttctcgggtacaaccccatgattcccgcggagaatatagagaacgttgtgaagcacgtggttctagtgcaccagtctgtcgaccattactcacagcagtttcttcagaagctgagacgcagcaattatgtcactccaaagaactacttggacttcatcaacacgtatagtaaactattggatgagaagacccagtgtaatatagcgcaatgtaagaggctcgatggagggcttgacaaactcaaggaagcaactatccagctcgatgaactgaaccagaaactggcggagcaaaaaattgtgctggctgagaagagtgcagcctgcgaggcgctgctcgaggaaatcgctgtgaatacagccgtggccgaggagaagaaaaagctggcagaggagaaggctatggagatagaggaacagaataaggtgatcgccatggaaaaggctgaagctgagaccacgctcgccgaagtgatgccgattttggaggctgctaaactggaactgcagaagctcgataagtccgacgttaccgagataagaagcttcgccaaacctcccaagcaggttcagactgtgtgtgagtgcatcttgatcatgaagggttataaagaactcaactggaagaccgctaagggagtgatgtctgacccgaatttccttcgctcacttatggagatagattttgactcgatcacacagtctcaggtcaaaaatatcaagggcctgctgaagaccttaaataccactacagaagaaatggaagcagtgtctaaggccgggctggggatgttaaaattcgttgaggcagtgatgggatattgtgacgtgttccgtgagattaaacccaagagggaaaaagtcgccagactggagaggaatttttaccttaccaagagggaactggaaaggattcaaaacgaactggctgcaatacagaaagaactagaaacccttggggcgaagtacgaggctgccatcctcgaaaagcagaaacttcaggaggaggcagagattatggagaggcggttgatagccgctgacaaactcattagcggactgggcagtgaaaacatccgatggctgaacgacttggacgagctgatgcacaggagggtgaagttgctgggggattgcttgctctgtgctgccttcttatcttacgagggagcatttacgtgggagtttagggatgaaatggtgaatcggatatggcagaacgatatcttagagagggagatccctttaagtcagcccttcaggcttgagagtctgctcacggacgacgttgagattagccgctggggctcccaagggttgccccctgacgagctgtcagtccaaaacgggatcctgacaactcgtgcctcccgcttccctctgtgcattgacccccagcagcaggctctcaactggataaaacggaaggaggagaaaaacaacttacgagttgctagttttaatgaccctgactttctcaaacaactcgaaatgagcataaaatacggtaccccgtttctgtttagagacgttgacgagtacatcgatcccgtaatcgataatgtgttggagaagaatataaaggtgtcccaaggtcgccaattcattattctgggggacaaagaggttgactacgactcaaacttcaggttgtaccttaatactaagctggccaacccacgatacagtccatcggtattcggaaaggcgatggtgatcaattacaccgtgacccttaaaggattggaagaccagctcctgagcgtgctggtggcctacgaaaggcgcgagctcgaggagcaaagagagcatctcatccaggaaacttctgagaataagaacttgttgaaagatctggaggactctttgttgcgtgagctggccacttcgacagggaatatgctggacaatgtggacttggtgcacaccctcgaagagaccaagagtaaggccaccgaagttagcgagaagctgaaacttgccgagaaaaccgcacttgatatcgatagattacgggacggctacaggccagccgctaggcgtggtgccatactgtttttcgtcctgtcagagatggcactggtcaacagtatgtaccagtattctctgattgctttcctcgaggtgtttcgcctttcactgaaaaagagtctaccagactctattttgatgaagaggctgcgtaacatcatggacacccttaccttcagcatttacaaccacggctgtacaggcctgttcgagagacacaaactccttttctcattcaacatgaccattaagattgagcaggctgagggaagggtgccccaagaagaactggattttttcctgaaagggaatatatctctggagaagagcaaacgcaagaaaccatgtgcctggctttccgatcagggctgggaagatatcattctcctatctgaaatgttctctgacaatttcggtcagctgccggacgacgtggaaaacaaccagactgtctggcaggaatggtatgatcttgacagcttggagcagttccccgtgccgctgggttacgataataatattactccgtttcagaaactgctgatcttgcggtgttttcgcgtggatcgggtgtacagggctgttactgactacgtgaccgtgacaatgggcgagaaatatgtgcagccccccatgatcagtttcgaagccatcttcgaacaatccacaccccatagccctattgtttttatcctcagccccggaagcgatcctgctacggatctcatgaagctggcagagcggagtggatttggtggtaataggctgaaattcttggccatggggcagggtcaagagaaggtggcgctgcaactgctggagacggcagtagcccgcggtcagtggctgatgcttcagaattgccatttactggtgaagtggctgaaggacctggagaaatccctggagagaattaccaagccacaccctgactttcgactttggctcactacagatccgactaagggattccctatcggcatcttacagaaaagcctgaaagtagtgactgaaccccccaatggactgaaactgaacatgagagccacgtattttaagatatcccatgaaatgctagaccagtgcccacatccagcctttaagcctctggtttacgtcctagccttcttccatgcggtcgtgcaagaacggcgcaagtttggtaaaattggctggaatgtctactatgactttaatgagtctgattttcaggtgtgtatggagatcctgaatacctatctcacaaaggctttccagcaaagagatccaagaatcccatggggcagtttgaagtaccttatcggagaggtgatgtacggtgggcgtgcgattgactcctttgataggcgcatactaaccatatatatggacgaatatctaggcgatttcatcttcgatacctttcaaccctttcactttttcaggaataaagaagtggactacaagatcccggtgggcgatgagaaggagaaattcgtggaagcaattgaagctttgccgctggctaacacccccgaggtgttcggcctccaccctaacgccgagattgggtactacacccaagctgccagggatatgtgggcccacctgctggaactccagccccagaccggagaatcttcatcaggcatttcaagagatgattacatcggtcaggtcgcaaaagagattgagaacaagatgccgaaagtctttgaccttgatcaagtcagaaaaagactgggaaccggtttatcacccactagtgtggtcctcctacaggaactcgagcgctttaacaagctagttgtgagaatgaccaaatctctggccgaactgcaaagagctctggctggtgaagtgggcatgtctaatgaacttgacgacgtggctaggagtctgttcatcgggcatattccaaatatatggcgtcgcttagctccggacaccctgaagtccctgggcaattggatggtgtactttttgaggcggttttcgcaatacatgctgtgggtgaccgagagcgagccttcagtcatgtggctctcagggcttcacatccccgagagctatctgaccgctctggtccaggctacctgccgcaagaatgggtggcccttggaccgaagcacgttgtttactcaagtcactaagtttcaggacgcagacgaggttaacgagcgcgccggccaaggctgctttgtgtccggcctgtacctggagggcgcagactgggacatagagaaagggtgtctcatcaaaagcaagcccaaggtgctggtggtcgacctgcctattctgaaaatcatcccaatcgaggctcatcgcctcaagcttcagaatacctttagaacccccgtttataccactagcatgagaaggaatgccatgggcgtgggcctcgtgtttgaggcagacctattcaccacaagacacattagtcactgggtccttcagggcgtctgcctcacgctgaacagcgattag

SEQ ID NO: 115227 - DNA, 13572 bp, Artificial Sequence
  Description of Artificial Sequence: Synthetic coding sequence
atggccgctcaggtcgcagcgagagaagcccgagacttccgcgaggccccaaccctacgattgacctctggcgccgggctggaggccgttggtgccgtcgagctagaagaggaggaagaaaatgaggaagaggccgctgcccgacgggccagaagcttcgcccaggacgctcgcgtcagattcctgggcgggcggctggctatgatgctgggcttcaccgaggagaagtggtcacagtacttagaatccgaggacaaccgacaagttctcggcgagttcctggaaagcacttcaccggcatgtcttgtcttctcttttgcagcctcaggaaggctggctgccagccaggaaatcccccgggatgcgaaccacaagctcgtgtttatctccaagaaaatcactgagagcatcggcgtgaacgacttttcccaggtggtgctgttcggcgaactgccagccctgtcccttggtcatgtgtcagccttcttagacgaaatactggtacccgtgctgagcaacaaaaataaccataagagctggtcatgttttacatctcaagacatggagtatcacatcgaagtcatgaaaaaaaaaatgtacatcttccggggaaaaatgtccaggaggacccttctgcccattcctaccgtggcaggcaaaatggatctggaccagaactgttcagaaaataagcctccttctaatgaacgcatcatcctgcacgccatcgagtccgtggtgatcgagtggagccatcagatacaggagatcatcgagcgggacagtgttcaacgcttgctaaatggcttgcacctgtctccccaagccgaactggatttctggatgatgagaagagagaacctctcttgcatctatgaccagttgcaggcccccgtagtcctcaagatggtgaagattctgactacaaaacaatcctcctattttcccacgttgaaagacatcttcctggctgtcgaaaacgccctgttagaggctcaagatgtggagctgtatttaagaccacttcggcgacacattcagtgtcttcaggagacagagtttccccagacccgcattctgatcgcccccctgttccacaccatctgcctgatatggagccactccaaattttacaatactcctgccagagtgattgtgctgctgcaagaattttgtaacttgttcattaaccaagccactgcatacctcagccccgaagacctgctccgcggagagattgaagagtccctagaaaaggttcaagtagccgtcaatatcttgaagacctttaaaaacagttttttcaattatcgcaaaaaattggcttcttacttcatgggccgaaaactgcgaccgtgggattttcagtctcaccttgtgttctgtagattcgacaagtttcttgatagactaatcaaaatcgaagatatcttcgccaccacacttgagtttgaaaagcttgagcgccttgagttcggtggaacgaagggtgctatcctcaatggacaagtgcacgagatgagcgaagagctgatggagttgtgtaaactgttcaagcagagcacgtatgatccatcagactgcacgaacatggaatttgaaagtgactacgttgctttcaagtcaaaaaccctcgagttcgatcgacgccttggcaccattatctgtgaggcatttttcaattgtaatgggctggaggccgctttcaagctgcttaccatctttgggaattttctggagaaaccagtcgtgatggaaattttcagtcttcactactccacactggttcatatgttcaatacagagttagacgtgtgtaaacagctttacaacgaacacatgaagcagatagagtgcggccatgtggttctgaataagaatatgccgttcaccagcggcaacatgaaatgggcacaacaagtgctgcagcgacttcagatgttctggtcaaatttcgcatcactccgttatctgttcctagggaaccccgaccatgccctagtctaccaaaaatacgttgagatgactactctcttagaccagttcgagtcccgtatttacaatgaatggaaaagcaacgtcgatgaaatctgtgagtttaatctgaatcaacctctcgttaaattctccgcgattaacgggctgctctgtgtgaactttgaccctaagcttgtggcagtcttacgagaagtgaaatacttgctgatgcttaagaagcaggacattcccgattccgccctggcgattttcaaaaagagaaatactattcttaagtacatcgggaacctggacctgctcgtgcagggatataataaactcaaacagactctgctggaggtggagtaccccttgatcgaagacgagcttcgggctatcgacgagcaactgactgcagccactacatggctgacatggcaagatgactgctgggggtacattgaaagagtgagggcagcgaccagcgagcttgagcaccgggttgaacgtacgcagaagaatgttaaggtgatccaacagacgatgcgcggatgggcacgttgcgtgctcccccccagaagagagcaccgccgggaagccgcgtttacgcttgaagacaagggtgatttattcacaaaaaagtacaaattgatccagggtgatggatgcaagattcacaacctggtcgaagaaaatagaaagctgttcaaggcgaacccctccctagacacctggaaaatttacgttgagttcatcgacgacatcgtcgtcgaaggcttttttcaagccattatgcacgatcttgatttttttttgaaaaatactgaaaaacagctcaagcctgctccctttttccaagcccaaatgatcctgctccctccggaaatcgtctttaagccgtccctcgatagggaagcaggcgatggtttttacgatctcgtggaggagatgctctgcaattcctttcggatgtcagcacagatgaatcggatcgccacacacctggagattaagaattaccagaacgatatggataatatgctgggcctggctgaggtccgacaagaaattatgaatcgagtggtgaacgttatcaacaaggtccttgattttagaaataccctggagacccacacatatctttgggtggatgaccgcgctgaatttatgaaacacttcttactgtacggacatgccgtctcttccgatgaaatggacgcacacgcaaacgaagaaattccagaacaacctccgaccctggaacagtttaaggaacagatagacatctacgaggcgctgtacgtccagatgagcaagttcgaggactttcgggtgtttgactcctggttcaaagtagacatgaagccatttaaggtgagcctcctgacaatcattaagaagtggagttggatgtttcaggaacacctgctgagatttgtgatcgattcactgaacgagctccaggagttcattaaagagacagacagcggcttacagcgggagcttaacgaaggtgaccatgatggtctggtggatataatggtgcacctgcttgctgtgagaagcaggcaaagggctactgatgagttatttgagcctctcaaagagacgattacactgctagaaagctacggacagaaaatgcctgaacaggtctacatacagctggaggagctgcctgagagatgggaaaccaccaagaagatagccgctacagtgcggcacgaggtgagcccactgcataatgccgaagtcactctgatcagaaagaagtgcatcctttttgacgccaaacaggcagagttcagagaacgttttcgacactacgcacccctgggcttcaatgctgaaaatccttacactgctctggacaaagccaatgaggagctggaggccctcgaggaggaaatgctacaaatgcaggagagcaccaggttgtttgaagtcgcactcccagagtataaacagatgaagcagtgccgcaaggagatcaagttgctcaagggactttgggatgtcatcatctacgtccgtcgatcaatcgacaactggacaaagacacagtggcgacagatacacgtggaacaaatggatgtcgagctccgcagattcgcgaaggcttctagcatcaccgagatttggagcctgaacaaagaggtaagggtgtgggacgcatacacgggcctggagggcactgtgaaggacatgacagcttctctgcgcgccattacagagctccagagtccagccttgcgggacaggcattggcaccagctcatgaaggccatcggcgtgaaatttctgatcaacgaggctacaaccctggcagacctcctggcactgcgcctgcacagagtcgaagatgatgtccggcgtatcgtggacaaagccgtcaaggaattagggactgaaaaggtgatcacggaaatatctcagacatgggcaactatgaagttttcctatgaagtccactatcgaacggggatcccattgcttaaatccgatgaacagttgtttgagactcttgagcacaaccaggtgcagctacagacgctgctccaaagcaagtatgtggaatacttcatagagcaggtcctatcttggcagaacaagctaaatattgctgatctcgtgatctttacgtggatggaggtgcagaggacctggtcccaccttgaatcaattttcgtgtgctcagaggatatcaggatacagctggtgaaagacgcgaggagattcgacggggtggatgcagagtttaaagagttgatgtttaagacagccaaagtggaaaatgtgctggaggccacgtgtaggcccaacttgtacgaaaagctgaaggatctccagagccggttaagcttgtgtgagaaggcactggcagagtaccttgaaactaagaggatcgctttccccagattctattttgtgtcaagtgcagatttgctggatattctaagcaaaggggcccagcccaagcaagtcacctgccacctcgcaaaattgttcgatagcatagctgatctgcagttcgaggacaatcaggacgtgtctgcccaccgggctgtgggcatgtacagcaaagagaaggagtacgtgccctttcaagcagaatgcgaatgcgtgggacacgtggagacgtggctgttgcagctggagcagaccatgcaagagacagtcagacattcaatcacagaggcaattgtggcctatgaggaaaagcccagggaactctggatcttcgatttcccagcccaggtggccctcacttcttctcagatttggtggaccactgatgtcggtatcgcatttagccgattagaggagggatacgaaaccgccctcaaggactttcacaagaaacagatatcccagctcaatactctcatcacgttgctgcttggggaactcccccccggcgacaggcaaaagataatgaccatctgcaccattgatgttcatgcgcgggacgttgtcgccaaactcatctcacaaaagcaggtagttgtgagcccccaggctttcacttggctcagccagctgcgacatcgatgggaagatacacagaagcactgtttcgtcaatatctgtgatgcccagttccaatatttctacgaatacctcggcaattcccccaggctcgtaatcacaccgctgaccgaccgctgctacattaccctgacacaatctctgcatttaactatgtcaggggcgccagctggtcctgctgggactgggaagacagagacgaccaaagacctgggcagagcactgggtatgatggtctacgtgttcaattgttccgagcagatggattataagtccatcggaaacatctacaaaggcctggttcagactggggcttggggatgcttcgacgagttcaaccgaattagtgttgaggtgctgtctgtggtggcggttcaggttaagatgatacatgatgcaatcagaaaccgaaagaagaggttcgtgtttctgggtgaagcgattacactcaagccatcggttgggattttcataactatgaaccccgggtacgccggaaggactgagctgcccgaaaaccttaaagcccttttcaggccatgtgccatggtcgcacctgatattgagctgatctgcgaaatcttactggtagccgagggtttcgtcgacgcacgagctctcgcgaggaagttcattacactttacaccctgtgtaaggaacttctttctaaacaagatcattatgattggggactgagagcaatcaagtcggtactggtggttgccggtagtctgaaacggggggacaagaatcgccctgaggatcaagttttgatgagagctcttcgagactttaacatgccaaagattgttacggatgatataccagtgtttcttggcttggtgggcgacctttttcccgcattagacgtaccccgccgacgaaaacttcattttgagcagatggtgcggcagtccactttggaactcaggctgcagcccgaggagagcttcatacttaaggttgttcagctggaggagctactggccgtccggcattccgtgttcgtggtgggcaacgccggcacaggcaaatcgaaaatcctgagaactctgaataggacgtacgtgaatatgaagcagaaaccagtgtggaatgatctgaatccaaaagccgtaactactgatgaattgtttggcttcattcaccacgctacccgggaatggaaagacggtaaaatcgtttattcttatttcattggtcttttcagctcaatattgcgcgagcaggcgaacctcaagcatgacgggcctaagtggatcgtgttggacggcgacatcgatcctatgtggatcgaatcgctcaacaccgtcatggacgataacaaagtgctgaccttggcctcaaacgaaagaatcgcacttacccccttcatgcgcctgctcttcgaaatccaccacctgagatctgctacccctgctactgtaagtagagccggcatcttgtacgtgaacccccaagacctcggttggaatccatatgtggctagctggatcgataggaggaggcaccagtccgagaaggccaatttgacaattcttttcgataaatacgtccccgcatgcctggataagctgcgcaccagctttaaaactattacttcaatccctgagtcctccttggtccagacactttgtgtgttgctagaatgtctccttacgcccgaaaacgtgccttccgatagccctaaggaggtctacgaggtctactttgtgtttgcctgcatctgggccttcgggggtaccctgctccaggatcagatctcagactatcaagctgatttctctcgttggtggcaaaaagaaatgaaagctgttaaattcccaagtcagggaactatcttcgattattacgtagatcataaaacaaaaaaattactaccctgggctgataaaattgcccagttcactatggacccggatgtgcccctgcagacagtcctggtccacaccacagagacagctcgcctccggtactttatggaactactccttgagaaaggcaagcccctgatgttggtgggtaatgcgggggtagggaaaactgtttttgtcggcgacacactcgcaagcttgtccgaggactacattgtgtctagagtgccattcaactattataccacaagcactgctctgcaaaagatcttggaaaagcctctggagaaaaaagccggccacaattatgggcccggggggaacaagaagctcatctatttcattgacgacatgaacatgccagaagtggatctttacgggacagtgcagccgcacactcttattcgccaacatattgattacgggcattggtatgataggcaaaaagttatgctgaaagagatacacaactgccagtacgtagcttgtatgaatcctatggtgggaagctttacgattaacccacggttgcagagacatttcaccgtgtttgccttcaatttcccgtctcttgatgccctgaatactatatacggccagatcttcagcttccacttccagcaacaggcgttcgcgccgtcgatccttcgcagcggaccaactctcattcaggcaaccatagccttccaccaaacaatgatgtgcaattttttacccacggccatcaagtttcattacattttcaacctgagggacctgtctaacgtgttccaggggatccttttcgcaagtcccgagtgtctgaaagggcccctcgacctgatccatctctggctgcatgaatctgcgcgagtgtatggggacaagctaatcgataagaaggactgtgacctgttccagcgtcggatgctcgaaacagcttataaatattttgagggcattgactcacacatgctgctacagcagccattgatctactgccatttcgcagacaggggaaaggacccgcattatatgcccgtcaaagattgggaggtactcaagacgattctgactgaaactctggacaactataacgagctgaacgccgctatgcatctcgtattgttcgaggacgcaatgcagcacgtctgccgaatttcccgcattttgagaaccccccagggttgcgccctgctagtgggcgtagggggctcaggaaagcagagcctcagcaggctggctgcctacctgcgtggcctagaagttttccaaataacacttacagagggatacggcatccaggaactgcgtgtcgatctcgcaaacctctatatcagaacaggagccaagaacatgccgaccgtttttctcttgacagacgcccaagttcttgacgaatccttcctggttctgataaacgatctactcgcatcaggagaaatccccgacctattctccgacgaagacgtggataaaatcatcagcggcattcataacgaggttcatgcactggggatggtggattcccgagagaactgttggaagttttttatggctagagtacgactccagttaaagattatcctgtgcttctctccagttgggcgaacgctgcgggtgagggcccgcaaatttccggccatcgtcaattgtactgcaatcgattggtttcatgcctggcctcaggaggccctggtgagtgtctctcggcgttttattgaagagaccaaaggaatcgaacctgtgcacaaagattcgatctccctgtttatggctcatgtacatacaaccgttaatgagatgtccacgagatactaccagaacgagcgacggcacaactatacaacacctaagtcattcctggaacagatttcattgttcaaaaatcttctgaagaagaagcaaaacgaagtaagcgaaaaaaaggaaaggctcgtgaacgggatccagaagctcaaaaccaccgcatctcaggttggagacctgaaagcgaggctcgcctcccaagaagctgaactgcagctgagaaaccacgatgcagaagctctgattacaaagatcggtctgcaaaccgaaaaggtttcccgggagaaaaccatcgctgacgccgaggagagaaaggtcacggccatccagactgaagtgttccagaagcagagagaatgtgaagcagacttgctcaaggccgagccggcactcgttgccgcgactgctgctcttaatacactcaacagggtgaaccttagcgagctgaaagcgtttcccaatccccctatcgccgtgacgaacgttacggccgccgtcatggtactcctagcgccacgtggaagggttcctaaggatagaagttggaaggctgcaaaagtgttcatggggaaagtggatgactttctgcaggcactgattaattatgacaaagaacacattcctgaaaactgtctcaaggtcgttaatgaacactacctaaaagaccccgaattcaacccgaacctcatccgcacgaaaagttttgcagccgctggcctgtgcgcgtgggtgatcaacatcataaaattttacgaggtgtactgcgatgtggagccaaagaggcaagccctggcccaggccaacttagagctcgcagctgccaccgagaaactggaagcaatccggaaaaagcttgtggatctggacagaaacctctccagactgaccgcctcctttgaaaaagccacagccgaaaaggtacgatgccaggaggaggttaatcaaaccaataagaccatcaagctggctaacaggctcgtgaaggaactggaggcaaaaaagattcgctggggccagtcaattaaaagtttcgaggcccaggagaagactctgtgcggcgatgtacttctgaccgcagctttcgtcagctatgtcggccccttcactcgccagtacaggcaggagcttgtgcactgtaagtgggttcccttcctgcagcagaaggtgtccataccactgaccgaagggctggatctgatctcaatgctcacagatgacgctacaatcgccgcctggaataatgaaggcctcccttcagacaggatgagcaccgagaatgcagctatactcacccattgtgagcgctggccactggtgattgacccacagcaacagggaatcaagtggatcaaaaacaagtacggcatggacctcaaggtgacccacctgggccagaaaggcttcctgaacgccatcgagactgctctcgcattcggggacgtcattttgatcgagaacctggaggagaccatcgaccccgtgctggatcctctcctgggcagaaacaccattaagaaagggaaatacattcgcattggagataaggagtgcgagttcaataaaaactttcgacttattctgcataccaaactggctaacccgcactataaaccggaactccaggcgcaaactacactgttgaactttaccgtaaccgaagacgggcttgaggctcagctcttggcggaagttgtgagtatcgaaagacccgaccttgagaaattgaaactggtcctcacaaagcaccagaacgacttcaaaattgagctgaagtacctggaagatgatttgttattgaggctgtccgcagccgaaggcagctttctagatgataccaagctcgtcgaacgcctcgaggccaccaaaaccacagtggctgagatcgagcacaaagttattgaggcgaaagagaatgagagaaagattaacgaggcaagagagtgctacagaccagtcgctgcacgggctagcctactgtactttgtgatcaacgatcttcagaagatcaaccccctgtaccagtttagcctgaaggcctttaacgtgctatttcaccgggccatcgaacaggccgacaaggtcgaagatatgcaggggaggatttccatcttgatggagtctatcacgcacgcagtgtttctttacacaagccaggccctgttcgaaaaagataagttaacttttttgagccagatggccttccagattctactgaggaaaaaggagatcgacccactcgagctggacttcctgctacggtttacagtggagcacacccatctgtcccccgtggattttctgactagccaatcctggtctgcgattaaggctatcgcagtgatggaagagttcagaggcatcgatagagatgtggagggttcagccaagcagtggcggaaatgggtggaaagcgaatgtccagaaaaagaaaaacttccccaagaatggaagaaaaagagtcttattcaaaagctgatcctcttacgcgcaatgcggccagacagaatgacatatgccctgagaaactttgtggaggagaagcttggcgcaaagtacgtggagcggacaaggttggatctggtaaaggcatttgaagagtcctcacctgccacaccaatcttctttattctttcccctggtgtcgatgccctgaaagaccttgagattttgggaaaacggctcgggtttacgatcgattccggaaagttccacaacgtttctttaggccagggacaggaaactgtcgccgaagttgctttagagaaagcatctaaaggaggccattgggtaatactgcagaatgtgcacctggtggccaagtggctggggacactggagaagctgcttgagcggttttcacagggatcccacagggactatagagtcttcatgtctgcggagagcgccccaacccctgacgagcacatcattccacaggggctgcttgagaattcgattaaaataacaaacgagccaccaaccggaatgcttgcaaacctacacgcggccctctataatttcgaccaggatactctcgagatctgcagtaaagaacaggagtttaaatccattcttttttctctgtgttattttcacgcttgcgtcgccggacgcttaaggttcggacctcaggggtggtcccgctcgtacccctttaatcccggtgatctgacaatttgcgcatccgttttatacaattatttggaggccaattctaaggttccctgggaggaccttagatatctgttcggcgagattatgtatggtggccatattacagacgactgggataggaaactgtgccgtgtgtacttggaggaattcatgaacccaagccttacagaagacgaactcatgttggcccccggcttcgctgcacctccctaccttgattatgccggataccatcagtacatcgaagaaatgttgccgcccgagtccccggccctttatggactacatcctaacgcggagatcgagttcctgaccgtcactagtaacacattattccggactctgttggagatgcagccacggaatgctctgagtggggacgaattaggccagtcaacagaagagaaagtgaaaaacgttctggatgacatcctggaaaagctccccgaggaatttaacatggccgaaatcatgcagaaaaacagcaacagatctccttacgtgctggtatgttttcaggaatgtgaacgcatgaacatcctgatccgggagatcaggatcagtttggaacagttagacttgtccttaaaaggcgagctcgctctgagccccgcagtcgaagctcaacagtttgcgctttcatacgacactgtacccgacacatggagtaagcttgcatatcctagtacgtatggattggcccagtggttcaacgacctcctgctcagatgcagagagctcgacacctggacccaggatctgacactgcccgctgtggtgtggttgtcaggcttctttaacccgcaaagtttcttgacagccatcatgcaaactatggctaggaagaatgaatggccactggacaagactaggttgactgccgatgtcaccaaaaagactaaagaggactacggtcaccctcccagagaaggtgcttatctgcatgggctctttatggaaggagcccggtgggatacccaggcgggaacgatcgtggaggctaggctgaaggagctggcctgccccatgcccgtgatctttgcaaaggccacgcccgtggacagacaggaaaccaagcaaacgtacgagtgccctgtttacaggaccaaacttaggggtcctagctacatatggactttccggttaaaaagtgaggaaaagacagccaagtgggtcctagcaggcgttgcattattgcttgaagcctag

SEQ ID NO: 115228 - DNA, 1374 bp, Artificial Sequence
  Description of Artificial Sequence: Synthetic coding sequence
atgtctgatgcaaacaaggcagccattgcagccgaaaaagaggctctgaacctgaaactgcctccaatcgtgcatttgcctgagaacatcggtgtggatacgcccacacaatccaagctcctcaagtatcgcagaagcaaagaacagcagcagaagatcaaccagctggtcatcgacggcgctaaaaggaacctggataggactcttggaaagcgaaccccattgctcccaccaccagattacccacagacaatgactagtgaaatgaagaaaaaaggtttcaactatatttacatgaagcagtgcgtggaatccagtccacttgttcccatacagcaagagtggcttgaccatatgctaagattgatccctgaatccctaaaggaagggaaggaaagagaggaacttctggagtcccttatcaatgaagtgtctagcgacttcgagaacagcatgaagcgctatctagtgcagagcgtgctggtcaagcctccagtgaaatcgttggaagacgaagggggtcccttacctgagtctccggttggtctcgattattccaacccttggcatagcagctatgttcaggcccggaaccagattttcagcaatttacatattatacacccgactatgaaaatgttactggatttggggtacaccacattcgctgatactgtacttctggactttacagggattagagccaagggtcccatcgactgcgagagcctcaagacagaccttagcatccaaacacgcaacgctgaggagaagatcatgaacacgtggtacccgaaggtcataaatctctttacaaagaaggaagccctggagggggtgaaacccgagaaactcgacgcgttctactcgtgtgtgtctaccctaatgtctaatcagttaaaggacttgctccggcgcacggtagagggattcgtgaagctgtttgatccgaaggatcaacagcgactgcctatctttaagattgagttgacgttcgacgatgataagatggagttctacccgactttccaggatcttgaagacaacgttctatcacttgttgagagaattgcagaggccctccaaaatgtccagactatcccctcctggctgtcagggacttcaacaccagtgaacctggatactgagctgccagaacacgtgcttcactgggccgttgatactcttaaagctgcggtacaccgaaacctggagggtgcacgaaaacactacgagacatacgtggaaaagtataattggctgctggacggaaccgcggtggagaacatcgagacgtttcagactgaggaccacactttcgatgagtacactgaggagctcgactgttgggttgtttgggaggtgtatttctag

SEQ ID NO: 115229 - DNA, 2040 bp, Artificial Sequence
  Description of Artificial Sequence: Synthetic coding sequence
atgttcttactgactggcggcgtgagccttaagtcggccgaaaagaatccagatcccacttggctacaagataagagctgggaggagatatgcagagctagcgagtttcccgctttccgcgggctacgccagcacttttgcgagcacatctacgagtggcgggagatctacgattccaaggagccacataacgcgaagtttcctgcacccatggacaaaaacctcaatgaactccagaagatcattatcctgaggtgtctccgcccagataagattacacccgccatcaccaactatgtcacggataagctcggcaagaaatttgtggagcctcctccgttcgacctgaccaagtcctatttggactctaactgcaccatcccgcttatttttgtcctaagccctggagccgatccgatggcttcactacttaaattcgcgaacgataagtctatgtctggaaacaaattccaggctatctctctgggccaaggtcagggccccatcgccgccaagatgatcaaggccgctatcgaggagggaacttgggtttgcctgcagaattgccacctggcagtttcctggatgccaatgttggagaaaatctgtgaagatttcactagcgagacctgtaactcttctttcagactatggctcacgagttacccgtcatccaagttcccagtgaccatcctccagaatggcgtgaaaatgaccaacgaacctccgaccggcttaagacttaacctcctacagagctacctcactgatcctgtcagcgatccagagttctttaaaggctgtcggggtaaagaattgctcttcataaatgaatacgataccataccatttgaagccatcagctatctgactggagagtgcaattatgggggcagagttaccgacgattgggataggcgactgttgctgaccatgctggcagatttctataacctgtatattgtggaaaaccctcattataaatttagcccatccgggaactattttgctcccccgaaggggacttatgaagactatatcgaatttatcaagaaactgcctttcacgcagcaccctgaaattttcggattgcatgaaaatgttgacatttctaaagacttgcagcagacgaaaaccctgttcgagagcctgctgctaacacagggaggttcgaaacagaccggggcctcgggaagtaccgaccagatcctactcgagatcacaaaggacatcctgaacaagctgccctctgattttgacatagagatggccttgagaaaatatcctgtccggtacgaggaatcaatgaatacggtcttggttcaggagatggagagatttaacaacttaatcataacaattcgaaacactttaagggatctggaaaaggccatcaaaggtgtggtggtgatggactcagccctcgaagcactcagcggatccctgctggtcggaaaggtacctgagatctgggctaagcggagttatccttcgctgaaacctctggggtcatacattaccgactttctggcaagactgaacttcctgcaggattggtataacagcggcaagccctgcgtgttttggttgtccggattcttctttacccaggctttccttacgggcgccatgcagaactacgctcgcaagtacacaacaccaatcgacttgttggggtatgaattcgaagtcatccccagtgataccagcgacacaagcccagaggatggcgtgtacatccacggcctctacctggacggtgctaggtgggaccgggagtctggactgttggctgagcagtaccccaaactgctgttcgatctgatgccgattatctggatcaaaccaactcagaagagtcgcataataaaatctgatgcctacgtgtgtcccctgtacaagacttccgagcgaaagggcacattgtcaactaccggtcactctaccaacttcgtgattgccatgctgttaaagactgaccagcccactcgacactggatcaagcgcggggtggcgctgctatgccagctcgatgattag

SEQ ID NO: 115230 - DNA, 9279 bp, Artificial Sequence
  Description of Artificial Sequence: Synthetic coding sequence
atgagcgacgccaataaagctgcaattgcagcggagaaagaggcactgaatctgaagctccctcccatcgtccacttgccagaaaatatcggcgtcgacactcccacacaatccaaactcctgaaatatagaagaagtaaagagcagcagcagaaaataaaccagctcgtgatcgacggggccaagagaaatctggatcggactctgggaaaacgtacgcccctactccccccaccagattaccctcagactatgaccagcgaaatgaagaaaaaggggtttaattacatttacatgaaacagtgtgtcgagagcagcccgctcgtgccaatccaacaagagtggcttgatcatatgctgaggttaatacctgaatctctcaaggagggaaaagaacgcgaagagcttttggaatcactcataaacgaggtgtcgagtgattttgagaactccatgaagcggtacctggtgcaaagcgtcctggttaaaccccccgttaaatcactcgaggacgagggcgggcccttaccagaaagtcctgttggcttagattactccaatccctggcattcaagctatgttcaggcacggaaccagatattttccaacctccatatcattcacccgacgatgaagatgctcttagacctcggctacaccaccttcgctgatactgtcctgcttgactttaccggcataagggccaagggtcccattgattgtgaatctctcaaaacggacttatctattcaaactcggaacgctgaagaaaagatcatgaacacctggtaccctaaggtgataaacctctttacaaagaaggaagcccttgagggagttaagcccgaaaaactcgatgctttctacagctgcgtatcaactctaatgagcaaccagctcaaggatctgctgaggcgaacagtggagggttttgtaaagttgtttgatccaaaggatcagcagcgcctgcccatcttcaaaatagaactaaccttcgacgatgataagatggagttttatcctacctttcaagatttagaggacaacgtcctcagcctggtggagcgcatcgcagaagctctgcagaacgtgcagaccattcccagctggctctcgggaacatcaactccagtgaatttagacactgaactgcccgagcacgtcttacactgggccgtggacacccttaaagccgcagtgcaccgaaatcttgagggcgcgcgcaagcactatgagacatatgttgaaaagtataactggttgcttgacggaaccgctgtggagaacatagaaactttccagaccgaagatcatactttcgacgaatacacagaattcattgaaaaattccttagcctggccagcgaaataatgctgctcccgcagtggatccattacaccatggttagactggattgcgaagatctgaagacaggactgactaataaggccaaggcgtttgctaacatactgcttaacgatatcgccagtaaatatagaaaggaaaacgaatgcatatgctctgaatttgaggcaatcaaggagcacgccctgaaggtgcctgagacaacggaggagatgatggatttgatatcgtacgtcgaaaaagcccgaaccgtggggatcgaagagctcatactgcgaattcaggagagtaagcggcagatgtcctatttccttgacgtgtttctgtttccacaagaggacctcgccctgaacgccaccgtgctgatgtggccccggaagattaacccaatctttgacgagaatgacgagctgatcgagaatgccaaacacaagaaagaaaacgaactcatggccaaaagagaaaagctgatcctcgaaattgagaaggagagtcgcaggatggaggagtttaccgagttcgccgagcttgaaaggatgcagcagtatgtgacagatgtgagacagctgcaaaagcgcatccaggaaagcgaggaggctgtgcaatttattaacaaggaggaagaactctttaaatgggagttgacaaagtacccagagctggataagctcaaagtcaacatcgagccgtaccagaagttctttaatttcgtgctgaaatggcagaggtccgagaagaggtggatggacggcgggttcctcgacctgaatggcgagagtatggaggcggatgttgaggagttcagcagagagatatttaagaccctcaagttcttccagactaaactaaagaaggaactgcaagagaagcggaaggcagctcgcaaacgatctctggaggaggagaaaatcgaggaagagcccaaggataacgcaaccataactatgtgccgaatgcgtgccaggcactggaaacaaatctctgagatcgtgggctatgacttaacacccgattcaggcactacgttgcgtaaagtgctgaaactgaatctgactccataccttgaacagttcgaggtgatcagtgcaggcgcttccaaggaattctcattggaaaaggcgatgaacaccatgatcgggacttgggaagacatcgcattccacatcagcctctaccgcgacactggtgtttgtattctaagttcggtggatgaaatacaggctatcctggacgatcagatcatcaaaacacagactatgagagggagcccgtttatcaagcctttcgagcatgagatcaaggcctgggaggaccgcctgatacgcattcaagaaactatcgatgagtggctcaaggttcaggctcagtggctctacctcgagcctatcttctgcagcgaggatatcatgcagcagatgccagaagaaggacgacagttccagacagttgataggcactggcgggacatcatgaagttttgcgccaaagatccaaaggtgctcgccgcaactagcctcactggactgctggagaaactgcagaattgtaatgaactgttagagaagattatgaaggggctcaacgcctacttggagaaaaagaggctgttcttcccaagattctttttcttgagcaatgacgaaatgctcgagatcctgtctgaaactaaagaccctcttcgcgtgcaaccacatctgaagaagtgttttgaagggatcgcaaagctggagtttttgcccaacctggatatcaaggctatgtattcctccgagggtgaacgcgtggagctgattgccctcattagcacgtctgccgcccggggagcagttgagaagtggctgatccaagtcgaagacctgatgctgagaagcgtgcacgatgtgattgcagcagccagattggcttatcctgagagcgcccgacgtgattgggtgagggaatggcctggccaggttgtgctgtgcatttcccagatgttttggacgtctgagacacaggaggttattagcggtggtacagagggtctgaagaaatattacaaggaactccagaaccagttaaatgagatcgtggaactggtgaggggtaaactgtccaagcaaacaaggacaacactgggcgccctggttaccatcgacgtacacgccagggatgtggttatggacatgatcaaaatgggtgtgagtcatgatacagatttcctctggctggctcagctccggtattactgggaaaacgagaacgctcgagtgagaattattaactgtaacgtcaaatacgcttacgagtatctgggtaactctcctcgactcgtcattaccccactcaccgatagatgctacaggacgctcattggtgcgttctacttgaatttggggggcgcacctgagggcccagcagggactggaaagacagaaacgaccaaagatctcgctaaggctctggcagttcagtgcgtagtctttaactgttcagatggactggactaccttgcaatgggtaagttcttcaaggggctggcttcatcaggtgcctgggcttgctttgacgaatttaacaggatcgaactggaagtactctcagtggtggcccagcagatcctctgtatacagcgcgccatccagcaaaaactggtcgtctttgtcttcgaaggcaccgagttaaaactcaaccctaactgcttcgtggctataacgatgaacccaggctacgcaggccggtcagaactgcccgacaatctaaaagtgttattccggaccgttgccatgatggttcccaattacgccttgattgctgagatcagtctttacagttacggcttcctgaacgccaggcccttgtccgtgaagatagtgatgacgtatcgtctctgctccgaacagctgtcctcccaattccattacgactacggtatgagggctgttaaggctgtcctagtcgccgccgggaacctaaagctgaagtacccaaatgagaacgaggacattctcctgttgcgaagcataaaagatgttaatgagccgaagttcctgtcccacgatatccctctgttcaatggcataaccagcgacctctttcctggcattaaacttcctgaggccgactaccatgaatttctagagtgtgctcacgaggcttgcaatgtccacaatctgcaaccagtcaaattctttctggaaaaaattattcagacttacgaaatgatgatcgtgaggcacgggtttatgttagttggcgagcctttcgctgccaagaccaaagtgctgcacgtactggcagacacccttactctgatgaacgaacacggctatggggaagaggagaaagtgatttataggaccgttaatcccaagagcatcacgatgggccagcttttcggtcagttcgacccggtgtcccacgagtggaccgatgggattgtggcgaacacctttcgggagttcgcattatccgagacccccgaccgcaagtgggtcgtgttcgacgggccaattgacacactgtggatagagagtatgaacaccgtgttagacgacaacaagaagctctgtctgatgagtggagaaataattcagatgtctccacagatgagcttgatctttgagaccatggacctctcacaggcaagccctgctacggtgagtcggtgcggaatgatttacttggagcccagtcagttggggtgggaacccctggtttcaagctggctcaatagcctcaagggtcccctgtgtgagcccgagtatcaagccctcctgcggggattgttcgcttggttgatccccccctcattaaatcagcgagtggagctattccagcttaactacctgtatacaactatagtgagcaaaatacttaagatcttaatcacatttcggatctcgaattattttaaatatgtcccgcttaaaacccagtgtacgtttataaaattcttcttgcaccagcaggcttgcttcattttttccctcatttggtctattggtggttcatgtgataccgacgggcgtagagtgtttgacacctttattcgcttgatcatcctcggcaaggacgatgaaaacccagtgccagattcagtggggaaatgggagtgtcccttcgacgaaaagggccttgtgtatgactacatgtacgaactgaaaaacaagggtagatgggtacactggaacgagctgattaagaacacaaacttgggcgataaacagattaaaatccaggacattatagtccctacaatggacactatcagatacacttttttgatggatctgtcaataacctacgccaaacccttattgttcgtcggtcctaccgggaccggtaagtccgtatatgttaaggacaagctgatgaaccacctggagaaagaccagtactttccattttacattaatctgtccgctcgcacatcagcgaaccaggtgcagaatataatcatggcaagactggataaaaggaggaagggagtattcggtccgcctatgggaaaaaagtgtatcatttttatcgatgacatgaatatgccagccctcgagaaatacggagcacagccacctatcgaattgttacgccagttctttgattgcgggcactggtacgaccttaaagacacaagtaaaataaccttagtcgatatagaactgatcgctgctatgggcccaccaggcggggggcggaatcctgtaaccccgaggtgtattaggcacttcaatatttgctccatcaatagtttcagcgatgaaaccatggtgagaatattctcctcaattgtagcgttctatctgcgtacccacgagtttccgccagagtacttcgtgatcgggaaccaaatcgtaaatggaactatggagatatataagcagtctgtcgagaatctcttgcccacacctactaaatctcattacacatttaatctgagagatttctccagagtgataagggggtgcttactgatcgagagagatgcagtggccaacaagcacaccatgattagactctttgtccatgaggtgctcagggtgttctatgatcgtctgataaatgacgacgacaggcggtggttgttccagctgaccaagactgtaattaaagatcactttaaggaatcgtttcactccatcttctcccacctgcggaaacaaaatgctcctgtgacagaagaagatctcaggaatttgatgtttggggactacatgaaccccgacctggagggggacgaccgcgtctacatcgaaatccccaacatccaccacttcagcgatgttgtggatcagtgccttgatgagtacaaccagacacacaagacgcggatgaacctggtgattttccggtacgtactggagcatttatcaaggatttgtcgcgtgctcaagcagagcggaggcaacgctctccttgtggggttgggtggttctgggcggcagtccctcacacggctcgcaacctcaatggctaagatgcacatctttcagcctgagatcagtaagagctacgggatgaacgagtggcgagaagacatgaagtccttcatcgcagttccagtgaccaatagaatcgtcgacaataagagcaaaatcctagagaagcggttacgctatctgaatgatcacttcacatataacctttactgcaatatctgtcgaagtctgttcgaaaaggacaagctgctcttcagtttcctcctgtgcgcaaacctgcttctggcccgtaaagagatcgagtaccaggaactcatgttcctcctgaccggaggggtctcccttaagagtgccgagaaaaacccagatccaacatggctgcaggataaatcctgggaagagatttgtcgtgcctccgagttccccgccttcagaggcctacggcagcacttctgcgaacacatttacgagtggcgcgagatttatgatagtaaagagccccacaatgctaagtttcccgctccaatggataaaaacctcaacgagctccagaaaattattatccttaggtgtctgcgccctgataaaatcactcctgccatcaccaactatgttaccgataagctcggcaaaaaatttgtggagcctcccccttttgaccttacaaagtcgtatctggactccaactgcaccattccactaatcttcgtgcttagccccggagccgatccaatggcttctctgcttaagtttgccaacgataagagcatgtctggtaacaagttccaagccatttctctgggccagggccaaggcccaatagccgctaaaatgatcaaagccgccatagaagaaggcacctgggtgtgcttgcagaattgtcacctggctgtaagctggatgccaatgctggagaagatatgtgaggactttacatctgaaacttgtaacagttcctttcgcctgtggctcacgtcatacccctcctcaaaatttcccgttacaatcttgcagaatggtgtgaagatgactaacgaaccacctacaggcctgcgtctaaacctgctgcagagttacttaaccgacccagtgagtgaccctgagtttttcaagggttgtcgggggaaggaactcgcttgggagaaactgctgtttggcgtgtgtttctttcatgccctggtgcaggagcggaagaagtttgggccactagggtggaatatcccatacggattcaacgagtccgacctgaggatcagtatcagacagctccagcttttcattaacgagtacgataccatcccctttgaggccatttcctacctgaccggcgagtgcaattatggagggagagtgactgacgattgggacaggcgcttgctgttaaccatgctagctgacttttacaatctctacattgtcgaaaatccgcactacaaattttcaccctcgggcaattatttcgctccacccaaaggaacctatgaggactacatagagtttatcaagaagttacccttcacccagcaccccgagatcttcggcctgcacgaaaacgtggacatttctaaagacctgcagcaaaccaaaacactttttgagagcttgctgctgacccaggggggaagcaagcaaactggagcatctggctccactgaccagatcctgctcgagatcactaaggacatcctaaataaactgccatccgattttgatatcgaaatggctctgagaaagtatccggtcaggtatgaggagagcatgaacaccgtcctcgtccaggagatggagcgtttcaacaaccttattatcaccatcaggaacactttgagagacctcgagaaagctatcaaaggggtggtcgtcatggattctgctcttgaggctctgtccgggtcactcctggtgggcaaggtccccgaaatctgggccaagagatcctatccatctctgaagccgcttggatcctatattacagacttcttagcacgccttaacttcctccaggattggtataattcaggaaagccctgcgtgttctggctgtctggattcttttttacccaggcatttctcacaggggccatgcagaactatgcacgaaaatataccactcccattgacttgctgggatacgagttcgaggtgatcccctctgacacctccgatacgtctccggaggatggagtttatatccatggtctttatctggatggagccagatgggatcgggagtcagggcttttagcggagcagtaccctaaactgctcttcgacttgatgccaataatttggataaaacccacccagaaaagcaggatcattaaatcagatgcgtatgtttgtcccctatataaaacatctgaacggaaaggcaccttgtctacaacaggtcacagtaccaatttcgtgattgctatgctcttaaagaccgaccaacctacgcggcactggatcaagcgaggagttgctttactttgccagctggatgactag

SEQ ID NO: 115231 - DNA, 2355 bp, Artificial Sequence
  Description of Artificial Sequence: Synthetic coding sequence
atgagtgacgctaacaaagcagctatagccgccgagaaggaagcacttaacctgaaacttcctccaatcgtccacctgcctgagaatatcggggtcgatactcccacacagtcaaaacttctgaagtacagacgatctaaggagcagcaacaaaagattaaccagctcgtgatcgatggcgctaagcgaaacctagaccgaaccctaggtaaaagaacaccgctgcttccaccaccagactacccccagactatgacctcagagatgaaaaagaaaggatttaattatatatacatgaagcagtgtgtcgaaagtagtcccctggttccaattcagcaagaatggctggaccacatgctgcgactcatcccagagtccctgaaggagggaaaagaacgggaagagctgttagagtctctgataaatgaggtcagctccgacttcgaaaattctatgaagcgctaccttgtgcagagcgttcttgtcaagccgcccgttaaatcactggaagacgaaggggggcccctcccagaaagcccggtggggttggactacagcaacccttggcactcttcctacgttcaagctcggaatcagatattttctaacctgcacattatacacccaactatgaagatgcttctggacctgggctacaccacatttgcggacacagtgcttcttgactttacaggcatcagagccaagggaccgatcgactgtgagagcctcaaaaccgatcttagtatacagacacggaacgccgaggaaaagatcatgaatacttggtaccctaaggtgataaaccttttcaccaaaaaggaggctttggaaggggtgaagccagagaagttggacgccttttatagctgtgtgtcgacactgatgtccaatcagttaaaagacttactgcggaggacagtggagggctttgtcaagctgttcgaccctaaagatcagcagcggcttcccattttcaagattgagctgacatttgacgatgacaagatggagttttaccccaccttccaagacctagaagataacgtcctcagtctggtggagcggattgctgaggccctgcagaatgtgcagaccattccttcatggctgtctggcactagcactccagtcaacttggatacagagctcccagagcacgtattgcactgggccgtggacaccctgaaggcagcggtgcacaggaacttggagggcgctcggaagcactatgaaacgtacgtggagaagtacaactggcttctcgacggaacggctgtggagaatattgagacttttcagaccgaagaccatacttttgatgagtacacagaatttattgaaaagtttctctctctggcctctgaaatcatgctgctcccccaatggattcattacaccatggttagactggattgcgaggatctcaaaaccggtctcacgaataaagccaaagcattcgcgaacatattgcttaatgacatcgcttcaaagtacaggaaagagaacgagtgcatatgttcagaattcgaggcaatcaaggagcatgcgctgaaagtgccggagaccacagaggaaatgatggatctcatctcttacgtggaaaaagctaggactgttggcattgaggaactaatcctccgaatccaggagagtaagcgtcaaatgtcttacttcttggatgtcttcctgtttccacaggaggacctcgccttaaacgcgactgtactcatgtggccaaggaagattaatccgatcttcgacgagaatgatgagctcattgagaacgccaagcataaaaaagaaaatgagctgatggcaaaacgagagaaactgatactggaaatcgagaaggaaagtcgccggatggaagaattcactgaatttgccgaactggagcggatgcagcagtatgtgacggacgttcgtcaactgcagaagcgcatccaggagagtgaggaggctgtccagttcatcaacaaagaagaagagctcttcaaatgggagctgactaagtatcctgaactggacaaactgaaagtgaacattgagccataccagaagttttttaacttcgtgctcaaatggcagcgctctgagaagagatggatggacggcgggttcctcgacctgaatggagagagcatggaagcggacgtggaggagttttcacgggagatctttaaaacgttgaagtttttccagaccaagctgaaaaaggaactgcaggagaaaagaaaagcagcacgaaaacgtagcctcgaggaggaaaaaatcgaagaggagcctaaagacaacgctacaatcacaatgtgttccacggtcatggagcagatcaaggcttttaaggtctag

SEQ ID NO: 115232 - DNA, 687 bp, Artificial Sequence
  Description of Artificial Sequence: Synthetic coding sequence
atggagacctttattcccattgatctgacaaccgagaatcaggaaatggataaggaggagaccaaaacaaaacccaggctgctccgctacgaagaaaaaaaatatgaggatgtcaagccattggaaactcagcctgccgaaatagccgagaaggaaaccctcgagtataagacggtgcggacattcagcgagagcctcaaatccgaaaaaacagaagactacctgcgagaatccataatccagcaacacatggtcagtccagagcctgcatcccttaaggagaaaggcaagtccagacggaaaaaggaccagacccatgcctgcccaaatgtccgcaaggctaggccggtctcctatgatagaacagaaccaaaggatgacgacgtcatccggaatataattaggctcagagagaaattgggttggcagaccatcttgccacagcacagcctgaaatatggttccagcaaaatcgccatccagaagatcacgcttaaaaaacccttggaagacgatggagagttcgtttactgcctgcctaggaaaagccccaagtcactgtacaacccctatgaccttcaggtggtgtccgctcacacggctaagcactgcaaggagttttgggtgattaccgcatctttcatctccaaacgctatctggtgatctgcggagccgtatacatttag

SEQ ID NO: 115233 - DNA, 687 bp, Artificial Sequence
  Description of Artificial Sequence: Synthetic coding sequence
atggagacatttatccccattgatctcaccacagagaatcaagagatggacaaagaggaaaccaaaaccaagccccgactgctgaggtacgaagaaaaaaaatatgaggatgtgaagcctttagagacccagcctgctgaaatcgccgaaaaggagactcttgaatacaagactgtgcgaaccttcagtgaatcccttaaatccgaaaagaccgaggactatctcagggagtccatcattcagcaacatatggtgtcgcctgaacctgcttcgctgaaagaaaagggaaagtcacgccggaagaaagaccagacacatgcttgccctaacgttcgtaaagctaggcccgtttcttatgatagaaccgagcctaaggacgatgacgtcattaggaatattattcgcctgcgggagaagctgggttggcagacaatattaccgcagcatagtctgaagtatggaagctcaaaaattgctattcagaaaataactctaaagaagccccttgaggatgatggcgagttcgtgtactgtctacccagaaaaagtcccaagtctctatacaacccgtatgacttgcaggtcgttagcgcgcatactgctaaacactgcaaagagttctgggtcattacagcctcttttatttccaagaggtatttggtgatttgcggtgccgtatacatttag

SEQ ID NO: 115234 - DNA, 1362 bp, Artificial Sequence
  Description of Artificial Sequence: Synthetic coding sequence
atggagacatttatcccaatagacctcaccactgagaaccaggaaatggacaaagaggaaacaaaaaccaagccccgcctactccgatatgaagagaaaaaatacgaagatgtgaagccactcgagacccagcccgccgagatcgctgaaaaagagacccttgagtacaagaccgtccgcactttttccgaatccctgaaatcagagaagaccgaggattacttacgtgaatccatcattcagcagcatatggtgtcacctgagcctgctagtctcaaagaaaagggtaagagccggcgaaagaaggaccagacccacgcctgtccaaacgtccggaaggcccgcccagtgtcttacgatcgaaccgagcccaaagacgacgacgtgattcgaaacatcatccgcctccgggagaaacttggctggcagacaattttgccccaacattctttgaaatatggcagctcaaagatcgcgatccagaaaattaccttaaagaagccactagaggacgacggagaattcgtttactgcctccctaggaaatcccctaaatctctgtacaatccctacgacttacaagttgtatcagcccatactgctaaacattgtaaggaattctgggtcatcaccgcttcgttcatctcaaaggttatcaacatagtggggagtgtcaaagaggttgagctcattcctacccttgagtggctgtccgaacggagacactattacctcctgagacaatttaagatttttagtgatttccgcatgaataaagcttttgttacctggaagctgaacgtaaagagaattaaaacggaaaagtctagaagtttcctatatcatcacctttttttggccgatgacctgttccagacatgtctcgtatacataagaggcctctgcgaggacgctatcaacctaaaaaattacaatgatcacgagaataacctgtcggccatctgcctcgtgaagttggattcctctcgtacttactcattggacgaattttgcgaagaacagctgcagcaggccacccaggctcttaagcagttagaagatataagaaataaagctatttccgagatgaaatccacatttctcaaggtggccgagaagaacgagattaaagagtatttcgagtccaaactgagcgaagatgatacaacccactttaagcttcccaaataccggagactgctggagaccttctttaagttcgtgatgttggttgattatatctttcaggaactcattcgtcagctgatgaataccgcggtcactttgcttctggaattgtttaatggctctgcaggaatgcccttctccgtggagaagaagaacgaaaacttgattcggtag

SEQ ID NO: 115235 - DNA, 13548 bp, Artificial Sequence
  Description of Artificial Sequence: Synthetic coding sequence
atggagacttttattcctatcgatctaacgaccgagaaccaggaaatggacaaggaagagacgaagacgaagccacggctcctccgttatgaggaaaaaaagtacgaggacgtcaaacctctggaaacacagccagcggagatcgccgagaaggaaactctggagtataagactgtcagaacattctcagaatcattgaagtctgagaaaacagaggattacctgcgcgagtccatcatccagcagcacatggtgtcccccgaacccgctagtcttaaagaaaaaggaaagtcgcgccgaaagaaagatcagactcacgcatgccccaacgtgagaaaagccaggccagtgagttatgatcgcaccgaacccaaggacgacgatgtcatccgcaacattatccggctgagggaaaagctcgggtggcagacaatcctcccccaacactccttaaagtacgggagttctaaaattgccatccagaaaatcaccctgaagaagcccctggaggatgacggggaatttgtgtactgcctgcccagaaagtcccccaaaagtctgtacaacccatacgaccttcaggtcgtgagtgcacacacggccaaacactgcaaggaattttgggtcatcaccgctagttttatcagcaaagtgatcaacatcgtggggtccgtgaaggaggtggagctcatcccaaccctggaatggctctcagagcggaggcattactacctgctccgacagttcaaaatattttcggactttaggatgaataaagcatttgttacctggaaattgaacgtgaaacgcatcaaaactgagaagtctagaagttttttgtatcatcatctgtttctagccgatgatctgttccagacctgcctcgtgtacatccgcggactgtgcgaggatgctattaatttaaaaaattacaatgaccatgagaacaacctgtccgccatctgcctggtgaaattagactcctctcggacatactctctggacgagttctgcgaagagcagctacaacaggcgacacaggcattaaagcagttggaggacatccgcaacaaagccattagcgaaatgaaatctacttttctgaaggtggcagagaaaaatgaaattaaggaatactttgagtccaagctttctgaggatgataccacacatttcaagctgccaaaatatcgaagacttcttgaaactttttttaagttcgtcatgctggtggactacatatttcaggagcttattcgccagttgatgaacaccgctgtgacccttttacttgagctgttcaatggttcagccggcatgcccttttcagtggagaagaagaacgagaaccttatcagaacattcaaggacaatagcttccctaccggcaaaactacaaatgactgcgaagaacttgtggacaattccaagttacatgccatcagcgtgcaaaaaagtgaggtaaaaactgacaccgacatcaatgaaattctgaattctgtagaagtgggaaaagacctgaggaaaacctatgctccaatattcgaggtgaacctgtgcctgaggatcccggccgaatctgactcctcagaaaattcaaaggagaatttccacgaaagcgatcagtgccctgaggaatgtgtaatgtttgaagacgagatgagcgagaacaaggacaattgcgtcaaaaagcactctagcgaggagctcctccccaaggccaagaagagtaaggaaatttcttacaatcttgaggatataatctctgatacggaaatcgaaactgaattcgaaaataagtatatgtattatgaattcccagaattcccaactaatctgtttatcgatcccaaccgtctggagttctctgtgaagattcaaaacatgctaaccaacatggagaagtgtattacaacaataaccccactctgtcaggacccacaactaagcatatttattgatctggtctctatcatggacctgcccaataagaccggctctatcatacactacaaagaacagacacgttggcccgactgtcacattttgtttgagactgaccctgcctaccagaacataatcgtcaatctcctcacaattatcggaaacagtatgggccttgtgaatgcttattcccacaaattcatcaagtactgcaccatgaccgaaaaagcaaaaattatgtctatgaaaatctcctctatgggagagcttacctcaaaagagtttgaagctatacttaaccgcttccgaaactatttcagacacatcgtgaacatggcgatcgagaaacgaataggtatattcaatgttgtgtctctggattatcaaagtgagtgtcttctgtacatagataacgtgatacatatgtcccacactctgatccagagtgtaatcgaaaaaaaaaacaagaacctgctcgaagtcgttgagtcttcactgcagcagctggagtgtgatcccacagagatcgaggagttcctggagcactttatctttttgaacgccattagttcaaaaatttccaagctggagaaggaattcttgacaatgtcgcagctctatagtgtcgctaagcaccaccagattcatatcagtgaagaacaaattgctattttccaggtgctgctgttgaagttttctcagctgaagagctctatgaaattgagcaagatcaacaaggacacggcaatcaccaagtttagggacaacctcgaggcctgcatctcaggactgcacgtcgacgtaggcaacctgaaggccaagatcaggacccctctattgctttgcgctggaacacaggtatccactgccatggaaatgattcaaaccttgtctggggaggccgcgtctttgactaataaggccaaggcctattcgcattatcaggattgcttttccgatagtcaaagtcacatgcacagcgtcaacgttgaagaaattacacaaattgtgctgtccgagatatctgatattgaaggagacctgactctgcgcaaaaaactatgggaggcacaagaagaatggaaacgggcatcctgggagtggaggaactcctctctgcaatccatcgatgtggagtctgtccaaagaaacgtgtccaagctcatgcacataatctcagtgctcgaaaaaggcctacctaaatccgatatggtaacccatttaaagcaagtggtgaccgaattcaaacaggaactgcctatcattattgccttgggcaacccgtgccttaagccacgtcattgggaggcgctgcaggagataattggcaagtctgtgccactggacaagaattgcaaggtcgagaacctgctggctctgaaaatgttccagtacgagaacgaaatcaatgacatgtcaacatcagccactaacgaagccgcgctcgaaaagatgctctttaaaattattgatttctggaacactaccccattgccactgatcttgcaccatacagaaatctactctatctttatcatccccagcatcgatgacatttctgcccagctggaggaatcgcaggttattctcgcgactatcaaagggtccccgcatatcggtcccattaaagatctcgtgaatgaatgggaccagaatctcaccctgttttcctacacactggaggagtggatgaattgtcagagaaactggctgtacctggagccagtgttccactcatctgagatccggcgccagttgcctgctgaaaccgagctgttcagtcaggtgattagtatgtggaaaaagattatgtcaaagattcagaacaagcagaacgccctgcagattacaacatccgccggcgtgttggaaatactccagaactgcaacatccatctggaacacatcaagaagtcactggaagactacctggaggtgaagcggctcatctttcccaggttctactttctctccaacgcagagctacttgatatcctggccgatagtagaaatcccgaaagcgtgcagccccacttggttaagtgctttgaaaatattaaacagctattaatatggaaacaggatataggcccaccggcggttaaaatgctgatatctgctgagggcgaaggtctagttctgcccaaaaaaatccgggtgcggagcgctgtggaacagtggttagtgaatgtcgagaagagcatgttcgatgttctgaaaaaagaaaggtacatatacaacataatcttactcttccagtcacagataatgttctataacgattgcgtgaagtcattcgttagctcttactctagggagaaactggagaaggtgcatgctggacttatgtgtcacctggaggaagtcgctgacctggtggtcctggacacaagcaattctcggaccaaagccatcctgggtgccttactcatcttgtatgtccattgcagagatattgtgatcaatttactgctaaagaatatctttaacgctgaggatttcgagtggactcggcacttgcagtataaatggaatgagaaacagaagctgtgctatgtgtcacaagggaacgcttcttttacatatggctatgagtatctcgggtgcacatcacggctcgttattacacccctgacagatcgttgttggctgacactgatggaagccctgcacttgaatctgggggggtgccccgccgggcctgcgggaaccggtaagactgagacagtcaaggatctggccaagagcctggggaaacactgcgtggtttttaattgctttgaagacctagattacaagatcgttaggaagttctttttcgggctggtccaaagtggcgcatggtcctgctttgatgaatttaatttaatagacctggaggtgctctccgtgattgcatcccagatcctgactatcaaggccgccaaagacaattacagtgctcggttcgtactcgagggcaaggaaattcgcatcaatatgtcttgcgcggtatttattaccatgaatcctagatatgggggcggtgttgagctgcccgataacctcaagtctctatttcggccagtggccatgatggtgccacactaccagatgatagctgagatcatcctgttttcgtttgggtttaaatccgctaactctttgtccggaaagctcacaaatctttacgagctcgctaggaaacaactgtcccagcaggaccactacaattttggtctgcgttcactgaagatcgtgttgattatggcaggaacaaagaagcgggagttcaaatgtctgagcgaagcagacgagacacttatagttatcgaagccatccgtgaggcttccctgcctaaatgccctcccgaagacgtgcccctgtttgaaaacatcattggtgatatcttcccggaggtcactgtgctgaaagtgaaccagctagctcttgagaaagtgatatacaccgctacacagcagctgggcctgcaaaactggagttcacagaaagaaaaaatcatccaattctacaatcagttgcaagtgtgtgtgggcgtcatgttggtgggcccgaccggcggcggtaagaccaccgtgcgacggatcctggagaaggccctgaccttgttgccaatagcagattttctgagcgtggctgagaggaaatctgcgtcgaaaatttcagaaaggaaaggcaaggtggacatctgcgttctgaaccctaagtgcgtgaccttgagcgagctgtatggacagctggatcccaacaccatggaatggactgacgggctcttgtctgccacgattaggagctacgtgtactttaatactcccaagaatacgaagaaggacattgatttgcgcttgaaatcaagaatttcagacttaagcaacgtcttcaagctagattcatccgacacaacggagaccgacgataatatctttgaagaaatcgaaaaggtggtgaagatcccagaaaatcacaactttgactggcagtggattatcttggacggcccagttgacactttttgggtggagaacctgaactcggtcttggacgacacccgcaccctgtgccttgccaatagcgaaagaatcgctcttacgaataagatcagagtcatatttgaagtggataatctctctcaggcctccccagccacagtctcgcggtgcgcaatggtatacatggatcccgtggatctgggctgggagccctatgtcaaatcttggctgctaaagacttccaagatcatctcgcaatctggcgtggactgcctcgagtttatgattaagaatagtgtcaccgatggactgcagttcattaggaatcgccaaaaatttcagccatacccaatggaggacatcactgtggtcataactctgtgcaggattctagatgctttctttgactttatgggaaagaatggcggcttcgaacaaagcgatgacctgaatgacacctcaagcaaggaagctaacagccagcgggagtctgtcacgtttaaagacattgagaagagagacgagaatacatggtaccccgagaagaaccccgataagctaaccaagatcattcaaaaactgtttgtattcgccttcacttgggccttcgggggcgccctcaatcgggaagacgagcaccgcgagaacattcctttttgccccagtctcgagccggattccctggccaaagtaacctatgactttgacaaactggtgcacgaattgtttggaaattcctcgcaggttggttggaagcactggggccagtctcagggacgcagacgcaagggaaactgtatcaacctgccaacgggagagtgttcaatcttcggctatttcgttgatattgagcaatgcgaatttatcccctggtcagacctggtgccgaacgaccagaccttaatccaacgaggtacttcattgctgacaaatctgcagcgatctggcggcaattttctgaagattaccgagtgtggcgaatgtatcaactatacagcgactcgcgacacaacttgcctgtcattcttgatgtctttgctgcttaagaactcatgccccgtactgctcaccggggaatccggcgtaggcaagactgccgctattaaccagatgcttgagaagctggagggacctggagcattcgatataaaacatggctctatccttggcgacacactactgtatagtgaaatcaagaaatccagttcactcaagcagaatatcaccattctcataccggagacgcataagactgcaacaggctcctctgataaccccactaagaagcccgaagttagaacaaataaaaaactactgaaaaataacgatcacaagggagttgtggtcagtactatcaatttctccacaaacgtaaccgccgcaaagaccaaggagatgattctgaagaagctcatcagaaggacaaaagacacactgggtgcgccgaaaaacaatagaatcctgatctttatcgacgacatgaacatgccagtgtcggatatgtatggcgcacagcccccattggaacttatcaggcagcttctggatctggggggcgtgtatgacactgaaaaaaacacctggaagaatattcaagacctcagtatcgtcgcagcatgtgtacccgtggtaaatgatatatcaccccgcctgctgaaacatttctctatgctggtgctgccacatccaagccaggacatactctgcaccatcttccaggcccaccttggcatctatttttctatcaacaattttacccccgaggtgcagaaatcaaaggaccagatcatctcctgttcactggccatctaccatcaggtgcggcagaacatgctgccgacccccaccaaatgccattatatgtttaacctcagggacatgttcaaactgcttctgggtttactccaggctgatcgtacggtcgtcaactctaaggagatggccgctctactgttcgtccacgaggccacacgcgtttttcatgatcgcctcattgattttaccgacaaatcactgttctacaggctgctgtcccgggaactggagaattgttttcaaattgggatcgatgggtgcggcaaaaaaacctgcgccactctcgcttgctacctgacagataataagctttacagggtccctatctcccacaagtgtgcctatattgagttcaaggaggtcttcaagaaagtgtttatccacgcgggcttgaaagggaaacccaccgtactgatggtgcccaatctgaatattgagcaggatagctttctggaagatcttaattatatcatcagctccggcaggatccctgacctgtttgagaacgtcgaactcgattctatcgcaatgaagatcaggtacctgacagaacagtctggccacatggataatcgccagagtctcttgtcgttcttccagaaaaggatttacaaaaacctgcatatcttcgtgattatgtcgcccgaaggtccatctttccgtcaaaattgccgggtttacccaagcatgattagcagctgtaccattgattggtacgagcgatggcccgaggaggcactcctcattgtagcaaattcgttcttgaaagaaaaagtaaactttgagaatcgagaaaacctgaaggagaagcttgctccaacctgcgtccagatccacaagtcgatgaaagacctgaataggaaatattttgaggaaacaggccgtttctactacactacacctaacagttatctacagtttatggaaacttttgcacatatactccgtgcacgagaggaggaaatgcaaaccaaaagagatagatttcacatgggtctcagcacaatacttgaggcaaccaccctggttaccgaaatgcaggaggagctccttatcttgggccctcaagtggagcagaagactaaggaaactgaaaccctcatggagaagctaaggaaggattcacaggtcgtcgaaaaagtgcagatgcttgtaaagcaggacgaagagatcgttgccgaagaagtccgcattgtggaggactacgcgcagaaaaccgcaaacgagctgaaatccgttctgcctgcattcgacaaggccattgtcgctctgaatgcattggacaaggccgacgtggccgagctgcgcgtgtatacccggcccccctttttagtcctcacggtgatgaacgccgtttgcattcttctgcagaaaaagccaaattgggcaaccgcgaaactgcttctctctgagaccggctttttgaagaagttgataaacctagacaaggactctatccccgacaaagtgtttgtgaagctcaagaaaatcgtgaccttgcccgattttaacccccacaaaattagtttagtgagcgtggcatgctgcagcctatgccagtgggtgatcgcgctgaataactaccatgaagttcagaaggtagtggggcccaaacagattcaagtcgccgaggcccaaaatgtcttgaaaattgcccgccagcggttagctgaaaagcagcgaggactccaactggtggaggagcacctgcttttcctgcaagcagcttataaggacaccgtagctgaaaaacagttgttggcaaaccgcaagacaatggctagccgcagatttcagtgtgccagtgtgctgctgaccgtgctggaagatgagaagacaaggtggcaagagactattaatcaaatcgacaacaagctggagggtatcctgggcgatatccttttgagtgcggcttgcatcgtgtatagcggtatactgactccagagttccgtcagctcatcgtgaacaaatgggaaaccttttgcattgaaaacggcatcagcctaagctcgaaattttcactgatcaaagtaatggctcagaagtatgagatcagccggtggcataaccaggggttaccgcatgggcagtatagcgtcgagaacgctatcctgatcaagaatggccagcagtggccgctcttaatcgatccacaccgtcaggcacataagtggataaggcagatggagggctcccggttgcagaagctgtcaattgaggactccaactataccaaaaagatcgagaacgccatgaagaccggaggcagcgtacttctgcagaatttacttgagactctagcccccggtcttaaagccatactgaaaaaggacatctatcagaaaaagggacactattttatacgcgtaggggatgccgagttcgaatataattccaactttcgactgtacctatctactgagatcgacaaccctcatttcttgccatctgtgtacaactttgtgacgatgattaactttactgtgacgttccagggtcttcaggaccagctcctgagtacagtggtcacgcacgaagtgccacacctggaggaccagcgaagtaagttgcttgagtctattagccttgacgccataacactggaggaattagaggagaagacgcttaacctgttgcagaaggctctaggctcaatcctcgacgacgataaaatcgtcgacactctccgtaagagcaagatgacttctaatgaaatctcaaaacgcatcgaagctacaaagaaggccgagtctgagatccaggccatcagaaagaactatctgccaattgccactagaggggctctcttgtattttcttgtcgccgacttgacacagataaactatatgtatcagttcagcctggactggttccatcaagtttttgtgtcttcggtggtctctaagtccaaagagcaggaacacagttttaaaagagaaaaggttagtccaaaggaagtgcatgagtttatcagcatctccaaggagcccaatttggagaatgaaaaaaatcttcttgataagcatattaagtccgccatcgatatgctgacaaaatccatttttaaagtggtctcctcagcgctgttcaacgaagacaagctctgtttctccttccgtctgtgcacagttattatgcagaataatgccaacggtaatctgatacaagatgatatcggatttctacccgaagaagagtggaacatctttctctactcaggcattctaatcaatattaaaagcgctctatctcaaagtagattgacgtctacctttgagataggcgagtcccagcatctccaatggcttagcgatagccggtggcggcaatgtcagtacgtttctacacatttggaaccattttccctcctgtgcaaatccctgctcagcaacgtgtcgcaatgggacactttcaagaacagcaaggctgtctactcacttatatccactccgtttagcagtgagaatgcatcgcttgaggagaacacaaagccacccgaggagactgagctgcttaatgaaaataaagaaacatgcaatccgatcaattttccctgggagaagctcaccagcttccagcgtctgattctcgtgaaggtgctgcgccccgaaagcctgaataattcagtccgcaagtttattacagagaaaatggggaataagtatctccagcgaaccggggtaaaccttaaggacgcctacaaggggtcaaatgcacggacccctttgatcctgatccagactcacgggatagatctgacgaatatcctgttaagattcgctcaggaactgaaggggacaacgcaccacgtcacaataatttccctgggacgcgaccaggcggccaaagcagaggacctgatcctaaaagcgctgactaagacacaacaatgggtcttcttgcagaactgtcatcttgcaacaagtttcatgcctagactgtgtactatcgtggagtctttcaacagccccaatgtaactatcgatcctgaattccgcctgtggctttcatccaaatcttatagttccttccccatccctgtgttgaagaaagggctgaagatagccgtggagtcaccccaaggactcaagagtaacctgctgcagacgttcggctgtacaggtagtggcgaagtgacagaggagattttcgaaaatcccgactgcgggcaatggtggaagaagctactgttcagtttgtgtttcttcaacgccgtgattaatgaacggaagaattacggaatcttgggctggaacattgcatacaagtttaatagctctgacttgggagtcgcaattaaagtcctagagaattctttaagagggcagcccagtattagctggcaggcactgcgatatcttatcggggaagtgatttacggggggcgcgtcatagataactgggacaaacggtgcctgaaaactctgctatacaagttttgcaatcctgaagtgctgaaggacgatttctccttcagcaggtccgcaagtatcaaggattatatccacatcattcagtcattgcctgacgatgatctgcctgaagtactgggcatccacccagaggccataaggtcttgctgggagacccagggagaaaagttcattgaaaacctgattgccatgcagcccaaaactacgaccgccaatttgatgatccgcccggagcaatcaaaggatgaactggtcatggaaatcctatcagaccttttaaaaaggctcccgctcacagtggaaaaggaagagatagctgtcggcaccccgtccacgctcaaatctatgatgtccagctctatctgggaaagcttgagtaaaaatctgaaggaccacgaccctctcatccactgtgtcctgttgacctttttgaagcaggaaattaaacgatttgataaattgttatttgtgatccacaagtccctcaaagaccttcagctagccatcaagggcgagatcatcttgactcaggaacttgaagagatctttaactccttcctcaacatgcgtgtgcccaccctctggcagaagcacgcttataggagttgcaaaccgctgagttcttggatcgatgatctgattcagcggctcaactttttcaacacgtgggctaaggttgcttatactgctattcaacgtagatacatgagattcgtgacagtgtggaaacaatctataccttctacctcccagaaatgcaaacaccctgaggatagtgagaacaatttctttgagggatttcccagccgatattggctacctgccttcttctttcctcaggcgtttctagcggctgtgttgcaagattatggacgcagcagaggaatagctgttgacgcactgacatttactcaccacgtgattagcaatacaaccgacaaggacgagaagttttctgtgtttatgcccaagaagttgaatatagtgagaagggcatttaagggtagtgcttcatcgcacactggggtctacattttcggcctatttatcgaaggcgcgaggtggaatagggaacaaaagatcctagaagactccctgccactcgagatgtgctgtgacttccctgatatctactttctgccaacaaagatctccacaaaaacacccaatgcctctaatcagacagacagcgagctctacgcatttgagtgccccgtgtaccaaacgccggagcggagtaggattttggccacgactggcctccccaccaacttccttacctcggtctatcttagcacgaagaaaccccccagccactggatcacaatgagagtggcgctgttgtgcgaaaagaatgaaaagtag

SEQ ID NO: 115236 - DNA, 13548 bp, Artificial Sequence
  Description of Artificial Sequence: Synthetic coding sequence
atggagaccttcatccccatcgatctcaccacagaaaatcaggagatggataaggaggagactaagaccaagcctcgcttgctgagatatgaggagaagaagtacgaagacgtaaagcctctggaaactcaaccggccgagatcgccgagaaagaaaccctcgaatacaagacagtgcgtacattctctgaatcactcaagtccgagaagactgaggattacttacgtgagagtatcatacagcagcacatggtgagtcctgaaccagcatccctgaaggagaagggtaaatcccggcgaaagaaggaccagacacacgcctgtcccaacgtacggaaggcacgacccgttagctatgataggacagaacccaaggacgacgacgtgattcggaatatcattcgccttcgcgagaagctggggtggcagactattctgccccagcacagtcttaaatacggcagcagtaagattgccatccagaagatcacgctaaaaaagccactcgaggatgacggtgagtttgtgtattgcctgccacgaaagagccctaagtccctctataacccatatgacctgcaggtagtttccgcgcataccgctaagcattgtaaggagttctgggtgattaccgctagctttatatctaaagtgattaacatagtcggatcagtaaaagaagtggagctgatcccaacactggaatggctcagtgaaagaaggcactactatcttctaaggcaattcaagatcttcagcgattttcgaatgaataaggcatttgtgacctggaagctgaacgtaaagcggataaagaccgaaaaatctcgaagtttcctgtatcaccatctgttcctggcagacgatctcttccagacatgcctagtctatatccgcggtctgtgtgaggatgccattaatctcaaaaactataacgaccacgagaataatctctctgccatttgtctggtgaaactggattcgagcagaacctacagcctggatgaattttgcgaagagcagctccaacaggctacccaggcattgaagcagttggaggatatccgcaacaaagccatcagcgagatgaaatccacctttctaaaggtcgccgaaaaaaatgagattaaagaatatttcgaatccaaactgagcgaggatgacaccacacactttaagctgccgaagtacaggcgcctgctggaaacatttttcaagtttgtgatgctggtggattacatattccaggaactgatcaggcagctcatgaatacagcagttacactgctgctggaactgttcaacggaagcgccggtatgcctttttccgtggagaaaaaaaatgagaacctgatacgcaccttcaaagataatagtttccccactggcaaaaccactaacgattgtgaagaacttgtggataattctaagctccatgccatcagtgtccaaaagagtgaagtaaagactgacaccgatataaatgagattctgaatagcgttgaagtgggcaaagacctgcgaaaaacatacgcacccatatttgaggtgaatctttgcctcagaatcccagctgaatcagacagctccgagaactctaaggagaattttcacgaatccgatcagtgcccagaggagtgcgtgatgttcgaggacgagatgagcgaaaacaaggataactgtgtgaagaaacattctagtgaagagttgcttccgaaagccaaaaaatcaaaggagattagctataatttggaggacatcattagcgataccgaaatcgaaacggaatttgaaaacaagtatatgtactatgagttccccgagtttccaacgaatttattcattgaccccaatcgcctggaattttctgtaaaaattcagaacatgctgacaaacatggaaaaatgcataacaactatcaccccactctgccaggatcctcaactgtcaattttcatcgatcttgtctccatcatggacttgcctaacaaaacaggttcaattattcattataaggagcagactaggtggcctgactgccatatcctatttgagaccgatcccgcttatcagaatattatcgtcaatctgctcactatcatcggcaactctatgggattagtgaacgcgtactcgcacaaatttattaaatactgtactatgactgagaaggcaaaaatcatgtccatgaagatcagctccatgggcgagcttacctcaaaggaatttgaagcaattctgaatagattcaggaattactttcggcatatcgtgaacatggccatcgagaaaagaatcgggattttcaatgtggtgtcactggactaccagagcgagtgtctcttatatattgacaacgtcattcatatgtcacacacactcatccagagcgtcatagagaaaaagaataaaaatctcctcgaagtggtggagtcaagtctccaacaattggagtgcgatcctaccgagattgaggaatttctagagcatttcatcttcctaaatgccatatctagcaagattagtaaactcgagaaggagtttctaactatgagtcagctgtattccgtggctaaacaccatcagatccacatctcagaggagcaaattgctatcttccaggtgttgctcctcaaattcagccagcttaagagctccatgaagttaagtaaaattaataaggataccgccattactaagttccgcgacaatttggaggcctgcatctcaggcctgcacgtagacgttggcaacctcaaggctaagatccggacgcctttattgctgtgcgccggcactcaggtttctaccgccatggagatgatccagacactgtccggtgaagccgctagcctcaccaacaaggcgaaagcttacagccattatcaggattgcttttctgattctcagtcacacatgcatagcgtgaatgtggaggaaatcactcaaattgtcttatctgaaatctccgacattgaaggtgacctgactctccggaaaaagctttgggaggctcaggaggaatggaagagggcctcctgggagtggcggaacagttctttacagtcaattgacgtcgaaagcgtccaacgaaatgtgtccaaacttatgcatattatttccgtgctggagaaagggctgcctaaatcagatatggtaactcatctgaagcaggtagtgacagagtttaagcaggagcttccgatcattattgccctaggaaatccatgtctgaaacctcgccactgggaagctctccaagaaatcattgggaaatctgtccccctcgataagaactgtaaagtagaaaatctcctagctctgaagatgttccaatatgagaatgaaatcaatgacatgagcacaagcgccacaaatgaggcagctctcgaaaaaatgctgttcaaaattatcgatttctggaatacaactcccttgccactgatattgcatcacacggagatatattctatctttatcatcccaagtatcgacgatatctccgcccagttagaggaatctcaagtcattctggccactattaagggatccccgcacattgggcctatcaaggacctggtgaatgagtgggatcagaacctgaccctcttttcttacaccctcgaggagtggatgaattgccaaaggaattggctgtacttggaacctgtgttccactccagcgaaatccggcgccaacttccagctgaaaccgagctgttctctcaggttatcagcatgtggaagaagataatgtctaaaatccagaataagcagaacgccctgcagataaccactagtgctggagttctcgaaattcttcagaattgtaatatccacctggagcacattaagaagagcctggaggactacctggaagtaaagcgccttatctttcctaggttttacttcttgagcaacgctgagcttctggatatattggccgactctaggaatcccgagtcagttcagcctcacttggtgaagtgtttcgaaaatataaaacagctactcatatggaaacaggatattggtccacctgctgtgaaaatgctgatctctgccgaaggcgagggactggtcctcccgaagaaaattcgcgtccggagcgcagtggagcagtggttagttaatgtggagaagtccatgtttgacgttctgaagaaggagcgctatatttacaacattatccttctcttccagagccagattatgttctataacgattgtgtgaagtcattcgtgagctcgtactcacgcgaaaagctcgaaaaggtgcacgccggacttatgtgccatttggaggaagttgcggacctggtggtgctggacacgtcaaatagcagaaccaaggctattctcggcgccctgttgatcctctacgtgcattgtcgcgatattgtgataaatctgctgctgaaaaatatttttaacgcggaagacttcgagtggaccaggcaccttcagtataagtggaacgaaaaacagaaactttgctacgtaagtcagggcaacgccagctttacttacggatatgaatacctgggatgcacctccagactcgtaattacgccactgaccgatcgctgttggctgacactgatggaagctctgcatctgaacctgggagggtgtcccgcgggccctgcgggcaccggcaagactgagacggtcaaggacctggccaaatccctaggcaaacactgcgttgtgtttaactgcttcgaagatctcgactataaaattgtccgtaagtttttcttcggcctggttcagtccggggcttggtcctgcttcgatgagttcaatctcatagatcttgaagtcctgtccgttattgcaagccagatccttaccattaaagccgccaaagataattattccgcccgattcgtcctggaaggaaaggaaataaggatcaacatgtcttgtgcggtgtttattacaatgaacccaaggtacggggggggtgtggaactccctgataacctgaaatcactgtttcgtcccgtagctatgatggtgcctcactaccagatgatcgcagaaatcattctgttctcttttggcttcaagagcgccaattcactaagcggtaagttaacaaatctctacgagctggcaagaaaacagctgtcccaacaagatcattataacttcgggctccgctcactaaaaatcgtcctgatcatggcggggactaagaagagggagttcaagtgcttgtccgaggctgatgaaacacttatagtcattgaggcgatcagggaagcctcgttacccaaatgcccccccgaggacgtgcccctttttgagaacataatcggtgacatctttcctgaagttacggtgcttaaggtcaatcaactggctctagaaaaggtgatttatacggcgacacagcaacttggtttgcagaactggagcagccagaaggagaaaataattcaattttataaccagctccaagtatgtgttggcgtgatgctggttggccctaccggaggcgggaaaaccactgtgcggaggatcctggagaaggcactgacattgctgccaatcgcagacttccttagtgtcgccgaacggaaatccgccagtaagatctctgaacggaaggggaaggtggatatctgcgtgctgaacccgaaatgcgtcaccctgtccgagctctatggccagctggatcccaataccatggagtggaccgatggtcttttatctgctacgattcggagctacgtatacttcaacacgcctaagaacaccaaaaaggatatagacctgaggttgaagagtagaatctcggatttatccaatgtattcaaacttgactctagtgacactacagagactgacgataatatctttgaagaaatagaaaaggtcgtgaagattcctgagaatcataactttgactggcaatggattatactagatggcccagtcgatactttctgggtggagaatctgaattcggtcctcgacgataccaggacactgtgtctggccaactcggagaggatcgcactgacaaataagattcgggtgatcttcgaggtggataatctgtcgcaggcctctccggcaacagtgtctcggtgcgcgatggtgtacatggatcccgtggacttaggatgggaaccatacgtgaagagctggttgctgaagaccagcaagatcatcagccagtctggtgtagactgtctggaattcatgataaaaaacagcgtcactgatggcctgcaatttattcgaaatcgtcaaaagttccaaccctatcctatggaagatattactgttgtcattaccctgtgtcggatcctggatgcatttttcgacttcatggggaaaaacgggggctttgagcaatcggacgatctgaatgatacctcaagcaaggaagcaaacagccagagggagagcgtgacatttaaggacatcgaaaaacgggacgaaaacacctggtatccagaaaagaatccggacaagctgaccaaaatcatccagaagctattcgtgttcgccttcacgtgggcattcggaggggccttgaatagagaagacgagcacagggagaacatccccttctgtccgtccctggaaccagattcattggcaaaagttacatacgactttgataagctggtacacgaactgtttggaaatagttctcaggttgggtggaagcattggggtcagagccagggcaggagaaggaagggcaactgcattaatctccccactggcgaatgtagcatcttcggctacttcgtggatattgagcagtgtgaatttataccttggagtgatctagtgcccaatgatcagaccctcatccagcggggcacaagtctcctgaccaatctgcaaagaagtgggggaaacttcttgaagataaccgagtgtggggagtgcatcaattacaccgccacaagggacacaacatgtctaagctttctcatgtctctgctgcttaagaactcatgtccagttttgctcacaggcgagagcggggtggggaagactgccgcgatcaaccagatgctcgaaaaactggaagggccaggggcgttcgatatcaaacatggaagcatcctgggcgacactctcctgtattccgagataaagaagtctagctctctgaaacaaaatatcacaatcctgatcccagagacccataaaaccgccaccggcagttctgataacccaaccaagaagcccgaggtgcgcactaacaaaaaattgcttaagaacaatgaccacaaaggtgttgttgtctcaacaatcaatttttctacgaacgtgactgcagcaaaaactaaagaaatgattctgaagaagcttatcagacgaacgaaagatacgctcggcgcccccaagaacaatagaatcctgatctttattgatgatatgaacatgccagtaagcgacatgtacggcgctcaacctcctctggaattaatcaggcaactgttggacctggggggcgtgtacgataccgagaaaaatacgtggaaaaacatccaggacctctccatagtggccgcttgcgtcccagttgttaacgatatatccccccgcctcctaaagcacttttcgatgctggtcttaccacacccttcccaggatatcctgtgcacaatttttcaggcccatctggggatatacttctctatcaataattttacccccgaggttcagaaatctaaagatcagatcatcagctgctcgcttgctatttatcaccaggtacgacaaaatatgctccccaccccaacaaaatgccattacatgttcaacctccgggacatgttcaaattgctgctcggcctgctccaggccgatagaactgtcgttaacagcaaagagatggcagccttgctgtttgtgcacgaagccacacgggtgtttcacgacaggcttattgactttaccgataaatctctcttttaccgactactctcccgtgaactggagaactgcttccaaatcggcattgatggttgcggaaagaaaacttgcgccaccctggcttgctacctgacagataataagttgtaccgagtgcctatatcccataaatgcgcatatatcgagtttaaggaggtctttaagaaagtgtttatccatgcaggcttaaaggggaagcccaccgtgctgatggtgccgaacctcaacatcgagcaggatagttttctggaagatttaaattacataatctcaagcgggagaattccggacctttttgagaacgtagaactggactccattgccatgaaaatccgctatttaacagagcagtccggccacatggataatcggcagtccctgctgagttttttccagaagcggatctacaaaaacttacacatctttgtgatcatgtcccctgagggaccctcattccgacagaattgtagagtatacccctccatgattagctcctgcaccatcgactggtacgaaagatggcccgaggaggccttgcttatagtggccaacagttttttgaaggaaaaggttaactttgaaaaccgagagaaccttaaggagaagcttgcccctacatgcgtacagatccacaagtccatgaaagatctcaataggaaatacttcgaggaaacgggtcgcttctactataccactcccaattcatacctgcagttcatggagacgttcgcgcacatactgcgagcccgcgaagaagagatgcagaccaagagagaccgctttcacatgggattgtctaccattctggaggcgactacgctcgtcacagaaatgcaggaagaacttctcatattaggcccccaggtggaacagaagaccaaagaaacagagacactcatggagaaactccgaaaggatagccaagtcgtcgaaaaggtgcagatgctggtgaagcaggatgaggagatcgtggcagaagaagtccggatcgttgaggattatgctcagaaaactgctaatgaactcaaatctgtgctgcctgccttcgataaggccatcgttgctctgaacgccctggataaggcagatgtggccgaacttcgcgtatacacccgccctccctttttggtcttgacagtcatgaatgccgtatgcattttgctgcagaagaaacccaactgggcaaccgctaaattgctgcttagtgaaacaggcttcttgaagaagctcattaatctcgataaagattctattcccgataaggtgtttgtaaagctgaagaaaatcgtgacactgcctgatttcaacccccacaagatctcacttgtgtcggtggcctgctgtagtctgtgtcagtgggtgattgccctgaacaactatcacgaggtgcagaaagtagtcggccccaaacaaatccaagtggcagaagcccagaatgtgttgaagattgctcgccagagactggctgaaaagcagcgagggctgcaacttgttgaagagcacctcctgttcctccaggccgcctacaaagacacggtcgccgagaaacaattgctggccaataggaaaacgatggcaagcagacgctttcagtgcgcaagtgtgctcctgactgtactggaagatgagaagacccgatggcaggagacaatcaaccagatagacaataaactggaagggatccttggagacatcttgctcagcgctgcctgtatcgtctattccgggatcctgactcctgagttcagacaactaatcgtaaataaatgggagactttttgcatagagaatggtatcagcttatctagtaagttctcgttgatcaaggttatggctcaaaaatacgagatctctcgatggcacaatcaaggcctgccacacggccagtactctgtagagaatgcgatccttattaagaacggtcagcaatggccacttcttattgatcctcataggcaggcccacaagtggatccgccaaatggaagggtccagattgcagaagctatctattgaagacagtaattacacgaagaaaatcgagaatgcgatgaagaccggcggttccgtattgctccagaatcttttggaaacccttgctcccggactcaaggccatactcaagaaggatatataccaaaagaaggggcattactttatccgtgtgggcgatgcagaatttgagtacaactccaatttccgactgtatctaagtaccgaaattgataatccacactttctcccttctgtgtacaatttcgtgactatgatcaactttaccgtgacattccagggcctgcaggaccagctgctttctactgtagtgacacacgaagtgccacatctggaggatcagcggagcaaactgcttgagagtatttccctggatgccatcaccctcgaagagctggaggaaaagacattgaaccttctgcaaaaggcccttggtagcatactggacgatgacaagatagtcgatacacttcgtaagtctaaaatgacgagcaacgagattagcaagcgaattgaggcgacgaagaaggccgagtctgaaatccaggcaattaggaaaaattacctcccaattgccactcgtggggctctcctttacttcttggtggccgatctgacacagataaactatatgtaccagttttccctggattggttccatcaggtctttgtctcttcagtggtctccaaatcaaaagagcaagaacactccttcaagcgtgagaaggttagtccgaaagaagtgcacgaattcatttccatatctaaagaacctaatttggagaacgaaaagaaccttctcgacaaacatatcaagtctgcaattgacatgctgacgaaatcaatatttaaagttgtgtcgtcagccctgttcaatgaagacaagctctgcttctcatttcgtctatgcactgtaatcatgcagaataacgccaatggaaacctgattcaggacgatattggcttcttgccagaggaagagtggaacatttttctgtactctgggatcttgatcaacatcaagagcgccttgtctcagagtcgcttgaccagcacattcgagataggtgagagtcagcatttgcagtggctatccgattctcgctggaggcagtgccagtacgtcagcacccacctcgagccttttagcctgctttgcaaatcactgttgtctaatgtgtcacagtgggacacatttaagaattccaaggccgtttatagccttatctcaaccccattctcctccgaaaatgcctccctggaggaaaacaccaagcctccggaagagaccgagctcctgaatgaaaacaaggagacttgtaatcctatcaattttccttgggaaaagttgacctcatttcagaggctgatactggttaaggtcttgcgaccggagtctctaaacaactctgtcagaaagttcattacagaaaaaatgggaaacaaatatctgcagcggactggcgtgaatctgaaggacgcgtataaagggtcaaatgcacggacccccctgatcctgattcagacgcacggaatcgacctgacgaatatcctgctgcggtttgcccaagagttgaaagggactactcatcatgtgacaattattagtctgggccgagatcaggccgccaaggcggaagaccttatcctgaaagctcttacaaagactcaacagtgggtgttcctccagaattgtcatctggctacaagtttcatgcctcgactgtgcaccattgtcgagtctttcaacagccccaatgttactatcgatccagaatttaggttatggctgagtagcaaatcttattctagcttccccatacctgtgctcaaaaagggcctgaagatcgcagttgagtctcctcagggcttaaagtccaacctgctccagacatttggctgcacaggtagcggtgaagttaccgaagaaatcttcgagaatcctgactgcgggcagtggtggaagaaactgttgttctcgctgtgtttcttcaacgcagtcatcaacgaacgcaaaaattacggcatcctcggttggaatatagcatacaaattcaattccagcgatctgggtgtcgccattaaggttttggaaaatagcctcagggggcagccaagcatttcttggcaggccctgaggtatctcatcggtgaagttatttatggtggtcgagtgattgacaactgggataagagatgcctgaaaacgttgctttacaagttttgtaatcccgaggttttgaaggatgacttctcattctcacgctccgcttcaataaaggactacatacatattattcagtccctgcctgatgacgacttacctgaggtattaggcattcaccctgaggcgatccggtcttgttgggaaacccaaggagaaaaatttatagagaacctcatagccatgcagccaaagaccaccactgcgaacctgatgatccggccggagcagtcaaaggatgaactggtgatggaaatcctatccgacttgctgaaaaggctcccattgacagtagagaaagaggaaatcgccgtaggaacaccaagcacccttaaatccatgatgagtagctctatatgggaaagtctcagtaaaaacctcaaagaccatgatcccttaattcattgtgtgttgctcacattcctgaagcaggagatcaagaggtttgacaagctgctttttgtaatacacaagtctttaaaggacctccagctggctattaagggcgagataatcctgacacaggagctggaagaaatatttaactcgtttcttaatatgcgggtcccaacattgtggcagaagcatgcttataggagttgtaagcctctatcaagttggatcgatgatttgatacagagattgaacttttttaatacatgggccaaggtggcttataccgctattcagagaaggtacatgcggttcgttactgtgtggaaacaatccatccccagtaccagtcaaaagtgtaagcaccccgaggattccgagaacaatttctttgaaggattcccctctaggtactggctgcccgcattttttttcccacaagcattcctcgccgccgtccttcaggactatggacgttcacgaggcatcgccgttgacgccctgacatttactcaccacgttatctctaatacgacagataaggatgagaagttcagtgtatttatgccaaagaagctgaacattgtccggcgggccttcaaaggttctgcctcctcacatacaggtgtgtacatcttcggattatttattgaaggcgcgcgttggaacagagaacagaagatcctggaagacagcctccccctggaaatgtgttgcgacttccccgatatttacttccttcctacaaagatttctacgaagactcccaacgccagcaaccagaccgatagcgaattgtatgccttcgagtgtcccgtgtaccagactcccgagcgctccaggatcctcgccacaactgggctacctaccaacttcctcacgagtgtctacctgagtacaaagaaacccccttctcactggattaccatgcgggtagctctcctgtgcgagaagaacgagaagtag

SEQ ID NO: 115237 - DNA, 10524 bp, Artificial Sequence
  Description of Artificial Sequence: Synthetic coding sequence
atggggcgccgaagccagtggatctgggccatgagatgtcagatgctggttccagtgctgtctttacacattgggctcgctagggccctcgggtgcggctgcattgcgagcaaaattgagtgtctgatccgctgcaacgctccattcccccttctggatgccgtaggaagtgtggcatcgcaagaactccagagtctcactgggactgtgggcgtcaccagcggtgccgctgcttatcctagatggaatctcgcacgagcacgagcgccacctcacctcccagggacccaggatcctctccgccgcgtcagggatccgacaccgattgttgcgtcaagcccgggtcggaggaggggatcctggtcaggcggctatggccaggaagcatctgagcccggtgtcgtcggtctgtgctgcgctgtgctgcctatacacccaagcctagccctggccggagtgggcgggcctgaccttagaaggttccaggaaggtcctcagaggcccagtgatcacggggcggctgaaaaacacatggaaactttcatcccgattgacctgacaacagagaaccaggaaatggacaaggaggaaaccaagacaaaacctcggttgcttcggtatgaggagaagaaatatgaggacgtcaaacctcttgaaacccagccggcagagatcgctgagaaagaaaccctagaatacaagacggtacgcacattcagcgagtcactgaagagtgagaagacagaggaacccaaagatgacgacgtcatccgcaacatcatccggctccgggaaaagctgggttggcaaacaatcctccctcaacatagtcttaaatacggcagtagcaagatagccatccagaaaattactctaaagaagcccctggaagatgacggcgagttcgtctattgcctccctaggaaatcaccaaagagtctgtataatccttatgacttacaggtcgttagcgctcatacggctaaacactgtaaagagttctgggttatcactgccagttttattagcaaattagattcttccaggacttactcactggacgaattctgcgaagagcagctgcagcaggctacccaggccctgaaacaactggaagacattcggaataaggccatttccgaaatgaaaagcacctttcttaaagttgccgaaaagaacgagatcaaagagtacttcgaaagtaagctctccgaggacgatactacccactttaagctgccaaagtaccgtcgcctgctcgaaaccttttttaaatttgttatgttggtcgattatatatttcaagaattgattcgccagcttatgaacacagctgtaacacttcttctagaactgtttaatggatcagctggtatgcccttttccgtagaaaagaagaatgagaacctgatacgaacgtttaaggataattcctttcccaccggcaagaccaccaacgactgcgaggagttagttgacaattcaaagctacacgccatctccgtacagaagtctgaggtgaaaacggatacggacatcaatgagattcttaacagtgttgaggtcgggaaggatttgaggaaaacatacgcccccatttttgaggtcaatttgtgcctccggattccagccgaaagcgatagcagcgaaaattcgaaggagaacttccatgagtctgaccagtgcccagaagagtgcgtgatgttcgaggatgaaatgtcagagaataaggacaactgcgtgaagaaacacagcagtgaagagttgctcccaaaagctaagaaaagcaaagaaatatcttacaatctcgaagatattattagtgccacaatcactcctctgtgtcaggaccctcagctgagtatcttcatagacttggtttctattatggatctgccaaacaagacaggcagtattatccactataaagaacagactcgctggccggactgccatattctgtttgaaaccgaccccgcttatcagaatattattgttaatctgttaacgataattgggaattctatggggttggttaacgcatattcgcataaattcatcaaatactgcaccatgacagaaaaagctaagataatgagtatgaagatttcctctatgggagagctgacgagcaaggagttcgaggcaatcttgaataggtttaggaattacttccggcacatcgtgaacatggccattgaaaagcgtattgggatcttcaacgtggtcgtggaatcctcattgcaacagctggaatgtgaccccactgagatcgaagagttcctagaacatttcatttttctcaacgctatttcctctaagatatcaaagttagaaaaagagtttttgaccatgagtcagctgtacagtgtggccaaacaccaccagattcatatctctgaggaacagatcgccatttttcaggtattattgttaaagttcagtcaactgaagtccagtatgaaactctctaagattaataaggacactgctataactaaattccgggacaacctagaggcctgcattagtggacttcacgtagacgttggcaatctgaaggcaaagataaggacgccactgctgctgtgcgctggaacacaggtgtctactgccatggaaatgatccagacactatctggcgaagccgcctcgctaaccaataaagccaaggcctacagtcactaccaagattgtttttccgactctcagtctcacatgcactcagttaacgttgaggagatcacccagatagttctgtccgaaatctccgacatagaaggagacctgactctgcggaagaagctctgggaagcccaagaggaatggaaacgggccagctgggagtggcgcaacagctcactccagagtatagacgtggaatccgtgcaaaggaacgtttccaaactgatgcatataatctccgtattagagaaagagatttacagtattttcatcattccatctatcgacgacatttcagctcagctggaggaaagtcaggtgattctggccacgatcaagggttccccccatatcggcccgataaaatcccagattatgttctataatgactgtgtaaaaagctttgtttcatcgtatagtagagagaagctggaaaaagtacacgcagggctcatgtgccatttggaggaggtggcagatcttgttgtcctcgatacctcaaacagtaggaccaaagctattctcggcgccctgctgatcctgtatgtccactgtagagacattgtgatcaatcttctgctcaagaacattttcaatgctgaggacttcgagtggacgcgacacctgcagtacaaatggaacgagaagcagaaactgtgctatgttagccagggcaacgcctccttcacatatgggtatgaatatctcgggtgcacgtccaggctggtgatcacgcctcttaccgaccgctgctggcttactctcatggaagctctgcacctcaatttggggggatgccctgctggcccggccgggaccggcaagactgaaactgttaaagacctagcaaagtgtgccctttttgcgttcaagtgtaacacagccttgatcaaacttcccaacagcctgattgtgctcacatgctttggcctcgaaaagaccgtgttggtgatgaacaccgtaatgagcttccgctttgtgcttgaaggcaaggagattagaatcaatatgtcatgcgctgtctttattactatgaacccaaggtacggtgggggggtggagctgccagataacttaaaatccctctttcgcccggtggctatgatggttcctcattaccaaatgatcgcagagattatactgttctcctttgggtttaaatccgcaaacagtttatccggtaagcttactaacctctacgaactggcccgcaagcagctgagtcagcaagaccactataacttcgggttacggtcgttgaagattgtcttaataatggctgggacaaagaaaagggaatttaaatgtgacacgagtgactccctgagtgaagcggacgagaccttgatagtcatcgaagccattcgggaggccagcttgcctaagtgtcctccagaggacgtgcccctctttgagaatattattggagacatctttcctgaggtcacagtcctgaaggtgaaccaactggctcttgaaaaggtaatctatacggcgacccagcagttgggactccaaaactggtctagtcagaaagagaagatcatccagttttacaaccagctacaggtttgtgttggcgtcatgctggtgggccctacaggtggtggcaagaccaccgtgcgcaggatcctggaaaaggctctgaccctcctgcctattgcagacttccttagtgtcgccgagcgaaagtccgccagtaagatctccgagcgcaaaggcaaggtggacatatgtgtgttgaaccccaaatgtgttacccttagcgaactctacgggcagctggacccgaatacaatggagtggactgatgggttactttctgctactattcgatcttacgtgtacttcaatacacccaagaatactaaaaaggacattgatttgaggctgaagtccaggatcagcgacctgtctaacgtgtttaagctcgattcttccgatactacagagacagacgacaatatcttcgaggagatcgaaaaagtggtgaagatacccgaaaatcacaatttcgactggcagtggataattctggatggccccgtggacacattctgggtggagaatctgaactcagtgttggacgatacgcggacactgtgtctcgcgaactcggagcgtatagccctcactaacaaaatacgcgttatctttgaggtggataacctctctcaggccagtccggctaccgtgagtcgctgtgcaatggtctacatggatccggttgatttggggtgggagccctatgtgaaaagctggctcctgaaaacgagcaagataattagtcaatccggagttgactgcctggagtttatgatcaagaactctgtgaccgacggcctgcagtttatccggaacaggcaaaagttccaaccctatccgatggaagacattaccgtcgtgattactctgtgtcgcatcttggacgcttttttcgacttcatggggaagaacgggggcttcgagcaaagtgacgatctgaatgacacttcctccaaggaagccaattcacagcgggagtctgttacgttcaaggatatagagaagcgggatgagaatacttggtatccagaaaagaatccggataagcttactaaaatcatccaaaaactgttcgtctttgccttcacatgggcattcggaggtgccctcaacagggaggacgagcacagagaaaatatcccattctgcccatctctggaacccgactccttagcgaaagtcacatacgactttgataaacttgtccatgaattgttcgggaattctagtcaagttggcatcaacctgcccacaggtgagtgttcaatctttgggtattttgttgacatcgaacagtgtgagttcatcccgtggagcgatctcgttcccaacgatcagaccctcattcagcgtgacaatcccaccaagaagcccgaggtccgcacaaacaagaaactgttaaaaaataacgatcacaaaggggttgttgtttccaccataaacttctcgacaaacgttaccgccgccaagacgaaagagatgatcttaaagaagctgataaggagaaccaaggacacactcggggctcctaagaataaccgcattcttatttttatcgacgatatgaatatgcccgttagtgatatgtatggggcccaaccccctctggagctcatcaggcagctcctagatcttgggggggtttacgatacagaaaagaatacgtggaaaaacatccaagatctctcaattgtcgctgcatgtgtcccagtggttaacgacatctcaccacgacttctaaagcactttagcatgctggtactcccacacccctcccaggacattctctgtacaattttccaaatcggtatcgacgggtgtggaaagaaaacatgtgccactttagcttgctatcttactgacaataaattgtaccgggtgcctattagtcacaagtgtgcatacattgagttcaaggaagtattcaagaaggtttttatccatgccgggctcaagggaaagcccactgtactgatggtaccaaacttaaacatcgagcaggattcctttctggaggacctgaactacatcatctcctccggacgcattccagacttgtttgaaaacgtggaacttgacagtattgctatgaagatacggtacctgacggaacagagcggacacatggacaaccgccagtccctgctgtcatttttccagaagcgtatctacaagaacttgcatatatttgtcattatgagccctgaaggccctagctttaggcagaattgtcgtgtctacccaagtatgatctccagctgcactatcgactggtacgagagatggccagaggaggccctgcttatcgtggctaacagctttttaaaggagaaagtaaacttcgagaatagggagaatctgaaggaaaagcttgctcccacatgcgtccaaatccataagagcatgaaagacctcaatcgcaagtacttcgaagagaccggtcgcttctactacacaacccctaactcttacttgcagttcatggagacctttgcgcacatcctcagagcacgcgaagaggagatgcagactaaacgagatagattccacatgggacttagcactatcctcgaggccacaactctcgtgacagaaatgcaggaggaactcctcatcctcggaccgcaggtggaacagaaaacgaaggagactgagacgctcatggagaagcttaggaaggactcccaagtagttgagaaggttcagatgctggtgaaacaggacgaagagatagttgcagaggaggtccggatcgttgaagattatgcccagaagacggccaacgaactgaagtccgtgttgcctgcttttgataaggccattgtggcacttaacgcactggataaagcggacgtcgcggagctgagagtctatactcgtcccccttttcttgttctgactgtcatgaacgctgtttgcattctcctccagaagaaacctaattgggccaccgcaaaacttctcctgtccgagactggcttcctaaagaagctgatcaatttggataaagactctattccggataaagtgtttgtgaagctgaaaaagatagtgaccctcccagactttaatcctcataagattagcttagtgagcgtggcctgttgcagcctttgccagtgggtgattgcccttaacaattaccacgaggtgcagaaggtggtaggcccgaaacagatccaagtggccgaagcccagaacgttttaaaaattgcaaggcagagacttgctgagaagcaacgggggctgcagctcatcagccgctggcacaatcagggcctgccccatggacagtatagtgttgaaaatgccatcctcatcaaaaacggacagcagtggcctttactaattgaccctcatcgacaggcgcacaaatggattcgccaaatggaaggcagccggctgcagaaactgagtatcgaagattcaaactacaccaagaaaatagagaacgccatgaaaaccggaggctccgtattgttacagtcctgccaagctagcacatggcggaagaagctctatctgagcactgaaattgacaatccacactttttgccttccgtgtacaattttgttacaatgatcaatttcactgtgacgtttcaggggctgcaggatcagctgctgagcaccgttgtaacccatgaggtgcctcacctagaggaccagcgatccaaacttctcgagtctatctctctggatgctataacacttgaggaactggaagaaaaaacactgaatctgttacaaaaagctctgggatctatactggatgatgataaaatcgtagacactcttcgcaagagtaaaatgactagtaacgaaatttcaaagcgaattgaggcaacgaaaaaagccgaatctgagattcaggctatcagaaaaaattatctcccgatcgctacacgcggtgccctgctttattttttagtggctgaccttacccagattaattacatgtatcagttttccctggattggtttcaccaagtgtttgtgagtagcgtggtgagtaagagcaaggaacaagaacactcatttaaaagggaaaaagtcagtccgaaggaagtgcacgaattcatatcaatttctaaagagccaaacctggagaatgagaaaaacctcttagataagcatatcaaaagcgcgattgacatgctcactaagagcattttcaaagtcgtaagttccgctctgtttaacgaggataaactttgcttcagcttccgcctttgtacagtgatcatgcagaataatgccaatggcaatttgattcaggatgacatcggatttctgcctgaagaagagtggaacattttcctatattctggaatcttaattaacattaagtctgccttgtcccaaagtagactgacctctacatttgaaataggtgaatcccaacaccttcagtggcttagcgatagtcgttggcggcaatgtcagtacgtttccacccacttggagccattctccctgctgtgtaaatctctcttatctaacgtgtctcagtgggacacgttcaagaactccaaagctgtctactctctgatatctacccccttttccagcgagaacgcttcactcgaagaaaataccaaacccccagaggaaaaacacactttctgtttgctgttgcgtgcgatcaatcatactgggaccgatctcggacccgtaggccggggccagtggctgaccagcactgcctgcgaccgtcataccgacgtttgcagcttctcatttgccctcaatgatggcgtgccggatgtcgagcacgttcaggacattttctatgggcactgtgtggacaagtaccatgtaaaagttcttcgtcccgaaagcctaaataatagtgtgagaaagttcattacagaaaagatgggcaataaatatcttcaacgcactggcgtcaacctgaaggacgcctacaaaggctccaacgctcggactcccctgatcctcattcagacgcacggcagcgcctccattaaagattacatccatattatccaaagcctgccagacgacgaccttcccgaggtcttaggcatccatccagaggcaattaggtcctgctgggagacccagggagagaaatttatcgaaaacctaattgccatgcaaccaaaaacaactaccgctaacctgatgataagaccggagcagtctaaagacgagttagtgatggaaatcttgtcagacttgctcaagcggctgccactcacagtggagaaggaggaaatcgcggtgggaacaccctctacgctcaaatccatgatgtccagctcaatttgggagagcttgtcaaaaaacctgaaagatcacgaccctttgatccactgtgttctgttgacatttctgaagcaggaaatcaaaaggtttgataagctccttttcgtcattcataaaagtctgaaggacctgcagttggccattaagggggagataatccttacccaggaactcgaggagatatttaacagcttcctgaatatgagggtccctactttgtggcaaaagcacgcctatagatcctgtaagccgctcagcagctggatcgatgatctcatacaaagactcaatttttttaatacgtgggctaaggtggcctatacagctattcagagacgctacatgcgattcgtcacagtctggaagcagagtattcctagtaccagccagaaatgtaagcaccctgaagactcagagaataactttttcgaagggtttccctcaaggtactggttgcccgcgttcttttttccgcaagcttttctagctgcggtgttacaggattacgggcgcagccggggaatcgcagtggacgcccttacgtttactcatcacgtgatcagtaacactaccgacaaggacgagaagttttctgttttcatgccgaagaaacttaatatcgtcaggcgggcctttaaagggagtgcttcctcccacactggggtgtatatttttgggctattcatcgagggtgcacggtggaacagggagcaaaaaatcttggaggatagcctcccccttgaaatgtgctgcgatttcccggacatctactttctcccaacaaagatcagcaccaagacaccaaacgccagcaaccagaccgactcagagctttacgctttcgagtgtcctgtttaccagacccctgagcgctcgaggattctggctactacaggcttgccaaccaacttcctgacgtccgtctacctcagcaccaaaaagccgccctcacattggatcaccatgcgggttgccctgttgtgtgaaaaaaacgaaaaatag

SEQ ID NO: 115238 - DNA, 2619 bp, Artificial Sequence
  Description of Artificial Sequence: Synthetic coding sequence
atgagttccaaagcggagaagaagcagaggctctccggtaggggcagcagccaggcttcttggtcagggcgggcaaccagagctgctgtagctacacaggaacagggcaatgctccagcagtgagcgaacccgagttacaggccgaacttcctaaagaggaaccagagccgcggttagagggacctcaagcccagagcgaggagagcgttgagcccgaggcggatgttaagcctctgtttctgtccagagcagccctcaccggactagcggatgccgtctggacacaggaacacgacgccatactcgagcacttcgctcaggatcctacagaaagcatcctgaccatttttatagacccgtgcttcgggctcaagctcgagctgggcatgccggttcagacccaaaaccaacttgtatattttatccgccaggcgcctgtgccgattacctgggagaatttcgaagcaaccgtccagttcgggaccgtccggggcccttacatcccagccctgctgaggctcttaggtggagtatttgctcctcagatttttgccaacacaggctggccggagtcgatcaggaatcactttgccagccacttgcacaaattcctggcctgtctgactgatacacggtataagctggagggacatacagtcctctacattccagctgaggctatgaatatgaaacctgaaatggtcattaaagacaaagaactagtccaaaggctcgaaactagcatgatccactggaccagacagatcaaggaaatgttgtccgctcaggagactgtggagaccggcgagaatctggggcctttggaggagatcgaattttggcgaaatagatgtatggacctgtcaggaattagcaaacagctggtgaagaagggagtgaaacatgtggaatccattctccatctagcaaagtcctcgtacttggctccttttatgaagttagctcagcagattcaggacggcagcagacaggcccagtccaacctgacatttttaagcatactgaaagaaccttatcaagagctggcattcatgaagcccaaagatatctctagcaaattacccaagctcatttccctaattcgcatcatctgggttaattcaccccattacaacaccagggagcgccttacctcactttttaggaagatgtctaacgagatcatacgactctgttgccatgcaatttctctggatcgaatcttcgagggctacgtgagctccagcaaagaagacctccagggatgcatactgtgttgccatgcttggaaagaccattacgtgcaggctgtacagatgcatattcagttttcatcgaggggatgggtgcttgaccagacatcaatcttcgcccaggtggatgcattcgtgcagcgatgtaaggaccttatagaagtttgtgattgtcagtatcatttcgctaggtgggaggatggaaagcaagggccactgccctgttttttcggcgcacaggggccccaaatcacaagaaacttactcgaaattgaggacatttttcacaaaaacctgcacactctcagagccgtacgtggcggtatcctggatgtgaaaaacacatgctggcacgaggattacaataaattcagggccgggattaaggatctcgaagttatgactcaaaatctgataacttccgcatttgagcttgtacgggatgtgcctcacggagtccttctgctggatacatttcatcgcctggccagccgagaggctattaaaagaacatatgacaagaaggccgttgatctgtatatgctgttcaactccgagttggctctagtaaacagggagagaaacaagaaatggcctgacctggagccatacgtggctcagtactccggcaaagcccggtgggtgcacattctccgacggcgcatcgatcgcgtgatgacatgtctcgctggcgcccactttctcccacgcattggcaccggcaaggaatctgtgcatacataccagcagatggtgcaggccatcgacgaacttgttcgcaagacattccaggaatggacaagttccctagataaagactgcatcagacgactcgatacacccttattaagaataagccaggagaaagcaggtatgcttgatgtgaacttcgacaagtatagatcccatctcgccccattcccgtacacgcctctgctgcagctgagccaggaatttcactcacatctgctgactccattgtttataatcttgtcattgtcccataccatttgcctcttgagctccttttacttttttttcagcagcttcatctttgttagccctcaccttcccccttgttaccagcactttaactttacaacctacttgaaaacccagcagaataagacaatgatcggacaggcgagatggcttacacctgtgatccctgctctctgggaggcagaggtgggagcttctttggaacctagatccttgaggaccgcatgggcaacctggcagaatcccgtcagcgcaaaaaacactaagattagctgggcatggtggcataaaccagttgtctcagctacatgggagggcgaggtgggagggtcccctgagcctggccgacagaggctacaatag

SEQ ID NO: 115239 - DNA, 12591 bp, Artificial Sequence
  Description of Artificial Sequence: Synthetic coding sequence
atgagtagcaaagctgagaaaaagcaacgattgtccggaagggggagcagccaagctagttggtccgggcgtgccactcgggctgccgtggccacgcaggaacagggaaacgcacccgccgtatccgagcctgaactgcaggccgagctgccaaaggaagaacccgagccaaggctggaaggaccacaggcccaaagcgaagaatccgtagagcccgaggctgacgtgaaaccgctgttcctgtcaagagccgcgctgacgggattggctgacgccgtctggacacaagaacacgatgcaatcctagagcactttgctcaggatcctactgagagtattctgactattttcattgatccatgctttggccttaagctcgaactcgggatgcccgtgcagacacagaatcagctggtgtacttcatacggcaggcccctgtgccaataacctgggaaaattttgaggcgactgtccaattcggaaccgtccgtggcccatatataccagctctgttgcgtctcctaggcggtgtgttcgcccctcagatttttgcaaacaccggatggcccgagtctatacgtaatcactttgcatcccacctgcataaatttttggcctgtctaaccgatacacgctacaagcttgaggggcataccgttttgtacatccctgctgaggcaatgaacatgaagcctgaaatggtgatcaaggataaggagcttgtgcagagattggaaacttcaatgattcactggactagacaaattaaggaaatgctgtctgctcaggagacagtcgagaccggcgaaaatttgggccccttggaggaaattgagttctggagaaatcgctgcatggacttgtcaggcatttccaagcagcttgtgaagaagggcgttaaacacgttgagagtattcttcacctggccaaatcaagctaccttgctccttttatgaaactcgctcaacagatacaggacggttcaaggcaggcgcaaagcaacttgacttttctctccattctgaaagaaccctaccaggagctggcatttatgaagccaaaagacataagcagcaagctgccaaagctgattagccttattcgcataatctgggtgaacagcccacactacaacacacgggagagactgacatcactgttccgcaaagtatgcgactgtcaataccatttcgctcgatgggaagacgggaagcagggccccctgccctgtttttttggagctcagggtccccagatcactaggaatcttttagagatcgaagacatcttccacaagaatctgcatacactgagggccgtaagaggcggaattcttgatgttaagaatacctgctggcatgaagactataataaattccgggcgggaatcaaagatctagaagttatgacccaaaacctgattacttcggctttcgagctggtgcgagatgtaccacacggggtcctacttctcgatacatttcataggttggcaagtcgagaagctatcaagagaacatacgataaaaaggcggtggacttgtatatgctctttaactccgaactggcactggtcaatcgcgagagaaacaagaagtggccagatctcgagccctatgtggcccagtacagcggtaaggcgcgctgggtgcatattctgagaagacggatcgaccgggtgatgacatgcttagcaggggcccactttttgcctagaatcgggaccggcaaggaaagtgtgcacacataccaacagatggtacaagccatcgatgagctcgtgcggaaaacttttcaggagtggacaagcagcctggacaaggactgcataagaaggctggacacacccctgctgagaatatctcaggaaaaagcggggatgttggatgtgaacttcgacaagagcctgctaatactgttcgccgaaattgactactgggaacgcctgttgtttgaaaccccccattacgtggtgaacgtcgcagagcgagctgaggacctccggattctgagggagaacctgctgctcgtggctagggactataaccgcataatcgccatgctgagtccagatgagcaagcactattcaaggagaggattaggctactggataaaaaaatccacccaggattgaaaaagttgcactgggcgctgaaaggggcctctgcatttttcattactgagtgtaggatccacgcctcaaaggttcaaatgatcgttaatgagtttaaagctagtaccctcactattggttggagggcccaggagatgtcagaaaagctgctcgttaggattagcggtaagcgagtgtaccgtgacctggagtttgaagaggaccaaagagagcaccgggcagcggtgcagcaaaagctgatgaatctacaccaggacgtggtaacaatcatgactaatagctacgaggtttttaaaaacgatgggcctgaaatacagcagcagtggatgctgtatatgatacggctggacagaatgatggaggacgccctccggctcaacgtgaagtggtctttactagagctttctaaggctataaacggtgatggaaaaacctctccgaacccgctgtttcaggtgctcgtgatcctaaagaacgatctccagggaagcgtggcccaagtcgaattctcacccactctgcagacactagccggggtagttaatgacattgggaatcacttgttcagcacgatctccgtcttctgtcacctgcccgacattctgacaaaaagaaagcttcaccgtgaaccaattcaaactgtggtcgaacaagatgaggatattaaaaagatccagactcagatctcctctggtatgaccaataatgcgagccttctgcagaactacctaaagacatgggatatgtatagggaaatttgggaaattaacaaggattcatttatacaccggtaccagaggctgaaccctcccgtctcctcttttgttgctgatatcgctcggtatacggaagtcgcaaataacgtgcagaaggaggagaccgtcacaaatatacaatttgtgttattggattgctcccatttaaagttcagtctagtccagcattgcaatgagtggcagaataagtttgccacactgttacgagaaatggctgcaggacggttactggaactgcatacttacctgaaggagaacgccgaaaagatctcaagacctccccagactctcgaggagctaggcgtctcccttcaactagtagacgctctgaagcatgaccttgcaaacgtggagacacagatccctccaatacacgaacagtttgccatactggagaagtacgaagtgccggttgaagacagcgtccttgaaatgctggatagcctgaacggggaatgggtggtgttccagcaaaccttactcgactctaagcagatgcttaagaaacacaaagagaaattcaagaccggcctgattcactctgccgatgactttaaaaagaaggctcacacactcttggaagactttgagttcaagggccatttcacatccaatgtgggttatatgtcagcgctagaccaaattactcaggtgcgggccatgctgatggctatgagggaggaagagaatagtctgcgtgccaacctaggcatcttcaaaatcgaacagccaccttccaaggaccttcagaatctcgaaaaagaactggatgctttgcaacaaatctgggaaatcgctcgagactgggaagagaactggaacgaatggaaaaccggacggttcttgatcctgcaaaccgagaccatggagacgactgctcatgggctctttaggaggctaactaagctagccaaggagtacaaagatagaaactgggagataatcgagactacacgaagtaaaatcgaacagtttaagcggaccatgcctcttatctctgacctcaggaacccagcgttgcgtgaaaggcactgggatcaagtacgggacgagatccagcgggagtttgaccaggagtccgagagtttcactctagagcagatcgtggaactggggatggatcagcacgtggagaaaatcggagagatatcagccagcgcaacgaaggagctcgcaatcgaggtggctctacagaacattgctaaaacatgggacgtgacacaactggacatcgttccttataaagacaaaggccaccacagactgagaggcacagaagaagtgttccaggccctggaagataatcaggtggccctatccacgatgaaggctagccgctttgtcaaagcattcgaaaaggatgtcgatcactgggagagatgtttgtccctgatcctggaggttattgagatgatcttgacagtgcagaggcagtggatgtatcttgagaatatctttctgggggaggatatccgcaaacagctccccaacgagagcacactatttgaccaggtcaattccaattggaaggccatcatggataggatgaataaggataataacgcactgcgctccacccaccaccccggcctcttggacaccctaattgagatgaacaccatcctcgaagatatacagaagtcattggatatgtatctcgagaccaagaggcatatctttcctcggttttatttcctttcaaatgatgacctcttggagatcctgggccagtctcgcaatcccgaagcagtccagccccatctgaaaaaatgcttcgacaacataaagctgcttagaatccaaaaggttggtggtccctcgtccaagtgggaggcagtcggaatgttctccggggacggagagtacatcgattttttacactcggttttccttgagggacctgtcgaatcttggctgggggatgttgaacaaacaatgagagtcactctgagggatctgctgcggaattgccatctcgccttgaggaagtttcttaataaaagggacaaatgggtgaaggagtgggctggccaagttgtgatcactgctagtcaaatccagtggaccgctgatgtgacaaagtgtttgttaacggcaaaggagcgtgccgacaagaaaatcctgaaagtcatgaaaaagaaccaggtgtctattcttaataagtactctgaagctatccgaggtaatctgacgaaaataatgaggttgaaaattgtcgccctggtgaccatcgagatccacgcacgtgacgtactggaaaaactgtacaagagtggccttatggatgtgaattcattcgactggctcagtcagttacggttctactgggaaaaagatctcgatgactgcgtgattcgtcagactaatacccagtttcagtacaactacgaatatctgggcaattcaggtcggctggttattacgcctctgacggatcggtgttatatgaccctgaccacagccctgcatctccacaggggtggatcccctaagggacctgccgggaccggaaagacggagacagttaaggacctggggaaagcgctgggcatttacgttattgtggtgaactgcagcgagggtctggattacaaatccatgggtaggatgtactctgggttggcccagactggggcgtggggctgctttgacgagttcaatcgcatcaatatcgaagtgctctccgtggtggctcaccagatcctctgcatactgtccgctctcgccgctggcctgacgcatttccattttgacggcttcgaaatcaacctggtgtggtcgtgtggcatcttcataactatgaaccccggatatgccggccgcacagagctgccggaaaacttaaagagtatgttccgccccattgccatggtagtgcccgactccactctcatcgccgaaattattctgtttggtgagggctttggtaattgcaagattctggccaagaaggtgtatacactgtattccctggcggtgcaacagctttcccgccaggaccattatgatttcggactgcgggcacttaccagcctgctaaggtacgcaggaaagaagcgcagattgcaaccagatttaactgacgaggaggtgttgctgctctccatgcgggacatgaacattgccaaactcactagtgttgatgcccctctttttaatgctattgttcaggatttatttcctaacatcgagctgccagttatcgattacggaaaacttcgggagaccgtagaacaggagattagggatatggggctgcaaagcactcctttcactcttacgaaggtattccagctgtatgagacgaagaatagccgacattccacgatgatcgtgggttgcacgggctctggcaagacggcgtcatggcggatcctccaagccagcctgtcctcactgtgccgggccggtgatcctaatttcaacatcgtgagggagttccccttgaatcctaaggctctatcccttggagagctgtatggcgagtacgacctgagcactaacgagtggacagacgggatattatcctcagtcatgcgcacggcttgtgctgacgaaaagccagatgaaaagtggatactctttgatggccccgtggatacgctgtggattgaaaatatgaacagcgtgatggatgacaataaagttctgaccttgattaatggagaacggattgccatgcccgagcaggtgtcgctcctgtttgaagttgaagacctcgctatggcctcccctgctactgttagtaggtgcggcatggtttacaccgattatgccgatttggggtggaaaccttacgttcagtcttggctggagaagagacctaaagctgaggtggagcctttgcagagaatgtttgaaaaactaattaacaagatgcttgccttcaaaaaagataactgtaaagaactcgtgcctctgcccgaatattccggcattacatctctgtgcaaactgtactcagcactggcgacccctgagaatggtgtgaatcctgcagacggtgagaattatgttaccatggtggaaatgacatttgtgttctcgatgatctggagcgtgtgtgccagtgtggacgaagagggtaggaagcggatcgactcgtacctccgcgaaatagagggttcattcccaaacaaagacactgtgtacgagtacttcgtggatcccaaaataaggagttggacatctttcgaagacaagctccccaagtcctggaggtacccccctaacgcccccttctataaaattatggtcccgaccgtagataccgtgcgctacaattacctcgtgtcttcacttgtggcaaaccagaaccccattctgctagtgggccctgtaggtacaggcaaaacgagtatcgcccaaagcgtccttcaaagtctgcccagtagtcagtggtccgtgttagtagtaaacatgagcgcccagaccacctcgaataacgtacagtccataatcgagagccgggtggagaagcgcacaaagggtgtgtatgttccctttgggggaaagtcaatgattacgttcatggatgatctcaacatgccagctaaagatatgtttggttcacagccgcccctcgagctgatcaggctctggatagactatggcttctggtatgatagaacaaagcagactatcaagtacatccgggagatgtttttgatggccgccatgggcccccccggtggaggacgaaccgtgattagtccacgcctgaggtccaggttcaatattatcaatatgacctttccgacgaaatcccagatcatccgaatcttcggcacaatgataaatcagaagctgcaggacttcgaagaagaagttaagccgatcggcaacgtggtgacagaagcaaccctggacatgtataacacagtcgtacaaagattcctccctacacccacaaagatgcactacctttttaatcttcgggacatttctaaagtgtttcagggcatgctgcgcgctaacaaggactttcatgacactaagagctccatcacaagactgtggatacacgagtgctttcgggtcttctctgaccgactggtggatgctgctgatactgaggcctttatgggcatcatctcagataagctaggttcctttttcgatctgacttttcatcacctgtgcccttctaaacggccgcccatctttggtgatttcctgaaagagccaaaggtgtacgaagatctcacagatcttacggttctaaaaaccgtgatggagacagctctgaatgaatacaacctgagtccttctgttgtgcctatgcagctggtgctgtttagggaggctattgaacatattacacgtattgtgcgcgtcatcggacagcccagaggaaacatgttacttgtcgggattggaggcagtgggcggcagtctttagcccgtctcgcaagctcaatctgcgactacaccacttttcagatcgaagtcacgaaacactacaggaagcaggaattccgcgacgatatcaaaagactttatagacaagccggagtagaacttaaaaccacaagctttatttttgttgacacgcagatcgcggatgagagttttctggaagacatcaataatatcctatccagtggggaagtgccaaatttatacaaaccagacgaattcgaagaaatccagagccacatcatcgaccaagccagagtcgagcaggtgcccgagtcctctgacagcctctttgcctacctgatcgaaagggtccagaataacctgcacattgttctgtgcctctccccgatgggcgatccctttagaaattggattcggcaatatccagcactggtcaactgcaccactattaactggttttccgagtggccccaggaagctctgcttgaagtcgccgaaaagtgtcttatcggcgtcgatctgggaacgcaggagaacattcacaggaaagtcgcacaaatcttcgtaacaatgcattggtcggttgcacagtactcacaaaagatgctgttagagctccggagacataactatgttactccgactaagtatctggaacttctgagtgggtacaagaagctccttggcgagaaacgccaggaacttctggcacaagcaaacaagttacggacaggcctcttcaaaattgatgagactagggaaaaggtgcaggtgatgagtcttgagctggaggacgcaaagaaaaaggttgccgagttccagaagcaatgtgaggaatacttggtgataattgtgcagcagaagcgggaagccgatgagcagcagaaagcccttgagagtctcaacaagaaagacataggcgaaatcaaatcctacggcaggccacccgcccaggtggagattgtcatgcaagccgtcatgatcttgcgcggtaacgaaccgacatgggctgaagccaagcgtcagttaggagagcagaatttcataaagagtctaataaatttcgacaaagacaatattagtgacaaagtgctcaaaaaaattggcgcatattgcgctcaacccgatttccagcctgacatcatcgggagagtgtccttggccgctaaaagcctctgtatgtgggttcgggccatggagttgtacgggaggttgtaccgggtagttgagcccaaacgcatacgcatgaatgctgctctggctcaactcagagagaaacaggcagccttggctgaagcacaggagaaactgcgggaagtcgctgaaaaactggagatgctcaaaaagcagtacgatgagaaactggcccagaaggaggagctgcgcaagaagtccgaggaaatggagctgaaactggagagagcgggcatgctggtgtccgggttggccggtgagaaagctcgctgggaggagaccgttcagggtcttgaggaggatctgggatacttggtcggcgactgtcttttggctgctgcctttcttagctacatgggacctttccttaccaattaccgtgatgagattgtgaatcagatctggattggaaagatctgggaattgcaggtgccatgcagtcccagcttcgcgattgataacttcctttgcaatcctaccaaagtgcgggattggaacattcaggggttgccgtctgacgccttctctactgaaaatggtataatcgttacacggggaaatcgctgggcgcttatgattgatccccaagcacaggccttaaagtggattaagaatatggagggaggccagggcctcaagataatagacctgcagatgtctgactacctccggatactggaacacgccattcatttcggctacccagtgctgctccagaacgtgcaagaatacttagatcctacactgaaccccatgcttaacaagagtgtagcccgcatcggcggcaggttactaatgaggataggcgataaggaggtagagtataacacaaatttccgtttttatatcacaacaaagctttctaatcctcattacagtccagaaacatctgccaaaaccaccatagtgaattttgcagtcaaagaacagggtttggaggcacagttactggggatagttgttcgcaaagagaggccagagcttgaggagcagaaggattccctggtgattaatatcgccgccggtaaacgaaaactgaaggaactggaggatgaaatccttagactgctaaatgaggctactgggtcccttctcgacgacgtgcagctggtaaataccctgcacacaagtaaaattaccgcaacggaggtgacggaacagctggagacttccgagaccaccgaaatcaacacggacctggcaagggaggcctacagaccatgtgcacagagggccagcattctgttcttcgttttgaatgacatgggatgcattgaccccatgtatcaatttagcctcgacgcatacatctctctgttcatcctatctatcgataagtcccaccggtccaacaaactggaggacagaattgactatcttaatgactaccacacctatgccgtgtacagatatacgtgtaggactctgttcgagagacataaactgctgttttcttttcatatgtgcgctaaaatcctcgagacctcaggaaaactgaacatggatgaatacaacttttttctgcggggcggcgtcgtcctcgaccgcgagggtcagatggataatccgtgtagcagctggttggccgacgcatattgggataacataaccgaactggataaactgacaaactttcacggcctgatgaactctttcgagcagtacccgagagactggcacttgtggtatactaacgcagctccggaaaaggcaatgctgcccggagagtgggaaaacgcatgcaatgaaatgcagcgcatgctaattgttcgtagtctccgtcaggaccgtgtggcattctgcgtgacaagtttcatcataacaaatctgggaagtcggttcatcgagcccccagtgcttaacatgaaatccgtgctcgaggacagcacccctcgctcccccctggtatttattctgagcccaggcgtggaccctacgtccgctctcctgcagctggcagagcatatgggcatggcacaacgctttcacgccctcagtctcggacagggacaggctcctatcgctgcacggctactgcgcgagggcgttactcagggccactgggtgtttttggcgaattgtcacctttccttatcctggatgcccaaccttgacaagctggtggaacaactgcaggttgaagaccctcacccatcatttcggttatggttgagtagtatacctcaccccgacttccctatctccatacttcaagtgtccattaagatgaccaccgagccaccaaagggcctaaaagcaaatatgacaagactgtaccagttaatgtcagagccccagttcagtcgctgcagcaaaccggctaagtataagaagttgctgtttagcttatgtttttttcacagcgtgttgctggagagaaaaaagtttctgcagctgggatggaacatcatttacgggttcaacgactccgattttgaggtcagtgagaacttgctgtcactctacttggatgaatacgaggaaaccccctgggatgctttaaaatatcttatcgcagggatcaattacgggggacacgtgaccgatgactgggaccgccgactcctcaccacgtacattaatgattacttctgcgaccagagcctctcaaccccttttcatcgattaagcgctctagaaacttacttcatccctaaagatggatctctggcgagctacaaggaatatatctctctcttgcccggcatggacccacctgaagcatttggacagcatccaaatgccgatgttgcatcccagattaccgaggcccagacgctgtttgacactctcttatcactgcagccccagatcacacccacccgggctggaggccaaacacgtgaagagaaggtgcttgagttagctgcagacgtcaagcagaagattccagaaatgattgattacgaagggacccaaaaactacttgcgcttgacccctccccgctgaacgtcgtgttgctgcaagagatacagcgctataacactctgatgcaaactatcttgttctctcttaccgatctggaaattccctcttgcgtatcccacaagtcagaacgagtagtgctcgagctcagcgccgtcaaacacccccgacagtag

SEQ ID NO: 115240 - DNA, 13284 bp, Artificial Sequence
  Description of Artificial Sequence: Synthetic coding sequence
atgagtagcaaagcggagaaaaagcagagacttagtgggagaggttccagtcaagcctcttggtccggtcgggcaacgcgggcagcagtagccacccaagagcagggaaacgcacccgccgttagcgagcccgaactgcaggctgagctacctaaagaagagcctgagccgagactggaagggcctcaggctcaatctgaggagtcagtagagcccgaggcggatgtgaaacccctcttcctgagtagggctgctctgaccgggttggcagatgccgtgtggacacaggaacatgatgccatcctcgagcacttcgcgcaggacccaacagagtcaatcctgaccatcttcattgatccatgctttgggctgaagcttgaactggggatgccggtacaaacccagaatcaactggtctactttatacggcaggcacctgtcccaattacctgggaaaacttcgaggccacagtccagttcgggacagtaaggggtccttacattcccgcactgctgcgcctgttagggggggtattcgccccccagatcttcgcaaatactggatggcctgaaagtatcagaaatcacttcgcttctcacctgcacaaattcctggcttgtctgacagacacacggtataagttagagggccacacggtcctgtatattcccgctgaggctatgaatatgaagcccgagatggtaatcaaggacaaagagctggtgcagaggctagagaccagtatgattcactggaccaggcaaatcaaggaaatgctgagcgctcaagaaacagtggaaacaggtgagaacctgggacctctagaggagatcgagttctggcggaatcgctgtatggacctctccggtatctcaaaacagctcgtgaaaaagggagtgaagcatgtggagagcatcttgcacctcgccaaatcttcctatttggcgccttttatgaaattggcacagcaaatccaggatggcagccgccaggctcagagcaatttgacctttctgtccattctcaaggagccgtatcaagaactggccttcatgaaaccaaaggatatttcaagcaaactgcctaagctcattagcctgatccgcatcatctgggtcaacagcccccactataataccagagagcgcctgacttccctattccgcaaagtttgcgattgccagtatcactttgccagatgggaagatggtaagcagggaccattgccgtgcttttttggagcccaaggccctcaaattacccgaaacctgcttgagatcgaggacattttccacaagaacctacatacactgcgggcggtgaggggaggtattctggacgttaagaatacttgttggcacgaagactacaacaaattcagagctggcatcaaagaccttgaggttatgactcaaaacctcatcacctcagccttcgaactcgtacgtgacgtacctcacggagtgctcctgcttgacacatttcatcgactggctagccgggaagccattaaacgcacctatgataagaaggcagttgacctatacatgctgtttaactctgagttagcgctggtgaaccgagaaagaaacaagaagtggccagacctggaaccctatgtcgcccagtattctgggaaagccaggtgggtacacatcctgagacggagaatagaccgcgtcatgacttgcctggcaggcgctcactttctcccacgcatcgggacaggaaaagagtctgtccacacctatcagcagatggtccaagccatcgatgaactggtcaggaaaaccttccaggagtggacttcctcactagataaggattgcatcagaagactggacacccctttgctgagaataagtcaagaaaaggctgggatgctggatgttaacttcgacaagtctctgttaattctattcgctgaaatagactactgggaacgactgctgttcgaaacaccccactatgtggtcaacgtcgctgaaagagcggaagacctgcgcattctccgcgagaatctcctgttggtagcccgagactataaccgcattatagccatgttgagtccagatgaacaagccctatttaaggaacggattcgcctactcgacaaaaaaatccacccaggtctgaagaagctgcactgggctttaaagggggcctccgccttcttcatcacagagtgccgtatacacgcctccaaggtccaaatgattgttaacgaattcaaagccagtactctcacgattgggtggagggcccaggagatgtccgaaaaactgttagtgcgcatatctggtaagcgtgtctatcgcgatttagagtttgaggaggaccagcgggaacatcgggccgccgtgcaacagaaactgatgaacttgcaccaagatgttgtcacaatcatgactaactcatacgaggtgtttaaaaacgacggacctgaaattcaacaacagtggatgctttacatgatcagactcgatcggatgatggaggatgccctgcggttaaatgttaagtggagcctcttggaactctccaaagcaatcaatggggacggtaaaacctcacccaacccactgttccaagttctggtgatcctgaaaaacgatttgcagggtagcgttgcacaggtggaattcagcccaaccctccaaaccctggcaggggtggtcaatgatatcgggaatcatctcttttctactattagcgtgttttgtcacttgcccgatatactgacgaaacgcaagcttcaccgagagccaatccagaccgtggttgagcaggacgaggatatcaaaaaaattcagactcagatcagctccggaatgactaataacgctagtttgctgcaaaactaccttaagacttgggacatgtatcgggagatctgggaaatcaacaaggatagcttcatacatcggtatcagaggctcaatccaccagtatcgtcctttgtcgctgatatcgctcgctataccgaggtggctaacaatgtccaaaaggaagaaacagtgacaaacattcaatttgtcttgctcgactgcagccaccttaagttttcccttgtgcaacactgtaatgaatggcaaaacaaattcgcgacactgttgcgagagatggccgcgggtcggctgcttgagttgcacacatacttgaaggaaaacgctgaaaaaataagcaggcctccacagaccctggaggaactaggagtgagcctgcagctcgtggatgccctcaaacatgacctcgctaacgtggaaacccagatccctcccatccacgagcaattcgcaatcctggagaagtatgaggttccagtggaggacagtgtcctggagatgctggattctttgaacggggagtgggtggtgttccagcagaccctgctcgacagcaaacagatgttaaagaagcacaaagaaaaattcaaaaccggcctgattcacagcgccgacgatttcaaaaaaaaggcccatacactgttggaggactttgaattcaaaggtcacttcacttccaacgtcggttatatgagtgcgctcgaccagatcacccaggttcgcgccatgcttatggctatgcgggaagaagaaaactcactccgggctaacctggggattttcaaaattgagcagcctccctccaaggatctgcaaaacctggagaaggagctcgatgctttgcagcagatttgggagattgctagggactgggaagagaattggaacgaatggaagacaggaagattcctcatcctgcaaacggaaaccatggagactaccgcacacggcttgttcaggcggctgacgaaacttgctaaagaatacaaagatagaaactgggaaattatagagacaactcgcagcaagattgagcagttcaagcgcaccatgccgctaatcagcgacctgaggaatcccgcactgagagagcgacactgggatcaggtacgagacgagattcagcgggagttcgaccaggaaagcgaatcctttaccctcgagcagattgtagagttagggatggaccaacacgtcgagaagattggggagatcagtgcctcggccactaaggagctggccattgaggtggcgctacagaacattgctaagacctgggacgtgactcagcttgacattgtaccatacaaagataaaggtcaccaccggctcaggggaacagaagaagtctttcaggcattggaagacaaccaagttgccctttctacaatgaaggccagccgttttgtgaaagctttcgagaaagacgttgaccattgggagcgttgtctgtcccttatacttgaggtcatcgagatgatactaactgtgcaacgacaatggatgtacttggaaaatatttttctgggcgaggatatccgtaagcaactccctaacgaatccaccctgtttgaccaggtgaactccaactggaaggcaatcatggaccgtatgaacaaagacaacaacgctctgagaagcacacaccacccaggcctattagacacccttatcgagatgaacacaatccttgaggatatccagaaatcccttgatatgtatctagagacgaaacgacacatcttccctcggttctactttctgtccaacgacgacctcctcgagatccttgggcaatctcgcaatcccgaagctgtgcagccccatctgaaaaagtgctttgacaatattaaactgctgcggattcaaaaagtcgggggcccaagcagcaagtgggaggcagtgggaatgttttccggggacggtgaatatattgatttcctgcattccgtctttctggagggtccggtcgagagttggctgggcgacgtcgagcagacgatgcgggtgaccctcagggatctcttgagaaattgccacctggccctgcgcaagttcctgaacaagagagataagtgggtgaaggaatgggccgggcaagtggttattactgcatcacagattcagtggaccgccgacgtgacaaagtgcctcctcacggccaaggaaagagccgacaagaagatcctgaaggtgatgaaaaagaatcaggtgagcattttgaataaatactctgaggctattcgggggaaccttacaaaaatcatgcgtcttaaaatcgtggctctcgtcaccattgaaattcatgcccgcgatgtcctcgagaagctgtacaaatccggtttaatggatgtgaatagttttgactggttaagccagttgcggttttactgggaaaaagatcttgacgactgtgtgatacgccagacaaacacccagtttcaatacaattacgaatatctgggcaattccggacgtcttgtgatcacaccactgacagatagatgctatatgacactgactaccgcactgcatctgcatagggggggaagtcctaaaggccccgcaggcactggcaagacagagacagtgaaggatctcggaaaagcactaggcatttatgtgatcgttgtgaactgctctgaaggcctggattataagagtatgggacgaatgtatagcggcctagctcagaccggagcttggggttgttttgacgagttcaaccggattaacatcgaggttctgagtgtggtagctcaccaaattctgtgtattctctccgctctcgccgctggtctgacacatttccatttcgacgggttcgagatcaatctcgtatggagctgcgggatatttatcaccatgaaccccgggtatgcaggtcgcaccgagctgccagagaacttgaagagtatgtttagacccatcgcaatggtggtgccagatagcaccctgatagccgaaattattcttttcggcgagggcttcggaaactgcaaaatattggccaaaaaggtatacactctgtatagtctggctgtacaacaacttagccggcaggaccactatgacttcggtctgcgtgctcttacctcgcttcttcggtacgcgggaaaaaagaggaggctgcagcctgatctcacagatgaagaagtcctgctcctctctatgcgcgacatgaatatcgccaagcttacatcagtggacgccccattgtttaatgccatcgttcaagacctgtttcctaacatcgaactccccgtcatagattacggcaagctgcgggaaactgtggagcaggaaattcgtgatatggggctgcagtcgacaccctttacactgacgaaagtgtttcagctgtatgagacgaagaattcccggcactccacaatgatcgtcggatgcacaggcagcggcaaaacagctagttggaggatcctgcaggccagtttgtcatctctatgtcgcgccggcgatccgaactttaacatcgtaagggagttccccttaaatcccaaggcactgtccctcggcgagttgtacggagaatatgatttgagcacgaatgaatggacagacgggatccttagctcggtgatgcgtacagcatgcgctgacgaaaagcccgacgagaaatggattttattcgacggtcccgtagacacgctttggattgagaatatgaattccgtgatggacgataataaagtgctgaccctcataaatggcgagcggatcgccatgccggagcaagtgtcattgctgttcgaggtggaagacctggctatggcctcaccagccacggtgtccaggtgcggaatggtgtatacggattacgccgacctcgggtggaagccgtatgtccaatcatggctcgagaagcggcctaaagccgaggtggaacctcttcagaggatgttcgagaaattgattaataagatgcttgcctttaaaaaagataactgcaaggaattagtacctctccccgagtactctggcatcactagcctgtgcaagctgtactcggcgttagccactcccgaaaatggggtcaacccagccgacggggaaaactatgttaccatggtcgagatgacatttgtgtttagcatgatttggagcgtgtgtgcttcggtcgacgaagaaggaaggaagcgcatcgattcctacctccgagaaatcgagggctcattccccaataaagatacagtctatgagtactttgttgatccaaagatacggtcttggacaagttttgaagacaagctcccgaagagctggagatatccccctaacgcccctttttacaagatcatggtgccaacagtcgacacagtgcgctacaactacctcgtatcctctctggtggccaaccagaacccaatcctactggtgggaccagtagggaccgggaagacctccattgcccagtccgtgctgcagtctttgcccagtagccaatggtcagtgctcgtggtcaatatgagcgctcagacaacttctaacaatgtgcaatctattattgagagcagagtggagaaacgaacaaaaggcgtgtatgtgcccttcgggggaaagtctatgattacttttatggacgacctcaatatgccagcaaaagacatgttcgggtctcagccccccctggagctcatccggctttggatagattacgggttttggtatgacaggacaaagcaaaccatcaaatacattcgcgagatgtttcttatggcagctatggggccccctgggggcggtcgcactgtcatttctccccgcctgaggtcaaggttcaatatcatcaatatgacgttccctacaaagagccagatcatccgcatttttggaacaatgatcaaccagaaattgcaagattttgaggaagaagtgaaacctatcggtaatgtggttactgaagccacactggatatgtacaatacggtcgtgcaacggttcctcccaacacccaccaagatgcactacctctttaacttacgtgatatttcaaaggtgttccaaggtatgctcagagccaacaaagacttccacgacacgaaaagtagtatcacgcgtctctggatccatgaatgttttcgggtgttctccgataggctggtggatgccgcagatactgaggcctttatggggataatctcagacaaactgggctcatttttcgacttgacttttcatcacctctgtccctcaaaacggccgccaatcttcggggacttcttaaaggaacccaaagtttacgaagacctcaccgatctaactgtgctcaaaactgtgatggagacggccctgaacgagtacaaccttagcccaagtgttgtgccaatgcagctggtgttgtttcgcgaggccatcgagcatataacccggatagtcagggtgatcggccaaccgcgcggaaacatgctgctggtgggaatcgggggttctggcagacaaagccttgcccgactcgcatcaagcatttgcgactacactacctttcagatagaagttaccaagcattaccgcaaacaagagttcagagatgatatcaagcgtctgtaccggcaggccggtgtcgaattaaaaactacctccttcatcttcgttgatacccagatcgcagacgagtcattcctcgaagatattaacaacatattatcatcaggggaggtgcccaatctgtataaacccgatgagttcgaagaaattcagagtcacatcatagaccaagcaagggtcgaacaggtgccagaatcatccgacagtttatttgcttacctcatcgagcgcgtccagaataacctgcacattgtgctctgtcttagcccaatgggtgaccctttcaggaactggattagacagtaccccgcactggtcaactgtaccactattaactggttttcggagtggccccaggaggctctcctggaagtggctgagaagtgccttatcggggtcgaccttggaacccaagagaacatccatcgcaaagtcgcacagatatttgtcacaatgcattggtctgtcgcccagtactcacagaaaatgttactggaactgcgtagacacaactacgtaacgccaacaaagtatctcgaattactgtccggctacaaaaaacttttgggcgagaagaggcaagagctcctggcccaggccaacaagctgaggactgggctgttcaagattgacgaaactagggaaaaggtgcaggtcatgtcgctcgagctggaggacgctaagaaaaaagtcgccgagttccaaaaacagtgcgaggaataccttgttattattgtgcaacagaagcgggaggcggacgagcagcagaaggcagtcacagctaattctgagaaaatcgctgtggaagaaatcaaatgccaagctctcgctgacaatgcccagaaggatttggaggaggctttgcctgccttagaagaggccatgcgagctctggaatccctcaacaaaaaggatattggagagatcaaatcatatggtcggccacccgcccaggtggagatagtcatgcaggctgttatgatcttgagaggtaacgaacctacatgggcggaagccaaaaggcaattgggtgagcagaattttattaaatccctgataaattttgataaagacaacatcagcgataaagttctcaagaaaattggtgcgtattgcgcgcagcccgacttccagccagatattataggccgtgtcagtcttgcggcgaaaagcttatgcatgtgggtgcgtgccatggagctgtatgggagactctacagagtggttgaacccaaacgaatccgcatgaatgctgctctggctcaactacgcgaaaagcaggctgctttggctgaagcacaggagaagctgcgcgaagtcgcggagaaactcgaaatgctgaaaaaacagtacgatgaaaagttggcgcaaaaggaagagctgcgcaagaaatcagaggagatggaacttaagttagagagggcaggaatgttagtgagtggtcttgctggagagaaagcgaggtgggaagagaccgtccaaggccttgaggaagatcttggctaccttgtgggagattgtttgttagcagcggcgtttctaagttatatgggcccgttcctcactaattatcgtgatgaaatcgtgaaccaaatctggatcggtaaaatttgggagttacaagttccttgttctccctccttcgccattgacaatttcttgtgcaatcctacaaaggttagggattggaatattcaaggactgccatctgatgcgttcagcactgaaaacgggatcatcgttactagaggtaaccgttgggctctgatgattgacccacaagctcaggcgctcaagtggatcaagaacatggaaggcggacaaggattgaaaataatcgatcttcagatgtcagattacttgaggattcttgaacatgccattcactttggttatcccgtgttgctacagaatgtgcaggagtacctggaccccacactgaaccccatgctcaataagagcgtggcccgcattggaggtcgactcctcatgcgaattggcgataaggaggtggagtataatacaaatttccgattttacatcacaaccaagttgagcaacccccactactctccagagactagcgcaaaaaccacaatagtcaatttcgccgtcaaggagcaaggcctcgaagcgcagctcctggggatcgtcgtcagaaaggagcgtcccgaactcgaggagcaaaaagatagtttggtgatcaacatcgccgcaggcaagcggaaactgaaggagctggaggacgagatcttgcgactcttaaacgaggccaccggatccttactggatgatgtacagttagttaacaccttgcatacatcaaagattaccgccaccgaggtgacagagcagcttgaaaccagcgagacaacagaaattaataccgacctggccagagaagcataccgcccatgcgcccagcgggcctctattctcttctttgtcctgaatgatatgggatgcattgacccgatgtaccagtttagcctagacgcctacatcagcctctttattctgtcaatcgacaagtcacataggtcaaataaacttgaggacaggattgactacttgaacgactaccacacttacgcggtgtaccggtatacttgtcgaacactgttcgagagacataagctgctgtttagtttccatatgtgcgctaagatactagagacctcagggaagcttaacatggacgagtacaatttcttcctgagagggggcgtagttttagacagggagggtcagatggataacccatgttcaagctggctagccgacgcctactgggataacattaccgaactggacaagctaaccaattttcacggcctcatgaatagctttgagcagtatcccagggattggcacctctggtatactaatgcagcgcctgaaaaggccatgctacctggcgagtgggagaacgcttgtaatgagatgcaaaggatgctgattgtacgctccttgcgacaggatcgggtcgcattctgcgttacatccttcattattacaaatctggggtcccgctttattgaacctcctgtgcttaatatgaaaagcgtgctcgaggatagcacccctagatcccctctggtgttcatcctttccccgggcgtggatccaacctcagctctgttgcaactggcagaacatatggggatggctcagcggtttcacgcactctcactgggtcagggtcaagcgcctatcgcagcacggttacttagagagggagtcacccagggacattgggttttcctggccaactgccatctgtccttgtcttggatgccgaaccttgataaactggtcgagcaactgcaggtggaagatccccatccctcttttaggctgtggttaagttcgattccacatcccgacttcccaatttctatcttgcaggtgtccatcaaaatgacaactgagccacccaaaggcttgaaggcaaatatgacacgcctgtaccagttgatgtccgaaccacagttctcccggtgcagcaagcccgctaagtataaaaagctcttgttctccctgtgcttcttccacagcgtgctgctggagaggaaaaagttcctgcagttgggctggaacattatttacggttttaacgactcggactttgaggtcagcgagaatcttctgagtctctatctggacgaatacgaggagactccttgggacgcgcttaagtacctcatagctggcatcaattatggagggcacgttaccgatgattgggataggcggctcctcaccacttatatcaacgattatttctgcgatcagtcactgagtacacccttccacaggctaagcgcactcgagacctatttcatccctaaggacggatctctcgcatcttataaagagtacatcagccttttgccgggcatggatcccccggaagcttttggtcaacaccccaacgcagatgtggcttcccaaatcaccgaggcgcagaccctctttgacacccttctgagcctgcagccccaaatcacgcccacaagagctggggggcaaacacgggaggaaaaagtgttagagctggctgcggacgtcaagcagaagatacccgagatgattgactatgagggtacgcagaagttgttagccctggacccttcacctcttaatgtcgtgttgctgcaggagattcaacggtacaacactcttatgcaaaccatactgttttcgttgactgacctcgaaaaggggattcagggcttgattgtcatgtcaacatcccttgaagaaatctttaattgtatcttcgacgctcacgttccccctttatggggtaaagcttaccccagtcagaaacccctggccgcttggacacgagacctagccatgcgggtcgagcaattcgaactatgggcatctagggcccgtccccctgtgatattttggcttagtggtttcacatttccgactggtttcctgactgcagtgctgcagagctcagcccgtcagaataacgtctcagtggactcgttgtcctgggaatttatcgttagtacggtcgacgacagcaacctcgtctatcctcccaaggacggtgtgtgggtgagaggactctacctggagggagcaggatgggataggaagaactcttgtctggtcgaggccgaacccatgcaactggtatgcttgatgcctacaattcactttcgtcccgctgagagcagaaaaaagagtgccaagggcatgtactcatgtccatgttactactatcccaaccgggcaggttcttccgatagggcctcctttgtgatcgggatcgatctgcggtcaggcgcaatgacacccgatcattggattaaaagggggacggctctgctcatgagtctggattcatag

SEQ ID NO: 115241 - DNA, 12351 bp, Artificial Sequence
  Description of Artificial Sequence: Synthetic coding sequence
atgggcgccacgggacggctggagctcactctggctgcgcccccccacccagggcccgcattccagcgatccaaggctagagagactcagggggaggaagagggtagcgaaatgcaaatagccaagtcagattctatacatcatatgtcccattctcaggggcagccagaattgccacctcttcccgctagtgccaacgaagaaccatccggtctctaccagaccgtgatgtcgcactctttttaccctcctctaatgcagcgaaccagttggaccctggccgcaccctttaaggagcagcaccaccatcgaggtccatctgacagtatcgctaacaactacagtttgatggcccaggatctgaagctgaaggatctgctgaaagtgtaccaacccgccactatctctgtgcccagagacagaacaggccaaggattgccaagttcgggcaaccgctccagtagcgagcccatgcgcaaaaagactaaattttcttccaggaacaaggaggattctacaagaattaaactcgcctttaaaacgtccatattttccccgatgaagaaggaggtgaagaccagcctgacatttcctggttcacggccaatgtcccctgaacagcaacttgatgtgatgctccagcaagaaatggagatggaatcaaaggagaagaagccatccgaatctgaccttgagcggtattattattaccttactaacgggatcaggaaagacatgatcgcccccgaagagggagaggtaatggttcgtatctccaagctcatctccaatactctgctcacatctcccttccttgaacccttgatggtggtcctcgtgcaagagaaagagaatgattattactgctccctcatgaagagtattgtggattacatcctaatggatccaatggagcgtaagcgcctgtttatcgagtctatccctcgcctatttccacagagggtgatacgggcgccagttccgtggcattcagtatataggtccgccaaaaagtggaatgaggagcatctgcataccgtaaacccaatgatgctgaggctgaaggagttatggttcgctgagttcagagatcttcggtttgtgcgcaccgccgagatactggcaggcaaattgccgttacaaccccaggagttttgggatgtgattcagaagcactgcttggaggcacaccagacattgctcaataaatggatccccacttgcgcacagctgtttacaagtagaaaggaacactggattcactttgcccctaagtccaactatgacagcagccggaacattgaggaatattttgcgtctgttgctagctttatgtccctgcagttgagggagctcgttatcaaatccctcgaggatttagtgtcactgttcatgattcataaagatggcaatgactttaaggagccgtatcaggagatgaagtttttcatcccccagctgataatgatcaagcttgaagtgagcgagccaatcattgtttttaaccctagctttgatggttgctgggagttaattcgagattcttttctagaaatcattaagaattctaatggaatacccaaactcaagtatattcctcttaagttttcattcacagcagctgcagccgaccgccagtgtgtgaaagccgccgagcccggcgaacccagtatgcatgcggcagccacagccatggcagagttaaaaggctacaatttactgctcgggaccgtgaacgctgaggaaaaactcgtatccgattttctgatccagacattcaaggtcttccagaaaaaccaggtgggaccttgcaaatatctgaatgtgtataagaagtacgtcgacctactggacaacactgcagaacaaaacatcgcggcttttctgaaagagaaccatgacatcgacgacttcgtaacaaagatcaacgctataaaaaagcgcagaaatgagatagcctcgatgaatatcacggttccactggcaatgttctgccttgacgctactgccctaaaccatgacttatgtgagcgggcccagaatctgaaggaccaccttattcaatttcaagttgacgtcaatagggacaccaacactagtatttgcaatcaatactcacacatcgccgataaagtgtcagaagtgccggctaataccaaagaattagtgagtcttatagaatttctcaagaagagtagtgccgtcactgtgtttaaactacgaaggcagctgagggatgcctccgagaggctcgaattcctcatggattatgctgatctgccttaccagatcgaagatattttcgacaacagccgtaacctactccttcacaagagggaccaagcagagatggacctcattaagcggtgttctgaattcgaattgaggctcgaaggctatcaccgcgagctggagtcatttcgaaaaagggaggttatgacaacagaagaaatgaagcataatgtagaaaagctcaacgagctgtccaaaaacctcaaccgtgcttttgctgagttcgaactgattaacaaagaagaagagctgctggaaaaagaaaaaagtacctacccactgctgcaggcgatgctgaagaataaggtgccttatgagcagctgtggtccactgcatacgagttttctatcaagtccgaagaatggatgaatggccccctttttctgctcaacgcagaacagatcgccgaagaaattggcaatatgtggcgtaccacctacaaactgatcaagaccctgagtgatgtgcccgcgcccagacggctcgcagaaaacgtgaagattaagatcgataagttcaaacagtacatccctatactgtctatttcgtgtaatcccgggatgaaggaccgacattggcagcagatctctgagattgtaggttatgaaattaagcccactgaaacgacttgtctcagcaatatgctagaattcgggtttgggaagttcgtggaaaaactcgagcccatcggcgcagctgcaagtaaagaatactcattagaaaaaaatctggaccgcatgaagcttgattgggttaatgtgacgtttagcttcgtgaaatatcgcgataccgacaccaatattttatgcgcaatcgatgacattcagatgttgttagacgatcatgtgatcaagacccagaccatgtgcggaagtccttttatcaaaccaatagaggcagaatgtaggaaatgggaggaaaagctcattcggattcaggataatcttgatgcatggctgaaatgccaggcaacatggttgtacctcgagcctatattttctagtgaggacattatcgcccagatgccagaggaaggccgtaaattcggtattgtcgattcatactggaagtctctgatgtctcaggcggtcaaagataatcggattttagttgccgccgaccagccaagaatggccgaaaaacttcaggaggccaattttttattagaagacatccagaagggactgaatgactacctggagaaaaagcgcctgtttttcccaagattcttctttctcagcaatgacgaacttttggagattctgtcagagaccaaagatcctctgagagtacagccacatctaaagaaatgtttcgagggcatcgctaagctggagtttaccgataaccttgaaatagtgggcatgatttccagcgagaaagaaaccgtgccctttattcaaaagatataccccgcaaacgctaagggcatggtcgaaaagtggttgcagcaggtcgagcagatgatgttggccagcatgcgggaggtcattgggttgggaatcgaggcctacgtgaaagtccctcgaaatcattgggttctccagtggccaggccaggtggtgatctgcgtgtcaagtatcttttggacacaggaagtttctcaggccctcgccgaaaataccctgctggacttcctcaagaagtcgaacgaccagatagcccaaatagtccaacttgtccgcgggaagctgtcgtcaggcgccagactaacactgggcgccttgaccgttattgacgtccatgctcgggatgtcgtcgcaaagctatctgaggatagggtctctgacctgaatgactttcagtggatctcccagctgcgctactattgggttgccaaggatgtacaagttcagataataactaccgaagccctctacggatatgagtacctaggaaatagtcctagattggtcattaccccgttgaccgacagatgctatcgaaccctgatgggcgccctcaagctgaacttaggcggcgctccggaaggacctgcgggtactggtaaaaccgagaccactaaggacctggccaaggcgctggcgaaacaatgcgttgtctttaactgtagcgatggcctggattacaaggctatgggcaaattttttaagggactggcacaagccggggcctgggcctgtttcgatgagttcaatagaatcgaggtggaggttttgtcagttgtggcccagcagattctaagcattcagcaggccatcatccgaaaactgaagacctttatatttgaaggcactgagttgtctttgaatcccacctgcgcggtgtttatcactatgaacccaggctatgcgggccgcgcagagcttcccgacaaccttaaggctctatttagaactgtagcaatgatggtgccggattatgctctcattggcgaaatttccctgtacagcatgggctttctggattcaaggagcttagcacagaagatcgtggccacgtataggttatgcagcgagcagctctcgtctcaacaccactatgactacggcatgcgcgctgtgaagagcgtgcttacagccgccggcaacctgaaactgaagtatccagaagaaaatgaatcagttctgctcctgcgagcccttctggatgtgaatcttgccaagttcctggcccaggacgtacccctcttccaagggatcatttcagatctctttccgggcgttgtactcccgaaaccagactacgaggtgtttctcaaggttctgaacgacaacattaaaaagatgaaactccagccagtgccatggtttatcggcaagattatacagatctatgaaatgatgctcgttaggcacggctacatgatcgtaggtgatcccatgggtgggaagacaagcgcatataaggtcttagccgccgcactgggtgacttgcacgctgcaaaccagatggaggagttcgctgtagagtataagattatcaatccaaaagctattacaatgggccaactttacggatgtttcgaccaagtgagccatgagtggatggatggggtgctggctaatgccttccgcgagcaggctagcagcctgtccgacgaccggaaatggatcatttttgacggacccgtagatgcgatctggatcgaaaacatgaacactgtgctcgacgataacaagaaactgtgcctcatgagcggggaaatcatccagatgaacagtaaaatgtcgctgatctttgagccagccgatttggagcaggcctctccagcaacagtatcccgctgtggcatgatttacatggagccgcaccagcttggctggaagccactcaaggattcttacatggacactctgccatccagtctgaccaaggagcacaaggagttagttaatgacatgttcatgtggcttgtgcaaccttgtctggaattcggaagactgcactgtaagtttgtagtacagaccagtccaattcacctcgcctttagcatgatgaggctgtacagctcattattagacgagatccgcgcagtggaggaagaagaaatggaactcggagaggggttgtcctctcaacagatcttcttgtggctccagggcctgttcctattctccctggtgtggaccgtcgcaggcacaattaatgcagattcaagaaagaagttcgatgttttcttccgcaatctgatcatgggcatggatgataatcatccgaggcctaaatccgtgaaattgactaagaacaatatctttcccgaaaggggctcaatttacgatttttactttatcaagcaggcaagtggccattgggaaacctggacccagtatatcacaaaggaagaagagaaagtaccagctggagcgaaagtgagcgagcttatcatccccaccatggaaacggcgcgtcagtcattctttctcaagacatacctggaccacgaaatccccatgctgttcgtcggacctacaggaaccggcaagtcagcaattactaacaatttcctgctgcacctgcctaaaaacacttacctgccaaactgcatcaatttcagtgcacgcacttcggctaatcaaactcaagatataattatgtccaagctggaccggaggcggaagggattgttcggccctcctatagggaagaaagcagtggtcttcgtcgacgaccttaacatgccagccaaggaggtttatggtgcacagccacctatcgaactactaagacaatggattgaccacggatactggttcgataaaaaggatacaacgaggctggatatagtcgatatgttgttagtgaccgcaatgggaccccccgggggcggtagaaatgacattaccggacgattcaccaggcacttgaacattatcagtataaacgcctttgaggatgacatactaactaaaattttcagcagcatagtggattggcacttcggtaagggtttcgatgtcatgttcctgaggtatggtaagatgctcgttcaggccacaaaaacaatctacagggacgcagttgagaattttctgccaacacctagcaagagtcattacgtgttcaacctgcgagacttcagccgcgtgatacagggagtgctgctctgcccacatacccacctgcaagatgttgagaaatgcattcgcctgtggatccatgaggtgtaccgcgtgttttatgatcgcttgatcgataaggaagacaggcaggtgttttttaacatggtgaaagaaaccacttccaactgctttaagcagaccatcgagaaggttctgatacatctttcaccgactggaaagattgttgatgataatatcagaagtctgtttttcggtgattatttcaaacctgaaagcgaccagaaaatttatgatgaaatcactgacctgaagcaactcacagtggtaatggaacactacctggaggaattcaataatatatccaaggctccaatgagcctggtgatgttcagattcgcgatcgaacacatctctcggatttgccgggtgctgaagcaggataagggacacctacttctcgtcggtataggcggcagcggacgtcagtccgccgctaaactgtctactttcatgaacgcgtatgaattatatcagatcgaaatcacaaagaattacgccggaaacgactggcgcgaggacttgaagaaaattatcctccaagtgggcgtggcgaccaaatcaacagtctttctgtttgctgataaccaaattaaagatgagagttttgtggaggacatcaatatgctgttgaacacaggagatgtgcccaacatttttcctgccgatgagaaggcagacatagtggaaaagatgcagaccgcagcccgcactcagggggaaaaagtggaggtgacgcctttgtcgatgtacaattttttcattgagagggtgatcaacaagatctcttttagcctcgccatgtctcccattggcgacgcctttcgcaaccgtctcagaatgtttccttccttgatcaactgctgtacaatagactggttccagagctggcccactgatgccctggaactggtggccaacaagtttttggaagacgttgagcttgacgataacatccgggtcgaggtggtctctatgtgtaagtatttccaggaatccgtaaagaaattatctctggactattataataaactcagaaggcataattatgttactcctacttcctacctagagctgatccttacgttcaagacacttttgaacagcaagcgtcaggaagttgcgatgatgcgcaaccggtacctgactggcctccagaaattggactttgccgcttctcaggtggccgtgatgcagagagaactcaccgccctgcagcctcaactgatcttgacctccgaagagacggctaaaatgatggtcaagatagaagccgagacccgagaggctgacggcaagaagctgttagtgcaggccgacgaaaaggaagccaacgtggccgcagctatcgcccagggtattaagaatgaatgtgaaggcgacctggctgaagccatgccagcactcgaagccgcccttgcagcactcgatacactgaaccctgctgacatcagtttagtgaagtcaatgcagaatcctcctggacccgtcaagctggtcatggagtctatttgtatcatgaaaggcatgaaacctgaacgcaaaccagatccgagcggaagcgggaaaatgattgaggattactggggcgtgtctaagaaaatattgggtgatctcaagttcttggagagcctgaaaacgtatgataaggataacattcccccacttaccatgaagcgtatcagggagcggtttattaaccatcccgaattccaacccgctgtaatcaagaacgtgtcctctgcttgtgagggcttgtgtaaatgggtgcgggctatggaggtgtacgatagagtcgctaaggtagtggcacccaagagggagcgcctccgggaagctgaggggaaactggctgcccagatgcagaagttaaaccaaaaaagggctgaactgaaattagtggttgaccgccttcaggcactgaatgacgatttcgaggagatgaatactaaaaaaaaagatctagaggagaatattgagatatgttcccaaaagctggttcgggcggagaaattaatatctgggttgggcggcgagaaagatcgatggactgaagccgctaggcagctaggcatacggtacactaatctgaccggtgacgtattgttgtccagcggaacagtcgcctaccttggtgccttcaccgtggactatagggtgcagtgtcagaaccagtggctggcagagtgcaaggataaggtgatccctggcttcagcgatttctctctctcacacaccctgggcgacccgattaagatccgtgcatggcagatcgcagggctgccagttgacagtttctcaattgataatggcataatagtgtcaaacagtagacggtgggcgttaatgatcgatccgcatggccaggccaacaaatggattaagaatatggaaaaagctaacaaactggctgtgatcaagttctccgatagcaactacatgcgaatgctggagaatgcacttcagttgggaacaccagttctcatcgaaaatatcggtgaagagcttgatgcctcaatcgagcccatcctcctgaaggccacctttaagcagcagggcgtggaatatatgcgccttggcgaaaatatcatagaatacagtagagactttaaactttacattaccacccggctgaggaacccacactatctgcctgaagtggcagtgaaagtgtgccttttaaatttcatgataacccctctcggcctccaagaccaactgctaggtatcgtcgccgctaaggagaaaccggagctcgaggagaaaaagaatcagttaattgtcgaatcagctaagaataagaagcatcttaaagagatagaggacaaaattctcgaagtgctgagtatgtcgaagggcaatatactggaggatgagactgccattaaagtgcttagctcttcgaaggtgctttccgaggagatcagcgaaaagcagaaggtggccagtatgaccgagactcagatagatgaaacacggatgggctataagcctgtggcagtccactcagcgacgattttcttttgtattagcgacctggcaaacatagagcctatgtatcagtactcgctgacttggtttatcaacctgtatatgcacagcctgacgcacagcactaaatctgaggaattgaatcttcggattaagtacattatcgatcacttcacactgtctatttacaataacgtgtgtcgttctctctttgagaaagataagctgctgttcagcctgttgttgacaataggcattatgaaacagaaaaaagagattaccgaagaggtatggtattttctgctcacaggagggattgccttagacaatccctacccaaacccagccccacagtggctttccgagaaagcctgggcagagatcgttagagcatcagccctgcccaagctgcacgggctgatggagcatctggagcagaatcttggagaatggaaactgatatacgactccgcatggcctcacgaagagcagttgcctggcagctggaagttttcccagggccttgagaagatggtgatcctgcgctgtctaaggcccgacaagatggtgcccgccgtccgagagtttatcgctgaacatatgggaaagctctacatcgaggcgccaactttcgacttgcagggctcatacaatgacagctcttgttgtgcccctcttattttcgtactgtccccctcagcagatcccatggcgggtctgctgaagtttgcagacgatcttggcatgggagggaccaggactcagacaatatctctcggccaagggcagggacctatagctgctaagatgattaacaatgccataaaggatggcacctgggttgtgttacagaactgccaccttgccgcatcttggatgcccacgctagagaaaatctgtgaggaggtcattgtccccgaaagtacgaatgcccggttccgactgtggctgacttcgtacccttccgaaaagttccccgtgagcatcctgcagaatggcattaaaatgacaaacgagccacctaaaggacttagggctaaccttctgcggagctatctcaacgacccaatctcagacccagtattcttccagagctgcgcaaaggcagtcatgtggcagaagatgctgttcggtctctgcttctttcacgccgtggtacaggagaggaggaactttggacccctgggctggaatatcccatacgagtttaacgagtctgacttacgcatttctatgtggcagatccaaatgtttctgaatgattacaaggaggttccctttgacgcgcttacttatctgactggtgaatgtaattatggcggtcgtgtaactgacgataaagacagacgactactcctgtcgttgctcagtatgttctactgcaaggagattgaggaagattactactctttagcccctggagacacatattacatccccccacacgggtcataccagtcatacatcgattatctgcgcaatctgcctataactgcacatcctgaagttttcgggttgcacgaaaatgctgatattaccaaagacaaccaggagaccaaccaactgttcgagggggtgctgctgactttaccgcgccagtccgggggaagtggaaagtcccctcaggaagtggtggaggagctggctcaggacatcctgagtaaactcccaagggatttcgatctggaggaagtcatgaaactgtatcctgttgtttatgaagaatcgatgaacactgtacttcggcaggaactgatccggtttaataggctgactaaggtcgttcgcaggtcacttattaatctgggacgcgcaataaaagggcaggtactgatgtcatctgaactggaggaggtcttcaatagtatgctggtgggaaaggtaccagctatgtgggctgcaaaatcatatccgagcctcaagccactgggaggctacgtggcagaccttctggcccgcctaacttttttccaagagtggatcgataaggggccccctgtggttttctggatcagcggattctacttcacccagtcctttctgaccggggtatctcagaattacgcaaggaaatatacgatacccattgatcatatagggtttgagttcgaggttaccccccaggagacagtgatggagaataacccagaggacggggcttatataaaggggctcttcctggagggtgcaagatgggataggaagacaatgcagataggtgagtccctgcctaagatcctgtacgacccgttacctattatttggctgaagcccggggaatccgctatgtttcttcatcaggatatctacgtctgccctgtgtacaaaacatcggctcgccgcggtacactatccaccaccggccatagcacaaattacgtgctcagcatcgagctaccaaccgacatgcctcagaagcattggattaacaggggagttgcaagcctgtgtcaactggataactag

SEQ ID NO: 115242 - DNA, 2262 bp, Artificial Sequence
  Description of Artificial Sequence: Synthetic coding sequence
atgggcgacatggactgtagctctcagaaaatcgcaaagtccgatagcattcaccatatgagtcactcccagggacagcccgaactcccacccctgcctgcatccgccaacgaggagccctcgggtctgtaccaaactgttatgtcacactcgttctaccctccactgatgcagcgcacctcatggaccctggccgctccttttaaggaacagcatcatcatcgcggtccctcggacagcattgcaaataattatagcttgatggctcaagacctcaagctgaaggacctactgaaagtctaccaacccgctaccattagcgtccctagggatcgcaccggccaggggctgccatcttcaggcaatcgttcctcctctgagcccatgcggaagaaaacgaaattctcaagtaggaacaaagaggactctacccggatcaagctggcattcaaaactagcatcttctccccaatgaaaaaggaggtcaagacctccctgaccttccctgggtcacgacccatgtctcccgagcaacaactggacgttatgctgcaacaagagatggagatggaatccaaggaaaagaagccttccgaatctgatttagaacgctattattactacctaaccaacggcatcagaaaggacatgattgctcctgaagagggcgaagtcatggtccgaatctccaagctcatctccaatacactgctgactagccccttcttagaacctctcatggttgtccttgtgcaggaaaaggaaaatgactattattgctctctgatgaaatctatagtggactacattctgatggatcctatggagcgaaagcgtctgtttattgagtcgattccccgcctgttcccgcagcgggtgatcagagcacccgtcccctggcattcagtttatcggtcggccaagaagtggaacgaggagcatctgcataccgtcaatccgatgatgttgaggcttaaagagctgtggttcgctgagttcagagacctgcggtttgtgagaacggccgagatcctggctgggaaactccctttacagcctcaggaattctgggacgtcatccagaaacattgcctggaggcccatcagacgcttttgaacaaatggatcccaacctgcgcccaactcttcacctcccggaaggagcactggatccacttcgcccctaagtcaaattacgatagttcccgcaacattgaagaatacttcgcatcggttgctagttttatgagcctgcagctccgcgaactcgtcatcaaaagtttggaagacctggtgtccttattcatgattcacaaagacggaaacgattttaaagaaccgtaccaggaaatgaagttctttatacctcaactaatcatgatcaagctggaagtgagtgaaccaatcatcgtgtttaatccttctttcgacgggtgctgggagctcattagagacagcttcctcgagattatcaagaacagcaacggaattcctaaggtggagtcagtgctcttccccgaactgaaagggtacaacttgctcctggggactgtgaatgccgaagaaaaattagtttcggatttcctgatccaaactttcaaagtctttcagaaaaaccaggtgggcccctgtaaatacttaaatgtttataaaaagtacgtcgatctgcttgataacacagcagaacaaaatatcgctgcatttctgaaggaaaaccacgacatagacgacttcgtcaccaagattaatgcaatcaaaaagcggagaaacgaaatcgcttctatgaacataacagttcctttggcaatgttttgcctggatgcgactgcccttaaccatgacctgtgcgagagagcccagaaccttaaagaccatttaattcagttccaagtggacgttaacagagacactaataccagcatttgcaatcagtattctcatatagccgacaaagtgagtgaagtgcctgccaacaccaaagaattagtgagcttaatcgagttcttgaaaaagtcttcagccgtgaccgtgttcaaactccgtagacagttgagggacgcttccgagcgtctggaattcctcatggattatgccgatctgccttacgaagatattaaactcaactcgaccctgttcttatggcctgatcagattgaagatatctttgacaattcccggaatctcttattacacaagagagaccaggcggaaatggatctcattaaacgctatcgtgaatctctgggcctgtcctggaagtag

SEQ ID NO: 115243 - DNA, 5664 bp, Artificial Sequence
  Description of Artificial Sequence: Synthetic coding sequence
atgggtgcaaccggccgtttggagctcacattggcggcccctccgcacccagggccagcattccaacggtccaaagccagagagactcagggtgaggaggagggctcagagatgcagatcgccaaatccgacagtatacaccacatgagtcactcgcagggacagcctgaactgccccccctgccggcctccgctaacgaagagccctccgggctgtatcaaaccgttatgagccatagcttttacccgcctctgatgcaacgaacttcctggacactggccgctccttttaaggaacagcaccatcaccggggccctagcgacagcatcgccaataactacagtctgatggctcaagacctgaagctaaaggacctgctgaaggtttaccagcccgccaccataagcgtgccacgagaccggacgggccagggcctgccgtcctctgggaacagatcatcctccgaacctatgagaaagaaaacgaagttttcgagtcgtaataaagaagatagtacccggataaagttagcattcaagacaagcatcttttctccgatgaagaaggaagtgaaaacttctcttacgttccctggcagccgaccaatgagtccagagcaacagctggacgtcatgctccaacaggaaatggagatggagagcaaggaaaagaagccatcggagtcagacctagaaaggtattattattacctcacaaacgggatcagaaaagacatgatcgcaccggaggaaggggaagtcatggttcgaatttccaagttaatatccaacaccctgctcacttcaccttttctcgagccacttatggtcgtgctggtgcaggagaaagaaaatgattattactgtagtctgatgaagagcatcgtggattatatcctgatggacccaatggaacggaagcgcttattcatcgagtcaatcccaaggctctttccccaacgcgtgattagggcgccagtgccatggcactcagtataccgttctgcaaaaaaatggaatgaagagcacctgcacacggtcaaccccatgatgctccggctgaaggagctatggtttgcagagttcagagatctcagattcgttcgcacagccgaaattctggccggcaagctgccgctccaaccccaggaattctgggatgttattcaaaaacactgtctggaagcccatcagaccctgttaaacaagtggataccgacatgcgcccagctattcacgagcagaaaggaacattggatccatttcgctccaaaatccaactatgattccagccgaaatatcgaagagtattttgcatcggtggcatctttcatgagcctgcagctgcgggagctggtgattaagtccttagaagatctggtttcactgtttatgatccacaaggacgggaatgatttcaaggaaccctaccaggagatgaaattttttatccctcagctgatcatgattaagctggaggtgagtgaaccaattattgtttttaacccaagttttgatgggtgctgggagttgatccgcgactctttcctggagatcattaaaaattctaatggaatcccgaagctgaaatacattccgctgaagttttccttcaccgcagcggccgcagaccgacagtgcgtgaaagccgccgagccgggagaaccaagtatgcacgctgccgccactgctatggcagaacttaagggctataacttactgctaggcactgttaatgctgaggaaaaactggtgagcgatttcctaattcagacctttaaggtcttccagaagaatcaggtgggcccctgtaagtacctcaacgtgtacaaaaagtatgttgatctgctggataatacggctgagcagaatatcgccgcttttcttaaagaaaatcacgatatagacgactttgtgactaaaataaacgcaattaagaagcgacgaaacgagatcgcttctatgaacatcacagtccccctggccatgttctgcctggatgctactgccctgaaccacgacctgtgcgagcgcgcacagaatctaaaggatcatctgatacagtttcaggttgacgtgaatagggataccaacacgagcatatgtaaccagtactcccacattgctgacaaagtatctgaggtgccagctaacactaaagagctcgtgtctttaatcgaatttctgaaaaagtcatccgcggtgactgtattcaagctacggcgccaactgcgggatgccagcgaacgactagaatttctgatggattacgcagacctcccctaccagattgaagatatcttcgataattcccggaacttgctcctccacaaaagggaccaggctgaaatggacctcatcaaaaggtgctcggagtttgagctaaggctcgaaggatatcaccgcgagctggagagcttccgcaaaagagaagttatgaccactgaggagatgaagcataacgtggagaagctaaacgaactgtccaagaaccttaatcgcgctttcgcagagtttgaacttataaataaagaggaagaattgctcgagaaggagaaatctacttatccactcctgcaggcgatgctgaagaacaaggtgccctatgagcagctctggtcaacggcatatgagttcagtatcaaatcagaagagtggatgaatgggcctctgttcctcctcaacgccgagcagatcgctgaagagattggcaatatgtggcgcactacctataagctgattaagaccctgtctgacgtgcctgctccccgtcggctggccgaaaacgtgaagatcaaaatcgataagtttaagcagtacatcccgattctgtctatctcctgtaatcccggcatgaaggaccggcattggcagcagataagcgaaatcgtggggtacgagatcaagccaacagaaacaacttgccttagtaacatgttagaattcgggttcggtaagttcgtggaaaaattagaacctatcggtgccgccgcctcaaaggagtactctctggagaagaatctcgacaggatgaagctcgactgggtgaacgtgaccttttcgtttgtgaaatacagagacacggatactaatatcctctgtgccattgatgacatccagatgctcttggatgatcacgtgataaagactcagacaatgtgcggcagtccattcatcaaaccaatcgaggccgagtgccggaaatgggaagaaaagctgattcgaattcaagataacttggacgcatggctgaagtgccaagccacctggctgtacctcgagccaatcttctcctccgaggacatcatcgcccagatgcccgaggaaggccggaagttcggcatcgttgatagctattggaagagcctcatgtcacaggcggtaaaagataacagaattctggttgccgcagatcagccaaggatggccgagaagcttcaagaggctaacttcctcttagaagacattcagaagggcctgaatgactaccttgagaaaaagaggttgttcttcccacgctttttctttctctcaaatgatgagctcctggagattctctccgagaccaaggaccccctaagagtccagccacatctgaagaagtgctttgaggggattgctaaactggaattcaccgacaacttggaaatagtgggcatgatcagctcagaaaaagagacagtgccatttatacagaagatctaccctgctaatgccaaaggcatggtcgagaaatggctgcagcaagtcgagcaaatgatgcttgcatccatgcgggaggtgatagggctgggcattgaagcatacgtcaaggtacccagaaaccactgggtgctacagtggccaggtcaagtggtgatttgtgtgtcatccatcttttggacacaggaagtaagtcaagctctggcagaaaacacactcttggatttcttgaaaaaaagtaatgaccagattgcccagatcgttcagctggttagaggcaagctcagctcaggcgctcgtttgaccctcggtgctttgacagtgatcgacgtgcacgccagggatgtagtggccaagctgagcgaagaccgtgtgagcgacctgaatgatttccagtggatctctcagctaaggtactactgggtggccaaggacgtacaggttcagatcatcacgacagaggcattgtacgggtatgagtacctgggaaactcaccccggttggtcatcaccccactgactgaccggtgctaccggaccctgatgggtgccctgaagctcaaccttgggggagctcccgaaggacccgccgggaccggcaagacagaaactacaaaggaccttgcaaaagcactcgctaaacagtgtgtggtgttcaactgttctgacggcttggactacaaggccatgggtaagtttttcaaaggactcgcccaagccggagcctgggcctgctttgacgagtttaatcggatcgaagttgaagtgctgtctgtagtggcccagcagatcttgagcatccagcaggcaatcattcggaagctcaagaccttcattttcgaaggtacggagctctctctgaaccccacctgtgccgtgtttatcacaatgaatcctggctatgctgggagagcagagctgccagataacttgaaggccctgttccgcacagtggccatgatggtgcccgattacgcactgatcggcgaaatttccctgtatagcatggggttcctagacagccggtctctggcacagaaaattgtcgccacctacaggctttgctccgaacagctgtcaagccagcaccattatgactacggtatgagggccgtgaagtcggtgctgactgctgcggggaatctcaaactgaagtatcctgaagagaatgagtctgttttgcttctacgggccctgttggacgtgaatctcgctaaattcctcgcgcaggatgtgcctctgttccagggaataatctccgatctgttccccggggtggtgctacctaaaccagactatgaagtctttctaaaggtccttaatgataatatcaagaagatgaaactgcagccagtaccctggtttatcggtaagataattcaaatctacgaaatgatgctggtccgccatggctacatgatcgtcggggacccaatgggtggaaagaccagtgcttacaaagtcctggcggctgccctgggcgatctgcacgcagcgaaccagatggaagaattcgcagtggagtacaagataataaatcccaaggccattactatggggcaactttacggctgctttgatcaggtcagccacgaatggatggatggggttctggccaatgcatttcgagaacaggcaagctccctcagcgatgaccgcaagtggattattttcgacggaccagtagatgctatatggattgagaatatgaacaccgtactcgacgacaacaagaaactttgcctgatgtctggtgagatcattcagatgaattcaaagatgtcgctgatttttgaacccgctgacctcgagcaggcctctccagccaccgtttcaagatgtgggatgatatatatggaaccccaccaattgggctggaagcctctcaaggattcttatatggatacattgccctccagcctgactaaggaacacaaggagctgatgaagtcagggcagtag

SEQ ID NO: 115244 - DNA, 462 bp, Artificial Sequence
  Description of Artificial Sequence: Synthetic coding sequence
atgctgcacatgggactggcccatgtgaagaggatgccaaggtcatctagactacagtgcaaagaggcccaggcttttttctccttgcagtccggcacctacagagttttgagcacacccctgaagctgggcgtgtgggaggagaagaaacattgggcggccctgttgcagcccgtgtcactcggccggaaatggaaaaaacgaccttgcaacttggacgactatgtttgggggcagcttaaatatatcccccttaaattctccttcacagctgctgcagctgacaggcagtgcgttaaagctgcagaacccggggagccatccatgcacgccgcagccaccgccatggctgggacgcgcgccgggacaacattcgatgagctgcaatgtcaggaggatatggtatgtacgcggtttgaaaacaaagcctatgtaaatactaatgatttcacccgccagtag

SEQ ID NO: 115245 - DNA, 13875 bp, Artificial Sequence
  Description of Artificial Sequence: Synthetic coding sequence
atgttccggattggtagacgccagctctggaaacattctgtcacgagggtcctgacccagcgcttaaaaggcgagaaagaggccaagagggctctgctcgacgctaggcataattacctgtttgccatcgtcgcatcttgtctagatctaaataaaaccgaggtggaagacgcgatacttgaaggcaaccaaatcgagcgaatcgatcagttgttcgcggtgggcggtcttcgccacctgatgttctactatcaggacgtggaggaagcggagactggacaacttggctccctgggcggtgtgaacctggtgtcaggaaaaatcaagaagccgaaggtgttcgtgaccgaaggcaacgatgtcgcgcttactggtgtttgcgttttttttatacgcacagatccaagcaaggctattacacccgataacattcaccaggaggttagcttcaacatgttggatgccgctgatgggggtctgttgaactcagtccggcggttactgtctgacatattcatccccgccctgagggccacctcccacggttggggtgagctggagggtctgcaggacgcagctaacattcgccaggaatttctgtcctccttggaaggctttgtgaatgtgctgtctggagcccaggaatccctgaaagaaaaagtgaacctgagaaagtgtgatattctggagttgaagacacttaaggaacctaccgattacctgacccttgcaaacaatcccgagacactggggaagattgaggactgcatgaaggtgtggattaagcagaccgaacaggtcctggctgagaacaatcagctcttaaaggaggccgacgacgtaggcccaagggccgagttagagcattggaaaaaaagactgtctaagtttaactacctcctggagcaattgaagagccccgacgtaaaggcagtgctcgccgtgctggcggctgccaaatcaaaactgttgaaaacctggcgagaaatggacatcaggattactgatgcaacaaacgaggccaaggacaatgtaaagtatctgtacactctcgagaagtgttgtgaccccctctactcctctgaccctctgtcgatgatggacgctattccaacgctcattaacgccatcaagatgatttattccatttcacactattacaatacgtccgagaagatcacgtctctgttcgtgaaggtcacaaaccagatcattagcgcatgcaaggcttatatcacgaacaacgggacagcttctatttggaatcagccacaagacgtggtggaagagaaaatcctgagtgcgataaagttaaagcaggaataccagctgtgcttccacaaaactaaacagaagttaaagcaaaaccctaacgccaaacagttcgatttctcagaaatgtatatttttggaaaattcgaaacttttcacaggcggttagctaaaattattgacatcttcacgactctgaagacttatagcgtgctgcaggattctaccatcgagggtcttgaggacatggccacgaagtaccagggaatcgtggccacaattaagaagaaggagtacaattttctcgatcagcgaaagatggattttgaccaagactacgaggaattttgcaagcaaacgaacgacctccacaacgaactgaggaagtttatggacgtcaccttcgcgaagattcagaatacaaaccaggctctgcggatgttgaagaagtttgagcgcctcaatattccgaacctgggcatcgatgataagtatcagcttatattggagaactacggagccgacattgacatgatcagtaagctgtatacaaaacagaaatatgaccctccgctcgcccggaaccagccgccaatagccgggaagattttgtgggcacgccaactgtttcacagaattcaacaaccaatgcagctcttccagcagcacccagcagtcttgtccaccgctgaagctaaaccaataattcgtagctacaacaggatggcaaaagtgctgttggaatttgaggtattgttccacagagcctggctgaggcaaatcgaggaaatacacgtcggactggaagcttccttgttagtgaaagccccaggtactggggagctctttgtgaatttcgacccacaaatccttattctctttagggaaaccgaatgtatggcgcagatgggactggaggtctccccactcgcaacttccctcttccagaagagagacagatacaaaagaaactttagcaatatgaaaatgatgctggcagagtatcagagggtgaaatctaagatccccgccgcaattgaacaactgatcgtgccacacctggccaaagttgacgaggcactgcaacccggactggccgcacttacctggacgagtctgaacatcgaagcctaccttgaaaatacattcgccaaaataaaggaccttgagcttctgttggaccgggtgaatgatctaatcgagttccggattgacgctatcctcgaagagatgagcagcactccattatgccagctcccgcaagaggagcccctgacctgtgaggagtttctacaaatgacaaaagacctttgcgttaacggagcgcagatcctccacttcaaatcctccctcgttgaggaggctgtcaacgaattggtgaatatgcttttggacgttgaggtgttgtcggaggaagagtccgagaagatcagcaatgagaacagtgtaaactataagaatgagtcctcggcaaaacgcgaagaaggaaacttcgacactcttacatccagcatcaatgccagagccaacgcactgttattaacaaccgttacacggaaaaaaaaagaaaccgagatgctaggcgaggaagcccgggagcttctctcccattttaaccaccaaaacatggacgcattactgaaagtgactcggaacactctggaagctatccggaagaggatccacagcagccacactattaattttagggactccaattctgccagcaacatgaagcagaatagcctccctatttttcgggcaagcgtcactctcgctataccgaacatagtcatggcccctgccctggaggacgtgcagcagactctgaacaaggccgtggagtgcattatttccgtccctaagggagtccgccagtggtcgagcgagctcttaagcaagaaaaagatccaggagcgtaaaatggcagctctgcagtctaatgaagattccgactccgacgttgagatgggcgagaacgagctccaggatactcttgaaattgccagcgtgaacctgcccattccggttcagacaaagaattattataagaatgtctcggagaataaggaaatcgttaagctggtgtctgtactgagcacgataatcaactccaccaaaaaggaggtgatcacttctatggattgcttcaagaggtacaaccacatctggcagaagggtaaagaagaggccatcaagacgtttataactcagtctcctctgcttagcgagtttgagtctcagatcctgtatttccagaatctggagcaagaaattaacgccgaacccgagtatgtgtgtgttggctccatcgcgctttatactgccgacctcaaattcgcactcaccgcggagactaaggcatggatggtggtcattggccggcactgcaacaagaaatacaggagtgagatggaaaacatcttcatgctcattgaagagtttaacaaaaagttaaaccgacctattaaggatctggacgacatccggatcgctatggcagcccttaaagaaatccgggaggagcagatcagtatcgacttccaagtgggccccatcgaagagtcctatgcattactgaatagatacggtcttctaattgccagggaagaaatagacaaggttgacacactgcactatgcctgggagaagttgctagcgagggcaggggaagtccagaataaactcgtaagcttgcagccaagtttcaaaaaggagctaatttcagctgtcgaggtctttttgcaggactgtcaccagttctatctggattatgacctgaacgggcccatggctagcgggctaaagcctcaggaagcgagtgatagactgatcatgtttcagaatcagttcgataacatttaccgtaagtacatcacctacacaggtggcgaagagctctttgggctcccagccacccagtacccacaactgctcgagattaaaaaacagttaaacctactgcaaaagatttataccctgtataacagcgtgattgaaacagtaaatagctactacgatattttgtggagtgaagttaacatcgagaagattaataatgagttgctggagttccagaatcggtgcagaaagctaccacgagccctaaaggactggcaggcctttttggatttaaagaaaattatcgatgacttcagtgagtgctgccccctcctggagtacatggcaagcaaggccatgatggaaaggcattgggagcgaattacaacacttaccggtcatagcctggacgtgggaaacgagtcttttaaacttcgaaacattatggaagccccgctgcttaaatataaggaagagatcgaggatatctgtatcagcgccgtaaaagaaagagacatcgagcagaaacttaagcaggttataaacgaatgggataacaaaacattcacctttgggagctttaagacccgcggtgaacttctgctgagaggagatagtactagtgaaattattgctaacatggaggactctctgatgctgctgggttcactcctcagtaatcggtataacatgcctttcaaggctcagattcaaaagtgggtgcagtatctgagtaactctactgatattatagaatcctggatgacagtgcagaatctatggatctatctggaggctgtgtttgttggaggtgacatagcaaagcagctaccgaaagaagctaagagattcagcaacatagacaagagttgggtgaaaatcatgacccgcgctcacgaggtgccctccgtggtgcaatgctgcgtaggcgatgaaactcttgggcaattgctgccacacctgttagatcagctcgagatttgccaaaaatcactgacaggatatttggaaaaaaagcgcctgtgtttccctcggtttttcttcgtgtcagacccagctctgctggagattcttggccaggcgtctgacagtcacaccattcaggcccacttgctgaatgtatttgataacattaaatcagtgaaatttcatgagaagatctatgaccgcattctctccatcagcagtcaggagggcgaaaccattgagctagacaagccagtaatggccgaaggaaatgtggaggtctggctgaatagtcttctggaagaatcacagtcatcactccacctggtaattcgtcaggctgcagctaatattcaagagacggggtttcagctgacagaattcctcagctcctttcccgctcaagtcggcttgctgggcatacaaatgatatggacgcgggacagcgaggaagctcttcggaacgcaaaattcgacaaaaaaatcatgcaaaaaacaaatcaagcctttctcgagttactgaacaccctgattgacgtaacgacaagggacctgtccagcactgagcgagtgaaatatgagacactcattacaatccacgttcatcagcgcgatatcttcgatgacctttgtcatatgcatattaagagccctatggattttgagtggctgaagcagtgtaggttctatttcaacgaagattccgacaaaatgatgatccacattaccgatgtcgcatttatttaccagaacgagtttctcggatgtacagaccgtctggtcataacaccactcactgaccgctgttatattactctggcccaggctttaggtatgagcatgggtggagcaccagccgggcccgctggaacagggaagacggagactacaaaggacatgggccgatgcctgggaaagtacgtggtggtgtttaactgcagtgatcagatggactttcgtgggctgggccgtatcttcaaaggactagcccaatccgggtcgtgggggtgctttgatgagtttaatagaattgatttgcccgtgctctctgtggccgctcagcagatttcgatcatccttacctgtaagaaggaacacaaaaaatccttcattttcacagatggagacaacgtgacaatgaacccagaatttggcctgtttcttactatgaatcctggatacgctggcagacaagaacttcctgagaacctcaaaataaatttcaggagtgtggccatgatggtgccagacagacagatcatcattagagtaaagctggcctcctgcggctttatcgataacgtggtattagctcggaaattttttaccctgtataagctctgtgaggaacagctttctaagcaggtgcactacgactttggcctaaggaatatcctgagcgtgcttcgtaccttaggggctgcaaagagagctaatcctatggacacagaatccactattgtaatgcgagtgctgagggacatgaacttaagtaaactaattgatgaagacgagccactgtttctatctctgattgaggatcttttcccaaatatcctacttgacaaagccggttacccagaactcgaagccgccatctccaggcaagttgaagaagcaggcctgatcaatcaccctccctggaagctgaaagtgatccagctgtttgaaacacagagagtgcgccacggcatgatgacactaggtccttcaggcgctgggaagactacatgcatccacacattaatgagagcaatgactgactgtggaaaaccacacagagaaatgcgcatgaatcccaaagcaattactgcccctcagatgtttggtcgcctagatgtggccaccaacgattggactgatggtatcttcagcaccctgtggaggaaaaccctgcgtgcgaagaaaggcgagcatatatggataatactggatgggccagtggacgccatctggattgagaatctgaattccgtgttggatgacaacaagaccctgactctcgctaacggggaccgaatccctatggctcccaactgcaaaatcatctttgagccccacaacattgacaacgctagtccagctaccgtgagtcgaaatggaatggtgttcatgagctcatcaatcctggattggtcacccattcttgaaggtttcctgaagaagcgaagccctcaggaggccgagattctgcgccagctatacacagaaagttttccagatttgtacaggttctgtatccagaacctagagtacaaaatggaggtcctcgaggcttttgttattacccagtccataaacatgttacaaggtctcatccctctaaaagaacaaggaggggaggtgtcccaggcccacttaggtagactgttcgttttcgcacttctgtggagcgctggcgccgcacttgagctggacggtcgccgcagactggaactctggttgcgctcacgtcctactggcacactggagctgcccccccccgccggcccaggcgacacagcctttgattactatgtggcaccagatggaacatggacccattggaatactaggacacaagagtacctgtatccctctgatacaacgccagagtatggcagcattctggtgccaaacgtcgacaatgttcgcaccgattttctgattcagacaatcgccaagcagggcaaagctgtgctacttatcggggagcagggtactgctaaaaccgttatcattaaaggttttatgtccaaatacgaccctgagtgtcacatgatcaagtcactgaatttttccagtgcaacaactcctctgatgttccagcggacaatagaaagctacgtggataagagaatggggacgacctatggcccacctgcaggaaagaagatgacagtgttcattgatgatgtgaacatgcccattatcaatgagtggggagaccaggttacgaatgagatcgttcggcaactgatggagcagaatgggttttacaacctcgagaagcccggcgagttcacctcaattgtggatatacagttcctggcagcaatgattcaccctgggggaggacggaacgatatcccccagaggctgaagagacagttttcaattttcaattgcaccctcccatcagaggccagtgtggacaaaatctttggcgtgattggggtcggccactattgtacacagagaggcttttccgaagaagtgcgtgattcggtgacaaagttggtgccactcactcggcggctctggcaaatgacaaagattaagatgctgcctactcctgccaaatttcactatgtatttaatttgcgcgatctgtcccgcgtgtggcaaggtatgctaaatacgacaagcgaggtgattaaagaacccaatgacttgctcaagctgtggaaacatgaatgcaaacgggtgatcgccgatcgatttactgtctcatccgatgtgacgtggttcgataaagccctggtgtctttagtggaggaggagtttggagaggagaagaaactactggttgattgtggtatagacacctacttcgttgatttcttaagggacgccccggaggccgcaggggagactagcgaggaggcagacgccgaaacaccaaaaatttacgagccaatcgaatccttcagtcacctgaaggaacggctaaatatgttcttacagctttataacgaatctatccgaggggcagggatggacatggtcttctttgctgatgccatggtgcatctggtgaagatttccagagtgataagaacaccccaagggaatgccctgctggtgggcgtggggggttcaggcaaacagagtctgactcgacttgccagctttatcgctggatacgtgtcttttcagattaccttgacacggtcctataataccagcaatctaatggaggacctgaaggtgctatatcgaactgccgggcagcaaggtaaaggcattacatttatcttcacagacaatgagatcaaagatgagagttttctggagtacatgaataacgtgctatctagcggcgaggtgagcaacctcttcgcaagggatgaaatcgatgagattaactctgatctggcatcagtcatgaaaaaggaattcccgcggtgcctccctaccaacgagaatctccatgattactttatgtctagagtccgacagaacctgcatatcgtcctatgctttagcccagtgggagaaaagttcaggaaccgggcacttaagtttcccgctttaataagcggttgcactatcgattggtttagccggtggccaaaagatgccctcgtcgctgtgtccgagcacttcctgaccagttatgatatcgattgttccctggagattaagaaggaagtggttcagtgcatgggttccttccaggatggtgtggcggaaaaatgcgtggactactttcaaaggtttagaagatcaacacatgtgacgccgaagtcttacctgtcctttatccaaggatataaatttatatacggcgagaagcatgttgaggttcgaacactggcgaaccggatgaacactggcctcgaaaaactgaaggaagccagtgagtccgtggccgcattgtctaaagagcttgaggccaaggaaaaggaactgcaggtcgccaacgacaaggcggacatggtgcttaaggaggtcaccatgaaggcccaggctgccgaaaaggtcaaagccgaggtacagaaagttaaagacagggcccaagccatcgtggatagcatcagcaaggacaaggccatagccgaggagaagcttgaagccgctaaacccgctctggaggaagccgaagctgcccttcagaccattcgtccaagcgacattgctactgttagaaccctcggccgtccgccacacctaattatgcgtataatggactgtgttctgctcctcttccaacgcaaggtgagcgctgtgaagattgacctggagaagagctgtactatgccgtcatggcaggaaagcctgaaactcatgactgccgggaactttctccagaacctgcagcaattccccaaggacaccattaacgaggaggtcattgagttcctctctccttactttgagatgcctgactataacattgagacggccaagagggtgtgcggaaacgtcgcgggactgtgcagctggactaaagccatggccagcttcttttctatcaacaaagaggtactgcccctcaaagccaatctcgtggtccaggaaaacaggcatctgcttgccatgcaagatctgcaaaaagctcaggctgaattggacgataaacaggcggaactagacgttgtccaggcggagtacgaacaggcaatgaccgaaaagcagacactgctggaggatgccgagaggtgcaggcacaaaatgcagaccgcctctacattgatcagtggactcgctggcgagaaagaacggtggactgaacagagccaggaatttgccgcacagactaagagactggtcggcgacgtcttgctagcgaccgccttcctgtcttactctggcccctttaaccaggaattcagggatctcctattaaatgactggcgtaaggagatgaaggcaaggaagatcccatttggcaagaacctgaatctgtctgagatgcttattgacgccccaactattagcgagtggaaccttcaggggcttcccaacgatgacttatctatccagaatgggataatcgtaacaaaagctagccggtaccctcttttgatcgatccccaaactcagggaaaaatctggatcaagaataaagagtctcgtaacgaactccagatcactagcttgaaccacaagtacttccgcaatcatctggaggattccctgtccctcggcagaccattgttgatagaggacgtaggcgaagagttggaccctgcacttgataatgtgcttgagagaaacttcataaagacagggtcaacatttaaagtgaaggtgggcgataaagaagtcgacgtgctggacggatttcgcctatatattactacaaaacttcctaatcccgcttatacccccgaaatctccgctagaacttcgattatcgattttaccgttacaatgaaaggactggaagaccagctactgggacgagtaatcctcacagagaagcaagaactggaaaaagaacgaacacacctgatggaggatgtgaccgccaacaagagacgcatgaaggaattggaggataacctgttgtaccgtctgacctcaacacaagggagcctcgtggaggatgaatctttgatcgtggtcttgtcaaatacgaagaggaccgctgaggaagtcacacagaaactggagatatctgcagaaacggaggttcagattaatagcgcacgggaggaatatcgcccagtggctacgcgcggcagcattctttactttctgattaccgaaatgaggctggtgaatgaaatgtatcaaacgtccctgaggcagtttttagggctctttgaccttagtctggcccggagcgtgaagtcacccatcacatctaagcgaatcgcaaatataattgaacatatgacgtacgaggtgtataagtatgccgcacgtgggttatatgaagaacacaagttcctgttcacactactgttgaccctaaagattgatatacagagaaacagggtgaagcacgaagaatttttaaccctgattaaaggcggcgcctctctagatctgaaagcgtgccctcccaagccttccaaatggattctagatattacatggctgaacctggtggaactgagtaaactgaggcagttcagcgacgttctcgaccagatcagcaggaacgagaaaatgtggaagatatggttcgacaaagagaaccctgaggaagagcccctgcccaatgcctacgataagagcctggattgttttaggagattgctactaatcagatcatggtgcccggaccgcaccatcgcccaggctcgcaaatatatagtggacagtatgggagaaaagtacgcggaaggagtcattctggatctggagaagacctgggaggagagtgatccccgcaccccactgatctgtctgctctctatgggctccgaccccaccgattctattatcgccttaggaaagaggttgaagatcgaaacgaggtacgtctccatgggtcagggtcaagaggtgcacgcacgtaaacttcttcaacaaaccatggctaatggcggctgggctttacttcaaaattgccatctcgggctcgacttcatggacgagctgatggatattattatagaaaccgagctcgtgcatgacgcttttcgtctttggatgactactgaagcgcacaaacagttccctatcacgttactgcagatgtcgattaagttcgcaaatgaccctccgcagggcctccgcgcggggctcaagcggacttattctggggtatcccaggatctgctggatgtgtccagtggctcccaatggaaaccgatgctgtatgcagtagcattcttgcattctacggtgcaagagcgcagaaaatttggagcgcttggatggaacattccctacgaatttaaccaggccgattttaatgcgactgtccagttcatccaaaaccacctcgatgacatggacgtgaagaagggcgtaagctggaccaccatcaggtacatgatcggagagatccagtacggaggccgcgtaaccgatgattacgataagcggctcctgaacaccttcgcaaaagtctggttctcagagaatatgttcggacccgatttctccttctatcagggatacaacattcccaagtgctcaacagttgataactatttgcagtatatccagtccttgccagcatacgattcccctgaggtgtttggcctccatccgaacgcagatatcacatatcaatctaagctagcgaaggacgtcttggataccattctcggcatccaaccgaaggatacgtctggtggtggagatgagacccgggaggctgtcgtggccagactggccgatgacatgctggaaaagctgccccccgattacgttcccttcgaggttaaagaacgattgcaaaagatgggaccattccagcccatgaatatcttcctccgccaggaaatcgacaggatgcagagggtcctgtcgctggtgaggagtaccctgactgagctgaagctcgctattgatggcacgattattatgagcgagaaccttcgggatgccctggactgtatgtttgatgctcgcatcccagcctggtggaaaaaggcctcatggatttcctcaaccctgggattctggttcaccgagttgatagaaaggaacagccagttcacatcatgggtgtttaacggcaggccacattgtttttggatgacaggtttctttaaccctcagggtttccttaccgcgatgcggcaggagatcacccgggccaataagggatgggcactagacaacatggtgttatgtaacgaggtcacgaagtggatgaaagacgatatttccgcgccgcccactgaaggcgtgtacgtatatgggctatatctggagggggccgggtgggataagaggaatatgaagctgattgaatccaaacctaaagtactgttcgagctcatgcctgtcattcgcatatacgctgagaacaatactctacgggatccaaggttttatagttgtcccatttataagaaacccgttcggactgatctcaattacatcgccgcagtagatttgcgcacggctcagacgccagagcactgggtgcttaggggggtggcactcctgtgtgacgtgaaatag

SEQ ID NO: 115246 - DNA, 12477 bp, Artificial Sequence
  Description of Artificial Sequence: Synthetic coding sequence
atgaccttccgagctaccgactccgagttcgatctgacaaatatagaagaatatgcagagaactcagcactctcgcgcctcaacaatatcaaggctaagcaacgcgtatcctacgtgacctccaccgaaaacgagtctgacactcaaatactgaccttccgccacatcaccaaagctcaggagaagacaaggaaacggcagcaaccaattaagctggagcctctgccagttcttaaggtctatcaggaccataaacagcctgaatacattcacgagcagaaccgcttccagctgatgacagcaggaataattaaacgtccagtttctatcgccaaaaagagttttgctacctctagcacccagttcctggagcaccaggatgctgtgaaaaaaatgcagattcatcgcccttacgtggaagtatttagcccatcacccccaaagcttccgcataccggtatcggcaaacgtggattattcggcactaggtcctcagcctaccccaagtacaccttccatgaccgggaagaggtggttaaggcaaacattcgggaccctctacagatcatcaagatcatacgggagaacgaacatctcggctttctgtacatgatccctgccgtcccacggtctagtattgagtacgacacatacaatttgaaagtcgtgagttatgaaaatatcaataagaacgactattacactatctctcagagggcagtgacccatatatataacgaggatatagaatttatcgaaattgatcggtgggagcaggagtatctgtatcaccgggaactgactaaaatcccaatattcagtctatttaggaaatggaaggccttttcagtttggcgcaaaaacgtacggtctaaaaaaatcacggggtgtcagaagtccctgcaaaagaatctcttcattgtcaatccgcacctgaggcccgctttgctcaaaatcaacgaattgtgctatcatctctcatttatggggttatgttacattgaaaagtgtcacacatacacgctgcaggagttcaaggcagcacaagtgattagactcgcggaggtcactgagaggttgggggagttccgaaacgaagccaaatacgtggttaggcgggcgtgtaggtttgccctacgggctgcgggattcgtgcctgacgactgcgcctttggcccttttgaggactatcacaaggtgcaaagcagcggaagttttatcaacacgcctcacgagcttcccacatatggcgactcggagaaaatgacatacacagaacaagcttccaagagacattattgtatgcggttgacttgcttcatccgcctcaacgattacctcattgaaaataccatgcacattctaacagtgaatgccgtcaactcactcttgaaccatctcaccgacaaattgaaaaggaccccgagcgccgacgtaattcagaagtggatcactgaagagaagccggaagtgcctgataaaaaaggcactttgatggtggagaagcaggaagaagatgagagcttgatccctatgttcctgacagagctgatgctaacagtccagtcattgctcttcgagcctagtctcgaggattttttagacggaattctcggcgcagttaatcattgccagaataccgtgctcagtgtgccaaacctcgtgcccgattcttactttgatgctttcacttccccatacataaacaataagttagaagggaaaacgtgcggaaccggcccaagcctggccgccgtctttgaagatgataagaatttccacacgattatctcacagatcaaggagactatccaggccgctttcgaatctgctaggatttacgcagctacctttgagaagttccaaatcttttttaaggaaaacgaaagcctggatctgcaggcgctgaaattgcaagagcctgacatcaacttcttttccgaacagctcgagaaataccataaacagcataaagacgctgttgcattacgacctaccagaaatgtgggactgctgctgattgataccagactcctgcgcgagaagctgattccatctcccctcagatgcttggaggtgctgaatttcatgctgccccgccagtctaagaagaaggtggatgcgatcatattcgaggcccaggatgccgaatacaagctggagttcgtgcccacaacaacgaccgagtatgtccacagcttgctgttcctggatgagattcaggaaagaatagagtctttggaagatgaggggaatattgtcacgcagatgtataagctcatggaacagtaccaggtgcctaccccacccgaggacttcgcagtgttcgctactatgaaacccagtatcgtggccgtgcgcaatgccatcgacaagagcgtcggcgaccgcgagtcttctattaaacagttttgtgtgcacttgggaagcgacctcgaggagttaaataatgaggttaacgaagttaagctgcaagcacaggatccccagatccttgatattagcgctgaccaggacaaaataaggctgattctcaacaatctgcagagcgttctggctgatctccagaaacgagcctttcagtacaagagttaccaaaagaactttaaggtggaagtgtccaaatttgaagcgttagaggaagtgtctgctgaattaaagttaaagcagctgctgtgggatagcttctccgagtgggacaagctgcagcaggaatggctgaagagcaagttcgactgtctcgatcctgaggttttaaacgggcaggtttcgaaatatgctaaattcgtcacacagctggagaaaggactgccgccaaacagtgtagtgcctcaattaaagtataaagtcgagaagatgaaagagaagcttccagtcattattgatcttagaaatcccacccttaaggccagacattgggccgctatcgaacagactgttgatgctactttggtcgacgcagaaattcctttgacacttgagagactctcccagctccacgtgtttgattttggacaggagattcaagatatttctggacaggcctccggagaggcagctcttgaggccatcttgaaaaaagtcgaggactcctggaaaactacagagttcgtcatcctgcctcatcgcgactccaaagacgtctttatattggggggaactgacgacatacaagtgctgctcgatgatagcacaatcaacgtggccactctggcctccagccggtacctaggccctctcaagactcgcgttgacgagtggcaaaaacagttagcattattcaaccagacccttgaggaatggctgacatgccagcgaaactggctctatctggaaagcattttcaatgcccctgacattcaaagacagctgcctgcagaggccaagatgttcctgcaagtggacaaatcctggaaggagattatgcgaaaggtcaatcggctgccaaacgccctgcgggctgctacacagccaggccttttagaaacatttcagaacaacaacgctcttctggatcagatccagaaatgtctggaagcatatctagaatctaaacgtgttatttttccaaggttctatttcctgtcaaacgatgagcttctggagatcctagctcaaacccgtaatccccaagccgttcagccgcacctgaggaagtgttttgacagcatatcaaagctcgagtttgcacttatgccacccgctgaagggaaaatccctggcattgatggagaaccggagaaagtgtataccaatgatattcttgcaatgctttcacccgagggcgaacgtgtctcacttggaaagggcttgaaagcacgcgggaatgtggaggagtggcttggtaaggtcgaggaggccatgttcacctctttgcgccgcctgtgcaaggcagcaattgccgactatcagggaaagcttagaaccgattgggtcgtggccgggcacccaagccaggttattttgacagtttctcagatcatgtggtgtagggatctcactgagtgtctggagactgaacactctaatcacattcaggcccttaagaacttcgaaaaggtcaactttgagagactgaatgccctggctgctattgtgcaggggagtctcccaaaactgcaccgcaacatcctgactgccttaataactatcgatgttcacgcccgcgacatcgtgactgagttagtccagtccaaagtggagactgtagagagctttgactggcagaggcagctcaggtactactgggatatcgatctggataattgcgtggcacgaatggctctgagccaatacacatatggatatgagtatctcggagcttgtccgagactggtcatcacaccactgactgaccgatgctacttgtgtttgatgggcgcgctccaactggatctcggcggtgcgcccgcagggcccgcaggtacaggaaagaccgagacaactaaagatctggccaaggcccttgctattcaatgcgtagtcttcaactgctccgacggcctcgactataagatgatgggtcgcttctttagcggcctcgcacaatccggagcatggtgctgcttcgacgagttcaaccggattgacatcgaagtgctgtccgtcatcgcgcagcagctgattactatcagaaacgccaaggccgcaaagctttcccggtttatgttcgagggacgagagatcaaactggtcatgacttgcgctgcatttatcacaatgaacccaggctacgcaggcaggaccgaactcccagataacttaaaagctcttttccgtccattcgccatgatggtcccaaactacgcactgattgctgaggtcattttgtactccgagggcttcgaatcttctaaaatcctagcgcgaaaaatgacccagatgtataagctctgcagtgagcagctgtctcagcaagaccactatgactttggtatgagggctgtgaaatccgttctcgtgatggccggtagtctgaaacgggagaaccctgatcttaacgaggatgtggttctcatcagggccctgcaggactctaatttacctaaatttttaactgatgacgcgctgctgttttccggtattatcagtgacctttttcccggcgtccagatccccgagcatgattacgggatcctccaatccactatcgttgatgttatgaacaggcagaatctgcagcccgaaatgtgtatggttcggaaagttattcagttctacgaaaccatgctggtaagacatggtgtgatgttagtgggaccaacaggcggaggaaagacaactgtgtataggatcctggccgaaaccctcggtaatctgcagaagttaggtatagaaaactcattctaccaagccgtcaagacatatgttctgaaccccaaatcaatcacgatgggggagctctatggtgaggtgaataaccttaccctggaatggaaagatggcctgatggcactttcagtccgtgccgctgtaaatgatacctctgaagaccacaagtggatcattagcgatggaccggtggacgctctgtggatagaaaacatgaacaccgtgctcgacgataacaagatgttatgcctagctaactctgagcgtatcaagctcactccccagattcatatgctgtttgaggtccaggacttgcgggtcgcttcccccgccacagtgagccgttgcggaatggtgtttgtggatccagaggagctcaaatggatgccgtacgtgaagacgtggatgaagggaatttctaaaaagctgacagaggaaacccaagaatacatcctgaacttgttccagcgctatgtggacgagggcttgcatttcatcaataagaagtgtagtcaggcaattccccaggtggatatctccaaagttaccacattatgttgtctcttagaatccctaatcctcgggaaagacggtgtcaatctcgctatggagcagactaagcttaatacgatactgtgtcaaacatttgtgttttgctatctgtggtcattgggcggcaacctcaccgagaactactatgattcattcgacacctttattagaacccagttcgatgataaccccgatgcaagactgcccaactccggagacctgtggtccattcacatggacttcgataccaaacgtctagatccttgggaacggatcatacctacattcaaatacaaccgggacgtaccattctttgagatgctggttcccaccacagacaccgtcaggtatggctacctcatggagaagttgcttgcggtgaagcatagtgtcctcttcaccggtatcaccggtgtggggaaaagcgttattgcgaaaggcttgctgaacaaaattcaggagtcagctgggtacgttccagtctacttaaacttcagcgcccagaccagctccgcgagaacccaggagattatagagtctaagctggaaagaaagagaaagaacatcttgggggctcccgggaataagagaatcgtgatcttcgtcgatgatctcaacatgccccgcttagatcggtacggttctcagccacccatcgagctattgcggcagtaccaggattttggaggtttttacgacaggaataagctcttctggaaggagatccaggacgtcacgatcatcagtgcttgtgctccacccggcgggggaagaaaccctgttaccccccgattcatccgtcatttttccatgctatgcctgccgatgccctcagagcattctcttaagcaaatctttcaggccatactgaatggctttctcagtgatttcccaccagcggtgaagcagaccgcttcatcgattgtcgaggccagcgtggagatatacaataagatgagcgtagatcttctgcctactcctgccaaatcccattatgtcttcaatctccgggatctttcaaagtgtgtacaaggaatactccagtgcgacccaggcactatccgggaggagatccagatctttagattgttctgccacgaatgccagcgggtgtttcatgatcgcttgattaacaacgaagacaagcattactttcatgtgatccttacagaaatggctaataagcatttcggcatcgccatcgatctggagtatttcctgaacaagccaatcatcttcggcgactttatcaagttcggtgctgataaggccgatcgaatttatgacgacatgcctgacatcgagaaaacagccaacgtgctgcaggactacctggatgattataacctgacaaatccaaaagaggttaagctggtttttttccaggatgctattgaacacgtcagccgcatagcacggatgataaggcaggagcggggcaatgctttgctagtgggagtcggaggcacagggaagcagtccctgactagactcgcggcccatatttgtggttacaaatgccttcagatcgaactcagtagagggtataactacgactcattccacgaggatcttaggaaattatacaagatggccggtgttgaggacaagaacatggtgtttctctttactgacactcagatagtggtggaggagttcctagaggacatcaataacatactaaacagtggggaggttccaaacctgtttgaaaaggatgaactggaacaagtcctggctgcaacgaggcctcgggccaaagaggtcggaatcagtgaagggaatcgggacgaggtttttcagtattttatttctaaggtgaggcagaaactacatatcgtgctgtgcatgtcacccgtcggagaagccttccgttccaggtgtcgcatgttccccagcctggtaaactgttgcaccatcgactggtttgtacagtggcctcgcgaggccctgctttcagtcagcaaaacttttttctctcaggtggacgccgggaatgaagagcttaaggagaagctgcccctgatgtgtgtgaacgttcatctgtctgtatcttctatggcagagcggtattacaatgagttgaggcgcaggtactataccaccccaacttcatatctagaattaatcaatctgtacctgagtatgcttagcgaaaagaggaaacagatcatctctgcgcgggaccgtgtcaaaaatggattgaccaagttactggaaacaaatattctggttgacaagatgaagctggatcttagtgcgctagagcccgttctgctcgcgaagagcgaagacgtcgaggcgctgatggagaaactggccgttgatcaggaatcggccgatcaggttcgcaataccgttcaggaagatgaagcaactgccaaggttaaggccgaggaaactcaggccatcgcagacgacgcccagcgggatcttgatgaagcattgccagccctggatgcagctaacaaggcgttggactccttagataaggcggacatctctgagatcagggtgtttacgaagccaccagacctggtaatgacagtgatggaagcgatctctattctcctgaatgccaagccagattggccaagtgccaaacagctgctgggagactccaactttctgaagaggctcctggagtatgacaaagagaatataaagcctcagattcttgctaaactccagaagtatattaataaccctgatttcgtgcctgagaaagtggaaaaggtgtctaaggcctgtaagtccatgtgcatgtgggtgagagctatggatctgtattccagggttgtcaaagtagtagaacctaaacgccagaagttacgcgcggcccaggccgagctggacataacgatggcaacactgcgcgaaaagcaggccttgctgcggcaggtggaggaccagatccaggctctccaggacgaatatgataaaggggtgaatgaaaaagaatctctggccaaaaccatggctctaacgaaggccaggctcgttagggctggaaaattaaccgcagctctggaagacgagcaggttagatgggaagagtctattcagaagttcgaggaggagatctcaaacataactggaaacgtatttatagccgctgcttgtgttgcatactatggtgcattcactgcgcaatatagacagagcctgatagagtgttggattcaggattgtcaatctctcgagattccgatagaccctagttttagtctgattaatatcctgggtgacccctacgagattcggcagtggaatactgacggactccctcgggatctgatcagcactgaaaatggcatcctcgtcacccagggtaggaggtggccactcatgatagatcctcaggaccaagcgaacagatggataaggaataaggagagcaagtctggcttaaaaatcattaagctcacggatagcaatttcctcaggatcctggaaaactcaattaggctgggccttcccgtgcttctcgaggagctcaaggagactttggatcccgccctcgagcctattcttcttaaacagatcttcatttccggcggacgcttattaattcgactcggcgacagtgatattgattatgataagaacttcaggttttacatgaccaccaagatgcctaacccgcactatctgcccgaagtgtgtattaaggtgaccatcattaacttcactgtgacaaagagtggtctggaggaccaattgctgtccgatgttgtgaggctcgagaaacctcgcctcgaggaacagcggataaaactgatcgtccgaatcaacaccgacaagaaccagctgaaaaccatagaggagaagattttaagaatgttgtttaccagcgagggcaatatcctggacaacgaggagcttatcgataccttgcaagacagcaagattaccagcggcgccataaaaacaaggctcgaagaggctgagagtacagagcaaatgatcaacgtggccagagaaaaatatcggcccgtcgccacccagggatccgtgatgtacttcgttatcgccagcctgagcgaaatcgacccgatgtaccaatactccctaaaatattttaagcagttgtttaataccaccattgagacttccgtgaagaccgagaatctccagcagcgccttgatgtcctgctcgagcagacactactgacagcatacgtgaacgtgagtagaggcctgttcgaacagcacaagttgatctacagcttcatgctgtgtgtggagatgatgcgccagcaggggacattatccgacgcggaatggaacttctttctgcgcggttccgcaggcctggagaaggagaggccacctaagcccgaggcaccatggttgccgaccgctacttggtttgcttgctgcgatcttgaagagagcttccccgttttccatgggctgacccagaacattctttctcatccaatttcaattcgcttgggatccttcgagacgtatataaatcctcagaaatgggagggctacagcaagatgaaacacgaggataaacacatgcggcaggagaaggaagccgctcaccaggatccgtggtctgctggactcagttccttccataaattgatactgatcaaatgctgtaaggaagaaaaggtggtgttcgctctcacagactttgtcattgaaaatctcggtaagcagttcattgaaacccctccagttgatttgcccacactctaccaggatatgtcctgcaacaccccactggtgttcatcctgtccacgggaagtgacccaatgggggctttccagcgattcgcaagagaatctggttatagcgaacgggtccagagcatcagccttggccaggggcagggacccattgctgaaaaaatggtgaaagatgctatgaagtctggcaactgggtattcttacagaactgtcacttggcagtgtcttggatgttggctatggaagagctgatcaagacatttactgatccggactctgcaatcaaagatactttcaggctctttctctcctctatgccatctaacacattccccgtgacggtgctccagaatagcgtcaaggtgaccaacgaaccacccaaggggctgagagcaaatataaggagagctttcacagaaatgaccccatccttctttgaagagaacatcctgggtaagaaatggcggcagatcattttcggaatctgtttctttcacgcaataatacaggaacgtaagaaattcggtccactcggctggaacatatgctacgagtttaacgacagcgatcgcgagtgcgcactcctgaacctcaaactttactgcaaggagggaaaaattccttgggatgctctcatttacattacaggggaaatcacgtacgggggtcgtgtaacagattcttgggaccagcgttgcctgcggaccatattgaaacgcttcttctcccctgagacattggaggaggattacaaatacagtgagtccgggatttatttcgccccaatggctgactctctccaggaatttaaggattatatcgagaacttaccactgattgatgatcccgaaatcttcggcatgcacgaaaacgctaatctggtcttccagtataaggagacctccacactgatcaatacaattctggaggtccagccccggtccagtacagggggggagggcaagtccaacgacgagatcgtccaagagctcgttgcgtctgtacagacccgggtgccagaaaagttggaaatggagggtgcctctgaatctcttttcgtgaaggaccttcagggacgactgaacagcctgacgaccgttctgggtcaggaagtcgatcgttttaacaacctgctgaaactgatacatacttcattggagactttaaataaagctattgccggattcgtggtcatgtccgaggagatggagaaggtatataactccttcctcaacaaccaggtgccagctttgtggagcaacactgcctatccctctctgaagcccctggggtcatgggtgaaggacctcatcttacgaacctctttcgtcgatctatggctcaaacggggccagccaaagtcttattggataagtggattctttttcccacaggggttccttacgggcactttacagaatcatgcccgcaagtataacctacctatagatgaactgagcttcaagtactctgttattcccacatacagggaccaggccgcggttatagaggccgctaaaactgtgcagtttggacaagagctcccaatggatatggagctcccatcaccggaggatggagtgctggtacacggcatgttcatggatgcgagcaggtgggatgataaggaaatggtgattgaagacgcactgccaggacaaatgaaccccgtacttccagtggtccacttcgaaccgcagcagaactacaaaccaagccccaccttgtatcactgcccgctgtataaaacaggtgctagagcaggcaccttgtctactaccgggcacagcaccaattttgtggttacggtcctgctgccttcgaagaggagcaaagactactggattgccaaaggatccgcccttctctgtcagcttagtgagtag

SEQ ID NO: 115247 - DNA, 12477 bp, Artificial Sequence
  Description of Artificial Sequence: Synthetic coding sequence
atgaccttccgggcaactgatagcgagtttgatctaacgaatattgaagagtatgctgagaactccgctctgtcacggctgaataacatcaaagccaagcagagggtctcgtatgtgacctcgactgaaaatgagagcgatacgcaaatcctcacatttcgtcatattacaaaggctcaggagaaaactaggaaacgacaacagcctattaagctggagcctttgccagtgctaaaggtctatcaggatcacaaacaacctgagtacatccatgagcagaacaggttccagctgatgactgccggtatcataaaacgtccagttagcattgccaagaagtcctttgccacttctagtacacagttccttgaacaccaggatgctgtgaaaaagatgcaaatccaccggccttatgtggaagtgttctcgccttccccgcccaagctgcctcatactggaatcggtaagcggggcctattcggcactcgaagctctgcctatcccaagtacacattccacgatagagaggaagtagttaaagccaacatccgggatcccctccagataattaagatcattagagagaacgagcacctcgggttcctctacatgatccctgccgttcctaggtctagcatagagtatgacacttataacctgaaggtggtatcttatgagaacatcaacaaaaacgactattacacgatttctcagagggccgttacccacatttacaacgaggatattgaattcatagagattgaccggtgggagcaggaatatctttaccacagggagcttacgaagatcccaatcttttctctgttcagaaagtggaaggccttttctgtttggagaaagaacgtgcgctccaagaaaatcacaggctgccagaagagcttacagaagaatctcttcattgtcaaccctcatctgaggccagccttgctgaagatcaatgagctgtgttaccacctgagctttatgggcctgtgctacattgagaaatgtcacacctacaccttgcaggaatttaaagcagcccaggttatcaggctggccgaggtcacggaacgactgggagaattccggaatgaagcaaaatatgtggtgaggcgcgcctgcagattcgctctaagagccgccggctttgtacctgacgattgcgccttcggacctttcgaagattaccacaaagtccagagttctggtagttttatcaatactccccacgaacttccaacgtacggggacagcgaaaagatgacatatacggagcaggcttctaaaagacattactgcatgagactgacctgttttatccgattgaacgattatctgatcgagaacacaatgcatatccttacagtcaacgcggtaaactctctgttgaaccacttgaccgacaaactgaagcgaaccccttcggcggacgtgatccagaagtggattactgaggagaaacctgaggtcccggacaagaaaggaacacttatggtggaaaagcaagaagaggatgaatccctcatacccatgtttctcacagagctcatgctaactgtccagagtctgctgtttgagccaagtctagaagacttcctggacgggattctcggggctgtcaatcactgtcaaaatacagtcctgtccgtgccaaacctggtgcctgacagctactttgacgccttcactagtccatatattaacaataaattggaggggaaaacctgtgggactggcccatccctcgccgcggtgtttgaagacgacaagaatttccacacgatcatttcccagatcaaggagacaatacaggccgcattcgagagtgcccggatctatgccgccactttcgagaagtttcagatattttttaaggaaaacgagtcactcgatcttcaggccctgaaactccaggagcccgacatcaacttcttctccgaacaactggaaaagtatcacaaacagcacaaggacgcggtagcactgaggcccactcgcaacgtcgggttgcttcttatcgacaccaggcttctgcgcgagaagctgatcccatcgcccctacggtgtctggaggtgctaaatttcatgctgccacggcaaagcaagaagaaggtggacgctatcatcttcgaggcccaggatgctgaatataaactcgaattcgtccccaccactactaccgagtacgttcattcactgctctttttggatgagatccaggaacggattgagtccctggaggatgagggtaacatcgtgacccagatgtacaagcttatggagcagtaccaggtaccaacccccccagaggacttcgccgtatttgcaactatgaagccgagcatagtcgctgtgaggaatgctatagacaaaagcgttggggatagggagtctagcatcaaacaattttgcgtccacctgggcagtgatctggaggagctgaacaacgaggtaaatgaagtgaagctgcaggcccaagatccgcagatcttagacataagcgccgaccaagataagatcaggctcatcctcaacaacttacagtctgtcctggccgatctccagaaacgagcttttcagtacaagagttatcagaaaaactttaaggtagaagtatccaagtttgaagcgctggaagaggtgtcggccgagctcaagctcaagcaactcttatgggatagctttagcgaatgggataagcttcaacaggagtggttaaaatccaagtttgactgcctggatcctgaggtgttgaatggacaagtgtcaaagtatgccaaattcgtgacccagctggagaaggggcttcctcctaacagtgtggtgcctcagcttaaatataaagtcgagaaaatgaaggagaagctgcccgtgattatcgacctgagaaatcctactcttaaggcccgacattgggctgccattgagcaaactgttgacgccacgcttgtggacgcagaaatcccattgaccctcgaaagattgtctcaactccacgtcttcgattttgggcaggaaatccaggacatctctggccaggcttcaggggaggcggccttagaagcaattcttaagaaggtggaggatagctggaagacaacagagttcgtcatcctaccccaccgggattcaaaggacgttttcattcttggagggactgacgatattcaggtgctattggatgactcaacgatcaacgtcgccactcttgcaagcagtagatatctagggccgttaaagactcgcgttgacgagtggcagaaacaattggcccttttcaaccagactttagaagaatggcttacatgtcaaagaaattggctctatttggagtccatttttaacgccccagatattcagcgtcagctgcctgccgaggcaaagatgtttctgcaggtggataagtcctggaaagagatcatgcgcaaggtgaatcggctccctaacgcgctgagggctgcgacacagcccggtttacttgaaacattccaaaataataatgcccttctggatcagatacaaaaatgcttggaggcctatctcgagtcaaagagagtgattttcccgcgtttctactttctatcgaatgatgaactgcttgagattctcgcgcaaacccggaatccccaagctgtgcaaccccacctgcggaagtgcttcgactcaattagcaagttggagttcgctctcatgcctccggcagagggcaaaatccctggaatagacggagaacctgagaaggtctacaccaatgacatcctggcgatgctaagcccggagggagagcgcgtgtccttaggcaagggactcaaagctcggggcaatgtggaagaatggctaggcaaagtggaagaagctatgttcacctcactgcgcagactctgcaaagcggctattgctgattaccagggcaagctgaggaccgactgggtggtcgctggtcaccccagccaagttatccttacagtctcccagattatgtggtgtagggatttgaccgagtgtctggagactgaacattctaaccacattcaggcactgaaaaatttcgaaaaggtgaatttcgaaagattaaacgctcttgccgccatcgttcagggaagtcttcctaagctacatcgtaatatcctgaccgcactgatcactatcgacgttcacgccagggacatcgttaccgaacttgttcaatcaaaagtggaaacagtggagtctttcgactggcaacggcagctgcggtattattgggacattgatctggataactgtgtggccaggatggcgctttctcaatacacttatggatacgagtaccttggcgcatgtcccagactcgtcatcacacccctgacggaccgatgctacctgtgcctgatgggggcattacaactggacctgggtggcgcccctgctggccctgcagggaccgggaagaccgagacgacaaaggacctggccaaggccctagctatacaatgcgtcgtctttaattgctcagatggcctggattacaagatgatgggtagatttttctccgggctggctcagtccggtgcttggtgttgctttgacgaattcaaccggattgacatcgaagtgctcagtgttatagcacagcagctcatcacaattcgtaatgctaaggccgcaaagctctcacggtttatgttcgagggcagggaaatcaaattggtaatgacttgcgccgcatttatcaccatgaatccaggttacgcagggcggacagagctgcccgataacctgaaagcgttgttcaggccgttcgcaatgatggtgccaaactatgctctgatcgctgaggtgattctgtattctgagggatttgaatcttcgaaaatccttgcaaggaagatgacacagatgtacaaactgtgctcagaacagctgtcacagcaggaccattacgacttcggcatgagggctgtgaaaagtgttttggttatggccggatctttgaagcgagagaaccctgaccttaacgaagatgttgttcttattcgcgcactccaggatagtaaccttccgaagttcctgacagatgacgccttattgttctctggaataatcagcgatctgtttccaggtgtgcagatccctgagcatgattacggcatcctgcagtctacaatcgtcgacgttatgaaccgccagaacctgcagcccgagatgtgtatggtgaggaaggtgatccagttttacgaaaccatgctggtgaggcatggagtcatgctggtgggacctaccggtggcggaaaaaccactgtgtacagaattctggctgagaccctgggaaacttacagaagttgggcattgagaatagcttttatcaggcagttaagacatacgttcttaacccaaaatccatcacaatgggggagctgtatggtgaggtgaacaatctcactcttgagtggaaggatggactcatggcactgagcgtcagggcggccgtaaatgatacctccgaggatcacaagtggataatctctgatggccctgtggacgctctctggattgaaaatatgaacactgtgttggacgacaacaagatgctttgcctggcaaattccgaacggatcaagctcacaccgcaaatacatatgctgtttgaggtccaagatctccgcgtggctagccctgccaccgtcagccgatgtgggatggtgttcgttgaccctgaagagcttaaatggatgccttacgtgaagacttggatgaaggggatcagcaaaaaactcaccgaagagacgcaggaatacatcctgaacctttttcagcgctatgtggatgaaggtctgcacttcattaataagaagtgctcacaggcgattccccaggtggatatcagcaaagtcacaacactttgttgcctcctggaatcactgatcttgggaaaagatggcgtgaatcttgccatggagcaaaccaaattgaatacaatcctttgccagacctttgtgttttgctatctttggtcactcggcggaaatctcacagagaactactatgattccttcgacacttttattcggacacagttcgatgataatccagacgcaaggctacctaatagtggcgacctgtggagtatacacatggactttgataccaagcggctggacccctgggaacggatcatccccacttttaagtacaatagggacgtccccttcttcgaaatgctggtccccaccactgatactgttcgctatggatacctgatggagaagctgctggccgtgaagcatagcgtgttgtttacggggataaccggagtggggaagagtgtcatcgctaaaggcctgcttaataagattcaagaatctgccggatatgtgccagtttacctgaacttcagcgcccagacctcctcagcaaggacacaggaaatcatagaaagcaaactggagcgaaaacgcaagaacatcctgggagcccccggaaacaaacgcatagttattttcgtggacgatttaaacatgccacggctcgaccgctatggtagtcagccaccgattgagctactccggcagtaccaggacttcgggggcttctacgacagaaacaagctgttttggaaagaaatccaggacgtcactattatctcggcctgcgcccctcctggagggggacgcaacccggtgacacctagatttataagacatttttcaatgctgtgtctccccatgccttcggaacacagtttgaaacagatttttcaggcaatcttaaacgggttcctctctgattttccacctgcagtcaaacaaacagcaagctcaatcgttgaggcatcagtggaaatatacaacaaaatgagtgtcgacctgctcccgacacccgccaaaagtcactatgtttttaatctgagggacctgagcaaatgcgttcaaggaatcttgcaatgcgaccctggtaccatccgcgaagagatacaaatcttccggctcttctgccatgagtgccagcgggtcttccacgatcgcctgattaataatgaggataaacactacttccacgtaatcctcaccgaaatggcaaataaacactttggcattgctattgatttagaatactttcttaataagcccatcatattcggggactttataaagttcggagccgataaggctgaccggatctatgacgatatgcctgacatcgagaagacggctaacgtgctacaggattatctggacgattataacctcaccaacccaaaggaggttaagcttgtattcttccaggacgctatcgagcacgtgagtcggatagccagaatgatcaggcaggagcgggggaacgctctgctagttggggtaggcgggactggcaagcaaagcctcacaagactcgcggcccacatctgcggctataagtgcttgcagatcgaactctctagggggtacaactacgactcatttcatgaagatctacgaaagctctataagatggctggcgtagaggataaaaacatggtgttcctattcactgatacccagatcgtcgtggaagagttcctcgaggacatcaataacatactgaattcaggagaagtgccgaatttgttcgagaaggatgaactcgagcaggtcctggccgcaacacgtccacgggcaaaagaggtgggaatttcagagggaaatagagacgaagtgttccaatacttcatttctaaggtgcgccagaagctgcacatcgtgctttgcatgtcccccgttggagaggcatttcgctcacggtgcaggatgtttcctagtctggtcaattgctgtacaattgattggttcgtccagtggccccgggaagcccttttgagcgtaagtaagacatttttttcccaggttgacgcaggaaacgaagagttgaaggagaagcttccactgatgtgcgttaacgtccatctaagtgttagtagtatggctgaaagatactacaacgagctgagacgccggtactatactactcccacttcgtatttagagttaatcaacctttatctgagcatgctctctgagaagcggaagcaaattatctctgcgagagatagagtgaagaacggactcaccaaactgttggagacaaatatcctggtggacaagatgaagttggacctatcagcactggaaccagttttgctggcgaagtctgaagacgtggaagcattgatggaaaaactagccgtggaccaagagtcggcagaccaggtaaggaacacagtccaggaggatgaagctaccgctaaggttaaagctgaagagacccaggccatcgcagacgacgcccagcgcgaccttgatgaggccctgcccgccctcgacgccgccaataaagctctggactcactcgataaggctgatatctcggagatccgcgtgtttactaaacctcctgacttggtcatgaccgtcatggaagctatctccatactgttaaacgcgaagcctgactggccctccgcaaagcagctgctgggcgactccaacttcctcaagcgactattggagtacgacaaggagaatattaagccccagattctcgccaagctccagaagtacataaacaaccctgattttgttccagagaaagtagaaaaggtaagtaaagcatgcaagtcaatgtgtatgtgggtgagggcaatggatttatacagccgggttgtgaaggtggtggagcccaaacgccagaagctgcgcgcggcccaggccgaactggacatcaccatggcaactctcagagagaagcaagccttgctgcggcaggtggaagatcagatacaagctcttcaggacgagtatgataagggggtaaacgaaaaggaaagcctggctaagaccatggcattaactaaggcaaggctcgttcgtgcaggcaagctgacggctgcgctggaggacgaacaggttaggtgggaggagtcaattcaaaaatttgaggaagagatctccaatatcactgggaatgtatttatcgcggccgcttgtgtagcctattatggtgcttttactgcccagtaccgacagtccctgatagagtgctggatacaggactgtcagtctttggagatcccaattgatccaagtttctcactgatcaatattttgggcgacccctacgaaattaggcagtggaacactgatggattgccccgggatctgatttctaccgaaaacggcatactggttactcagggccgtcgctggcccctgatgatcgaccctcaagatcaggccaaccggtggatccggaacaaggagtctaaaagcggcctgaaaatcataaaactgacagattccaactttctgagaatcctagagaattcaatacggctggggctgcctgtgctcctcgaagaactaaaagaaacccttgatccagcactggaacccatcttgcttaaacagatttttatcagcggcggccgcctactgattcggctaggcgactccgacatcgactatgacaaaaatttcaggttctacatgactacaaaaatgccaaatccccactatcttcccgaggtctgtataaaggttaccattattaactttactgtcaccaaatcagggttggaagatcaactgctctcggacgtagtccggctcgaaaagcctcgtctggaggagcaaaggatcaagctgatcgtaaggatcaatactgacaagaatcagctgaaaacgatagaagaaaaaatcctgcgcatgctcttcacctcggaaggtaatattctggacaatgaggagctgatcgacacactgcaggattccaaaattaccagcggagcaattaagacgaggctcgaagaggctgagagtactgaacagatgataaacgttgcaagggagaaataccggccagttgcgacccaaggcagtgtgatgtactttgtgatcgcctccttgtctgagatcgatccgatgtaccagtacagtcttaagtactttaaacagctgttcaacaccacaatcgaaacctccgtcaagacagagaatttacagcagcgccttgacgttttgctagagcaaactctgctcaccgcttacgtgaacgttagcagagggctgtttgagcagcacaaattaatatatagctttatgttgtgcgtagaaatgatgcgtcagcaggggaccttgtctgacgcagaatggaatttctttctccgtggatctgccggccttgagaaggaacggccccctaagcccgaggctccatggctacccaccgctacctggttcgcctgttgcgacctcgaggagagctttccagttttccacggtttaacccagaacatcctctctcatcccatttctattagactcggctctttcgaaacttatattaatccacagaaatgggagggttattccaagatgaagcacgaagacaaacacatgcgccaggagaaggaagcagcccaccaggatccctggagcgctggattgagcagcttccacaagctgattctgataaaatgttgcaaagaggaaaaagtcgtatttgctctcactgacttcgtcatcgaaaatttggggaaacagtttatcgaaacccctccagtggacctgccaaccctctaccaagacatgtcttgtaacactcccctcgttttcattctctctactggctctgatcccatgggcgcatttcagcgctttgcaagagaatccggctatagcgagcgagttcagagcatatctttgggccaaggtcaggggccaatcgctgagaagatggttaaagacgccatgaaatccggaaactgggtatttcttcagaattgccatctggccgtgtcctggatgctcgccatggaagagctgatcaagaccttcacagatcccgatagcgcaatcaaggatacatttcgcctgtttctctcctctatgccaagtaacacatttcctgttaccgtactccagaatagcgtgaaggtgactaacgagcctcccaagggtttgagagccaacattagaagggcatttactgaaatgacaccatctttctttgaggagaacattctgggcaaaaaatggaggcagattatattcggcatctgctttttccacgcaattattcaggaacgtaaaaagtttggtccactgggatggaacatttgctatgagtttaatgatagtgacagggagtgtgcattgttaaatctgaagctctactgtaaggaagggaaaattccttgggatgcccttatttatatcacaggagagatcacttatgggggaagagtgactgactcctgggaccaaaggtgtctacgcaccatcctcaaaaggtttttcagccctgagacgcttgaggaggattataaatatagtgaaagcggcatctactttgcgccaatggccgattcgttgcaggaattcaaagattacatcgagaatcttcccttgatcgacgatcccgaaatcttcgggatgcatgaaaatgccaatcttgtgttccagtacaaggaaacctcgactctcatcaatactatcctggaggtgcagcctagatcgtccaccggaggagaggggaaatccaacgacgaaattgtgcaggaactagtggccagcgtgcagactcgcgttcccgaaaaactggagatggaaggagcaagtgagtccttgttcgttaaggacctgcagggtaggctcaactcactaactaccgtcctgggacaggaagtggaccgttttaataatttgttgaaactcatccacaccagtctggagaccctgaacaaagccatcgccggttttgttgtgatgtccgaggagatggaaaaagtctataattctttcctcaacaaccaagtccccgcgctctggtccaatacagcctatccgagcctcaaacccctcggctcctgggtcaaggacctgattctgcgaactagcttcgttgacctgtggctgaaaagaggtcagcccaagagttattggatctccgggttctttttcccacaagggttcctaaccggaactctgcaaaatcacgcccggaaatataatcttcctatcgacgagctctcttttaagtactccgtgatccctacctaccgagaccaggctgccgtgatcgaggcagctaagactgtgcagttcggtcaggagctacctatggatatggagctgcctagcccagaggacggagttttggtccacggaatgtttatggatgcaagccgttgggatgacaaggaaatggtgattgaagacgcactgcccgggcagatgaaccccgttttaccagtggtccacttcgagccacaacaaaattataaaccctcaccaaccctctaccactgccccctttataagactggagctagggccggaaccttgagcactacgggacacagcaccaacttcgtggtgactgtactgctgcccagcaagagatccaaagactattggatagcaaagggatccgctctgctttgtcagttatccgaatag

SEQ ID NO: 115248 - DNA, 7593 bp, Artificial Sequence
  Description of Artificial Sequence: Synthetic coding sequence
atgacgttccgagccacggattcagaattcgacctgaccaatatcgaggagtatgccgagaattcagccctatcacgcctcaacaatatcaaggcaaagcagcgcgttagttacgtgacgagcactgaaaatgagagcgatactcagatcctgacctttcgccacattactaaagcccaggaaaaaacccggaaacgccagcagccaatcaaacttgagccccttcccgtccttaaggtgtatcaagatcataagcagcccgaatacattcatgagcagaacaggttccagctgatgacagctgggattattaaaagacctgtatccattgccaaaaagtcattcgccacctcgagcacacagttcctggaacaccaagacgctgtaaaaaagatgcagatccatcgaccctatgttgaggtgttctccccgtccccgcctaagctgccccatactggaattggtaagaggggactgttcggtacacgctctagcgcatatccgaaatacaccttccatgatagggaagaagtggtcaaagcgaatatcagggacccgctccagatcatcaaaatcattagggagaatgagcatctgggattcctgtatatgataccagccgtcccccgcagtagcatcgagtacgacacatataacctcaaagtggttagctacgagaacatcaacaaaaatgattattacaccatttcccagcgagcagttacccacatttacaacgaagatatcgagttcatcgagattgatagatgggaacaggaatacctgtatcaccgggagttgacgaaaattccaatattctcattgttccggaaatggaaagctttctctgtatggaggaagaacgtgcgctccaagaagattacgggatgtcaaaagtcattgcaaaaaaacctattcatagtcaatccacacctgcggcctgctctactaaagattaacgagctgtgttaccatcttagctttatggggctgtgttatatcgagaagtgccacacatacacgctgcaggagttcaaagcagcacaagtcatcagactggcagaggtgaccgagagactgggcgaatttcgtaacgaagccaagtacgtggtgcgaagagcctgcaggtttgctttgcgggccgccggtttcgtccccgatgattgcgcctttggccccttcgaggactaccacaaagtgcagagttccggctcattcattaatacacctcatgaactgccgacttatggggacagtgaaaagatgacctatacagaacaagcatccaagaggcattattgtatgaggctgacgtgctttataaggcttaatgactacttaatcgaaaataccatgcacattctcaccgtcaacgccgtcaatagcctgctcaaccatctgaccgacaaacttaagagaaccccatcagcagatgtgattcagaaatggatcaccgaggaaaagcccgaagttcccgacaagaaaggcacactgatggtcgagaagcaggaggaagacgagagccttatccccatgttcttgaccgagttgatgctcaccgtgcagtccctactgtttgaaccgtcacttgaggattttctggacgggatcctgggggccgtcaatcactgccagaatacagtattatcggtccctaacctggtgccagactcctactttgacgcgttcacatctccatatattaataataaactggaaggcaaaacatgtggaacaggaccttctctggccgctgttttcgaagatgacaaaaatttccacactattatcagtcagattaaggagacaatccaggccgctttcgagagcgcccggatctatgccgcgactttcgagaagtttcaaattttctttaaggaaaacgaatctctcgatctgcaagcgctgaagcttcaggagcccgacatcaattttttctctgagcaacttgaaaagtatcacaaacagcataaagacgccgtggccctaaggcccaccagaaatgtcggcctgctgctcattgatacccggctgcttagggagaagctcatccctagcccactcagatgcttagaggtgttgaactttatgctaccacgacagtcaaaaaaaaaagtcgacgcaatcatttttgaagcccaggacgcagagtacaagctagaattcgtgcctactacaacaaccgaatatgtccattccctgctgtttcttgatgagatacaggaaagaattgaatcactcgaggatgagggaaatatcgtgacccaaatgtacaaactgatggagcagtaccaggtgcctactcccccggaagacttcgccgtgtttgccacaatgaagcctagtatcgtcgccgtgcggaacgctatcgataaatcagttggggaccgcgaaagcagtatcaagcaattttgtgttcacttggggagtgatctcgaagagctaaataatgaggtcaacgaggtcaaactccaggcccaggaccctcagatcctcgacatttcagccgatcaagataaaatccgactgatattgaataatctgcagagtgttcttgcagatctgcagaagcgggccttccagtacaagtcctaccagaaaaacttcaaagtggaggtttccaaattcgaggctctcgaggaggtgtccgccgaacttaagctgaagcagttgctttgggactccttctcagaatgggacaagcttcagcaggagtggctcaaaagcaaatttgactgtttggatcctgaggtgctgaatggccaagtttctaagtatgccaaattcgttacccagttagagaaaggactgccccctaacagtgtagtaccccagctcaagtacaaggtggagaagatgaaggaaaagctgccagtgatcattgatttacggaaccccaccctgaaggctcggcactgggccgctattgaacagactgttgatgctacacttgttgacgccgaaatcccactaactctggagaggcttagtcagctgcatgtgttcgatttcggtcaagagatccaagacatctccggacaggcaagtggggaagccgccctcgaggccatattgaagaaggtggaggactcctggaagaccacagagttcgtgattctgccacatagagattctaaagatgtcttcattctgggaggaacagatgatattcaggtgcttcttgatgactcaactattaacgttgctacactcgcctcgtccaggtacctgggccccctgaagaccagagtcgacgagtggcagaagcagttagccttgtttaatcagactctggaggagtggctcacatgtcagcggaactggctctacttggagtctatttttaacgcccccgacattcaacggcaactgcctgcagaagctaagatgttcctgcaggtcgataaatcatggaaagaaatcatgcgcaaggttaatcgtctgcctaacgccttaagggctgcaactcagcccggactgttggagacttttcagaacaataatgccctcttagaccagatacagaaatgcctcgaagcctatctggaatcaaagcgcgtcatctttccccgattctacttcctgagcaatgacgagctgctggagatcctggcacagactagaaaccctcaagccgtccagccccacctgagaaagtgcttcgattccatttcaaagcttgagtttgctctgatgccaccagctgagggaaaaatccccgggattgacggcgagcccgaaaaggtttacactaatgatatccttgccatgctgtctccagagggagagcgggtcagcttgggcaaagggctcaaggcccgcggcaacgtggaggagtggctcgggaaggtcgaagaagctatgtttacctctctgagaagactgtgtaaggccgccattgcagactaccagggcaaactgagaactgactgggttgtagcaggacacccctcccaggtgatccttacagtgagtcaaataatgtggtgcagagacctgaccgaatgtctagaaacagaacattccaaccacatccaggccctcaaaaactttgagaaggttaactttgagcgcctgaatgcactagccgcaatcgtgcaggggtccctgccaaagctgcatcggaatatcctaaccgctctcattaccattgatgtgcatgcccgagatattgtgacagagctggttcaaagcaaagttgagacagtcgaatcttttgactggcagcgtcagctgagatactactgggacatagatctggacaattgtgttgcccgtatggccctttctcagtatacctacggatatgagtacctcggcgcctgcccacgcctggtgatcacgcctctcaccgaccggtgctacctgtgcttaatgggagcattacagttggacctgggcggggctccagcaggaccagccggaaccggcaaaaccgagacaacaaaagatctcgccaaagcactggctattcagtgcgtggtgtttaattgctctgacggactggactataaaatgatgggccgcttctttagtggactggcccagagcggtgcctggtgctgcttcgacgaatttaatagaattgacatcgaagtgttatccgtaatcgcgcagcagctcatcacgattcggaacgcaaaggcagccaagttgtcgagattcatgtttgaaggccgcgagattaaacttgtcatgacatgcgccgcgtttattactatgaacccaggctacgccggccggaccgaacttcctgataatctgaaggcgctttttaggccgtttgctatgatggtcccaaactacgcactaatcgccgaagttatcctgtactccgagggctttgaatcttccaagatcctggcacggaaaatgactcagatgtacaagctttgttctgaacagctgtctcagcaggaccactacgacttcggtatgcgagccgtaaaatccgtgctcgtgatggcagggtcactcaagcgagagaacccggatttaaatgaagatgtggttctgataagagccctgcaggattcaaacctccccaagtttctgactgacgacgcacttcttttttcaggcataatatccgacttatttcctggtgtgcagatcccagaacacgactatggcattttgcagtctaccatagtagacgtgatgaaccgtcagaatctgcagcctgaaatgtgcatggttaggaaggttattcaattttacgaaactatgctcgtccggcatggggtgatgctagtaggtcccaccggggggggcaaaaccacggtgtaccggatcctagcagagacacttggtaatcttcagaaattaggaattgaaaattccttctatcaggctgttaaaacatatgtgctgaaccctaagtcaattacaatgggagaattgtatggtgaggttaataacctgacccttgagtggaaagatgggctaatggccctgagtgtcagagctgccgtgaacgatacgtccgaggatcacaagtggattatcagcgatggtcctgttgacgccctctggatcgaaaacatgaatacggttcttgatgacaataagatgctgtgcctggcaaacagcgaacgcatcaagctcacgccacaaatccatatgcttttcgaggtgcaggaccttcgtgtggccagcccagccacggttagtaggtgcgggatggttttcgtagatcctgaggagctgaaatggatgccctacgttaagacttggatgaagggcatttccaagaagctcacagaggaaacccaggagtatatactcaatctgtttcaacgttacgtggacgaggggctgcacttcatcaataagaagtgcagtcaggcgattccgcaggtggacatcagcaaggtaacaactctgtgttgtttgctggaatcactgatcctcggaaaggacggcgtcaacctggctatggaacaaactaagctgaacacaattttgtgccagacgttcgttttctgttacctttggtctctcgggggcaatcttaccgagaattattacgactcatttgacaccttcataagaacccagttcgatgacaatcctgatgcgcgcctcccaaactctggcgatctgtggagtattcacatggatttcgacaccaagaggctggacccctgggaacgaattatcccaaccttcaaatacaaccgggacgttccctttttcgaaatgctggtgcctaccactgataccgtgaggtacgggtatctgatggaaaagctcctggccgttaaacactccgttctctttacggggatcaccggcgtggggaagagcgtgattgccaagggtcttctgaacaaaatacaggagagcgccggctatgtgcccgtatatctcaactttagcgcgcaaacgagctccgcaagaacccaggagatcattgagagtaagcttgagcggaagcgaaagaacattctaggcgcccctgggaacaagcggatcgtcattttcgtagatgacttgaatatgcccaggctcgatagatacggtagtcagcctcctatagagttactgaggcagtatcaagatttcggcggattttatgatcgaaacaagctcttttggaaagagattcaggacgtaaccatcatcagcgcctgtgcaccaccgggcggggggaggaaccccgttacgcctcgattcattaggcacttttcaatgttatgtctgcccatgccttccgaacacagtctcaagcaaatctttcaggcgattctgaacggctttctgtctgactttcctcctgcagtcaaacaaaccgccagttcaattgtggaagcttctgttgagatctacaacaagatgagtgttgacctcttgcccacccccgcaaagtcccattacgtctttaaccttcgggacttgtcaaagtgcgtccaggacaagcattttgggatagccatcgacttagaatacttccttaataagccaattattttcggagatttcatcaagtttggggcagacaaggcggaccgaatctatgatgatatgcctgatatcgaaaagactgccaatgtgctacaagactacctggatgattacaatttgaccaatcctaaggaagtcaaacttgtctttttccaggacgcaattgagcatgtgagtagaattgccaggatgattaggcaggagcgcggaaatgccctactggtaggtgtaggaggtaccggcaagcagtcgctcacccgcctcgcagctcacatctgcgggtataaatgcctgcagatcgaactgtctaggggatacaattacgacagctttcacgaggatttgcgcaagttatataaaatggctggagttgaagacaagaatatggtgttcctgtttaccgatactcagatcgtagttgaggagtttctcgaagatatcaataatattcttaacagcggagaggttccaaacctgtttgaaaaggacgagctggaacaggtattagccgctacaagaccacgcgcgaaagaggtgggcatctcggagggaaacagggacgaagtcggctgcgctagagttgtgatgtggctgtatcacaagaatgtgtcctctccctttatttag

SEQ ID NO: 115249 - DNA, 14088 bp, Artificial Sequence
  Description of Artificial Sequence: Synthetic coding sequence
ggtgcagaggctccgccgtccaccgaagaggccgcacctccccgcagtgaggaggaggaagccccgcgccctcctacagtggaggctccagccgaagacgggttctcaccttcagccgaggacgcagtgtcatccgtggtcgattatcgcgatctgatcccaagcgaagaaggcatcgtcttgcccgatgatcacgaggccgatctgaatcgcgtaagacaaagactggcgccgcggccagtgcaaagcgttatctctgaggtgctgtctctaccctcctcacggagaagcagtagatatcgaagatccatgagtggactgcctaatttgcaggaaacgctgaaagaacggcaggcccgcttccgagaagcccgtgaaagtcggaggctgaaaatagacccttcatataagtacatctttgagatccttgctgagaacctcggtcttgacatagtcacggtggaggagctcatccttgattgtccaagtttggaagcattcaccaacttttttgctaaggacggatgtaaaaccctaaaattcctgtaccaagagggcgatgtgccaggaattgagtgcgggcgaacaatagccggcgccacaaaaggagccaagatgatgaaactctacatcgacaatgcggcgcctgacaaactgaaggggctgtgcattttctttgttaggtgcaggaacgacgtggccatcaatgtgaagaccatccaggaagaggccctcttcactgtattggacgccagcaaaggattactgaacgggatccgggatatgctcgccaacatcttcctacctgccgttctcgcaactaataactggggcgccttaaaccaaagcaaacagggcgagtcagaaaagcatattttcactgaaactattaatcgctatcttagcttccttgatggggctagaatttccattgagggcacagtgaagctcaaaacgatagacaacgtcaacttcagcaagcttcacacatttgaggaggtcacagcggcagcctcaaatagcgagaccgttcaccaactagaggaagtgttgatggtgtggtataaacaaatagaacaggtcctgatagagtcagaacagatgagaaaggaggctggagattctggtcccctgaccgagctcgagcattggaaaagaatgagcgctaagttcaactatatcatcgaacaaattaagggtccatcctgcaaagcggtgatcaatgtgctaaacgtggcgcatagcaagctgctcaagaattggcgagatctcgacgcccgaatcactgataccgctaacgagtccaaagataacgtaaggtatttgtacacgctggaaaaggtctgccagccactgtataaccatgacctggtgagtatggcccacggtatccagaatctgataaacgcaattcggatgattcacggcgtgagtagatattacaataccagcgaaagaatgacatctctgtttatcaaagtcaccaatcaaatggtgaccgcgtgcaaagcgtacattaccgatgggggattgaatcacgtgtgggatcaggagacgcctgtggtgcttaagaaaattcaggattgcatctttttgttcaaggaatatcaggccagttttcataaaactagaaagctcatcagcgaaagcagcggggaaaagagcttcgaggtttccgagatgtatatcttcggtaagttcgaggctttttgtaagcgcttagagaagatcacggagatgattaccgtggttcaaacttatagtacactgtctaattcaaccatcgagggcatcgatatcatggctatcaagtttcggaatatttaccagggcgtgaagaaaaaacaatacgatattctggatcccagaaggactgaattcgatacagactttctggatttcatgactaaaatcaatgggctggaggttcaaattcaggcgttcatgaattcatctttcggtaagatattatcctcacagcaggcgctgcagctgctgcaaagattccagaagctaaatattccctgtctcgggctggagatcaaccacacaatcgagagaattctgcagtattatgtggccgagctcgatgcaactaagaaactttatcatagtcagaaggacgaccctccactcgctaggaacatgcctcctatagcaggtaagatcctgtgggtcagacagctgtatcgccggataagcgaaccaattaattatttttttaagaactcagatatcctgagctctccagacggcaaagcggtgatccgtcagtataacaagatatcttacgttttggtagagtttgaggtggtttatcacacagcgtggatacgggagatcagccaactccattacgcccttcaggctactttatttgtgcgccatccagaaacagggaagttactggtcaacttcgacccgaaaatcctggaagtggtgcgggagaccaaatgtatgataaaaatgaagctggatgtccctgagcaggcaaagcgactcttgaagctagagagtaagttaaaggcagataagttgtatctacaggggctcctccaatactatgatgagctttgtcaggaggttccaagcgttttcgtaaacctgatgacgccaaagatgaaaaaggttgaatctgtgttaagacagggactcaccgtgctgacctggagctccttgacactggaaagtttttttcaggaggttgagcttgtgctggacatgtttaaccagttgctgaaaaaaatcagtgacctgtgtgagatgcacatcgacaccgtccttaaggagattgcaaaaacagtcctgataagtctgcccgagtctggggccacaaaggtcgaggacatgctcaccttgaatgagacctacactaaggagtgggctgacatcctaaaccataagtccaagcatgtcgaggaggcagtgagggagctcatttctatttttgagcaaatctatgaagtgaaatacaccggtaaggtgggaaagcagtccgaacagagaaagcacgtggtcttcggtagcgaaactggcgagggcgagaacaacgactacgaggccaacattgtgaacgagtttgatacccatgataaagaggatgaattcaaaaaggagtgtaaggaagtattcgccttcttctcacaccagctgctagacagcttgcaaaaagcaactagactgtcactggatacgatgaagaggcgaatctttgttgctagcctctacggtcgcaagcagtccgaggatattattagtttcatcaaatccgaggtgcatctggctatacccaacgtggtcatgatcccttccctggacgatattcagcaggctatcaatcggatgatccagctcacacttgaagtcagcaggggggttgcccactggggccagcagcagatccggccaatcaaaagcgtcataccaagccctacaacgactgacgtgacccaccaaaacaccggcaaactcctaaagaaggaggagcgtagctttgaagaagctattccagcacggaagttgaaaaacttttaccccggcgtggcggagcataaagatatctctaaactggtgctgctccttagttcatcagttaattcgctaaggaaagctgcgcacgaggccctgcaagacttccagaaatacaagaccttgtggaccgaagatcgggacgtgaaggtgaaagaatttctggctaacaatcccagcctgaccgagatccgatcagagatattgcattatgccacatttgagcaggagatcgacgaactgaaaccaattatcgttgttggggcactggagttgcatacagagcctatgaagcttgctctgtcgattgaggcaaaagcctggaagatgctcctgtgtcggtacttaaatgaggagtataagaaaaagatgtcctatatgatcgctttcatcaacgaatacttgaaaaaactgtctcgcccgattcgggacctggacgatgtacgcttcgccatggaagctctctcttgcatccgcgacaacgagattcaaatggatatgaccctagggcccattgaggaggcctatgccatcctgaacaggttcgaggtcgaggtgacaaaagaggagagcgaagccgtagacactctgagatactcattcaacaaactgcagtctaaggcggtctctgtgcaggaggatcttgttcaggttcagccgaaattcaagtcaaatctcctggagagcgtggaagtgtttagagaggacgtgatcaactttgccgaagcgtacgagctggagggccctatggtgccaaatatcccaccccaagaagcctccaataggttgcagatcttccaagccagcttcgacgacctgtggcgtaaattcgtgacatattcttctggggagcagttatttggcttgccagtgactgattatgaggtgctccacaaaactcgcaaggagctgaacctgttgcagaagctctacgggttatatgatacagtgatgagctctatttccggttattatgaaattctctggggagacgtcgatattgaaaaaatcaacgcggaactcttagagtttcagaatcgctgtaggaagttgccaaaaggcttaaaagactggcaagcattcttggaccttaagaagagaatagatgatttttctgagagctgtcccctgctcgagatgatgaccaataaggccatgaagcagagacattgggataggatttcagagttgacaggaactccctttgacgtcgagtccgactctttttgtttgcgtaatatcatggaggcgccactgctgaaacataaagacgatattgaagacatttgcataagcgcaattaaggagaaagacatcgaggccaagttaacccaggtgatcgagaactggacgaaccagaatttgtcattcgctgcctttaaaggaaagggggaactcctgcttaaggggaccgaatccggcgagattatcaccttaatggaagacagtctgatggtgctcggctccctgctgagtaaccggtacaatgccccgttcaagaaaaacatccagaactgggtttataaactgtccaccagctcagacattatcgaagagtggcttgtcgttcagaatctctgggtgtaccttgaagcggtgttcgtgggaggcgatatcgcaaaacagcttcctcaagaagctaaaagatttcagaacatcgataagagctggatcaagattatgcagagggcacacgagaatcccaatgtgatcaattgctgtgtgggggacgaaaccatgggccagctccttccacacctgcacgagcaactagaagtgtgccagaagagcctgaccggttacctggagaagaagcgcctgctcttccctagattcttctttgtcagcgacccagttctgctggagattctcggacaggcctcagacagccataccatccagccacacttgccggccgtcagcgacaacatcaatgaagtgacattccatgctaaagattacgatcgtatcatggccgtaatcagtagggaaggcgaaaagattgtcctcgacaattcggtgatggccaagggcccagtcgagatctggctgctcgatctcttaaagatgcagatgtcatcactgcataacattatcaggagcgcgttttatcagatatcggacagcgggttccagcttcttccgttcctgtcccattttccggcacaggtcggcctgttgggaatacagatgctatggacacacgactccgaagaggcactcagaaatgcaaaggatgatcgcaagattatgcaagtgaccaaccagaagttcctcgatattctgaacacccttatttcccagacaacccacgacctgtccaaatttgatcgggtgaaatttgagacactgatcactattcatgtgcaccaacgggatatattcgacgatctcgttaaaatgcatatcaaaagcccaactgacttcgagtggctcaagcaatctcggttttacttcaaggaggacctggatcagaccgtggtttctatcactgacgtggactttatttaccagaacgaatttttaggttgcacagatcgcctagtaatcacacctttgaccgataggtgctacattacgctcgcccaggccctcggcatgaacatgggtggagcaccagctggaccagccggcaccggtaagaccgagaccactaaagacatggggcgctgcttagggaagtatgtggtagtttttaactgcagtgatcagatggacttcagaggcttaggacggatttttaaagggctcgctcaatcagggtcttggggctgcttcgacgaattcaacagaatcgagttacccgttctatcagtggccgctcaacagatttatatcgtccttaccgcacgcaaggaacggaaaaaacagtttattttttccgacggagactgtgtggacctgaaccctgagttcgggatttttctgactatgaacccaggctacgccggtcgtcaggaattaccagaaaacttaaagattcagttccggaccgtggcaatgatggttccggataggcagattattatgcgggtaaagttggcaagttgcggattcctggagaacgttatcctagctcagaagttctacgtgctttacaaactgtgcgaagaacagctcaccaagcaagtgcactacgactttggtttgcgaaatatcctgtccgttctgcggaccctcggatcgcaaaagagagcccggcccgaagactccgagctctcaatcgtgatgcggggcctgcgcgatatgaatcttagcaagctggtggacgaggacgagccattattcttgtcattaattaacgatctgttcccggggctccagctggacagtaacacgtatgcggagttacagaatgctgtcgcccaccaagttcagatcgaaggccttataaaccatcccccctggaatctgaaactggtgcaattgtatgaaacctccctggtgaggcacggtctgatgactctggggccctcaggttccgggaaaaccaccgttatcactattttgatgaaggcacagactgagtgcggccgacctcatcgcgaaatgcgtatgaacccgaaggccatcaccgctccccaaatgtttggcagactcgacactgccaccaacgactggaccgatggcatcttttcaaccctttggagaaaaactctaaaggcaaaaaagggagagaatattttcctaatactggacggaccggtggacgctatctggatcgaaaatctgaatagcgttctagacgataataagacactcacactcgcaaacggcgacaggattcctatggcgcccagttgtaagctgctgtttgaggtgcataatatcgaaaacgcttcacctgctaccgttagccgtatgggcatggtctacatatcatcttccgcattgtcctggaggccaattttgcaggcctggctcaagaaaagaactgcccaggaggctgctgtgtttctcactctgtatgaaaaggtgttcgaagacacctacacatatatgaagctcaacctcaatccaaagatgcagcttctggagtgcaactatattgtgcaaagcctgaatttgctagagggacttatcccaagcaaagaagagggcggcgtctcctgcgtggagcatctgcataagctctttgtgttcggcctgatgtggtccctgggagccctgttagagttagaatcccgggagaagctggaagcctttcttagacagcacgaatctaagctggacctgccagagatacccaaaggttccaaccagacaatgtatgaattttatgtgacggattacggcgactgggagcattggaataagaagctgcagccctattactatccgactgatagcatccccgaatactcttcaatcctcgtgcctaacgtagataacattaggacaaatttccttattgatactatcgccaagcagcataaagccgtgctcctcaccggcgagcagggtaccgcaaagacagtgatggtcaaagcttatcttaagaaatatgacccggaggttcagctgtctaagagtctcaacttcagcagcgccacagagcccatgatgtttcagcggaccatagaatcctacgtcgataaaagaatcggctcaacatacgggccaccgggaggcagaaagatgacggtgttcattgacgatatcaatatgccagtgattaacgaatggggggaccaaatcaccaatgagatcgttcggcaaatgatggagatggaagggatgtacagcctggataagccaggagacttcaccaccatagtagacgtgcagctgattgctgctatgatccatcccggcggaggtcgcaacgatatccctcaaaggctgaagcgacaatttaccgtgtttaactgcacattaccatccaacgcaagcatagataaaatctttggaattataggttgcggttatttcgatccctgtcggagtttcaagccacagatttgcgaaatgatcgtgaacttggtgtccgttgggcgggtgctatggcagtggactaaggttaaaatgctgcccacccccagcaagtttcattacatatttaacctacgcgatctctcaaggatatggcagggaatgttaactatcaaggccgaggagtgtgccagcattccaacactgctgagcctctttaaacacgaatgttccagggtgattgctgatagatttattaccccagaagacgaacagtggtttaatgcccacctaaccagggccgtggaggaaaatatcggttccgatgctgcgtcttgtatactcccagagccatacttcgtcgatttcctgagagagatgcccgagccgacaggcgatgaaccggaggatagtgtgtttgaggtccctaaaatatacgagctgatgccatctttcgacttcctcgctgagaaattacagttttaccagcggcagttcaatgaaatcattaggggcacgagcctcgacctggtgttcttcaaggacgcaatgactcaccttatcaagatttcgaggattatcaggactagttgcgggaacgccctgctcgtcggcgtggggggatctgggaaacaaagcctctctcgcctcgcttcatttattgcaggctatcagattttccagataactcttaccaggagttataacgtgacaaacttgactgacgaccttaaagccttgtacaaggtcgccggcgctgacggcaagggaatcacgtttattttcaccgacagcgaaatcaaggacgaggcctttctggaatacctcaacaatctgctcagctccggtgagatctcgaacctattcgcgcgggacgagatggacgagattactcaaggcctgatctccgttatgaagagggagttgcctaggcatcctccgaccttcgacaacctctatgagtactttattagtcggtcacgaaagaacctccacgtcgtgctgtgtttttctcctgttggtgaaaaatttagggccaggtctcttaaatttccgggcttgatctcaggctgtactatggactggttcagcagatggccccgggaggctctaatagccgtcgcctcctatttcttgtcagactacaacatcgtgtgttcgtctgaaattaagcgccaggtggtggaaactatggggctgttccatgacatggtttccgaatcgtgtgagagttactttcagcgctatcgcaggcgagctcatgtgaccccaaagagctacctgtcgttcattaatgggtacaagaatatttacgctgagaaagtgaagttcatcaatgaacaggccgagcggatgaatatcggactggataaactcatggaggcttcggagagcgtcgctaagttgtctcaagaccttgcagttaaagagaaagagttagccgtcgcctcaatcaaggctgatgaggtgctggctgaagtgaccgtgtccgcacaagcatcggccaagatcaagaacgaggttcaggaggtgaaagataaagcccagaagattgtcgacgagattgatagtgagaaggtcaaagcagagagtaagctggaagcggctaaaccggcactggaggaagcggaagccgcattaaatactataaagcccaacgacatcgcaaccgtgaggaaattggcaaaaccgccccatcttattatgaggatcatggattgcgtcctgttgctgtttcaaaagaaaatcgatccagttactatggacccagagaaaagctgctgcaaaccttcttggggagagtctctcaagctgatgtccgccacgggattcctgtggtctctccaacagtttcctaaggataccatcaacgaggagaccgtggaactgttgcagccttacttcaacatggacgactacacgtttgagagtgccaagaaggtgtgtggtaatgtggccggcctgctctcgtggactctggccatggccatcttctatggtatcaaccgagaagtcctgccacttaaggcaaacctggccaagcaggagggcaggcttgccgtcgcaaacgccgaacttggaaaggctcaggcgctgctggacgaaaagcaagctgagcttgataaagtacaggccaagttcgatgccgccatgaacgagaagatggatctgctaaatgacgctgatacctgcaggaaaaaaatgcaagctgccagcaccctgatagacggtctgtctggggaaaagatcagatggacacagcagagcaaagagtttaaagcacagatcaataggttggtcggagatatattactctgcaccggttttctgagctacctcggtccatttaatcaaatattccgaaactatctccttaaagaccagtgggagatggagctgcgagcaaggaagattccctttacagaaaatttaaatctcataagcatgctggtggacccacctaccatcggggaatggggtctgcagggactgccgggcgacgacctgtccatccagaacggaatcatcgtcacaaaagcgactcgttaccccctcctgatcgatccacagacccaaggaaagacctggattaaaagcaaggaaaaggaaaatgaccttcaagtcaccagcctcaaccacaaatactttcgcactcacttggaggacagcttatctcttggccgccccctcttgatcgaggatatccacgaagagctagaccccgcattagacaatgtcctagagaagaacttcatcaagagcggaaccaccttcaaggtgaaagtgggtgacaaagaatgcgacatcatggacaccttcaaactctatattactacgaagttaccgaaccccgcgtttactccggaaatcaatgccaagacttctgtcatagattttaccgttacgatgaaggggctggagaatcagcttttgcgcagggtcatcctcacagaaaaacaggagctggaagctgaacgtgtcaagctgctggaagacgtaacgttcaacaagaggaaaatgaaggagttggaggataacctgctgtataagttatccgccacaaaggggtcgctggtggacgatgaaagtcttatcggagttttgcgtacaacaaagcagaccgctgcggaggttagtgaaaaattgcacgtcgccgccgagaccgagatcaagatcaacgcagcccaggaggagtttaggcctgctgcaacccgaggtagcatactctactttttaatcaccgaaatgtccatggtgaacatcatgtatcagacatctctggcccagttcctcaagctctttgatcaaagcatggcacggagcgagaagtctcctcttccacagaagagaatcactaatatcattgaatacctcacctacgaggtcttcacttactctgtgcggggactgtatgaaaatcataaatttctgttcgttttgctgatgactctgaaaatagacctacagagagggactgtcaaacatcgggagttccaggctctgatcaagggaggtgccgcactggacttaaaggcctgtccacccaagccctaccggtggattcttgacatgacatggttgaatctcgtggagctgtccaaattaccacaatttgcagaaattatgaaccagatcagccgcaatgaaaagggttggaaaagctggttcgacaaggatgctcctgaggaggagatcattcctgacggctataatgactcactggacacatgccacaagctgctcttgataagatcttggtgccctgataggactgtctttcaagcccggaaatacatcgccgattcgttagaagagaaatacacagaaccggtgattctcaacctggaaaagacctgggaagagtcagatacgcggactcccctgatctgcttcctcagcatgggaagtgacccaaccaaccagattgacgcactggctaaaaagctgaaactggaatgtagaactattagcatgggccagggacaggaggtacacgcacggaagctgatccagatgagtatgcagcaaggagggtgggtcctgttgcagaattgtcacctggggctagagtttatggaggagctcctggaaacacttatcaccaccgaggcgtctgatgatagtttccgcgtctggattaccaccgagccgcacgatcgcttcccaataaccctgctgcaaacatcactcaaatttactaatgaacctccacagggggtgagggccggcctgaaacggacatttgccggcataaatcaggaccttctggacatttccaacttgccaatgtggaaacctatgttgtacaccgtagccttcctgcactctaccgtgcaggaaaggaggaaatttggccccttgggttggaatatcccttatgaattcaactccgcggacttctcggcctctgtacagttcattcagaaccatctggatgagtgcgatataaaaaagggagtcagttggaacaccgtgcggtatatgattggggaagtgcaatacggtggcagggtcaccgacgatttcgataagagattacttaattgttttgcgagagtctggttctcagagaaaatgttcgaaccttctttctgcttctatacggggtataagatacctctttgtaagactctggatcagtacttcgagtatatccagagcctgccttctctcgataatcctgaagtgttcggcttgcatcccaatgccgatattacttaccagagtaacacagcatccgccgtcctcgagactatcacaaatatccaaccaaaggaaagtggtggaggcgttggggagaccagagaggcaatagtctaccgtcttagcgaggatatgctctcaaagctgccaccagactacatcccgcacgaagtgaaaagcagattgatcaagatggggcacctgaactcaatgaatattttcctgagacaggaaatcgaccgcatgcagagagtgatctccattttgcgcagctccctaagtgatctgaaattagctattgaaggcaccatcatcatgagcgagaacctacgcgatgctcttgataacatgtatgacgcccgcatcccgcagctatggaagcgggtcagctgggacagctctactctcggattctggttcaccgagctactagagcggaacgcccaattttccacttggatctttgagggacggcctaacgtgttctggatgaccggcttttttaaccctcagggctttctcaccgcgatgcggcaggaggtgactcgcgctcacaaggggtgggcgttggacaccgtcacgatacacaatgaagtgctccgccagactaaagaggagattacatccccgccaggtgagggcgtgtatatatacggcttgtatatggatggagctgcatgggataggcgcaatggtaagctgatggaaagtacccccaaggtcctgttcactcagctgcccgtgttacatatcttcgctataaatagtacagcccctaaggacccaaaactttatgtgtgtccaatctacaaaaaaccgcgacggactgatctgaccttcatcacagtcgtttacttaagaaccgtgctgtctcccgaccattggatactgagaggagtcgcgctgctgtgcgacattaagtag

SEQ ID NO: 115250 - DNA, 13473 bp, Artificial Sequence
  Description of Artificial Sequence: Synthetic coding sequence
atgatgaagctgtacatcgataacgccgctcctgataagctgaagggcctgtgcatattcttcgttagatgtaggaatgatgtggcgattaatgtgaagaccatccaggaggaagcactgtttaccgtacttgacgccagtaagggtcttctgaacggtatccgagacatgttggccaacatcttccttccggccgttctcgccaccaacaattggggcgcactgaaccaaagcaagcagggggagtccgagaaacacattttcaccgagaccatcaatcgatacctaagcttcctggatggtgctcgcattagcattgagggaacagtcaagctgaaaaccatcgataatgtaaatttttccaaattgcacactttcgaagaggtgacagccgcggcctctaacagcgagacagtgcaccagctggaggaggttctcatggtctggtacaagcaaattgaacaggttctcatagaaagtgaacagatgagaaaagaggctggggactcagggcctcttactgaactcgaacattggaagcgtatgtctgctaagtttaattatatcatcgagcaaataaagggaccgtcctgtaaagcggtgatcaacgtcctgaatgtggcccactctaagttgctgaaaaactggagagacctggacgcgcgcattaccgatacggccaatgaatcaaaagacaatgtgcggtatctgtatacactggaaaaggtgtgtcaacccctgtacaaccatgatctggtctctatggcacatggcatccagaacctgatcaacgcaattcggatgatacacggggttagcagatattataacacatctgaacggatgacttctctctttatcaaagttacgaatcagatggtgacagcttgcaaagcatacatcacagatggcggactaaatcacgtatgggatcaggagaccccagtagtgctgaaaaagattcaggactgcattttcctgttcaaggagtaccaggccagtttccacaaaaccagaaaactcatttcagaatcgagcggggaaaaatctttcgaagtgagcgagatgtatattttcggtaaattcgaagctttttgtaaacggctggagaagatcaccgagatgatcaccgtagtgcagacatactctacactctccaattcaacgatagagggcatcgacatcatggcaatcaagtttcggaacatctatcagggagtcaaaaagaaacagtatgatatccttgatccaagacgaaccgagtttgacacagactttctggacttcatgacgaaaattaatggactagaagtgcaaatccaagcttttatgaactcatcgtttgggaaaattctgtcgagtcagcaggctttgcaattactccaaaggttccagaaactgaacatcccatgtctagggcttgagatcaaccatacaattgagcgaattctgcagtactatgtcgccgagttagacgctacaaagaagctgtatcactcccagaaggatgaccctcccctggcgaggaatatgccacctatcgccggtaaaattttgtgggtccggcagctgtacagacgaatttccgaacccattaattacttctttaagaatagtgatatcctgtcctccccagacggtaaggctgttattaggcagtacaataagatcagctatgtcctggtcgaattcgaggtggtgtatcatacagcatggatacgcgaaataagtcagctgcattatgctcttcaggccactctgtttgtccgccatcccgagacggggaaactgctcgttaactttgaccccaagatactcgaggttgtcagagagaccaagtgcatgattaagatgaagctggacgtgccagagcaggctaagagacttctgaagctggagagcaaactgaaagctgacaaattatacctccagggactactgcagtactatgatgagctatgtcaggaagtgcccagcgtattcgtgaatctgatgactccaaagatgaaaaaggtggaatccgtcctgcggcaggggcttacagtgctgacctggagctcacttacattggaaagcttcttccaggaggtcgagcttgtcctggacatgtttaaccagctgctaaagaagatcagtgatctgtgtgagatgcacattgacacagttcttaaagagatcgcaaagaccgtgctgatatcgctgcccgagagtggggcgacaaaagtggaagatatgctaacgctcaatgagacctacaccaaggagtgggctgatatcctgaatcacaaatctaaacatgtcgaggaagccgtccgggaactgatttctattttcgagcaaatttacgaggtaaaatacactggaaaagtgggtaagcaatccgaacagcgaaaacacgtcgtgtttggcagtgagaccggggaaggcgagaacaacgattacgaggcaaatattgtaaatgagtttgacactcatgacaaggaagacgaatttaagaaggaatgcaaggaagttttcgcgtttttcagccaccagctgcttgatagcctgcagaaagccacaaggttatctctggatacgatgaagcgtcgcatcttcgtcgcaagtttgtacggacgcaagcaaagtgaagacatcatctcttttatcaaatctgaggtccacctggcaatccccaatgtggtaatgatccccagcctggatgacattcaacaggccatcaaccgtatgattcaacttaccctggaggtgtctaggggggtggcccactggggtcagcagcagattcgcccgataaagtcagtgattccgagccccaccaccacagatgtgacacaccaaaataccggtaagttgctgaagaaggaagagcgcagcttcgaagaggccatacctgctcgtaaactgaagaacttttaccctggagttgcagaacacaaggatatcagtaagctagtcctgttgttgagttcaagcgtaaatagcttacggaaggctgctcacgaggccttgcaggacttccagaagtacaagactttgtggactgaggaccgcgatgttaaggtgaaagagttcctggccaataatcctagcctcacagagatccgcagcgagattctccactatgctactttcgagcaggagattgacgaactgaagcctatcattgtggtcggggctctcgagttgcacacggagccaatgaagctggctttgagcatcgaggccaaggcatggaagatgctcttatgtagatacttaaatgaagagtacaagaagaagatgtcatacatgatagccttcataaacgagtacctgaagaagctgagtcgacctatccgcgacctggacgatgtgcgctttgccatggaagcactctcttgcattcgcgacaatgagattcagatggacatgaccttgggcccgattgaagaggcttatgcaattttgaacagattcgaggtggaggtaacgaaagaagaatctgaagccgttgatacactgagatacagcttcaataagcttcaatcaaaagccgtgtccgtgcaggaggatctggtgcaggtccagcctaagtttaaatcaaatctcctggaaagtgttgaagtgtttagggaggacgtgattaattttgccgaagcttatgagctggaggggcccatggttcccaatatcccgccccaggaagcctccaatcgcctccagattttccaagctagctttgatgatctttggaggaaattcgtgacctactcatccggcgagcagctctttggacttcctgttaccgattatgaagtgctgcataagacccgcaaggagctgaacctactgcagaagctgtatggcctgtacgatacagtgatgagtagtatctcagggtattatgaaattctgtggggggacgtcgacatcgagaagatcaacgcggaactccttgaattccaaaatcggtgtcggaagcttccgaagggtctgaaggactggcaggccttcttggacctcaagaaaagaatcgatgatttttcagagagttgccccctattggaaatgatgacaaacaaggcaatgaaacagcggcactgggatagaatcagtgagctcaccgggactccctttgacgtggagtcagactcattttgcctgaggaatattatggaagcccctcttttaaaacataaggacgatatcgaggatatttgcattagcgccatcaaagagaaggatattgaggctaagctgacgcaggtgatcgaaaactggacgaatcagaacctcagctttgcagcctttaaaggcaagggcgaactgttgctcaaaggtacagaatccggagagattatcaccttgatggaagattccctgatggtgcttggcagtctgctcagtaacaggtacaacgctcccttcaaaaagaatattcagaactgggtatataaattgagcacttcttccgacatcattgaagaatggctcgtggtccagaacctgtgggtgtacctggaggctgtgttcgtcggcggtgacatagccaaacagcttcctcaagaagccaaacggtttcagaacatcgacaagagctggatcaaaataatgcaacgggcccatgaaaatcctaacgtgatcaactgttgcgtcggggatgagacaatgggacagctcctcccccatctacacgagcaactcgaagtgtgtcaaaaatcgcttaccggttacctggagaaaaagcgcctgctgttccccaggttcttcttcgtgtccgaccccgtcctcttagagatactagggcaggcctctgacagtcacacgattcagccacatctgccagccgtatctgataacatcaacgaggtgacattccatgccaaggattatgatcgaatcatggccgtgatttctcgggaaggggagaaaatcgtcttggataattccgtgatggccaagggtcctgtggagatatggctgctcgaccttctgaaaatgcaaatgtcatctcttcacaacataatcagatcggccttctaccagataagcgattccggtttccagctactgccctttctcagtcattttcctgctcaggtcggtttgctaggaattcaaatgctgtggacccacgacagcgaggaggccctgcggaacgctaaggacgatcgtaagatcatgcaggttactaaccagaaatttctcgacattcttaacaccctgatctcgcagacaacccacgacctgagtaagttcgaccgagtcaagttcgaaacccttattaccatccatgtccatcagcgcgacatctttgatgatctggtgaagatgcacataaagtcccctacggacttcgagtggctaaagcagagccggttttacttcaaagaggatctcgaccagaccgtagtgagcataaccgacgttgatttcatctatcagaatgagtttctgggatgtactgaccgcctggtcataacccctttaaccgatcggtgttacataaccctggcccaagcgttaggaatgaacatgggaggagcacccgctggacctgccggaacaggaaagaccgagactaccaaggacatgggaagatgtctgggtaagtacgtggtcgtgtttaattgtagtgaccagatggattttcgggggttaggacggatctttaagggtctcgcccagtctgggtcatgggggtgttttgatgagtttaacaggattgagctgcccgtactgtcggttgcagcccaacaaatatatatcgttctgacggctaggaaggagcgtaagaaacaattcatattttctgacggggactgtgtggatttaaaccctgagttcggaatcttcctgacgatgaatccgggttacgcgggccgtcaggagctacccgagaacttgaagatacagtttcgaactgtggccatgatggtgcccgatcggcagattattatgagggttaagttagccagttgcggtttcctagaaaatgtcatactggctcagaagttctatgtgctgtacaaactatgcgaggaacaactaaccaaacaagtccattacgactttgggctccgtaatattttatccgtgctcagaacattaggaagccagaagagggcaagacccgaggactctgagctgtctatcgtgatgagaggtttgcgggatatgaacctgtccaagctcgtggacgaggatgaacctctcttcttgagcttgatcaacgacttgtttcccggtctgcagcttgattcaaacacttatgccgaactccagaacgccgtggcacaccaggtccagatcgaaggattgattaatcacccaccgtggaaccttaagctcgttcagctgtacgaaacttccctcgtgagacacggtcttatgacgctcggacctagtggaagtgggaagacaacagttattaccattctgatgaaggcacaaacagagtgcggaaggccccaccgtgagatgaggatgaaccccaaggccatcactgcccctcagatgtttgggagactagacactgcaactaatgactggactgatggcatctttagtaccctctggcgaaaaaccctgaaagctaagaaaggcgaaaacatctttctgatcctggatggacctgtcgatgcaatatggatagaaaacctcaacagcgtgctggacgacaacaagaccctaacactggcgaatggcgaccgaatccccatggccccctcttgtaaactgctgttcgaggtgcataacatcgaaaacgccagccctgcaacagtgagtcgcatgggaatggtatacatcagttcttcggccttgtcctggaggccaatccttcaggcctggctcaaaaagaggactgcacaggaggccgcagtatttctaaccttatacgaaaaagtctttgaagacacctatacctacatgaagctcaacctcaaccctaaaatgcaacttctggaatgtaattatatcgtgcagtctttgaacctgcttgagggactgatccccagtaaagaagagggtggcgtgagctgtgtagaacacctgcacaagctgtttgtattcggactgatgtggtcactcggtgctcttctggaattggagtcccgcgaaaaactggaagccttcctacgccagcatgagagcaagctggacctgcctgagatccctaagggttctaatcagactatgtacgagttttatgtgacagactatggcgattgggagcactggaataaaaaacttcagccgtactactaccctactgattctatcccggaatactcgtcaattttagtacccaacgtggataatatccggacaaatttcctaattgatactatcgcaaaacaacataaagcagttctgttaacaggtgaacaggggacagcgaagactgttatggtgaaagcgtacttgaaaaagtacgatcctgaggtacagttgtctaagtccctcaacttctcctccgccaccgagcctatgatgttccagagaaccatcgaaagttatgtggataagcggatcggctcaacctatggtcctcccggaggccgcaagatgactgtgttcatcgatgatattaacatgcctgtcattaacgaatggggggatcagataacaaacgaaatagtacgacagatgatggagatggaaggtatgtacagcctcgataagccgggggacttcaccactatcgttgacgtacagctcattgctgctatgatccatcctggtggcgggagaaacgacataccccagcgcttgaagagacagtttacagtatttaactgtaccctgccttccaatgcgtctattgataaaatatttggcattataggctgtgggtactttgacccttgccgcagctttaagccccagatttgcgagatgatcgtgaacttggtttcagtgggcagggtgctgtggcagtggactaaagtgaagatgctgcctactccatccaaatttcattatatttttaatctccgcgacctgagcagaatttggcaaggaatgcttacaataaaggccgaggagtgtgcctccatcccaacgttgcttagtctgttcaaacacgagtgctcacgagtgatcgccgaccggtttatcactcccgaggacgagcagtggtttaacgcccacctgacacgcgcagttgaagaaaatattggcagtgatgccgcaagctgtattttacccgaaccatactttgtcgactttctgcgggaaatgccagagcccactggggacgagcccgaagatagtgtattcgaggttccgaagatctacgaattaatgccctcgttcgatttcctggctgagaaactccagttctatcaacgacaatttaacgaaattatccgggggacttcccttgacctggtattttttaaagatgctatgacccacctaatcaaaataagcagaatcattcggaccagctgcgggaacgccctgttagtcggcgtgggcggatccggcaaacaatcattgtctagattggcaagttttatcgccggctaccagattttccagataaccctgacaagatcttacaatgtcacaaatcttactgacgatcttaaggcactttacaaggtggccggggcggacggaaagggcattaccttcatcttcactgacagtgaaatcaaagatgaggcctttctcgagtacttgaataacctactgtcttcaggggagatctctaatctttttgctagagacgagatggacgagattacccaaggcctcatctctgttatgaaacgcgagttgcctagacaccccccaacttttgacaacctgtacgagtacttcatcagccgcagtcgcaagaatctacacgtagtgctttgcttttctcctgttggagagaagtttcgagctagaagcctgaagttcccgggacttatctccgggtgcactatggattggttctccagatggcctcgggaagccctgatcgccgtggcctcctacttcctgtcagactataatattgtgtgtagtagcgagataaaacgccaggtggtggagacaatgggactgttccacgatatggtctctgaatcctgtgagtcgtactttcagaggtatagacggcgcgcgcatgtgactccgaagagttaccttagttttatcaacggctacaagaacatttacgcagagaaggtgaaattcatcaatgaacaagccgaacgtatgaatatcggtctggataaactgatggaggcctctgaatccgtcgcgaagttatctcaagatcttgcggtgaaggaaaaggagctcgctgttgcgtctataaaggcggatgaggtcctggccgaggtcaccgtgtcagcccaggccagcgcgaagatcaaaaacgaggtgcaggaggtgaaagacaaggctcagaagattgtggacgaaatcgacagtgagaaggtcaaggctgagagcaaactagaggcagccaagcctgcactcgaagaggccgaagcagccctcaatacgatcaagcccaatgatatcgccacagtgcgcaaactggccaagcctcctcatctgatcatgaggatcatggactgtgttctcttgctgtttcaaaaaaaaatcgatccagtcacaatggatcctgaaaagtcctgctgtaagccatcctggggtgaatctctgaagctcatgtccgccacgggctttctctggagcctgcagcagttccccaaagatacaatcaacgaagagactgttgaactgttacaaccctacttcaacatggacgattacacttttgagtctgcaaagaaggtgtgcgggaacgtagccgggctgcttagttggaccctggcaatggcaatcttctatggtatcaatcgggaggttttgcctcttaaagccaatctcgcaaagcaggaaggtagactcgccgtggccaatgccgaattagggaaagctcaggccctgctggatgagaagcaggcggagctagataaggtacaagcaaaattcgatgccgctatgaacgagaaaatggacttgcttaacgacgcggacacatgtcgtaaaaagatgcaggcagccagcacactgatcgatggcctgtctggtgagaagattaggtggactcagcaatccaaggagtttaaggcccagatcaacaggctcgtcggggacatactgctctgtacgggttttctgtcctacttaggcccttttaaccagatttttagaaactatctactgaaagatcaatgggagatggagttacgagcccgcaagattccgttcacggagaatctaaacttgatcagcatgctggttgacccccctacgataggggaatgggggctccagggccttccaggcgatgatctgagtatccaaaatggcattatcgtcaccaaagccaccagatatccactgctgatagacccccagacgcaggggaagacttggattaagtctaaggagaaggaaaatgatctacaggtgaccagcctaaatcacaaatatttcagaacccacctggaggattcgctgagtctgggtaggccattgcttatcgaggatattcacgaggaattagatcctgcattggacaatgtccttgagaagaatttcatcaaaagcgggacgaccttcaaagtgaaagtgggagacaaagagtgcgatataatggatacttttaaactatacattaccactaagttgccgaacccagccttcacacctgaaattaatgccaaaacctccgtgattgattttactgttaccatgaagggactggagaaccagctgttgcgaagggtcattctaacagagaagcaggaacttgaagcggagagagttaaacttctggaagatgtaaccttcaataagcgaaagatgaaggaactcgaagacaacctcttgtataaactgagcgcaacaaagggctctttagtggatgatgaaagcctgattggggtcttgagaacaaccaagcagacagccgcagaggtctccgaaaagctacatgttgccgcagaaaccgagataaaaataaacgctgcacaagaggaattcagaccagctgccactagggggagcattctgtacttcttaataacggagatgtcaatggtgaacataatgtaccagacttccctggcacagttcctgaaattgttcgaccagtcaatggcccggagtgagaagtccccactgccccagaaacgaattacaaacataatcgagtatttgacctatgaggttttcacctacagcgtgcgcggcctgtacgagaatcacaagttcctttttgtcctgctgatgactctcaaaattgatcttcagaggggcacagtgaagcacagagagttccaggcactgatcaaaggcggcgcagctctagatctgaaggcctgcccacctaaaccatatagatggattcttgatatgacgtggcttaacttggtggaactcagcaaactaccacagtttgctgagatcatgaatcagatctcccgaaacgagaaggggtggaagtcctggttcgataaggacgctccagaggaggagatcatccccgatgggtacaatgattctctggatacatgtcacaagctcctcttgatccggtcttggtgccctgacaggacggttttccaagcccgcaaatacattgcggacagcctagaggagaaatacacggagcccgtgattttgaacctcgagaaaacatgggaggaaagtgatacacgtacacctctaatctgttttttgagcatgggcagtgaccctaccaaccagatagatgccttggccaaaaagttgaagctcgagtgtcggaccatctctatggggcagggtcaggaagtgcacgcccgcaagcttattcagatgtccatgcagcaggggggttgggttctcttacagaactgtcacctggggctcgaatttatggaagaactcctcgagaccttaatcacaacggaagcttctgacgattcattccgtgtttggatcaccacagagccacacgacagatttcctatcactcttttgcagacttctctaaagttcacgaatgagccgccacaaggagtgcgggctggacttaagagaaccttcgcaggaattaaccaggatcttctcgatattagtaatttgccaatgtggaaaccaatgctatataccgtggccttcttgcactccacagtacaagagagaagaaagtttggaccactgggttggaatattccttacgaattcaactccgccgacttctccgccagtgtgcagttcatccaaaatcacttggacgagtgtgacataaagaaaggggtaagttggaacactgtcagatatatgattggtgaggtgcaatatggcggtcgagtgacagatgactttgacaaacgcctgctgaactgttttgcacgcgtgtggttctctgagaaaatgttcgagcccagcttttgcttctacacaggctataagatccccctgtgtaaaacccttgaccagtattttgagtatatccagtccttgccctcacttgacaatccggaagtgttcggtctgcaccccaacgcagatatcacctaccaatccaatactgcctccgcggttctggagactattactaatatccaacccaaagagtccggtgggggtgtgggcgagactcgtgaggcaattgtctacagattatctgaagacatgctgagtaagctacctcccgattacataccccacgaagttaagagtcgcctgatcaaaatgggacatctaaattctatgaatattttcctccgccaggaaatagacagaatgcagcgggtgatttcgatcctgcgctccagtttgtcagaccttaaactcgctatcgagggaacaatcatcatgtctgagaacttgcgcgacgcactagacaatatgtacgacgcaaggattcctcaattatggaaacgtgtgtcttgggactcttctactctcggattctggttcacagagctgctggagcgtaatgctcagttctccacgtggatctttgagggacgtccaaacgtgttctggatgacaggattctttaacccccaaggatttctgactgccatgcggcaagaggtcactagggcccataaggggtgggctctggataccgttacaattcacaacgaagtcctgcgccagaccaaagaggaaatcacctccccgcctggagagggggtctacatatacggcttgtatatggatggcgcagcgtgggacagacgtaatggtaagttgatggaaagtacgcccaaagtgttgtttacccaactcccagtgttgcacatctttgcgattaatagcacggcccctaaagaccccaagttgtacgtgtgccccatttataaaaaaccaaggagaaccgacctgacctttatcaccgtggtctatctacgtacagtgctcagtccagatcactggattttgagaggcgtggcactcctctgtgatataaaatag

SEQ ID NO: 115251 - DNA, 13365 bp, Artificial Sequence
  Description of Artificial Sequence: Synthetic coding sequence
atgatgaaactctacatcgataacgcagcccccgataagttaaagggattgtgtattttcttcgtgcggtgtaggaatgatgtggccattaatgtgaaaaccattcaggaggaagcgctcttcacagtgctggacgctagcaagggtctgctcaatggaattagagatatgctagcaaacatcttcctccctgcggtactagccaccaataactggggcgccctgaaccagtcaaagcagggtgagagcgagaagcacatatttacggaaactatcaacaggtacctctctttcctggatggcgcccgcattagtatagaaggaacagtgaagctgaagactatcgacaacgtgaacttctctaagctgcatacctttgaggaggtaactgctgccgcaagcaacagtgaaacggtccatcagctggaggaggtcctcatggtttggtataagcagatcgagcaagtgcttatcgagagcgaacagatgcgcaaggaagctggtgacagtgggcccctgacggagctggaacactggaagaggatgagcgctaagttcaactatattatcgagcagatcaaaggccccagctgcaaagcagttattaatgtactgaatgtggcgcactcgaagctcttaaaaaactggcgggatcttgatgcgaggatcacagacaccgccaacgagagtaaagacaacgtaaggtacctgtacacacttgaaaaggtatgtcaacctctgtacaaccacgatcttgttagtatggcacatggtatccagaacctaattaacgctatccgcatgatccacggggtttcacgctattacaatacctccgagaggatgacaagcttgtttattaaagtcactaatcaaatggtcaccgcgtgcaaagcctacatcaccgacggaggactgaaccacgtctgggaccaggagactccagtcgtgctgaaaaagatccaagattgtatctttcttttcaaggagtatcaggcctcattccacaagacaaggaaactgatcagcgaatcctccggagaaaagtcattcgaggtcagtgagatgtatatcttcggcaaattcgaggctttttgcaagaggctcgagaaaatcacagagatgatcacagtagtccagacgtactcaacactgagcaatagtacgatcgagggcattgacattatggcaattaagtttaggaacatttatcagggcgtgaaaaagaagcaatatgatatcctggatccccgtagaaccgaattcgacaccgattttctcgattttatgaccaagatcaatggattagaggtgcagattcaggctttcatgaattcaagcttcggtaaaattctctcaagccaacaggctctgcagcttctccaaaggttccaaaaactcaacattccttgcctgggcttagagatcaatcacactatcgagcgcattcttcagtattatgttgcggagttagacgccacgaagaagctgtaccattctcagaaagatgatcccccgcttgcaagaaatatgcctcctatcgctggaaagattttgtgggtccggcaactctatcgccggatctcagagcccatcaactacttctttaaaaactccgatattctgtcctcacctgatgggaaagccgttatcagacagtataacaaaatctcttacgtgctcgtcgagtttgaggtcgtttatcacacagcatggatcagagaaatcagccagttgcactatgcacttcaggctacactgttcgtgaggcaccccgagaccgggaaactgctagtcaatttcgacccaaaaattcttgaagtggtgagggaaactaagtgtatgattaagatgaaactggatgtccctgagcaggccaaaagattattgaagcttgagtctaaactcaaggctgacaagctgtacctgcagggtctgcttcagtactatgatgagctctgccaggaggtcccctccgtattcgtgaatctgatgaccccgaaaatgaaaaaggtcgagagcgtcctgaggcagggcctgactgtactgacttggagttctctcacactcgagtcatttttccaggaagtagaattggtgctcgacatgttcaatcagttattaaaaaaaatctctgacctctgcgagatgcatattgacacagtcctaaaagagatcgctaagactgtgctgatctctctgccggagtctggagcgaccaaggttgaagatatgctgaccctgaatgagacttacaccaaggaatgggccgacatcctcaatcacaagagcaaacatgttgaggaagcagtgagggagctaatcagcatctttgaacagatctatgaggtgaaatatacaggcaaagtgggcaaacagagcgagcaaagaaaacacgtggtctttgggagtgaaaccggggaaggcgaaaacaacgactacgaagccaatattgttaacgagtttgatacacacgacaaagaggacgaatttaagaaggaatgcaaggaagtcttcgcattcttctcccaccagttgctcgattcactgcagaaggctacacgcctgtcgttggatactatgaaacgtcggatttttgtcgccagcttatatggcaggaagcagtcagaggacataattagtttcatcaaatctgaggtgcaccttgccattcccaatgtagtaatgataccctcactcgacgatatccagcaggcaattaatcgaatgatccagctgaccctggaggtgtcccggggcgtagctcactggggccagcagcagatcagacccattaagtctgtcatcccgagccccaccactacagatgttactcatcagaatacaggtaaactgcttaagaaagaggagagaagcttcgaggaagccattcctgctaggaagctgaaaaatttttacccaggagtggcggagcataaagacatctcaaaattggttctcctgctttccagttctgttaactccctgagaaaggccgcccacgaagcactacaagactttcagaagtacaaaaccctttggactgaggacagagacgtgaaggtcaaggagttcctggcaaataatccaagtttgacagagattaggtctgagatcctgcactatgctactttcgagcaggagatcgacgagctcaaaccgatcattgtcgtgggagccctcgagctgcatactgaacccatgaagctggctctttctatcgaagctaaagcctggaaaatgttgctctgcaggtatttgaacgaggaatacaagaagaaaatgtcttatatgatagctttcatcaatgaatatctcaaaaagctatccagacccatacgcgatttggacgatgtcaggttcgccatggaggccctctcgtgtatacgcgataatgagatccagatggacatgaccttaggacctatcgaagaagcttatgccatcctgaacaggttcgaagtcgaggtcaccaaggaggaaagcgaagctgtcgacacactcaggtactcattcaataaactgcagtctaaggcggtgagcgtccaggaggacttggtgcaagtgcagccaaagttcaagagtaatctgttggagagtgtggaggtgttcagggaggatgtcatcaatttcgccgaggcctacgagctcgagggacctatggtcccaaacattcctcctcaagaggctagcaacaggctgcagatattccaggcttccttcgacgacttgtggcgcaagttcgtcacctatagttcaggggagcagctgtttggtcttccagtcacagattacgaggtgctgcataagacccggaaggaactaaatctcctccagaagctctacggactttacgacactgtcatgagcagcatctctggttactatgaaatcctctggggagacgtagatatcgaaaagattaacgctgagctcctggagtttcaaaaccgatgcagaaaacttcccaagggactcaaggactggcaagcgttccttgacttaaaaaagcgcatcgatgacttctccgagtcatgccccctgctcgagatgatgaccaacaaggcaatgaagcaacggcactgggatcgcatcagtgagctcacgggaacaccattcgacgttgagagcgattctttctgtctgcggaatataatggaggccccattactgaagcataaagacgacatcgaggatatatgtatcagcgccattaaggaaaaggacatcgaagccaaactgacccaggtgattgagaattggacaaatcaaaatctgagcttcgcagcctttaaggggaaaggcgaactgttactaaagggaaccgaaagtggagaaatcattacactcatggaggatagcctgatggtgctgggctcactgttgagtaaccggtataacgccccttttaagaaaaacattcagaactgggtctacaagctgtcaaccagctccgacattattgaggagtggctcgtggttcagaatctgtgggtgtacctggaagctgtatttgtggggggagatatagctaaacagctacctcaggaagcgaagagatttcagaatatcgacaaaagctggatcaaaatcatgcagcgggcacatgagaatcctaacgtaatcaattgctgtgttggcgatgagacaatgggccaactcctgccacacttgcatgaacagctggaagtgtgccagaagagtctgaccgggtacttagagaagaaacggctgttgttcccacgatttttttttgtttccgacccagttctcctggagattctcgggcaggccagcgatagccataccattcagcctcacctgccagccgtttccgataatattaacgaggttacatttcacgcaaaagactacgaccggattatggccgtgatcagccgggagggcgagaaaatcgtgcttgacaacagcgtgatggcaaagggcccggtagaaatctggctgctggatctgttaaagatgcagatgtcgagtctccataacattattagatctgctttctaccagatctcagacagcgggtttcagctcttacctttcctgtcacattttcccgcccaggtgggtctgttgggcatacaaatgttatggactcatgacagtgaagaggcgcttaggaacgccaaagacgataggaaaatcatgcaggtgacaaatcagaaatttttggacatacttaatactctaatcagccagacaacccacgacttatcgaagtttgaccgtgttaaattcgagactctcattaccattcatgtccaccaacgggacatattcgatgacctggtcaaaatgcacatcaaatcccctacggattttgaatggcttaagcaatcacgtttctacttcaaggaagatcttgaccagaccgtggtgtccataaccgacgtggactttatctaccagaatgagttcctagggtgcaccgatagactagtcattacccccttaaccgatcgctgctatataacccttgcccaagccttaggcatgaatatggggggagcacccgccggacctgctggaaccgggaagaccgaaaccactaaggacatgggacgctgccttggaaaatacgtggtggtgttcaattgctctgatcaaatggatttccgggggctcggtaggatcttcaaaggattggctcagtcagggagctgggggtgcttcgatgaattcaaccgcatagaactgccagtgctgagtgtggcggcccagcagatctacatagtcctgaccgctaggaaggaacgtaaaaaacagtttattttctctgatggcgactgcgtagatctaaatcccgagtttggtatattcctaaccatgaaccccggctacgcgggccgtcaggagttacccgaaaacctgaagatccagtttcgcaccgtggccatgatggttcccgatcggcaggttcactacgactttggactgagaaacattctgtccgtgcttaggacattaggcagtcaaaaacgggccaggccagaggattccgagctgagcatcgtgatgcgaggtctccgtgatatgaacttgtccaaactggtagacgaggacgagccgctttttcttagcctgattaatgatttgtttccaggcctgcaactagactctaacacctacgctgaactccagaacgccgtcgcgcaccaggtgcagattgagggtctaattaatcatccaccatggaacctgaaactggtgcagctgtacgaaacctcccttgttcggcacggactgatgacccttgggccatcaggtagtggcaagacgacagtgatcaccatactgatgaaggcccaaactgagtgcggaaggccgcatcgcgagatgcgcatgaaccctaaagctattaccgctccgcagatgttcggccggctcgatactgccactaatgattggaccgatggaatcttttccactctgtggcgaaagactcttaaagccaagaagggagagaatatcttcctgatccttgacggccccgttgacgccatttggatcgagaacctgaattctgtactggatgataacaaaacccttacactggcaaatggtgatagaataccgatggctccctcttgcaagctgctctttgaggtccacaatattgaaaacgcaagcccagccactgtctcccgaatggggatggtgtacattagtagctccgccctctcctggcgacccatactccaggcatggctaaaaaagcgcaccgcccaggaggctgcagtcttcctaaccctgtacgaaaaggtgttcgaggacacgtatacctacatgaagcttaatctgaatcccaaaatgcagttgctggaatgcaactacatagtccagagcctgaacttactagaaggtttaattcctagtaaagaggaaggaggtgtgtcgtgcgtggagcacctccacaaacttttcgtttttggtctcatgtggagcctgggagctctcctggagttggagtcccgtgagaagctcgaggcctttttacgtcagcacgagagcaagctggacctccccgaaattccaaagggttcaaaccagaccatgtacgagttctatgtgacagactacggcgattgggagcactggaataagaaacttcagccatactattacccgaccgatagcattcccgagtactcctcaatcttagtccctaatgtggataacattagaacaaattttttgattgacacaatcgccaagcagcataaggcagtcttgctgaccggggaacagggtacagccaagacggtcatggtgaaggcttatctgaagaagtacgatccagaggttcaactgtcgaagagcttaaactttagctctgccaccgagccaatgatgtttcagaggactatagaatcttatgtcgataaacgcatcggttctacctacgggcccccgggcggaaggaagatgacggtctttattgatgacattaacatgccggtcatcaacgagtggggggatcagataacaaacgaaattgtgcggcagatgatggaaatggaaggcatgtactccctagataagcctggggacttcacaactattgtggacgtgcagctcattgccgccatgattcaccctggggggggccgcaacgatatcccccagagactgaagaggcaatttacagtcttcaactgtacgctgcctagcaacgccagcatagataagatcttcggtatcattggatgcggctatttcgacccctgcaggtcttttaaaccacagatctgcgaaatgatcgtaaacttagtaagtgttggcagggttctgtggcagtggacgaaggtgaagatgctgcctacccccagtaaatttcactatattttcaatcttcgcgacctaagccgcatctggcagggaatgctgaccattaaggccgaggagtgcgcttctattcccaccctcctgtccttgttcaagcacgagtgttcccgggtcattgccgatcggttcatcacccctgaagatgagcaatggtttaatgcccatctcacacgcgccgtggaggaaaacatcggcagcgatgctgcttcctgtattcttcccgagccttattttgttgatttcttaagagagatgccggaaccgaccggggatgagcctgaggacagtgtttttgaagtgccaaaaatatacgagctgatgcctagtttcgacttcctcgctgagaaactacagttctaccaaaggcagttcaacgagataatcagaggtaccagcctggacctggtgttctttaaggatgcaatgacacatcttatcaaaatctcccggattattagaacttcatgcggcaatgccctccttgtgggcgtcgggggtagtggaaaacagagcctgtcacggttggctagctttatcgccgggtatcagattttccagatcactctgacaagatcatataatgtgactaacctcacggacgaccttaaagccctctacaaagtagctggggcggacggaaaaggaatcacttttatctttactgattcagagattaaggatgaggctttcctcgaatacctgaacaacttactctcaagcggcgaaatatcaaacctttttgcccgggatgagatggacgagattacccagggcctaatatcggtgatgaaacgagagctccccagacatcctccgacattcgacaatctttacgagtactttatctctagatcccgcaagaatctgcacgttgttctctgcttcagccctgtcggggaaaagtttagagcacgcagcctgaaattccctggattgatctccgggtgtaccatggattggtttagtcggtggccacgggaagctctgattgctgtcgcctcttactttctcagcgactataatatcgtctgtagctctgaaattaagcggcaagtcgttgaaaccatgggactgttccacgacatggtttccgaaagttgcgaatcctatttccagcggtacaggcgaagagcacatgtcacgcccaaatcttatttgtcctttatcaatgggtataagaatatctacgccgaaaaggtcaagtttatcaatgagcaggccgagagaatgaacatcggactggacaagttgatggaggccagtgaatcagtggcaaagttaagccaggatctggctgtgaaggagaaagagttggccgtggcttcaatcaaggccgatgaagtcttggccgaggttaccgtctctgctcaggccagcgcaaaaattaaaaacgaggtgcaggaggtgaaagacaaggcgcagaagattgtcgatgaaatcgactctgagaaagttaaggccgaatctaagctcgaagctgcaaaacccgcgcttgaggaggctgaggctgccctaaatacgataaaacctaatgacatagcaacagtacggaagctggctaagcccccccacttgatcatgcggattatggattgcgtcctgctattgttccaaaaaaagatcgaccctgtgacaatggaccccgagaagagctgttgcaagccttcatggggcgaatccctgaaactcatgagcgccacaggctttctgtggtctctgcagcagttccccaaagataccattaacgaagagacagtggagctccttcaaccctacttcaacatggacgactacacttttgagtctgctaaaaaggtgtgcgggaatgtggccggtcttctgtcttggacactggccatggctattttctacggcattaatcgagaagtgttgccactgaaagcaaacttagcaaagcaggaaggccgcctagcagtagctaatgctgaactgggtaaggcccaggctctattggacgagaagcaggcagaactcgataaggtgcaagctaagttcgatgccgccatgaacgaaaagatggatttactaaatgatgctgacacatgtcgcaaaaagatgcaggctgcttccaccctgattgacggcctgtcaggcgagaagattcgctggacccagcagagcaaggagttcaaagcccagattaaccgtctggtcggagacatccttttgtgtactggctttcttagctatcttggcccttttaatcagatcttccgaaattacctgctgaaggatcagtgggaaatggagcttagagccaggaaaattcccttcactgagaatctgaacctgatttctatgctggtggatcctccaacaatcggagagtggggcctccagggcctccctggggacgatcttagtatccagaacggtatcattgtgacgaaggccacacgttacccccttctgatagaccctcagacacaggggaagacatggatcaagtccaaggagaaagaaaatgacctgcaagtgacaagtctcaatcacaagtactttagaacacacctcgaagattcgctttcactgggccggccgttactgatcgaagacatacacgaagagctggatccagcgctggataacgtacttgaaaagaatttcatcaaaagtggcacaacattcaaggtaaaagttggcgataaggagtgtgacattatggacacgtttaaactgtacataaccaccaagctccctaacccggctttcactcctgagattaatgccaagacctccgtcattgattttacagtgacgatgaaaggactggagaaccaactgctgagacgcgtgattctgaccgagaaacaggagctggaagctgagagggtgaagctattagaagatgtgacatttaacaaaagaaaaatgaaggaactcgaggacaatctgctttataaattatccgcaaccaagggttccttggtggacgatgagtctctgatcggggtcttacgcaccaccaagcagacagcagctgaggtctctgagaaactgcatgtcgccgccgagaccgagattaagattaatgccgcccaggaggagtttaggccagctgcaactagaggctctatcttatattttctgatcaccgagatgtccatggttaacatcatgtatcagacctctctggctcaattccttaagctgtttgatcaaagcatggctcgaagtgagaagtccccactgccccaaaagagaatcactaacatcatcgaatatctgacctacgaggtgtttacttactctgtcaggggactctatgagaaccataaatttttgtttgtcttattgatgacattaaaaatcgacctgcagaggggcaccgtaaaacatcgcgagttccaagcactgattaaagggggggctgccctcgacttaaaagcctgtccaccaaaaccatatcggtggatccttgacatgacatggttgaacctcgtggagctgagcaaactgccacaatttgccgagatcatgaatcagattagccgtaatgaaaagggctggaagtcctggttcgacaaagacgcccccgaggaggaaattattcccgatgggtacaacgattctcttgatacctgtcacaagctgctcctgatcagatcatggtgccccgacaggacagtatttcaggcccgcaaatacattgctgactctctcgaggagaagtatacagagccagtgatcctcaacctcgagaagacttgggaggagtctgacactcgcacccccctcatctgctttctgagtatgggcagcgatcccaccaaccagatcgatgcactagctaagaagctgaaattggagtgccgaaccatatcgatgggtcagggccaggaagtccatgcgcggaagctgattcagatgtccatgcagcaggggggctgggtgttgctccagaattgccaccttggtttggagttcatggaggagctgctggaaaccctgatcactaccgaagcttcagacgacagtttccgagtttggattacaaccgaaccacacgacagattccctatcacgctgctgcagaccagcctgaagtttactaacgagccaccacaaggagtgcgagccgggctcaagcgaacattcgctggcattaaccaagacttgttagatatcagcaacttgcctatgtggaagcccatgctctatactgtggctttccttcattccacggtccaggagcggcgcaagttcggtcctctgggctggaacatcccgtacgagttcaactcagccgacttctccgcctcggtgcaatttatccaaaaccacttggatgaatgcgatattaaaaaaggagtaagctggaacaccgtgaggtatatgatcggcgaggtccagtacggtggacgagtcaccgacgactttgacaagagattactgaactgtttcgccagagtgtggttctccgagaaaatgttcgaaccgagcttctgtttctacacagggtacaaaattcctttgtgcaagaccctggatcagtactttgagtatattcaaagcttgccatctctagataaccccgaagtgttcggcctccatccaaacgccgacataacctaccagagtaacaccgcgtctgctgttcttgaaacaattactaacattcagcccaaagaaagcggcggaggggtaggagagacccgtgaagctattgtgtaccggttgagcgaggatatgctgtctaagctccctcctgactacatcccacatgaagtaaagagtcggctgatcaaaatgggccatttgaactctatgaatatatttctgaggcaggaaatcgatcgaatgcagcgggtgatctccatactccgaagctcgctttctgatctcaaattggcaattgagggaactatcattatgagtgaaaatctgagagacgccctcgacaatatgtacgatgcacggatcccacagctctggaaacgcgtgtcttgggactcctccaccctcggattctggttcactgaactcctcgaacgcaacgcacaatttagcacatggattttcgagggcagacccaatgtcttctggatgacaggcttcttcaacccccagggcttcttaaccgctatgcggcaggaagtcacgcgtgcccataaaggctgggccctggatacggtgacaatccacaatgaggttctcagacagaccaaggaggagattacgagccctccaggagaaggggtgtatatctatggcctttacatggacggcgcagcttgggatcgccgcaatggcaaactcatggaaagcacccctaaggtgctttttacacagctgcctgttttacacatcttcgctattaactctacagcgcccaaggacccgaagctttacgtgtgtccgatttataaaaaacctaggcggaccgatctgacttttatcaccgttgtctatctgcgcaccgttttgtccccagaccactggattttacgaggtgtagctctgctgtgtgatatcaagtag

SEQ ID NO: 115252 - DNA, 12567 bp, Artificial Sequence
  Description of Artificial Sequence: Synthetic coding sequence
atggagaaagatgctgaagatggggcgccctcagagggcgcggaggcgcccccctccaccgaggaggcagctcctcccagatcagaggaagaggaagctccaagacccccgacagtggaggcgcccgcagaagacggtttcagcccttccgccgaagatgccgtgagcagcgtggtggattatagagatttgatcccctcagaggaaggcattgtgctgccagatgaccatgaagctgacctgaatagagtgcggcaaagattagctccccgacctgtgcagtctgtgatcagcgaggtactcagcctgccgagttctcgccggagttctaggtaccggcgttcaatgtccggactgcctaaccttcaggagacactgaaggagcgccaagcccgcttcagggaggcacgggagtcaagacgacttaagatagaccccagctataagtacatatttgagatcctcgcagagaatctcggtttggacatcgtgaccgtggaggaactgatcttggattgtccctcactcgaagccttcacaaattttttcgccaaagatggctgtaaaaccctgaaattcctttatcaagagggggacgtgccaggaattgagtgtgggcgtaccatagctggagcgacgaagggcgccaaaatgatgaagctgtatatcgacaatgccgctccggacaagctaaagggactgtgcatattctttgtacgttgtaggaacgatgtggcaattaacgtaaaaaccattcaggaggaagccctgttcacagtcctggacgcgtccaaggggctcctgaatgggatccgggatatgttagccaatatattccttcccgccgtcctggccaccaacaactggggcgccctgaaccagagcaaacagggtgagagcgagaagcatattttcaccgagaccataaaccgctatctgtcttttttggacggtgccagaatctctattgagggtacagtgaaacttaaaacaatcgacaacgtcaatttttcaaagctgcacaccttcgaggaagtcaccgcggccgctagtaacagtgagaccgtgcatcaactcgaggaggtcctgatggtttggtacaagcagatcgaacaggttctcattgagtccgaacaaatgcgcaaggaagctggcgacagtgggccattaacggaactggagcactggaagcgcatgagcgcgaagttcaactacatcatcgaacagattaagggcccgtcatgtaaggctgtgatcaatgtactgaatgtagcccactccaagctgctgaagaactggcgggaccttgatgctagaatcacggataccgccaacgagagcaaggacaatgtgcgatacctgtacaccctcgaaaaagtctgccagcccctctacaatcatgacctggtttcaatggctcacggaatacaaaatctgattaatgccattcggatgatacacggtgtgtcccgctattacaacacgtccgaacggatgacatccctgtttattaaggttacaaatcagatggtgaccgcttgtaaggcatacatcaccgacgggggactgaatcatgtgtgggaccaggaaaccccagtggtcctcaagaaaatccaggattgtatattcctcttcaaggaatatcaggcctcctttcataagacacgcaagttgattagcgaatcctccggagaaaagagtttcgaggtttccgaaatgtacatatttgggaaatttgaggccttctgcaaaagactggagaaaataacagagatgatcacagtggtacaaacatatagcacactgtcaaactctactatcgaaggcattgacatcatggcgatcaagtttaggaatatatatcagggcgtgaaaaagaagcagtatgatatcttggacccgagaaggaccgaattcgacacggacttcctggactttatgactaagattaatggactcgaagtgcagatccaagcttttatgaattccagctttggcaagattttatcctcacaacaggcattgcagctgcttcaaagatttcagaagttgaatattccgtgtttaggcctggagattaaccacacaatcgagaggattttacagtactatgtcgctgagttagatgccacaaagaaattgtatcattcccagaaagatgatccgcccctggctagaaatatgccccctatcgccggaaagatcctttgggtacgacagttataccggaggatcagtgagccaattaattacttttttaagaactcagacattcttagtagtccagacgggaaggccgtaattagacaatacaacaaaatatcctacgtattggtggagttcgaagttgtgtatcatacggcatggattagggaaatatcacagttgcattacgcacttcaggctacactttttgtccgccatccagaaacaggaaagttgttagtgaactttgatcccaaaattctcgaggttgtgagggagacgaaatgtatgatcaagatgaagcttgatgtgccggaacaagctaagcgtctcctgaagctggaatctaaattgaaggctgataagctgtatctgcaaggtctgttgcagtactatgacgagctgtgtcaggaggttccctctgttttcgttaacctgatgacaccaaagatgaagaaggtggagtctgtactccgacagggactgacagtgttaacttggagtagcctaaccttggaaagctttttccaggaagttgagctggtgctagacatgttcaatcagttattgaagaaaatttcagatctctgcgagatgcatatagacactgtacttaaggaaatagcgaagactgtgcttatcagcctcccagagagcggtgcaactaaagtggaggacatgttaaccttaaatgaaacgtacactaaggagtgggccgacatactgaaccacaagtctaaacatgtcgaagaagcagttcgggagctaatcagcattttcgagcagatctacgaagtcaagtatacaggcaaggttggtaagcagagtgaacagcgcaaacatgtggtattcggcagtgagactggagagggagagaacaatgactacgaagcgaacatcgtaaacgagttcgatacccatgacaaagaggacgaattcaagaaagagtgtaaggaggtgttcgcattcttctctcaccaactgcttgactctctccagaaggccactagactatctctggacactatgaagaggcgcattttcgttgcaagcctttacggccggaagcaatccgaagacattattagcttcataaagagcgaagtgcatcttgcaattcctaatgtggtcatgatcccctccctggatgatattcagcaagccataaacagaatgattcaactgaccctggaggtttcccgtggtgttgcacactggggtcagcagcagatacggcctataaagtccgttatccctagtcccactacgaccgatgtgacgcaccaaaatacaggaaagttgctaaaaaaagaggagcgttccttcgaagaagccatccccgcacgcaaactcaagaatttctatcccggagtggccgaacataaggacataagcaagcttgtgctgctcctttccagtagcgtaaacagcttgcgcaaggcagcccacgaggcactccaggacttccagaagtacaaaactctgtggacagaggaccgcgatgtgaaagtcaaggagttcctggcaaataatcctagtctaaccgaaatccggagcgagattctccactatgccacattcgagcaggagatcgacgagcttaaaccgatcatagtggtaggcgcgcttgaactgcacacagaacctatgaagctggcccttagcattgaggccaaggcatggaagatgttgttatgcaggtacctgaacgaggagtacaagaagaagatgtcctatatgatcgcattcataaacgaatacctgaagaagctatccagacctattcgcgatctggatgacgtgagattcgcaatggaagccctgtcttgtattcgagataatgagattcagatggacatgacccttggaccgatcgaggaagcctatgcaattctcaatcggtttgaagtggaggtgacaaaagaagagtcagaggcagtcgatacgttgagatactctttcaacaaactacagtccaaagccgtttctgtgcaggaggatctagttcaagtgcagcccaaatttaagagtaatttgctggaaagtgtggaggtcttcagggaggatgtcatcaactttgctgaagcgtatgaactggagggcccaatggtgcctaacatcccaccacaggaagcttcaaaccggctgcagatctttcaggcaagcttcgacgatctgtggcgcaagtttgtgacatactctagcggcgagcagctgtttggcctacccgtgaccgactacgaggtgctacacaaaaccaggaaggagcttaatttgctgcaaaaactgtacggactttacgatacggttatgagcagcataagcggttattatgaaatcctgtggggcgacgtggacattgagaaaataaacgctgagctgctcgaattccagaatcggtgtcggaagctgcctaagggtctgaaggattggcaggctttcctggacctgaagaaaaggattgatgacttcagcgaaagctgtccgctcctcgaaatgatgacaaacaaagcgatgaaacagcgccattgggatagaataagtgagcttactgggactcctttcgacgtcgagtccgattcattttgcctgagaaatataatggaagctccacttctcaagcacaaggatgatatcgaggacatctgcataagcgctatcaaggagaaagacatcgaagcaaaactgacccaagtcattgaaaactggaccaaccagaacctgtcctttgcggccttcaagggcaagggggagctgctcctcaaggggaccgagtctggggagatcataacgctgatggaggattccttaatggtacttggctcactgctgagcaatcgctacaacgccccgttcaaaaagaacattcaaaactgggtttacaaattgtcaacatccagcgatattattgaggaatggctggtggtgcagaacctctgggtgtatctcgaggctgtttttgtcggcggggacatagccaaacagctccctcaggaagctaagcgctttcagaacatcgataagtcctggatcaagatcatgcagcgggcccatgagaatccaaacgtgatcaattgctgtgtcggtgatgagactatggggcaacttttgcctcacctccacgagcagcttgaggtttgccaaaagagcctgaccggatacctcgagaagaagagactcctctttccccgcttctttttcgtgagtgacccagtgctcttagagattctcggacaggcctcagattcccacaccattcagcctcatctcccagctgtgtcggataatataaacgaggtcactttccacgctaaggactatgacaggatcatggcggtaatttcaagagaaggtgagaagatcgtccttgataactcggtcatggcgaaaggcccagtcgaaatctggctcctagacctcttaaagatgcagatgtctagcctgcacaacattattaggagcgctttttaccagatttcagacagcgggtttcagctattacctttcctgagtcacttcccagcccaggtgggcctgctgggtatccaaatgctgtggacccatgacagcgaagaagccctgagaaacgccaaggacgatagaaagatcatgcaggttaccaatcaaaaattccttgacatcctgaacaccttaattagccagaccacccatgatttgtcaaagttcgaccgggtgaaattcgaaacactgattacgatccacgtgcatcagcgagacatcttcgatgatctggtaaagatgcacatcaagtctcccactgacttcgagtggctaaaacagtccagattttacttcaaggaggacctcgaccagaccgtggtctctattactgacgtggatttcatttaccagaacgagtttcttggttgcacagaccgcttagtgattacacccctgactgatcggtgctatattacactcgcccaggctctgggaatgaatatgggtggagctcctgccggaccagctgggaccggaaagacagaaacaacgaaggacatgggcaggtgcctgggtaaatacgtggtggtgttcaattgctctgaccagatggactttcggggccttggacggatctttaaggggctggcgcagtccgggtcttggggctgctttgacgaattcaaccggatcgagctgcccgtgctgtcagtcgctgcccagcagatatacatagtgcttactgcaagaaaggaacgcaagaaacagtttattttttctgacggggactgtgtagatttgaatcccgagtttggcatttttttgacaatgaaccccggctatgctggcagacaagaactcccggaaaacttaaagattcaatttcgcactgtcgcaatgatggtgccagataggcaaatcatcatgagggtgaaactcgctagttgtggattcctagaaaatgttatccttgctcaaaaattttatgttttgtataagctatgtgaggagcagctgacaaaacaagtgcactatgatttcgggctgaggaatattctgtctgtgctgcggacgcttggtagtcagaagcgagctaggcccgaagatagcgagctgtccattgtgatgcgcggattacgcgacatgaatctctccaaactggtggacgaggatgagcctctctttctgtctttaatcaacgacctgtttccaggcttacaattagactctaatacttatgcagagctgcaaaacgctgttgctcaccaagtccaaattgagggtctgatcaaccaccctccgtggaacctgaagctggtgcagctgtatgagaccagtcttgttaggcacggcctgatgaccttggggcccagcgggtccggcaagacaactgtgataaccatattgatgaaagcccaaacggaatgcggccggccacaccgagagatgaggatgaaccccaaggccattacggctccacagatgttcggccgacttgataccgctacgaatgactggacagacgggatattcagtaccctctggcgtaagacgttgaaagccaaaaagggcgagaatatttttttgattctggatggacccgtcgatgctatttggatcgagaacctcaattctgtgctggatgataataagaccctcaccctggctaatggcgatagaattcctatggccccaagctgtaaattactgtttgaggttcacaatattgagaatgcttcccccgccacggtgagcaggatgggaatggtgtatatttcctcctcggccctctcatggaggcccatacttcaagcatggctgaaaaaaaggacagcccaagaggcagccgtttttctcaccctctatgaaaaagtttttgaagacacgtacacatacatgaagcttaacctgaatcctaagatgcagctactggagtgtaactacattgttcagagccttaatttgctcgagggcctcatcccgtccaaagaggaagggggcgtgtcatgtgttgagcacctgcataaactgttcgtgttcggcctcatgtggtccctgggggcactgctggagctggagagccgagagaagctcgaagctttcctaaggcagcacgagtctaaacttgatctgcctgagataccaaaaggtagcaaccagaccatgtacgaattttacgttacggattacggagattgggaacactggaataaaaagcttcagccgtattactaccccacagacagtatccctgagtatagttcaatcctggtgcccaatgtggacaacatcagaaccaacttcctgattgatactatcgccaagcaacacaaggccgtgttgctcacaggggaacagggcacagctaaaactgtcatggtgaaagcttacctgaaaaaatatgacccagaagttcagctcagcaaaagcttgaattttagctctgcaacagaaccaatgatgtttcagcggacaattgagagttacgtggataagcgaatcggctccacctacggccctcccggaggcaggaaaatgactgtattcatcgacgacatcaacatgccagtgatcaacgagtggggagatcagatcactaacgagattgtgaggcagatgatggaaatggagggaatgtattcccttgataagcctggtgacttcacaaccattgtggatgtgcagctgatagccgctatgatccatccaggcggaggccgaaacgacattccacagcgcctgaagcgacagttcacagtcttcaattgcactcttcccagcaacgcatcgatagacaaaatcttcggcattattggctgtggctatttcgacccatgccgctccttcaaacctcagatctgcgagatgatcgtgaatttagtaagtgtgggacgggtcttgtggcagtggaccaaagttaaaatgctccccactccctctaagttccattatatatttaatctccgggacctgtctagaatctggcagggcatgctgaccataaaagccgaggagtgtgccagtatcccaactttgttgagcctatttaaacacgagtgtagcagagttattgctgatagatttataactcccgaagatgagcagtggtttaatgcccacctgacccgggccgtggaggaaaacatcggcagcgacgctgcgagctgcattctgccagagccctacttcgtcgactttctgagagagatgcccgagcccaccggagacgagcccgaagactctgtgttcgaggttccaaagatttacgaactgatgcctagcttcgatttcctggccgagaaactgcagttttaccagcggcagtttaatgagatcatacgtggaacgtccctggatctggtgttttttaaagatgcaatgacccatctgatcaagatcagtagaatcatacgtacgagctgtggcaacgctctcctggtgggagttggcggatcaggcaaacagagcctgtccaggcttgcttccttcattgctggatatcagatcttccagattacacttactcgatcttacaatgtgactaaccttactgacgatctgaaggctttgtataaagtggccggggcggatggcaaggggataacattcatttttacggacagcgagatcaaggacgaagcatttctagagtacctaaacaatctgttatcttcgggcgaaatcagtaacctgtttgccagggacgagatggacgaaatcacccaagggctgatctccgtcatgaagagagagctgcctaggcaccctcccacatttgataatctgtatgagtatttcatttcacgcagccgcaaaaatctgcatgtggtactgtgcttttccccggtgggagagaaattcagggcccgatctttgaaatttcctggactaatttctggatgcaccatggattggttctctcggtggccacgcgaagccctaattgccgttgcttcatacttcctttcagattacaatattgtgtgcagttccgagattaaacggcaggtggttgagactatgggactgtttcatgacatggttagcgaaagctgcgaatcatacttccagcgctacaggaggcgcgcccatgtcaccccaaagtcttacttgtcctttatcaatggatataaaaatatttacgccgaaaaggtgaagtttatcaatgagcaggctgagagaatgaacatcggtcttgataagttgatggaagctagtgaaagcgttgccaagctttcccaagatctggccgttaaagagaaagagctggctgtcgcctctattaaggcagacgaggtcctggcagaagttaccgtgtccgctcaagcctccgcaaagataaaaaacgaagtccaggaggtgaaagataaggcccaaaaaattgtcgatgagatcgattctgaaaaggtaaaggcagagtccaaactggaggcagccaagcccgccctggaagaggccgaggcagcgcttaatacaatcaagcccaacgacattgctacagtccggaaattggccaaaccaccccacctgatcatgcgaataatggactgcgttctgttgctgttccagaaaaagattgacccagtgacaatggatcccgagaaatcgtgctgtaagcccagctggggcgaatcactgaaacttatgtcagccaccggcttcctctggtccctgcagcaatttccaaaggatacaattaatgaagagactgtagaattactccagccttacttcaatatggatgactatacatttgaatctgctaaaaaggtctgtggaaacgtcgctggattgcttagctggacccttgccatggcaattttttacggaatcaatcgtgaggtactccctcttaaggcaaacctggctaagcaagagggcaggttagcagtcgcaaatgctgaactgggcaaagctcaggctctcttagacgagaaacaagccgagctggataaagtgcaggccaagtttgacgcagccatgaacgagaagatggatctgctgaatgatgctgatacctgccggaaaaaaatgcaggcagcatccacactcatcgatggtcttagcggggagaagattaggtggacacagcagtctaaagagttcaaagcacagataaacagacttgttggcgatatcctgctctgcaccgggttcctgagctatctgggaccttttaatcagatattccgtaactacctccttaaggatcagtgggagatggaacttagggcacgcaagattcccttcaccgagaatctcaatctgatcagtatgctggtggaccctcccactataggagagtggggcttgcaaggactgccaggagatgacctgtccattcagaacggtatcattgtgactaaagcaacccgttaccccttgctgattgacccacaaacccaaggaaaaacatggattaagtctaaggaaaaagagaatgacttacaggtaacatctctcaatcacaagtattttcgcacacaccttgaggattccttgtctctcggccgtcccctgctgatcgaagacatacatgaagaactggatccggctcttgataatgtgctcgaaaaaaacttcataaaatctggtacaaccttcaaggttaaagtcggagacaaagagtgtgatataatggatacgtttaagttatatattaccactaaacttccgaatccagcattcacaccagagattaatgccaaaacctccgtgattgactttacggtaacgatgaaaggtctggaaaatcagctgcttcgtcgcgtgattctcactgaaaagcaggagctggaggctgagagggtcaaactgctcgaagatgtcactttcaacaaaaggaagatgaaggagctagaggacaatcttctttataagctcagcgccacaaagggctccctggtcgacgatgagtctctcatcggggtcttaagaactaccaaacaaacggcggccgaagtgagtgagaaacttcacgtagccgccgaaaccgagattaaaattaacgccgctcaggaggaattcagacctgcagcaacccgtgggagcatcttgtatttccttataacagaaatgtcgatggtgaatatcatgtatcagacctctctggctcaattcctgaagctatttgatcaatcaatggccagatctgagaagtcacccctccctcagaaacggattacaaatatcatcgaatatctcacatacgaggtcttcacatatagtgttaggggactctacgagaaccataagtttttgttcgtcttgctcatgactcttaagatcgaccttcagcgcggcaccgttaaacaccgcgaatttcaggccttgataaagggcggagccgccctggatcttaaagcctgtcccccaaagccatacaggtggattctggacatgacttggctgaatctggttgagctctcaaaactgccacaattcgctgagatcatgaatcagatctctagaaacgaaaaaggatggaagagctggtttgacaaagacgctcctgaagaggagattatccccgacgggtataacgactctctcgatacctgccacaagctcctgttgattaggtcatggtgccccgacagaaccgttttccaggctagaaagtacattgctgactcgctggaagaaaagtatactgaacccgttatactgaatctggaaaaaacatgggaggagtccgacacaaggactccacttatctgttttctatctatggggtccgaccctaccaaccagattgatgccctggccaagaagttgaaattggagtgccgaaccatctccatggggcagggtcaggaagtgcatgcgagaaagctgatacagatgagtatgcaacaggtttgcgacaagcgactcttacttctacagcattactgttag

SEQ ID NO: 115253 - DNA, 13461 bp, Artificial Sequence
  Description of Artificial Sequence: Synthetic coding sequence
atgaggctggcagaagaacgcgcggcgctggcggccgagaatgctgacggagagcccggggccgaccgacgcctgcggctgcttggaacttatgtagctatgagcctgcggcccgctgcaggggcttgggaaagatgtgccggttcagccgaagccgagcagttactgcaggctttcctcggcagagacgccgcagaaggtccccgtccattacttgtcgttagaccgggccccagaggccttgctatccgacctggtttagaagtgggccctgaatcaggactcgctggtgccaaagccctgtttttcctccgcacagggccggaaccacctgggccggattcgttccgcggcgctgtggtgtgcggcgatcttcctgcagcgcccctcgagcacctggcagcgctgttctctgaggtggtgttgccagttttggccaacgagaagaatcgcctgaattggccccatatgatttgcgaagatgttagaagacatgcacattctctccaatgtgacctgagtgtaatcctcgaacaggtgaagggcaaaacgctacttcccctccctgctggcagcgagaagatggagttcgccgacagtaagtctgagaccgttctggactctatcgacaagtccgtgatttacgcgatcgaatctgccgtgatcaagtggagctaccaggtgcaggtggttctaaaaagggagtccagccagcctcttcttcaaggagagaatccaacgcccaaagtggagttggagttctggaagtctagatatgaggatctgaaatatatatacaatcagctaaggaccataaccgtccgagggatggccaagctgctcgataagctgcagtcctcctatttccctgctttcaaggctatgtacagagatgtagttgctgcattggctgaggctcaagacattcatgtgcacctgattccgctccagagacacctggaagccctggaaaatgccgagttccccgaggtcaaaccacagctcaggccattgctgcatgtggtgtgcctgatatgggccacttgcaagagttacaggtctcccgggcgactgaccgtcctgctgcaagaaatttgcaacttgctaatccagcaggccagcaactacctgtcacccgaggatctcctgaggtctgaagtcgaggaatcacagcgcaaactgcaggtcgtgagcgacactcttagtttcttcaaacaggagttccaggataggcgagaaaatctgcacacctatttcaaggaaaatcaggaggtaaaggaatgggattttcagagctcccttgtgtttgtcagactggacggctttctgggccagttgcatgtggtggagggcttgttaaaaaccgccctagactttcacaagctaggaaaggtggagttttccggcgtgcgcggcaacgcgctgtctcagcaggtgcagcagatgcacgaggagttccaggagatgtaccggctattatcggggtccagctccgactgcttgtacctgcagagtacagatttcgagaacgacgtgtcagagttcaatcaaaaggtggaagatcttgacagaagactggggactatctttattcaagcctttgacgatgcaccgggactggagcacgcctttaagttattggatatcgctggcaatctgctggagcggcctctggtggcacgcgacacaagtgataagtacctggtgttaattcaaatgttcaataaagatctcgatgcggtaaggatgatatactcacaacatgtgcaggaagaggcagagcttggcttctcaccggtccacaaaaacatgccgactgtggccggaggtctccgctgggctcaagaactgcgacagaggatccagggacctttctccaacttcggccgaatcacacacccctgtatggagtcagccgagggcaaacgaatgcaacagaagtacgaagacatgctttcactgctggaaaagtacgagactcgcttgtacgaagattggtgtagaacagtttctgagaaatcccagtataatctgtctcaacctctgctgaaacgcgatcccgagactaaggaaatcactatcaacttcaacccccaactcataagcgtgctgaaagagatgtcataccttgagccgagagaaatgaagcatatgcccgagaccgccgccgcaatgttcagcagtcgggatttttatagacaactggtagccaatctcgagcttatggcaaactggtacaataaagtgatgaagaccttgctcgaagttgaatttccacttgttgaggaagaattacaaaacattgatctcaggctgagggccgcagaagaaaccctcaattggaagactgaaggcatctgcgattacgtcacagagataacgagtagtatccacgatttagaacagaggatccagaagactaaggacaatgtcgaggaaatccagaacataatgaagacatgggtcacccctatctttaaaaccaaggatggcaagagagagtccctgttgtccctggacgaccggcatgacagaatggagaaatactacaacctcataaaagagtcaggccttaagatccacgcactcgtgcaggaaaatcttggtctgttcagcgccgaccctacttcaaatatatggaaaacgtacgtgaacagcatcgacaatctactgctaaacgggttctttttggctatcgagtgttccctgaagtacttgctggagaacactgaatgcaaggcaggactcaccccaatttttgaggcgcagctgtcactcgctattcccgaactggtgttttatccgtcgctggaatccggtgtgaaagggggtttctgtgacatcgtagaggggctcattacttcgatctttcgcataccttccctcgtgccccgactttctccccaaaatgggagcccacattatcaggtcgatctagacggcatacctgacttagcaaacatgcgtagaactctcatggagagggtgcagagaatgatgggactttgctgcggctaccagagcacgtttagtcagtacagctatctgtatgtggaggatagaaaagaagtattaggacaattccttctgtacggccatatcctgacccccgaggagatcgaggaccatgttgaggacggtatacctgaaaacccacctttgcttagtcagttcaaggtgcagatcgactcttacgaaacactctacgaggaggtttgtaggctggaaccgatcaaagtttttgatggctggatgaagattgatataaggcctttcaaagcttcccttctgaacattataaagaggtggagcctgctgttcaaacaacatctggtggatcatgtcacacactcgctcgccaacctggatgcatttattaaaaaatcggagtctgggctgctgaagaaggtcgaaaaaggagattttcaaggtcttgtggagatcatgggtcacctcatggcagttaaagagcgtcaatccaacaccgatgagatgtttgagcctctcaaacagaccattgagctgctcaagacgtacgagcaggaattgcctgagacggtctttaaacagctggaagagctcccagaaaaatggaacaatattaaaaaagttgctatcactgtaaagcagcaggtcgccccgcttcaggcaaacgaggtcaccttgctgcgacaacggtgtaccgcctttgacgccgaacagcaacagttttgggaacaattccacaaggaggccccatttcgttttgacagcatccacccacaccagatgttagatgcacgacacattgagatccagcaaatggaatccaccatggccagtatttcagagagcgcatctctttttgaggtcaacgtaccggactataaacagctacgacagtgccggaaagaggtgtgccagttaaaggaactctgggataccatcggcatggtcacgagcagcatccatgcatgggaaacgaccccctggcggaacatcaacgttgaggccatggagctggagtgcaagcagttcgctaggcacattcggaatttagacaaggaagtgcgcgcctgggacgcttttaccggcctggagtctaccgtatggaataccttgtcctccctgagggccgttgctgagttgcaaaacccagccatccgggagcgccactggcggcaattgatgcaggcgactggggtctcatttacaatggatcaagacaccactctggctcacctgttgcagttgcagctgcaccactacgaggatgaggtgcggggaatagttgataaagctgccaaagagatggggatggagaaaacgttaaaggagctccaaacaacgtgggcgggaatggagttccagtatgagccacatcctcgaaccaacgtgcccctgctgtgcagcgatgaggacctgatcgaggtcttagaggacaaccaggtgcagctgcagaatctggtcatgtccaaatacgtcgccttcttcctggaggaagtgtccggctggcagaaaaagctgagcacggtggacgctgtcattagtatctggttcgaggtgcagcgtacctggacacatctcgaatcaatctttaccggctcggaggatatccgtgcacagttgcctcaagattccaagaggttcgagggaatagatatcgacttcaaggaactcgcgtacgacgctcagaagataccaaatgtggtgcagacgaccaataagccgggcttgtatgagaaattggaggatatacagggtcgcctgtgcctatgcgagaaagcgctggccgaatacctcgacaccaaacgactcgcattccctcgcttttactttctctcgagttctgatctgttagacatcctgtcgaacggaaccgctccccagcaggtacagcgccacttgagtaagctgttcgataatatggcaaagatgaggtttcagcttgatgcgtcaggcgaaccaacaaagactagcctgggaatgtacagcaaagaggaggagtacgtcgctttctccgaaccttgtgactgttctgggcaggtcgagatctggctaaatcacgtgctgggtcacatgaaagccacggttcgtcatgaaatgactgaaggcgtcacggcatacgaagaaaagccgagagagcagtggctgtttgatcatcccgctcaagtggctctcacatgcacccagatctggtggacgacagaagttgggatggctttcgcgcgcttggaagagggatatgagtccgccatgaaggactactacaagaagcaggtggcccaacttaagaccttgattacaatgctgatcggacagctctctaaaggagacagacaaaagattatgactatttgtaccatcgacgtgcacgctagagatgtagttgctaagatgattgctcaaaaggttgataatgcgcaagcgttcctgtggctaagccagttgcggcatagatgggacgacgaggtgaaacactgttttgctaacatttgtgatgcacagttcctttattcatacgaatatctggggaacacgcccagactggtaataacccccctaacagaccgatgttatatcacgttgactcagtctctccatttaacgatgagcggcgcccctgcaggcccagctggaacaggcaaaaccgagacgactaaggacttagggcgtgcccttggcatcctagtctacgtgttcaactgctcagaacagatggactataaatcatgcgggaatatttataagggattggcccagactggcgcctggggatgctttgacgagtttaatagaatttccgtcgaagtcctgagtgtggttgctgtgcaggtgaagtccatccaggacgccatcagagacaagaagcagtggttttcatttttgggcgaggaaatctcattgaaccccagtgttgggatcttcattacaatgaatcctggatacgcaggcagaacagaactgcccgaaaacctgaaatccctgtttaggccctgtgcaatggtggtgccagacttcgagctgatctgcgagatcatgttggtggccgagggcttcatcgaagcccagagccttgctcggaagttcatcaccttgtaccagctgtgcaaagagttactgagtaaacaggaccactacgactggggactgagggcgataaagtcagtgctggttgtcgcgggatcccttaaaagaggggaccccgataggcctgaagatcaagtgctgatgagatccctgcgggatttcaatattccaaagatcgtgactgacgacatgcctatttttatgggacttataggggacctcttccctgccctcgacgtccctcggaggagggaccctaactttgaggcgttagtaaggaaggcaatcgttgatctaaaactgcaggccgaggacaactttgtactgaaggtcgtgcagcttgaagagcttctggctgtgcgccactccgtatttgtagtgggaggagcaggtaccggtaagtctcaggtcctccgttccctgcacaaaacatatcagatcatgaaaaggagacctgtttggactgatttgaatccaaaagcggtgacgaacgatgagctcttcgggatcatcaatcctgcaacgggcgaatggaaagatggcctgttcagtagcatcatgagggaactggctaacatcacacatgatggcccgaaatggatcctcttggacggtgacatagacccaatgtggattgaatccctgaatactgtgatggacgataataaagttctgacattagcttctaatgagagaatcccactcaaccccacgatgaaactcctcttcgagatctcccacctccgcaccgccacccccgctactgtgtcccgcgccggtatcttgtatatcaaccctgctgacctgggatggaacccacccgtctctagctggatagagaagcgtgaaatacaaaccgagcgggccaatctgaccattttgtttgacaaatacctcccgacatgcctcgatactctcaggacacggttcaaaaagattatacctataccagagcagtccatggtacagatggtgtgtcatctgctggagtgcttactcaccacggaagatatccccgccgattgcccaaaagagatatatgagcattactttgtgttcgccgccatatgggcgtttggtggtgctatggttcaggatcagctggtggactacagagcggagttttccaaatggtggctcacagaatttaaaactgtcaagttcccatcccagggtaccatctttgactactacatcgaccccgaaaccaagaagtttgaaccatggtctaaactggtgccccaatttgagttcgaccccgaaatgccactgcaggcctgcttagtgcacacaagcgagaccatcagagtctgctatttcatggagcgactgatggcgagacagcgccctgtgatgctcgtcggaactgcaggaacaggaaaatcggtgctggtgggagctaaactagcttcgttggatcccgaggcatatctggtcaaaaatgtcccatttaattactacaccacatccgccatgttgcaggccgtcttggagaaacctctggaaaaaaaagccggaagaaactacggacccccagggaataagaaactcatttactttattgatgatatgaacatgccggaggtggatgcttacggcacagtccagccccatactattatacgacagcatttggactatggccactggtatgacaggtcaaaactatcgttgaaagaaatcaccaatgtccaatacgtctcatgcatgaaccctacggcagggtcctttactatcaatcccagactgcagcggcatttctccgtgtttgtgctcagctttcccggcgctgacgcactctccagtatctatagtatcatcctgacgcaacatctgaagctcgggaatttcccggcgagccttcagaaatctattccacctctgatagatctggccctggccttccatcagaagatcgcgacaactttcctgccaacgggtatcaaattccactatatctttaacctccgcgattttgctaatattttccagggtatactgttctccagtgtggaatgtgtgaaatcgacatgggatttgatccgactatacctgcacgaatccaaccgggtctacagagacaagatggttgaagaaaaggacttcgatctctttgataaaattcagacggaagtgctgaagaaaacattcgacgacattgaagaccctgtggaacagacacagagcccaaatttatattgccattttgctaacgggatcggcgagccaaaatacatgccagtgcagagctgggagctgctaacacagaccctggtagaagctctggagaaccacaatgaggtcaacactgtaatggacctggtcttattcgaggatgctatgcgacacgtgtgccacatcaacagaattctagagagtccccgcggcaacgctttgttggtgggagtgggcgggtcgggcaagcagtcgttaacacggcttgctgctttcattagttccatggacgtatttcagatcacattaaggaagggctatcaaatccaggactttaagatggaccttgcgtcgctgtgtctaaaggctggagtgaagaatctcaatacggtctttttgatgaccgacgcccaggtagctgacgagagattcttggtcctcattaacgatctcctggcctctggcgaaattcccgatctctatagtgacgacgaagttgaaaacattatctcaaacgtgagaaacgaggtaaaatcacagggcttagtggacaaccgggagaattgctggaagttctttattgatcgcatccgcaggcaactgaaagtgactttgtgcttctcacctgttgggaataaactgcgcgtgagaagccgtaagtttcccgccattgttaattgtacggcaatccattggtttcacgaatggccccagcaagcgctggaatcagtgtctttgagatttttgcagaatacagaaggcatcgagccaaccgtcaaacagtctatctcgaagttcatggcttttgtccacacatccgtgaaccaaacaagccaaagttatctatccaatgagcagagatacaactataccacaccaaaatccttccttgaatttattcggctgtaccagtcactactacaccggcatcggaaagaactaaaatgtaagacagaaaggcttgaaaacgggctgctgaaacttcattcgacaagcgcgcaggtagacgacctgaaagccaaactggcagcacaggaggtcgagctaaagcagaagaacgaagacgccgacaagttaatacaggtggtgggcgtggaaacagacaaggtttctagagaaaaggctatggctgacgaggaggagcaaaaggtcgcagtcatcatgcttgaagtgaagcaaaagcagaaagactgtgaggaagacttggctaaggccgagcctgccctgaccgctgctcaagctgcccttaacacattaaacaagactaacttaactgagctgaaaagtttcggctcaccacctcttgctgtgtccaatgtatcagcagctgtcatggtattgatggccccacgaggccgagttccgaaagataggagctggaaggccgcaaaagtgaccatggcgaaggttgatggcttccttgactcacttatcaacttcaataaggagaatattcacgagaattgcttaaaggctattcggccatatctgcaggatcctgaatttaacccagagtttgtggccacaaagagctacgcagccgctggattatgctcttgggtcatcaatatcgtgagattctatgaagtcttctgtgatgtcgagcctaagcggcaggcccttaacaaggctactgccgacctaacggccgctcaggagaagctcgccgctatcaaggcaaagattgcacatcttaatgagaacctcgccaagcttacagccagattcgaaaaggcaaccgccgataagctcaaatgccagcaggaggcagaagtgacagctgtgacgatctcactggctaatcgcctggtggggggcttagccagtgagaatgtgagatgggctgacgcagtacagaattttaaacagcaagaaaggaccctttgcggcgatatcctactcattactgcttttatcagttatctaggtttcttcactaagaagtaccgacagtctctgcttgatagaacttggaggccctacttatctcagctcaaaacacccatccctgtcacgcctgccctggatccattgagaatgttaatggacgacgcagacgttgctgcatggcaaaatgagggtctccccgccgatcgtatgagcgtggagaatgccactattcttatcaattgcgaaaggtggcccttgatggttgaccctcagcttcagggaataaaatggattaaaaataagtacggcgaagatctgcgtgtgactcaaatcgggcagaagggctacctacagattatcgagcaggccctggaggccggcgctgtggtacttattgaaaatctcgaggagagtattgatcctgtcctcggcccactgctagggcgcgaagtcatcaagaagggtagattcattaagattggggacaaggagtgcgaatacaatccgaagttcaggctgattctccacactaaactggcaaatccccattatcaacctgaactgcaggctcaggccacccttatcaatttcaccgttactcgggacgggttggaagaccaattgctagccgccgttgtatctatggagcgtcctgatctcgaacaactcaaatctgatcttacaaagcagcagaatggcttcaaaattaccttaaagaccctggaagacagtttgctgtcccgcttgtccagtgcaagtggcaactttctcggtgagactgtgctcgtggaaaatctggaaattaccaagcagactgccgctgaagttgaaaaaaaggtgcaggaggcgaaggtcacagaggtgaagattaacgaagcacgagagcactaccgtcctgctgcagctcgcgcaagtctgctttacttcattatgaatgatttaagcaaaattcacccaatgtaccagttctcactgaaggccttttccattgtttttcagaaagccgttgagagagccgcccctgacgagtcccttcgggaacgggtcgcgaatttaatcgattcaataaccttctcggtgtaccagtataccattcgcggtctgtttgaatgtgataagctaacttatcttgcacaattgacctttcagatcctattgatgaacagggaagtgaacgctgtcgaattagactttttgcttcggtccccagtgcagacaggcaccgcttcgccggttgagtttctgtctcaccaagcttggggcgcagtcaaagtcctgagctccatggaggagttcagtaacctggatcgagacatcgaagggtcagccaagagttggaaaaaattcgttgagagcgaatgtcctgagaaggagaagttgcctcaagaatggaagaataaaacggccctgcagagactttgtatgctgcgcgccatgagacccgacaggatgacctacgcattgagggactttgttgaagagaaactcggcagtaagtatgtggtaggacgggcactcgatttcgctactagtttcgaggagtctggaccagccacacccatgttcttcatcctgtcacccggagtggaccctttgaaagacgtggagagccagggacgaaagctgggttacacgttcaataatcagaattttcataacgtctccctaggtcaaggtcaggaggtcgtggcggaggcggccctagatctagcagcaaagaagggccactgggttatcctgcagaatattcatctggtggccaaatggctgtctacattggaaaagaagttggaagagcactccgaaaactctcaccctgaattccgggtgtttatgagcgccgagcccgcgccctcccccgaggggcacattatcccgcagggcattctggaaaattccatcaagatcaccaacgagccacctaccgggatgcatgccaatctgcacaaggctcttgataatttcactcaggacacgcttgaaatgtgttctagagagaccgagttcaaatccatcctcttcgcactgtgctactttcatgcggtggtcgccgaacggcggaagtttggcccgcaggggtggaacaggtcctatcccttcaataccggagatctcacaatcagcgtaaatgtcttgtataattttctggaggccaacgccaaagtgccttatgacgacctgaggtacttattcggcgagattatgtacggtggacatataaccgatgactgggacagaagactatgtaggacttatctaggcgagtttattaggcctgagatgctggaaggtgaactatctttggccccgggattccccctgcctgggaatatggactataatgggtaccaccagtacatcgacgctgaattgcccccagaaagtccatacctatacggtttgcacccaaacgccgagatcggctttctaacccagacatcagaaaaactgttcaggacagtcttggagttgcagcccagagacagtcaggccagagacggggccggcgccacccgagaggaaaaagtgaaagccctgctcgaggagatcctggaaagggtgacagatgagtttaatatcccagagttgatggccaaggtcgaggagagaaccccatacattgtggtagcctttcaggagtgcgggcggatgaatatcctgacacgggagattcagagatcactacgagaactggagcttggcctgaagggggagttgaccatgacttctcacatggagaatcttcagaacgcactttatttcgatatggtgcctgagtcttgggcccgccgtgcttatccctctactgccggtctcgcagcatggttccccgacctgctgaaccgcataaaggagttggaggcctggacgggggacttcactatgccaagcactgtgtggcttactggattcttcaaccctcagtccttcctgacagcaatcatgcagagcactgccagaaagaatgagtggcctctcgaccagatggccctgcagtgtgacatgacgaagaagaaccgggaagagtttagaagcccaccgcgggaaggcgcttatatacacgggttgttcatggagggggcctgctgggatacacaggcaggtataatcactgaggccaaactgaaagaccttaccccaccaatgcccgtcatgtttataaaagcaattccggcggacaagcaagactgcagatcagtgtacagttgccctgtgtacaaaacgtcccagcgcgggcctacgtacgtgtggacattcaacttgaaaactaaggagaatcctagcaagtgggttttggcaggggtggctttgcttcttcagatctag

SEQ ID NO: 115254 - DNA, 1002 bp, Artificial Sequence
  Description of Artificial Sequence: Synthetic coding sequence
atgaaagacttcgtgctgggccgtgacaaggtccaggaggctaaggtgacagaggtgaaaatcaacgaagctcgtgagcactaccgccccgcggccgcaagagcgtcgctgctttactttattatgaatgatttatccaagatacaccctatgtaccaattctcactgaaagccttcagcattgttttccaaaaggcagttgagcgtgcagccccagatgaatctctccgggaacgggtagccaatctgattgacagcattactttttctgtgtatcagtatactatcagggggctgttcgagtgtgacaagcttacataccttgcacagcttacattccaaattttgctcatgaatagggaggtgaacgctgtggagttggacttcctgctgcggtcgcccgtgcaaacagggacagcttcccccgttgaattcttgtctcaccaggcctggggcgcagtgaaagtcttgtcctccatggaggaatttagtaatcttgatagggacatagaggggtctgctaaatcctggaagaagtttgtcgaatctgaatgccccgagaaggaaaaacttccacaagagtggaaaaacaaaacagccctgcagcgtctgtgtatgctgcgggccatgcgaccggaccgaatgacatatgcactgcgggacttcgtcgaagagaagttagggagcaaatatgttgtcggcagagcccttgacttcgccacaagttttgaggagtccggccccgccaccccaatgttcttcatcctcagccccggggtggaccccctcaaagatgttgaatcacagggccgtaaattgggctatacatttaataatcagaattttcacaatgtttcactggggcagggccaagaggtggttgccgaggccgcccttgatctggcagcaaagaagggccattgggtaatactgcaggtgaagagatgttctttcttcaccttctatcaccccgcgcactgtctcgagcattcgcgacattag

SEQ ID NO: 115255 - DNA, 2397 bp, Artificial Sequence
  Description of Artificial Sequence: Synthetic coding sequence
atgaacgatctgtctaaaatacacccgatgtaccaattctccctgaaggctttttcaattgtgtttcagaaggcagtggaaagagcagccccagacgaatcactccgagagcgcgtcgcaaatctgatcgactccatcactttctctgtctaccagtataccattcggggactgttcgagtgcgataaactgacttatctggcccagctaacattccagatactactaatgaatcgcgaagttaacgcagtggaactagattttctgctgagaagcccagtacaaacaggaacagcaagcccagtcgaattcctctcccaccaagcttggggcgccgttaaagttctgtcttccatggaagaattcagcaacctggatcgggatatcgaaggcagtgctaagtcttggaagaagttcgtcgaatccgaatgtcccgaaaaggagaaactaccccaggagtggaaaaacaagacagcgctccagaggctctgtatgctccgagccatgagacctgatcgcatgacctacgccctcagagatttcgtggaagaaaaactcggatccaagtacgtggtgggaagagcattagattttgccacttcgttcgaagagagtggaccggctacccctatgttcttcattctcagtcccggagtcgaccccctgaaagatgtggagtcacaggggcggaagcttggctatacattcaacaaccagaattttcataatgtttccctgggccagggccaggaggttgtggccgaggcagcattggaccttgcagctaaaaagggccattgggtgatcctgcagaatatccatctggttgccaagtggttaagcacacttgagaagaaactggaagagcattcagagaattcgcacccagagtttcgcgtgtttatgagcgcggagcccgccccctctcctgaaggtcacataattccccagggcattcttgaaaattctattaaaataacaaatgagccacccactggtatgcacgctaacctgcataaagccctcgacaacttcacacaggacaccctcgagatgtgctcacgtgaaaccgaatttaaaagcattctctttgcgttgtgctacttccacgctgtggtggccgaacggcgaaaatttgggccacaggggtggaatcgcagttaccccttcaatacgggcgatctcaccatctccgtcaatgtcttgtataacttcctggaggccaacgctaaagtaccttacgatgatctgcgttacctcttcggagagattatgtatgggggccacatcaccgatgactgggatcgaaggctctgcaggacctacctgggcgagttcatccggcctgagatgctcgagggtgagctcagcctcgctccgggctttcctctccctggaaacatggactacaacggctaccaccaatacatcgacgctgagcttcctccagagagcccatatctgtacggactccatcccaatgcagagatcggttttctcacacagaccagtgagaagctgttccgcaccgttctcgaactccagccccgcgacagtcaggccagagacggcgccggagccaccagagaagagaaggtgaaagcgttgcttgaggagatacttgagagagtcaccgacgagttcaatatcccagaacttatggctaaggtcgaggagagaacgccgtacattgtcgtggccttccaagagtgtggccggatgaatatactgaccagagagatccagcggagtctgagagaactggagctgggtctgaaaggggagttaactatgacgagccacatggagaaccttcaaaatgccctctattttgacatggtgcccgaatcgtgggctcgtcgggcctatcctagtacagccgggctggctgcttggttccccgatctccttaacaggattaaggagttggaagcgtggacaggggactttaccatgccttccaccgtatggcttacaggttttttcaatccccagagcttcctcacagctatcatgcagtccactgcccggaaaaacgaatggcctttggaccagatggccttgcagtgcgatatgaccaagaaaaatagagaggagttccgtagccccccacgcgagggagcttacatacacggcctcttcatggagggagcatgttgggacacgcaggccggcattatcaccgaagccaagcttaaagacctgaccccaccaatgcccgtcatgttcatcaaggctattcctgctgacaagcaggactgtcggtctgtctacagttgccctgtttataagacttctcagcgtggccctacttacgtttggaccttcaatctcaaaactaaagagaaccccagcaaatgggtcctagccggcgtggcattactcctgcagatttag

SEQ ID NO: 115256 - DNA, 8979 bp, Artificial Sequence
  Description of Artificial Sequence: Synthetic coding sequence
gaggtgcggggaattgtggacaaagccgcaaaagagatgggcatggagaaaacattgaaggaactgcagacaacctgggctggaatggaattccagtacgagccccaccctcgcactaacgttcccctgctctgcagcgacgaggacctcatcgaggtccttgaagacaaccaggtccaactgcagaacctcgtcatgtctaagtacgtggctttttttctagaagaggtgagcgggtggcagaaaaagctctcgactgttgatgcagtgatctccatttggttcgaggtccagcgaacatggactcacctagagagtatttttacaggtagtgaagacatcagagcccagctgccgcaagacagcaagaggtttgagggaatagacatcgatttcaaggagctcgcctatgatgctcaaaagattccaaatgtggtgcaaaccaccaataaacccgggctttacgaaaagcttgaagatatccagggaaggctgtgtctgtgcgagaaggcccttgcagaatatctcgacacaaaacgtctcgcattccctcggttttacttcttgtctagtagcgaccttctagatatccttagtaacggtacggcacctcaacaggtccagcgacatctctccaagcttttcgacaacatggctaaaatgagatttcagttggacgccagcggggaaccaaccaagacgagcttgggaatgtactctaaggaggaggaatatgtagcattctcagagccttgtgactgttcggggcaggtggaaatctggttgaaccacgtgctagggcacatgaaggcaacggttcggcatgaaatgactgagggtgtgaccgcctacgaagagaaaccccgggaacaatggctctttgaccatccagcccaggtggctctcacatgtacacagatctggtggacaacagaggttggtatggccttcgcaaggttggaagaaggctacgagtccgccatgaaggactactacaaaaagcaggtggcccagctgaagacgttaattaccatgcttatcgggcagctgagcaagggtgacagacaaaagattatgaccatctgtaccatcgacgtccatgcacgcgacgttgtggccaagatgattgctcagaaggttgataacgcccaggcctttctctggttaagtcagctgcggcacagatgggatgatgaggtgaagcactgtttcgccaatatatgcgacgcccagttcctctattcttatgaatatttggggaacacccctcgtcttgtgattacacctttgacagacagatgttacattaccctgacacagtctctgcatctgaccatgagcggagctccagctggccctgccggaacaggcaagacggagacgactaaagacctgggacgagctttgggcatccttgtatacgtgttcaattgttccgaacagatggattacaagagctgcggtaatatctataagggattagcacagaccggagcttgggggtgcttcgatgagtttaaccggatctctgtcgaggtccttagcgtggtggcagtgcaggtcaagagtatccaggacgctatccgcgacaagaaacagtggttttccttcctcggagaggaaattagtttaaatccctccgtgggaatcttcattacgatgaatccaggatatgctggccggactgagttgccagagaaccttaaatctctgtttcgaccctgcgccatggtcgtccccgacttcgaattaatctgcgagataatgctggtggcagagggcttcatcgaagcacagtccctcgcccggaagttcattactctctatcaactgtgtaaagaactgctctccaagcaggatcactacgactggggattacgggctatcaagtctgtcctggttgtcgccgggagcttaaaacggggggaccccgatcgccccgaagatcaggtcctgatgcgaagcctgcgagatttcaatatccctaaaatcgttaccgacgatatgcctatattcatggggcttattggtgatctattcccagccctggatgtgcccagacgccgggaccccaacttcgaggcattggtgagaaaggccattgtcgatctgaagctccaggccgaggacaacttcgtgctgaaagtcgtccagctggaggagctgttggccgtgcgtcactcagtctttgtagtaggcggcgcaggcacgggcaagtcccaggtcctgcggagtttgcacaagacctaccaaatcatgaagaggcggccggtgtggacggacctgaatcctaaggccgtgactaatgacgagctctttgggatcattaatcctgccaccggcgagtggaaggacggcctgttttcaagcataatgcgggaattagcaaatataacccacgatgggcccaagtggattctactcgatggcgatatcgaccctatgtggatcgagtccctcaataccgttatggatgataataaagtgttaactctggcgagtaacgaaaggatacccctcaatccaacaatgaagttattgtttgagatcagtcacttgagaacggcaacacccgctactgtctctcgtgccggcattttgtacataaatccagccgatttggggtggaatccaccagtatcttcttggatcgaaaagagagaaattcagaccgagagagcaaacctcacaatcctctttgataaatacctgccgacttgtctggacacactgagaactcggttcaaaaagataattcccatacctgagcagagtatggtgcagatggtgtgccatctgcttgaatgcctgctgacaaccgaggatataccggccgattgccctaaagaaatatatgagcactacttcgtgtttgccgccatttgggcattcggcggcgctatggtacaggaccagttggtggactaccgcgcagagttctccaagtggtggctcaccgaatttaagactgtgaaattcccatcgcaaggtacaattttcgactattatattgatccggagacaaagaagttcgaaccatggagtaaactggtgccacagttcgaattcgatcccgaaatgcccctacaggcatgtctcgtgcacacttcggagaccattcgcgtctgctactttatggagaggctaatggctcgacagaggcctgtgatgctggtagggactgcgggcacaggtaaatccgttctcgtgggtgcaaagttggcttctttggatcctgaagcataccttgtaaaaaacgttccgtttaattattacaccacttccgctatgttgcaagccgtgctcgaaaagcccctggagaagaaggcaggaaggaactatggaccaccagggaataagaaactgatctatttcatcgacgatatgaatatgcctgaagttgacgcctacggcacagtccagcctcacacaatcattaggcagcatctggactatggacattggtacgatcgttctaagctctcactgaaggaaatcacaaatgtgcagtatgtgagttgtatgaaccctactgccgggtcttttactataaatccaagattgcagaggcattttagtgtttttgttctaagctttccaggcgcggatgccctgagttctatttactccatcatccttacacaacatctgaaactgggcaacttccccgcctctttacagaaatccattccgccacttattgatctcgccctcgcttttcatcagaaaattgcaacaacttttctgccgaccggtatcaagttccattatatcttcaacctcagggactttgccaacatctttcagggcatcctctttagtagtgtcgaatgtgttaagagcacatgggacctgatcaggctgtacctccatgaaagtaacagggtttatagagacaagatggtggaagaaaaggactttgacctctttgataaaatacagactgaagtcttaaagaaaacgtttgatgatatcgaggaccccgtcgaacagacacagagccccaacctgtattgccatttcgccaacggaataggagagcctaaatatatgcctgtgcagtcctgggagctgcttacccagacacttgtggaggccctggaaaaccacaacgaggtgaataccgtgatggaccttgtcctgttcgaggatgctatgaggcacgtatgtcacatcaatcggatcctagaatctccacgcggaaatgctttgcttgtcggcgtgggtggttctgggaaacagagcctgaccaggcttgctgctttcataagttccatggacgtgttccaaattacgctgaggaaaggctatcagatacaggattttaagatggacctggcatccttgtgtctgaaagcaggtgtgaagaacctcaacactgtgtttcttatgacagacgctcaagtcgctgatgagagattcctggtcctgataaatgatctgctggcatccggggagatccccgacctgtactcggatgacgaagtcgaaaacatcattagcaacgttcgcaacgaagttaagtctcagggacttgttgacaatcgcgagaactgttggaagtttttcattgacagaatcagacgccagttgaaagtgacactgtgttttagccctgtggggaataaactgcgggtgcggagcaggaaattccccgcaattgtgaactgtactgccatacattggtttcatgaatggcctcagcaagccctggaatctgtctcactcagatttttgcagaacactgagggcatcgagccaacggtgaagcaatctatttcaaaattcatggcttttgtgcataccagtgtgaaccagacgtctcagtcctatttgtctaacgaacagaggtacaactataccacacctaagagctttttagaattcatccggctataccagtccctgcttcatcgacacaggaaggaattgaaatgcaagacagagaggctggagaacgggctgctaaaactgcattctacctccgcccaggtcgacgatctaaaggccaagctggctgcacaggaggtggagctgaagcagaagaatgaggacgcagacaagcttatccaggttgtcggcgttgagacggacaaggtcagtcgggaaaaggcaatggcagatgaggaggaacagaaagtggcagtcataatgctcgaggtcaaacagaaacagaaagactgcgaggaagatctagcaaaagcagagcctgccctgaccgccgcccaagccgcactgaatactttgaataaaacgaatctgaccgagctcaagagcttcgggtcccctcccctcgcagttagcaatgtaagtgccgccgtcatggtcttgatggccccgaggggaagagttccaaaggaccggtcctggaaggccgcgaaggtgacaatggcaaaggtggatgggttcttggatagtttaatcaattttaacaaagagaatattcacgaaaattgcctgaaagctatccggccatatctccaagatcctgagttcaaccctgaattcgtggccaccaagagctatgcggcagccgggctgtgtagctgggtgattaacatcgtacgcttttacgaagtcttctgcgatgtagaacctaagcgacaggccttaaacaaagcaacggcagacttaacagccgcccaagaaaaactggccgccatcaaggcaaaaatcgcccacctgaacgaaaacctggctaagcttaccgctagattcgagaaagccacagcggacaaactcaagtgtcagcaagaggccgaggtcactgccgtgaccattagcttggcaaacagactcgttggcggactggcatcggaaaacgtgcggtgggccgacgcggtgcagaatttcaaacaacaagagagaactctgtgcggcgacatcctcttaattaccgcttttatctcttatctgggtttttttacaaaaaaatatcgccagagcctgctcgacagaacatggcgcccgtacttgtcacagctaaaaacccccatcccagtcactcccgccctggacccgctgcgtatgttgatggatgacgccgacgtggccgcttggcagaacgagggattacccgccgaccggatgagcgtcgagaatgctacgattctgattaactgtgaacgttggcccctgatggtggatcctcagctccagggcataaaatggatcaagaataaatatggcgaagatctcagagtgacccaaattggccagaagggctacttgcagattatcgagcaggctctggaggcgggtgcagttgttctgatcgagaatctcgaggagtccatcgatcctgttttgggtcccctgctcgggagagaagtgataaaaaaggggagatttattaaaatcggcgacaaagaatgcgaatataaccctaagttccgtttgatactgcatactaagctggctaatccccactaccagcccgagctgcaggcgcaagccacactgatcaatttcaccgtgacaagggacggtttggaggaccagctgttggctgccgtcgtgagcatggaacgccctgatctggaacagttgaagtctgacctgacaaaacagcagaatggctttaaaattacactcaagacccttgaggactccctgttatctagactcagcagcgctagtggtaacttccttggtgaaacagtcttggtggagaacttagaaataaccaagcaaacagccgctgaggttgaaaaaaaggttcaagaagccaaagtgactgaagtgaaaattaatgaagcgcgagaacactaccggcctgctgctgctagagcctcactgctgtacttcattatgaacgaccttagtaagatacatcccatgtaccagttttccctcaaggcattctctattgtgtttcagaaagcagttgagcgtgcagcccctgacgaatcgctcagagagagagtcgccaacctaatcgacagcattaccttcagtgtgtatcagtatacaattagggggctcttcgagtgcgataagcttacatatctcgcccagcttacctttcagattcttctcatgaatcgcgaagttaacgccgtggaactggattttctcttaagatcccccgtccagaccgggaccgccagtcctgtagaattcctgagccaccaagcttggggggccgttaaagtgctgagttcaatggaggaattctcaaacctcgatcgcgatatcgagggttccgctaaatcgtggaagaagttcgtggagtcagagtgtccggaaaaggagaagctccctcaggagtggaaaaacaagactgccctgcagagactgtgcatgctgagggcaatgcgccccgacaggatgacctatgctctgagagactttgtcgaggagaagctcgggagcaagtacgttgtaggacgagccttggactttgcaacatcttttgaggagagcggcccagccactccgatgttcttcatcctgtctcccggagttgatcctctgaaagacgtggaatctcaggggcgtaagctcggatataccttcaataaccaaaattttcataacgtctctctcggtcaaggccaagaggtcgttgctgaagcagccctcgatctagctgccaagaagggacattgggtgatcctccaggacaccctggagatgtgtagcagggagacagaatttaaatcgatcctgttcgccttgtgttacttccacgcagtcgtagctgagcgaaggaaatttgggccacaggggtggaaccggtcatatccctttaacaccggagatctgaccatctctgtgaatgtcctttataatttcctcgaggctaacgcgaaagtgccttacgacgacctcaggtacctctttggtgagattatgtatggcggccacataacagacgactgggaccgccgcctctgccggacgtatctgggtgaatttattagaccagaaatgcttgagggagagctgtcactcgctccaggatttccattgcccggtaacatggactataacgggtatcaccagtacatcgatgccgaactgccacccgaatcgccttatttatatggtcttcatccaaacgccgagatagggttccttacccaaacgtctgagaagctctttaggactgtgctggagctgcagccacgagactcgcaggcccgggatggagccggcgccacccgggaagagaaagttaaggcactcctcgaagagattctggagcgagtaacagacgagttcaacattcccgagctgatggcgaaggtagaggaacgtaccccttatattgtggtggccttccaggagtgtggtcgcatgaacatcttgactcgagagatacaaagatccttgcgtgagttagagctgggactgaaaggagagctgactatgacctctcacatggagaatctgcagaacgcgctgtacttcgatatggtaccagaatcctgggctcgcagggcgtatccatctacggcaggattggcagcctggttccctgacctgctgaatcgcatcaaagagctggaggcttggaccggcgactttacgatgccgtctacagtttggctgacagggttctttaatcctcaaagttttctgacagccattatgcagagtacggctcggaaaaacgaatggccccttgatcaaatggctctgcaatgtgatatgactaagaaaaatcgagaggaatttcgtagtccgccacgtgaaggggcatacattcacgggttgttcatggagggcgcatgctgggacacacaggccggtatcattaccgaagccaaattgaaggatctgactccccccatgcccgttatgtttatcaaagccatccccgctgacaagcaggattgtcgctccgtatattcctgcccagtgtataagacttctcagcgtggccccacctatgtttggacttttaatcttaaaacaaaggagaacccctcaaaatgggtcctggctggcgtggcactgctgttgcagatctag

SEQ ID NO: 115257 - DNA, 13233 bp, Artificial Sequence
  Description of Artificial Sequence: Synthetic coding sequence
atgaggttggcagaggaacgggcagctctggctgccgaaaacgccgacggggaacccggtgctgaccggcgcctgcgtttattgggcacttatgtcgctatgagcctgcgtcctgccgccggtgcatgggagcgctgcgcaggatcagctgaagctgagcagctgctgcaggccttcctaggacgggatgctgcagagggccctagacctctgctggtcgtaaggcctggaccaaggggattggcaatccgaccaggtctcgaagtcggtcctgaaagcggattagcgggtgccaaagcactgtttttcctccggacgggccccgaaccccctggtccagacagtttcaggggcgcagtagtgtgtggtgacctgcctgccgcaccactggagcacctcgcagcgctctttagtgaagttgtgttacctgtcctagccaacgagaagaataggctgaactggcctcacatgatctgcgaagacgtccgccgtcatgctcatagcttacagtgtgacctgagtgttatcctcgaacaggtcaagggcaagacgctgttaccactcccagctggttctgagaagatggaattcgcagactcaaaaagcgagactgtgctcgatagtatagacaagagcgtgatctacgctatagagagcgccgtcatcaaatggagttatcaagtccaggtggtgttaaagcgcgaatcatctcaacctttgctccagggagagaatcccacacccaaagtggaattagagttctggaagtcccgttatgaggacctgaaatacatttacaaccagcttcgcaccatcaccgtgagaggaatggcaaaactgctggacaaacttcaatcatcatactttcctgcctttaaagcaatgtaccgagatgtagtagccgccttggctgaggcacaggatattcacgtccacctgatcccactgcagcgccacctggaggccctggagaacgcagagtttccagaagtaaaacctcagctgagaccattgctgcacgtggtgtgcctgatttgggcgacctgcaagtcataccgctcacccggccgcctgactgtcctgctgcaggaaatctgcaacctgctcattcaacaggcctccaactatctgtctcctgaggatctgcttagatctgaggtcgaagaatcacagcgaaagctacaggtcgtcagtgatacactgtcattctttaagcaggagttccaggatcggcgtgagaatttgcacacatacttcaaggaaaatcaagaagtgaaggagtgggatttccaatcatctctggtctttgtaaggttggacgggtttttgggacaactgcacgtggtagagggattgctgaaaacggcactggattttcacaagttgggtaaagtggagttcagcggcgtccgcggcaacgccctgtcacagcaggtccagcagatgcatgaggaatttcaggaaatgtatcgcttgctctctggatcttcgagtgactgcttgtatctccagtctacagacttcgagaatgatgtctctgagtttaaccagaaggtcgaagatttagatcgtcgcctcggcaccatctttatacaggcatttgatgacgcaccgggactggaacacgcttttaagctgctggatatagctggaaacttgttggagcgtcccttggtggcacgagacacttctgacaagtatttagttctgatacagatgtttaacaaagatctcgatgcagtgcgcatgatatactctcagcatgtccaggaagaggccgaactgggcttttctcccgttcataagaatatgccaactgtggccggagggcttaggtgggcacaggagctacggcagaggatacagggacctttctccaacttcgggcggataactcatccgtgcatggaatcagccgagggcaagcggatgcagcagaagtacgaggacatgcttagtctgctcgagaaatatgagaccagactctatgaggattggtgtagaactgtgagtgagaagtcacaatacaacctgagtcagccacttcttaagcgagaccccgagaccaaggagatcaccataaacttcaatccccagctaatcagcgttttaaaagaaatgagttacctggagccgcgggaaatgaagcatatgcccgaaaccgccgccgctatgttctccagcagagacttctaccgccaacttgttgcaaatcttgagctgatggcaaattggtataataaggtgatgaagaccctgctggaagtcgagttccccctagtggaagaagagctccagaacatcgacctgagactgagggcagcagaagagaccctcaattggaaaacagaagggatttgtgactatgtgacggagatcacatcatccatccatgacctggagcagcgcatccagaagacaaaggataatgttgaagagatccagaatattatgaagacctgggtgacacctatttttaaaaccaaggatggaaaacgtgagtctctcctgtccttagatgaccgccatgaccgtatggaaaaatattataacctgataaaagaatcaggactcaagattcatgcattggtccaggaaaatctgggcctgttcagcgcagaccctacctctaatatttggaaaacttatgtgaacagcatcgacaaccttctgctgaacggctttttcctggctattgaatgttctctgaagtatttgttagaaaacaccgagtgtaaagcaggtttgactccgatttttgaagctcagctgtcactggccatcccggagctagtgttctacccttcattagaatccggagtcaagggaggattctgtgacatagtcgagggcttgattacatcaattttccgaattccatcacttgtcccaagactgagcccccagaacgggagtccacattatcaagtggatctggatggaatcccagatttggctaacatgcggcggaccctcatggagcgggttcaaagaatgatggggctttgctgcggctaccagagcacgttctcccaatactcatacctatatgttgaggatcgtaaagaagtcttgggtcagtttctcctgtacggccacattttgacacccgaagaaatcgaggatcacgtggaggacggaatccctgaaaatcctcccttattatcccagtttaaggtgcagattgacagttacgaaacactctacgaggaagtatgcagactagagccaatcaaggttttcgacggatggatgaaaattgacatccgcccttttaaggcatcccttctgaacattattaagcgctggagcctgctgttcaaacaacacctggtggatcacgtaacccatagcctcgcaaatctggacgcttttatcaaaaagtctgagtctgggctgttgaaaaaggtggagaagggagatttccaaggtctagtcgagataatggggcacctcatggcggtgaaggagaggcagagcaataccgacgagatgtttgagcccctaaagcagacaattgagttgcttaaaacatacgaacaggaactccccgagacagtgttcaaacagctggaggaactgcccgagaaatggaataacattaagaaagttgccatcactgtgaaacaacaggtggcccccctgcaggctaacgaggtgacgctacttagacagcgctgtaccgcatttgacgctgagcagcaacagttttgggaacagtttcacaaagaagccccgtttcggtttgattctattcatccccaccagatgctggatgctagacacatcgagatccaacagatggaaagcaccatggcctccattagcgagtcagcctcattgttcgaggtcaatgtgcccgattataagcagctgcgccagtgtcgcaaagaggtttgccagctgaaggaattgtgggacaccatcggaatggtaacaagctcgattcatgcctgggagaccacaccatggcgtaacatcaatgtggaggctatggagctagaatgtaaacagtttgccaggcacatccggaatctggacaaggaggttcgcgcatgggatgcgtttaccggcctggaaagcacagtgtggaacactctgtccagcctacgagcggtcgcagaacttcagaacccagcaattcgcgagcggcattggcgccaattaatgcaagcaaccggcgtgtcatttacgatggaccaggacacgacattggcacacctgttacagctgcagctacaccactacgaagacgaggtgcgtggcatagtggacaaagcagcaaaagagatgggtatggaaaagaccctgaaggagctgcagaccacttgggcaggcatggagttccagtacgagccacaccccagaactaatgttcccctgctgtgctctgacgaagatttaattgaagttctggaagacaaccaggttcagctgcagaatctcgtgatgagcaaatacgtggctttcttcctggaggaagtgtctgggtggcagaagaagctaagtaccgtggacgcggtcatttcaatttggttcgaggtgcagcgcacctggacacatctcgaatcaatttttactggcagcgaggacattcgtgcccaactgcctcaggattctaagcggtttgaaggcattgacatcgactttaaggaactggcctatgacgcacaaaagatccctaacgtagtccaaacaacgaataaacccggattgtacgagaaactcgaggatattcaggggagactatgcctatgtgagaaggccctggctgaatacttggatactaaaagactggccttccctcggttctattttcttagttcatccgatctgttagacatactaagtaatggaaccgcgccacagcaggttcagagacatctgtctaaactgttcgacaacatggcaaaaatgagattccagcttgacgcttccggcgaacccacgaaaaccagtctcggaatgtactcgaaagaggaggaatatgtggctttttccgagccctgtgattgttcaggccaggtggagatttggctcaaccacgtgctaggacatatgaaagccaccgtgaggcacgaaatgactgagggggttactgcctacgaagagaaaccacgtgagcagtggctgtttgatcatcccgcccaggttgcgctgacctgcacccagatctggtggacaacagaagttggcatggcattcgcaagattggaagagggctacgagagcgctatgaaagactactacaagaaacaggtcgcacagctgaaaacgttgatcactatgcttatcggacagctctccaagggagatagacaaaagataatgactatctgcaccatcgacgtgcacgcccgggatgtggtcgccaaaatgatcgcccagaaggtggataacgcacaagccttcctgtggttgtcacagctgcgccatcgctgggacgacgaagtgaaacactgcttcgcgaatatctgcgatgcccaattcctttacagctatgaatacctgggcaatactccgaggttagtgatcacaccgctgacggatagatgttatattacgctgacgcagagcctgcaccttacgatgagcggggctcccgcaggtcccgccggaacaggaaagaccgagacaactaaagatcttggtagagccctcgggattttggtgtacgtcttcaattgtagtgagcaaatggattataagagctgcggtaatatttacaaaggtctggcgcaaaccggagcatgggggtgcttcgatgagtttaatcgcattagtgtcgaggtcttaagtgtggtggcagttcaggttaaaagcattcaggatgccattagagacaaaaaacagtggttcagctttcttggagaggaaatctcccttaatcccagcgtaggtatcttcatcacaatgaatcctggctacgccgggcgcaccgagctccccgagaaccttaagtctctgtttaggccttgtgccatggtcgtcccagacttcgagttgatttgcgaaatcatgctagtcgccgaaggatttattgaggcccagtcattggcacggaaattcattacattgtatcaactctgcaaggaattgctctctaaacaggaccactacgactggggtctccgcgccattaaaagtgtgctcgttgtggccggcagtcttaagcgaggagatcccgacaggccagaggaccaggtcctgatgcgctccctgcgcgattttaacatccccaagatcgtcaccgacgacatgccgattttcatgggcctgatcggtgacctgttccccgccctggatgtgcctaggcgccgagatcccaacttcgaagcgctggtgcggaaagctattgttgacctcaaacttcaggcagaagataatttcgtcttaaaagtggtgcaacttgaagaactcttggcagtcagacatagcgtctttgtggtgggcggcgcagggactggcaagtcacaagttttgcggtccctacataaaacctaccagatcatgaagcgccggccagtatggacagacttgaatcccaaggccgtcacaaatgacgaactgttcggcatcatcaatcccgctaccggagaatggaaagacggcttgttctcttccatcatgagggagctggccaacatcacccacgacggaccaaagtggatcttacttgacggcgacatagatcctatgtggatcgaaagcctgaacactgtcatggatgataacaaggtgctgacgcttgcctccaatgagcgaataccactcaaccccactatgaaactgcttttcgaaatctcccatttgcggaccgctactcctgcaactgtatctcgcgctgggattctgtatattaaccctgccgacctgggctggaacccccctgtgagcagctggatcgagaaacgagagatccagacagagagggccaatttgaccatactctttgataaataccttcccacctgtctggacacgctgagaacgaggtttaaaaaaattattccgattcctgaacagagcatggttcaaatggtttgtcatctgttggaatgcttactaacgacagaagatattccagcggattgccccaaggaaatttacgagcactattttgtattcgccgcaatatgggcctttggcggcgcaatggttcaggaccagctggtggattatagagcagagttctctaaatggtggttgacggaattcaagaccgtcaagttcccgagccaaggaaccatttttgactactacattgatcctgagacaaagaagttcgaaccctggtccaaactcgtgccccagttcgagtttgacccagagatgccccttcaggcctgtctggtgcacactagtgagactattcgcgtatgctattttatggagaggctgatggccagacagcggccagtcatgttggtgggcactgccggtactggtaaatcagtcctggtcggggcgaaactggcgtcacttgatcctgaggcttacttagtgaagaatgtaccgttcaactattacaccaccagcgcaatgctccaagcagtgctggaaaaaccgctggaaaagaaagcgggaaggaattatggtccaccaggaaacaagaagctcatctattttattgacgatatgaatatgcccgaagttgacgcctatggcaccgtgcagccgcacacaataatccggcagcacctcgactacggccattggtatgaccgtagtaagttgtccttgaaggaaatcaccaatgtccagtacgtatcctgtatgaacccaaccgctgggagtttcaccattaacccccgtctgcaacgccacttctccgtgttcgtgttatcctttccgggggccgacgctttgtctagcatctattctattatactaacacagcacttaaaactgggcaactttcccgcgtcgctgcaaaaaagcattccaccattaatcgatctggccctggctttccaccagaagattgccaccacctttttgcctacaggaataaaatttcactatatctttaacctcagggactttgccaacatcttccaaggtattctgtttagtagtgttgaatgcgtgaaaagtacctgggacctgattaggctgtatcttcatgagagtaatagagtgtaccgcgataagatggtggaagagaaggactttgacctgtttgataagattcagactgaagtactgaaaaaaactttcgatgacattgaggacccggttgaacagacacagtcccccaatctctattgccactttgccaacggcatcggtgaacctaagtatatgcccgttcagtcctgggagctcctgacccagacactggtggaagcgttagaaaatcacaatgaggtgaacactgtgatggatctggtgctgttcgaagatgcaatgcgacatgtgtgccacatcaataggatactcgagtccccccgtggcaatgcccttctcgtaggagtgggcggctcaggaaaacagtcgcttactcgactcgccgcttttatctcctcaatggatgtctttcaaatcacccttagaaaaggctatcagatccaggattttaaaatggatctggcttccctttgccttaaagctggagtcaagaatctaaatacagtctttctgatgaccgacgcacaagtggcagacgagcggtttctggttctcattaacgatctcctggcttccggggaaattcccgatctgtatagtgacgatgaggtggagaatataatctccaacgtccgcaacgaggtgaaaagtcagggcctggtggacaacagagagaattgctggaaatttttcattgatcggatccggcgccagctgaaggtgactctctgctttagccctgtcggcaataagttgagagtgaggtctcggaaatttcctgccatagtgaactgcaccgcaatccattggttccacgaatggccccagcaggccctcgaatccgtatcacttcgcttcctgcagaacacagagggtattgaacctaccgtgaaacaaagcataagcaagtttatggccttcgtgcacacttctgtgaaccaaaccagccaatcttacttgtcaaacgaacaacggtataattataccacacccaagagttttctcgagttcatcaggctctaccagagcttactacatagacaccgaaaagaactcaaatgcaaaactgaacggcttgaaaatggcctacttaaactgcacagtacctctgctcaggtggatgaccttaaggccaagttggctgcgcaggaggtggagctgaaacagaaaaacgaagacgctgacaaacttatccaggtcgtcggcgttgagacagacaaggtgtcccgagaaaaggccatggcggacgaggaggagcagaaagtcgccgtgatcatgcttgaagtgaagcagaagcagaaggactgtgaagaggatctcgctaaagccgagcccgcgcttaccgccgcccaggctgcccttaacaccctaaataaaacgaatttgactgagcttaaatccttcgggtcccctccacttgctgtttccaatgtcagcgcggccgtcatggtgctgatggcgcccagagggagagtcccaaaagataggagctggaaggctgcgaaggtaactatggctaaggtagacggcttcctcgactccctcatcaactttaacaaagagaacatccatgagaattgccttaaggcaattaggccatatcttcaggaccccgagttcaatcctgaattcgtggctaccaaatcctatgctgcagccgggttatgcagttgggtgattaacatagttcgcttttacgaggtgttctgtgacgtggagccaaaacgccaagccctcaacaaggccactgccgatctcaccgcagctcaggaaaaactggctgcaattaaggcaaaaatcgcgcaccttaacgaaaacctcgccaaattaaccgccaggttcgaaaaagctacggccgacaagctgaagtgtcagcaggaagccgaagtgacggccgtgaccatcagtcttgctaaccgactggtcggtggactggccagtgaaaatgtgcggtgggcggacgcagtgcagaatttcaaacaacaggagaggaccctgtgtggcgacattttgttgattactgcgttcatttcctacttgggattctttacaaagaagtaccggcaatctctcctggaccgcacatggagaccttacctatctcagctgaagacaccaatccccgtcactcccgccctggacccattgcgcatgctgatggatgatgccgacgtggcagcatggcagaacgaaggcctccctgccgaccggatgagcgtggaaaacgccactatcctgatcaactgcgagagatggcccctaatggttgacccacagttacagggaatcaagtggattaaaaataagtacggcgaagatctacgggtaactcagatcggtcagaaagggtatcttcagattattgaacaggcacttgaggcaggtgcagtcgtgctgattgaaaacctggaggagtccatcgatcctgtccttggcccactgttgggcagagaggtgataaagaaaggccgattcataaagattggggacaaggagtgtgagtataatcctaaattccggctgattctgcatacaaagctcgccaacccccactaccaacctgaactgcaggcccaagctaccttgatcaatttcacggtcacaagggatgggcttgaagaccagcttctcgcagctgtggtaagcatggagcgtccggaccttgagcaattaaagagtgatttgactaaacaacagaatgggttcaaaattactctcaagacgctcgaggatagcctgctcagtaggctttccagcgcgtccggcaatttcttgggcgagacagtgctcgtcgaaaatttagaaatcaccaagcaaacagccgcagaagttgagaagaaagtccaagaggctaaagtcacagaggtgaaaataaacgaggcccgggagcactaccgaccagctgccgctcgcgcatctttgctctatttcattatgaatgacctgtccaaaattcatccgatgtatcagttctccctcaaggcattcagcattgtgttccagaaggctgtggagcgcgccgcccccgacgagagtctgcgagaaagggtggctaacttgatcgactccattacattttcggtgtaccagtacacaatccgaggcctgtttgagtgcgacaaactgacctatctggcccagctaacctttcaaatcctgttaatgaatcgggaagtaaacgccgttgagttagacttcctcctcaggagtccagtgcagactggaactgcatcaccggtcgaattcctgtctcaccaggcatggggggcagtcaaggtgctgagctctatggaagaattttcaaacctcgaccgggacattgaaggcagtgccaagtcttggaaaaaatttgttgagtctgaatgtcctgagaaggaaaagttgcctcaagagtggaaaaataagacggctctacagaggttgtgcatgctcagagctatgcggcctgacagaatgacctatgccctcagagacttcgtcgaagagaagctcggtagtaagtacgtggtgggtagggccctcgacttcgccacatctttcgaggagtcaggccccgcaacacccatgtttttcatcttgagccccggggttgatccactcaaagacgtagaatcccaaggcagaaagctgggatatacttttaacaaccagaacttccacaacgtctcccttggacaggggcaggaagtcgtggcagaggcagctctcgatctggcggctaaaaaggggcattgggtgatcctccaggataccctggaaatgtgcagcagggaaaccgagttcaagagcatattgtttgcactctgttattttcatgctgtggtggctgagcggcggaaattcggcccccagggctggaacaggagctatcctttcaatactggcgatctgactatttctgtgaacgtcctttacaactttctggaggccaacgcgaaggtcccctacgatgacctgaggtacctgttcggcgagattatgtacggggggcatataacagatgattgggacaggaggctttgtcgcacgtatctgggtgagtttattaggcccgagatgctagaaggggaactgagcctggccccaggctttcctttgcccggtaatatggactacaacggttatcaccagtatatagacgcggaactgcctcctgagagtccatacctttacggactgcatccaaacgccgaaatcggtttcctgacacaaacctcggagaagctcttcaggactgtactcgaactgcagcctagagactcccaagcccgcgacggcgcaggggcaactcgggaggaaaaggtgaaggcacttcttgaggagattctcgaacgggtcaccgacgagtttaacatacccgaactaatggccaaagtcgaagagagaacgccatacatcgtagtggcgttccaagaatgcggcaggatgaacatattaacccgtgaaatccaacgttctttgcgggaactggagctcgggttaaaaggcgaacttacaatgacttcccatatggaaaacctgcagaatgccctgtatttcgacatggttcctgagtcctgggcacgccgcgcgtacccgagtaccgcaggactagccgcgtggtttcccgatctgctgaaccgaataaaggaattagaggcgtggactggggactttaccatgccatccaccgtctggctgacaggcttcttcaaccctcagtcctttctgacggccatcatgcagtcaacagccaggaagaatgagtggcccctggaccagatggcactgcagtgcgatatgacgaaaaaaaacagggaggagtttaggagcccaccgcgcgaaggggcttatatccatggactctttatggaaggagcttgctgggacacccaagccggaatcataaccgaggcaaagctgaaagaccttaccccccctatgcccgttatgttcatcaaagcgatccccgccgacaaacaggactgtaggagtgtgtatagctgcccagtttacaagacgtcacagcgtgggcccacatacgtctggacatttaatctaaagaccaaggagaatccaagcaaatgggtattagccggggtcgctctgctcctgcagatttag

SEQ ID NO: 115258 - DNA, 2100 bp, Artificial Sequence
  Description of Artificial Sequence: Synthetic coding sequence
atgatccctgcaagcgccaaggctccccataaacaaccccacaagcaaagcattagcattggccgtgggacgagaaaacgtgatgaagactctggtacagaggtcggagaaggcacagacgagtgggcacagagtaaggctaccgtccgacccccagaccagctggaactgacagatgccgagctgaaggaggaattcaccagaattcttactgcgaacaaccctcacgctcctcagaatattgtgaggtacagctttaaagagggcacatacaagcctatcggcttcgttaatcaactggcagttcactacacccaagtcggcaaccttattcccaaggattctgatgagggaagacggcaacattatagagatgaactggtagcggggagtcaggaaagtgtaaaggtcattagcgagaccgggaacctggaggaagatgaagagcccaaggagctcgaaaccgaaccaggttcacagacagacgtgcctgccgctggcgctgccgaaaaagtgacagaagaggagcttatgactccaaagcagcccaaggagcgcaagttgaccaaccagttcaatttctccgagcgtgctagtcaaacctataataatccagttcgcgacagggagtgtcagaccgaacccccgcccaggactaacttttcggccaccgcaaaccaatgggagatctacgacgcatacgtggaggagctcgagaagcaggagaagaccaaagaaaaagaaaaggcaaaaactcccgtcgcaaagaagagtggtaagatggccatgaggaagctgacatcaatggaatctcaaacggacgatctcattaagttaagccaggcggcaaagatcatggagcgaatggtcaaccaaaatacttacgacgacattgctcaggactttaaatactacgatgacgccgccgatgagtatcgggatcaggtggggactctcctgccgttgtggaagtttcaaaatgataaagcgaagcgcctgtcggttacggccctgtgctggaaccccaaatacagggacctatttgccgtgggttacggcagttatgatttcatgaaacagtccagaggaatgttgcttctgtattccctcaagaatccttccttccctgaatatatgttttctagcaacagcggggtgatgtgtctggacattcacgtggatcatccttacctggtcgcagtggggcactatgacgggaatgtggccatttacaacttgaagaagccccactcgcaaccatcattctgtagtagtgccaaatcaggcaagcatagtgaccccgtttggcaagtcaagtggcaaaaagatgacatggatcagaacctgaacttcttctctgtctcgtccgatggacgaattgtgtcctggacccttgtgaagcgtaaactggttcatatcgacgtgattaaactcaaggtggaggggtctaccactgaagtgcccgaggggctccagctgcatcccgtggggtgtggcacagccttcgactttcataaggagattgattacatgtttctggtgggtaccgaagaggggaaaatttataagtgctcaaagtcttattcaagtcaatttctggacacctatgatgctcataatatgtccgtggataccgtctcgtggaatccctaccatactaaggttttcatgagttgcagctctgattggaccgtgaagatctgggaccataccatcaagactcccatgttcatatatgatctcaattctgcagtaggcgacgtggcctgggcaccctacagctccaccgtcttcgctgctgttactaccgatgggaaggctcacattttcgaccttgccataaataagtacgaggccatttgcaaccagcccgtagcagccaagaagaatcgccttacacatgtgcagttcaacctgatccaccctattattattgtgggcgatgatagaggccacattatctccctgaaactgagcccaaaccttaggaagatgcctaaggagaagaaagggcaagaggtccagaagggaccggcagtggaaattgccaaactggacaagctgctgaacctggttagggaagttaagataaaaacctag

SEQ ID NO: 115259 - DNA, 585 bp, Artificial Sequence
  Description of Artificial Sequence: Synthetic coding sequence
atggaccaaaatctgaacttttttagcgtcagcagcgatggacgcattgtcagttggacacttgttaagcgtaaactggtacatattgacgtgatcaagctgaaagtggaaggctcaacgacagaagttcccgagggtctgcagctccaccctgtggggtgcggtaccgcgtttgatttccataaagaaattgattacatgtttttggttggtacagaagaaggtaagatatataagtgtagcaagagttatagttctcagtttctggatacctacgacgcccacaatatgagtgtcgacacggtctcctggaatccgtatcacacaaaggtgtttatgtcttgtagttctgactggaccgtcaaaatttgggatcacaccattaaaactcctatgttcatatacgacctgaacagtgctgttggcgacgtggcctgggctccttacagctccaccgtttttgcggccgtgactacggacggaaaagagaaaaaagggcaggaggtgcaaaaggggccagccgtggaaatcgcgaagttagacaaactgttaaatctcgtgcgcgaagtgaaaattaaaacatag

SEQ ID NO: 115260 - DNA, 870 bp, Artificial Sequence
  Description of Artificial Sequence: Synthetic coding sequence
atgatccccgcgagcgccaaggcccctcataagcagcctcacaagcaggacgaggacagcggaacagaagttggggaaggaacagacgagtgggcgcagtcaaaggccactgtcaggccacctgatcaactcgagctgaccgacgctgagcttaaagaagaattcacgagaattttgactgcgaacaatccacacgccccacagaacatcgtgcgttactcttttaaagaagggacatataagcctattgggttcgtaaaccagctggccgtacactatacccaggttgggaacctgatccccaaagacagcgatgaaggaagacgacaacattacagggatgagctggttgctggcagtcaggagtcagtcaaggtcatcagtgaaacgggtaatctggaggaggatgaagagccgaaagagctggagactgaaccggggagccagactgatgtcccggccgccggtgccgctgaaaaagtcacagaggaggagcttatgacccctaagcaaccaaaggaaaggaaacttaccaaccagtttaacttctctgagcgtgcctcccagacttacaataacccagtcagggaccgggagtgtcaaacagaacctccaccaaggactaacttttcagccacagctaaccaatgggaaatctacgacgcatacgtggaagaactcgagaaacaggagaaaactaaagaaaaagaaaaggctaagacccccgtcgctaaaaagagcggcaaaatggccatgcgcaaactcactagtatggaaagtcagaccgacgacttgatcaaactgtcacaggccgccaaaatcatggaacgaatggtcaaccagaatacttacgacgacatcgcacagtag

SEQ ID NO: 115261 - DNA, 870 bp, Artificial Sequence
  Description of Artificial Sequence: Synthetic coding sequence
atgattccagcaagtgctaaagcacctcacaagcagccccacaaacaagacgaggactccggcactgaggtgggtgaagggacagatgaatgggctcagagcaaagcaaccgtgcgcccccccgaccagcttgagttgacggatgccgagctgaaagaggagtttacgagaatcctcactgccaacaacccacacgccccccagaatatagtacgctacagtttcaaagaggggacatacaaaccgattggctttgtcaatcaactggccgttcactatacccaagtcggaaaccttatcccaaaagatagtgacgaaggccgtcgtcagcattaccgagacgagctcgtggctggttcccaggagagtgtaaaagtcatttcagagaccggcaacctcgaggaagatgaggagcctaaagaactcgagaccgaacctgggtcccagacagatgtacctgcagctggtgccgcagagaaggtaactgaagaggagctgatgacccccaagcagcctaaggaacgtaaactaactaaccagtttaatttcagtgaacgggctagccaaacatataacaaccccgtgagagatagggagtgtcagaccgagcctccccccaggaccaatttttctgctactgcgaatcagtgggaaatttacgacgcatatgtcgaagaactagaaaagcaggaaaagacgaaggaaaaggagaaagcgaagacacccgtggctaagaaaagcggaaaaatggccatgcgcaaattgacctccatggagagtcagacagatgatctgatcaagctttctcaggcagcaaagattatggagagaatggtaaatcaaaacacttacgatgacatcgcgcagtag

SEQ ID NO: 115262 - DNA, 429 bp, Artificial Sequence
  Description of Artificial Sequence: Synthetic coding sequence
tgatgcggcaccgcttttgacttccacaaggagatcgattacatgttcttggtggggactgaagaaggtaagatttacaagtgctctaaatcctattccagtcagttcctggacacctacgacgctcacaatatgtcagtggacacagtaagttggaacccttaccatacaaaagtttttatgtcatgcagcagcgattggacagtgaagatctgggatcatacaattaagacacctatgtttatatatgatctaaactctgcggttggggacgttgcttgggctccctactcgagcacggtatttgcagcagtaacaactgatggcaaggaaaaaaaggggcaggaggtgcagaaagggcctgcagttgaaatagctaaactggacaaactgctaaacctcgtccgcgaagtgaagattaagacatag

SEQ ID NO: 115263 - DNA, 507 bp, Artificial Sequence
  Description of Artificial Sequence: Synthetic coding sequence
atgattcctgcgtctgccaaggctccacataagcagccgcataagcagtcaatttctataggccgtggcacaagaaagcgtgacgaggactctggcactgaagtgggagagggcaccgatgagtgggcacaaagcaaagccacagtgaggcctcccgaccagctagaactgacagatgctgagctcaaggaggagtttacccggatcctcaccgcgaataacccacacgcaccacagaacatagtgcggtatagctttaagaaacagtggtccctcggtttcatccctaaactaaagaggaaaattccagtaaattactggggccaggatgaaggcgagatctccaacgagactgttagagtaatctacagtcttggaatctttatcatgaagattgtgacaatccttctgaatatcaacattgaacatctgctctgcgtgagacactgtgtgaacaggctgtttctcctgtttctgatccttattataataatgcaaatcaggtag

SEQ ID NO: 115264 - DNA, 1209 bp, Artificial Sequence
  Description of Artificial Sequence: Synthetic coding sequence
atgcgtacaaccctcacaccctcctgtagcagcgctctcgatccacaggaaataaaacgggccgcaacccacctttcctggcaccccgacggaaaccggaagctcgccgttgcatattcatgcttggactttcagagagccccagttggcatgtcaagtgattcctacatctgggatttggaaaatccgaataaacccgaacttgcacttaaaccctcctctccattggtcacactcgaattcaatcccaaggactcacacgtcctcctgggggggtgctataatgggcagatcgcatgttgggatacacgaaaagggagcctcgtggccgagctctcaactattgaatctagccatcgagaccctgtctacgggaccatctggctgcagtccaaaacaggaacagaatgtttttctgcttcaacagacggacaagtaatgtggtgggacattcggaagatgagtgaaccaaccgaagttgtcatcctggacatcactaaaaaggaacagctagaaaacgctctgggcgcgatatcgcttgaattcgaaagtacactgccgactaagttcatggtgggcaccgagcagggaattgtgattagctgcaaccgcaaggctaagaccagcgccgaaaagatcgtctgtaccttccccggccaccatgggcccatctatgcacttcagcgcaatccattttacccaaagaacttccttacagttggagactggacagcccggatatggagcgaggatagccgagagagctccattatgtggaccaagtaccacatggcttacctgaccgacgctgcatggagccccgtgaggcccacggtatttttcacaaccaggatggacggcacccttgatatctgggacttcatgttcgagcaatgtgaccccaccctgtcactgaaagtatgtgacgaggcactgttctgtcttagagttcaagataacggatgtctgattgcctgcggttctcagctgggtacaacaaccctcctggaagtcagtcccggtctgtcaacgctccagaggaacgagaagaatgttgcctcatccatgttcgagagagaaacccgtcgagagaagattcttgaagcacgccatcgtgagatgaggctaaaggagaaagctgcaaccaaaagtcggagacgacctggcggtgggggtggtcggggaagcagcggcggacggcggggttag

SEQ ID NO: 115265 - DNA, 1818 bp, Artificial Sequence
  Description of Artificial Sequence: Synthetic coding sequence
atggagatcgtctacgtctacgtcaagaagaggagcgagttcggcaagcagtgcaatttctcagacagacaggcggagctcaacatcgatattatgcctaatcctgaactggcagagcaattcgtggaacggaacccagtggacactggcatccagtgctcgatctctatgagtgaacacgaggccaatagcgagcggttcgaaatggagacaagaggtgtgaatcacgttgagggcggttggcccaaagatgtgaaccccctcgagttggagcagacgatccggttcaggaagaaggttgagaaagatgaaaattatgtaaatgctataatgcagctcggcagtattatggaacattgcattaagcagaataatgccatcgacatttatgaggaatatttcaacgacgaggaggccatggaagtcatggaggaagatcccagtgctaagactatcaacgtgtttcgcgatccccaggagatcaagcgtgccgcaactcacctctcctggcatcccgacggtaaccgcaaactggccgtagcgtactcatgtctcgattttcagcgtgccccggtgggtatgagttccgacagctatatctgggacctcgaaaatccgaacaaaccggagctcgctctaaaacccagctcacccctcgtaaccctggaatttaaccctaaggatagccatgtgctgcttggtggatgttacaacgggcagatagcctgttgggataccagaaagggctcactggtcgctgaactgagtaccatagagtctagccatagagatcccgtatacgggacgatctggcttcagtcaaaaacaggtaccgaatgcttctcggcctcaaccgacggccaggtcatgtggtgggatattcggaagatgtctgaaccaacagaggttgtgatcctcgacatcaccaagaaggaacagctcgaaaacgcacttggagctatttccttggaatttgaatccaccctgcctaccaagttcatggtgggcaccgaacagggtattgttatcagttgtaaccgcaaagccaagaccagcgcggaaaagattgtttgtacctttccaggacatcacgggcccatttatgctctgcagcgcaaccccttctatcccaagaactttctgactgttggagactggactgctcggatctggagcgaggatagcagggagtcctccataatgtggaccaaatatcacatggcatacctgaccgatgctgcctggagcccagtccgccctaccgtcttcttcacaacccggatggacggcacactcgacatctgggacttcatgtttgaacagtgcgaccctacactgtcccttaaggtgtgtgatgaagccctgttttgtcttcgagtgcaggataacggttgcctaatcgcttgcggatcccagttaggcactaccactctgctggaagtgagtccagggttgtcaactctacagcggaacgaaaaaaatgtggccagctctatgtttgagagagagaccaggagagagaagatactggaagcccgccacagagagatgcgattgaaagagaagggtaaggccgaaggtcgggacgaggagcagactgatgaggagctagcagtcgacctggaagctctcgttagcaaagcagaggaagaatttttcgatatcatctttgctgaattgaaaaaaaaggaggccgacgccattaagttgacacccgtccctcaacagccctctcctgaggaagatcaggttgttgaagagggggaagaagctgctggggaagagggggatgaagaggtggaagaagatctggcctag

SEQ ID NO: 115266 - DNA, 1818 bp, Artificial Sequence
  Description of Artificial Sequence: Synthetic coding sequence
atggagatcgtgtatgtgtacgtcaaaaagcgttctgaatttggaaagcaatgcaactttagcgatcgacaagccgagctcaatatcgatatcatgcctaaccccgaactcgccgaacagttcgtcgagaggaaccccgtggacactggcatacagtgcagcatttcgatgtcagaacatgaagcaaatagcgagagatttgagatggagacacgcggggtgaaccacgtggaaggcgggtggccaaaggatgtcaaccccctagaactggagcaaacaatccgtttcaggaaaaaggtcgagaaggatgagaattatgtgaatgccattatgcagctgggaagtataatggagcattgtataaaacaaaataacgcaatcgacatatacgaggaatacttcaacgatgaagaggctatggaggtaatggaggaggatccttccgccaaaaccatcaacgtctttagggacccccaggaaataaagcgggctgccacccacctgtcatggcaccccgatgggaacagaaaactggcagttgcttactcatgcttggactttcagcgcgcccccgtgggcatgagctctgatagctatatctgggatctagaaaaccctaacaagcccgaactggctctcaaaccttcgagccctctcgtgactcttgagttcaatccgaaggacagccacgtcctgctggggggttgctataatggccagattgcctgttgggacactcggaaaggcagcctggtggccgaactgagtactatagagagcagccaccgggatcccgtctatggcaccatctggcttcaatcaaagactggtaccgagtgcttctccgcctccaccgatggccaggtcatgtggtgggacatcagaaagatgtccgagcctactgaggttgtgatcctagacatcaccaagaaagagcagctggagaatgcactgggggcaatctccctggagttcgagagcacactgcccactaaatttatggttggcactgaacagggaattgtcatttcatgcaataggaaagccaaaacaagtgccgagaaaatcgtctgcacattcccaggacatcacgggcctatttacgccctacaaaggaatccattttatcctaagaattttctaactgtcggcgattggactgctaggatatggagcgaagattcgcgtgaaagctccatcatgtggactaagtaccatatggcctatcttactgatgccgcatggtcgccagtgaggcctactgtgttcttcactactcgtatggatgggacgctggatatttgggatttcatgttcgagcaatgcgaccctaccctctccttaaaagtgtgtgacgaagccttgttctgcttgagggtccaggacaacgggtgtctgatcgcatgtgggagccaattggggacgaccaccctgctcgaagtctcacctggactctccactctgcagcggaacgaaaagaacgtcgcctcgtccatgtttgaacgcgagacccgccgggaaaagatcttggaagcccgccaccgcgaaatgcggctgaaagagaagggtaaagctgaaggtagggacgaagaacagactgatgaagaactggctgtcgacctggaagccctggtgtcaaaggctgaagaggaattttttgatattatttttgcagaactgaagaagaaggaagcagatgcaatcaaactgaccccggtgccccaacagccatctcccgaagaggaccaggtggtggaggaaggtgaggaagcagcaggggaggaaggagacgaggaggtcgaagaggatctcgcctag

SEQ ID NO: 115267 - DNA, 234 bp, Artificial Sequence
  Description of Artificial Sequence: Synthetic coding sequence
atgaaaaaactaaagatcttgtacatgagcaacaatctcgtcaaagattgggcggagtttgtaaagctcgcggaactgccttgtctagaagacctcgtgttcgtgggtaatccgttggaggagaagcattctgctgagaacaactggattgaagaagccaccaagcgcgtacccaagttgaagaaacttgacgggactcccgtcatcaaaggagacgaggaagaagacaactag

SEQ ID NO: 115268 - DNA, 456 bp, Artificial Sequence
  Description of Artificial Sequence: Synthetic coding sequence
atggatgccagcctatctatgctcgcgaactgtgagaagctgagcctcagtaccaattgcatagagaagattgcaaacttaaatgggttaaaaaatctccggatcctttctcttggccggaacaatattaagaatctgaatggactggaagccgtcggtgatacactcgaagaactgtggatctcttataactttatcgagaagctgaaaggtatccacattatgaagaagcttaaaatattgtacatgtccaacaatctggtgaaggattgggccgaatttgtgaaactcgctgagctaccgtgtttggaagatctggttttcgtggggaatccactcgaggagaaacactccgcagagaacaactggatcgaggaggcaacaaaaagggtcccaaagctcaagaagttggacggcactcctgtgatcaaaggcgatgaagaggaggacaactag

SEQ ID NO: 115269 - DNA, 573 bp, Artificial Sequence
  Description of Artificial Sequence: Synthetic coding sequence
atggccaaggccaccaccatcaaggaagccctggcccgatgggaagaaaaaactgggcagcggccaagtgaggctaaggaaatcaagctgtacgcacagatacccccaatagagaaaatggatgcttcgttgtccatgctggctaactgtgaaaaactgtcgctctccaccaactgcatcgaaaaaattgccaacctgaacgggctgaaaaacttgagaattctatccttgggtcgcaacaatatcaaaaacctgaatggtttggaagcagtgggcgatacattggaggagctctggattagttataattttatcgagaagctgaaagggattcatatcatgaagaaactgaaaattttgtacatgtctaacaacctggtgaaagactgggccgaattcgtaaagcttgccgagcttccctgcctcgaagatctagtgttcgtggggaatccactcgaagaaaagcatagcgccgaaaacaactggatagaggaggccacaaaaagggtccccaagctgaaaaagcttgacggcacccctgtgataaaaggcgacgaagaggaggacaattag

SEQ ID NO: 115270 - DNA, 174 bp, Artificial Sequence
  Description of Artificial Sequence: Synthetic coding sequence
atgaaaaaactgaaaattctttacatgtcaaacaacttggtgaaagattgggctgaattcgtcaagttggcagagctgccctgcctggaggacctggtcttcgtcggtaacccccttgaggagaaacactctgctgagaataactggatcgaagaggctacaaagcgggtgtag

SEQ ID NO: 115271 - DNA, 456 bp, Artificial Sequence
  Description of Artificial Sequence: Synthetic coding sequence
atggatgcctcactgtccatgctggcgaattgcgaaaaactcagtctgtctaccaattgtatcgagaaaattgcaaatctcaatgggctgaaaaatctgcggatcctttcactggggcgaaataacataaaaaacctgaacgggctggaggctgttggggataccctggaggagttatggatctcctacaacttcatagaaaagctgaaagggatacacatcatgaaaaagctcaagatactttacatgtctaacaacctggtcaaggactgggcggagttcgtcaagctggccgagctgccctgtctggaggatctggtgtttgtggggaatcctctcgaggagaagcatagcgccgaaaataactggattgaagaggctacaaaaagggttcccaagttgaaaaaacttgacggcaccccagtgatcaagggggatgaggaagaagataactag

SEQ ID NO: 115272 - DNA, 195 bp, Artificial Sequence
  Description of Artificial Sequence: Synthetic coding sequence
atgaagaagttaaagattctctacatgtccaacaatttagtgaaggactgggccgagttcgttaagctggctgaactcccttgcctggaggatctggtgtttgttgggaatccactggaggagaagcacagcgctgagaataattggatcgaagaggcaactaaaagggttcccaaattgaagaagctggactag

SEQ ID NO: 115273 - DNA, 159 bp, Artificial Sequence
  Description of Artificial Sequence: Synthetic coding sequence
atggatgcctctttatctatgctggccaattgtgagaaactgagtctgtcgacgaactgtatcgaaaagatagcaaacctgaacggattgaagaatcttagaatcttgtccttgggacgaaataacattaagaacctcaacggcttggaggccgtatag

SEQ ID NO: 115274 - DNA, 198 bp, Artificial Sequence
  Description of Artificial Sequence: Synthetic coding sequence
atgaagaaactgaaaattctgtatatgtccaacaatcttgtgaaggattgggccgaattcgtcaaacttgctgaattaccttgcctggaggatctggtgtttgtgggaaaccccctggaagagaaacacagcgctgaaaacaattggatcgaagaggctactaaacgggtgcctaaacttaagaaattagatggatag

SEQ ID NO: 115275 - DNA, 843 bp, Artificial Sequence
  Description of Artificial Sequence: Synthetic coding sequence
atggtcacagccaataaggcccacaccggccagggtagctgctgggttgctactttagcctcagcgatgatcccgccggctgacagcctcctgaagtatgacacacccgtgctggtctctcgcaatacagagaagcgctctcctaaggctcgcctgcttaaagttagtccacagcagcctggaccctctggatccgcgccccagccaccaaagacaaaactcccaagtactccatgtgtacccgaccccaccaaacaagctgaggagatcctcaatgctattctgccacctcgtgagtgggtcgaggacacacaactgtggatccaacaggtcagctctaccccttcaactcggatggatgtagttcacctgcaggagcagctggatctgaaattgcagcagaggcaagccagagagacaggaatttgtccagtccggagagagctttatagccaatgttttgatgaactcatccgcgaagtaacaatcaactgcgcagagagaggcctgctgctgctgcgagtgagggacgaaatccgaatgactatagccgcctatcagacactgtatgagtcttcagtggcattcggcatgcggaaggcactccaggcagagcagggcaaatctgacatggagagaaaaatagctgagctcgaaactgaaaaacgcgatcttgaacggcaggtaaatgagcagaaagccaagtgtgaggcgactgaaaaacgggaaagcgaaagaaggcaggtagaggagaagaaacacaatgaggaaatccagttcctcaagcgaacgaatcagcagctgaaagcccaactggaaggaataattgcaccgaaaaagtag

SEQ ID NO: 115276 - DNA, 399 bp, Artificial Sequence
  Description of Artificial Sequence: Synthetic coding sequence
atgccttactacccgcaggacgaacttattcgggaagtaactatcaactgcgcggaacgcgggttgttgctcctccgggtacgggacgaaatccgaatgacaatagccgcctatcagacactgtacgagtcgagcgtggcctttggaatgaggaaggctctgcaggcagagcaggggaagtcggacatggagagaaaaatcgctgagctggaaaccgagaagagggatcttgaacgccaggtcaatgaacagaaggccaagtgcgaggctaccgagaaacgggaatcagaacgaagacaggttgaggaaaagaagcataatgaagagatccagttcctgaaacgcactaatcagcagctcaaagctcaattggaggggattatcgccccgaagaaatag

SEQ ID NO: 115277 - DNA, 13941 bp, Artificial Sequence
  Description of Artificial Sequence: Synthetic coding sequence
atgagcgagcccggggggggcgggggcgaggatggctcagcaggtctcgaggtatcagcagtccaaaatgttgccgatgtctcagttctgcaaaagcatcttcgcaaactggtccccctcctgctggaggacggcggggaggctccggcagcccttgaagctgctttagaggagaaatcagcactcgaacaaatgcgtaagttcctgtctgatccacaagtgcacaccgtgcttgtggaaaggtcaacactcaaggaagatgtgggagacgagggggaggaggagaaagagtttatttcgtacaacatcaatattgatattcattatggagtaaaatccaatagcctcgctttcataaagcggacacctgtgatcgacgcggacaaaccggttagcagtcaactaagggtgctaaccctgtcagaagattctccctacgaaactctgcactctttcatttccaatgccgtcgcccccttttttaagagttacatcagagagtccggtaaagccgaccgagatggcgacaaaatggctccatccgtggagaagaagatcgctgagctggagatggggctgctgcacctgcaacagaatatcgagataccggagattagccttcctatccacccgatgattacgaatgtcgctaaacagtgttacgaacgcggagagaaacccaaggttacagactttggcgacaaagtagaggacccaaccttcttgaaccagcttcagagcggggtgaaccgctggatcagggaaatacaaaaggtgactaagctcgaccgcgaccctgccagtggaaccgccttacaagaaatatccttttggctgaatcttgagcgtgccctctataggattcaggagaagagggagtcgccagaggtgttgctgacactcgacattctgaagcatggcaagagattccacgcgaccgtaagtttcgacactgacaccggcttgaagcaggctctggagacagtgaatgattacaaccccctgatgaaggatttccctctgaacgatctgctgtccgccaccgagcttgataagattcggcaggcgttagttgccatcttcacacacttgcgtaaaatccgtaataccaaataccctatccaacgcgctttgagattggtcgaggctatcagccgggacctgtcatcccagctccttaaagtcctgggaacaagaaaattgatgcatgttgcatacgaggagtttgaaaaagttatggtagcctgttttgaagtgtttcagacctgggatgacgagtacgagaagctgcaggttctgctgagagacattgttaaacggaagagagaggaaaatctgaaaatggtgtggcgaatcaatccagcacacaggaaacttcaggcccggctcgaccagatgagaaagttcaggcgacaacacgagcagctgcgggccgttattgttcgtgtgctccggccgcaggtgactgctgtggcacagcagaatcaaggcgaggtgcctgaaccccaagatatgaaagtggccgaggtgttgtttgacgctgccgatgccaatgctattgaagaagttaacttggcgtatgaaaatgtaaaggaggttgacggtctggatgtctctaaggaaggtacggaggcctgggaagccgccatgaagaggtatgacgaaagaattgaccgtgtagagactcgcatcaccgccaggctgagagatcagttgggcaccgccaagaatgcaaatgaaatgtttagaatattctctcgctttaacgcactgttcgtacgcccccacatcaggggcgccatccgcgagtatcagacccagttaatccaaagagtaaaagacgacatcgagtctctacatgacaaattcaaggttcagtacccacagagccaggcctgcaaaatgagtcatgtcagagatcttccccccgtgagcggaagtattatttgggctaaacagattgataggcagttgactgcctatatgaagcgagttgaagatgtactaggcaagggctgggagaaccacgtcgaggggcagaagctgaaacaagatggtgacagcttccgtatgaaactgaatacccaggaaatttttgacgactgggctagaaaagtgcagcagagaaacttaggcgtgtcagggcgaatcttcaccatagagagcacacgtgttcgcggccggactggcaatgtgctcaagttgaaggtcaattttctgcctgaaataatcacgttgtccaaggaggttagaaatttaaaatggctgggcttcagagtccctctggcaatagtgaacaaggcacaccaggccaaccagttgtatccgttcgcaatttcgctgatagaatctgtcagaacatatgagcgaacgtgcgagaaggttgaagaacggaataccatttccctgctggtcgccggtttgaaaaaagaagtccaggccttgatcgctgaggggatcgcccttgtgtgggagagttacaagttggacccatacgtgcagagactggcagagacggttttcaattttcaagagaaggtggacgatctgctcatcatcgaggaaaagattgacctggaggttaggagtctggaaacttgcatgtatgaccacaaaacattctccgagattctgaaccgtgtccagaaagcagtggacgacctgaatcttcactcttacagtaacctccccatctgggttaacaaactcgacatggaaatcgaaagaattctgggagtacgcttacaagccggactgagagcctggactcaggtcctgctcgggcaggctgaggacaaagcagaagtcgatatggatacggacgccccacaggtgagtcataaacctggcggtgagcctaaaatcaaaaacgttgttcacgagcttcgaattacgaaccaggtgatctacctcaaccctccgatcgaggaatgtaggtataaactctatcaggaaatgttcgcctggaaaatggtggtgctgtctctaccccggatccagagccagcgctatcaagtgggcgttcactacgaactgaccgaggaagaaaaattttaccggaatgccctgacccgcatgcccgacggtcccgtggcgcttgaggaatcttacagcgccgtgatggggattgtgtctgaggttgaacagtacgtgaaagtttggctccagtaccagtgcctctgggacatgcaggccgagaatatttacaatcggctgggcgaggacctgaacaaatggcaggcgttgctcgtgcagattcgaaaagctaggggcaccttcgataacgcggagaccaaaaaggagttcggccccgttgtgatagattacgggaaggtgcagagcaaagtcaacctaaagtacgacagctggcataaggaagtcctgtccaagtttggtcagatgctgggatcaaacatgaccgagtttcacagtcagatctccaagtccaggcaagagttggagcagcactccgtggacaccgccagtaccagtgacgctgtcacattcatcacgtacgtacaatccctcaagaggaagatcaagcagtttgagaaacaggtggaactgtatcgaaatggacaacgcctactggagaagcagcggtttcaattccccccgtcatggctctacatcgataatattgagggcgaatggggtgcctttaacgatatcatgagacggaaggacagcgccattcagcagcaagtcgccaacctgcagatgaaaatcgtccaggaagacagggcagtagagagcaggacaaccgatttactgactgattgggagaagaccaaacccgtgactggcaacctgcgccctgaggaggctctccaagccctgactatatatgaggggaagttcggtcggttgaaggatgacagggaaaagtgcgccaaggcaaaggaagctctcgagctgacagacacaggcctcttgtctggcagcgaagaacgagtccaagtggcccttgaggaattgcaggatctcaaaggggtgtggtctgagctgtctaaggtgtgggaacaaattgatcagatgaaggagcagccatgggtgtccgtgcaacctcgaaagctgagacagaaccttgacgctctgctgaatcagctcaaaagctttcctgcacgccttcgccagtatgcttcatatgagtttgtccagcggctgttgaaaggctacatgaaaatcaatatgttagtgattgagttgaagagcgaggcgctaaaggaccgacactggaaacaactgatgaaacgcctgcatgtaaattgggtggttagcgagttaactttgggtcaaatttgggacgtagacctgcaaaaaaatgaggctatagtcaaggacgtcttactggtggcccagggcgaaatggcactcgaagagttcctgaaacagataagggaggtgtggaatacttatgagcttgatctggttaactaccagaacaagtgtcgtttgatcagaggctgggacgatctgtttaataaggttaaggagcacatcaattcagttagtgcaatgaagctgagcccgtattacaaagtgttcgaagaggacgcattgagttgggaagacaagctgaaccgcatcatggcactgttcgacgtctggattgatgtgcagagacgctgggtgtacctggaggggatatttacggggtccgccgacatcaaacatctgcttcccgtggaaacacagcgcttccagtccatttccaccgagttcctagcccttatgaaaaaggtgagtaagagtccactggtgatggacgtgctcaatattcagggggtccagcgttccttggagcgcctggctgatcttctcggaaagattcagaaggcccttggcgagtacttggagagagaaagatcctcctttcctcgtttttactttgtcggagacgaagatcttttggagatcattggcaattccaaaaacgtggccaagctgcaaaagcatttcaaaaaaatgtttgcaggagttagcagtattattctaaatgaagataattccgtggtcctggggatttcaagccgagaaggggaagaagtgatgtttaaaacccccgtgtctatcactgagcatcccaaaattaatgagtggctgaccctggttgaaaaagaaatgagggtgacactggcgaagctgctcgcggagagcgtgactgaagtggagatcttcggaaaggccactagtattgatccgaatacctatataacctggatcgataagtatcaggcccaattagtagtgctctctgcgcagatcgcctggagcgaaaacgtggagacagcccttagctccatggggggaggcggagacgccgcccctctacattctgtgctatcaaacgtcgaagtgacgctcaacgttttggctgatagcgtgctgatggaacagccacctctgcggcggcgaaaactggaacatctgattacagaactagtgcaccagcgggacgtaacgcgctctctaatcaaatcaaagattgataatgccaaaagctttgagtggctatctcagatgcgattctactttgatccgaagcagactgatgtgttacaacaattgagtatccagatggcaaatgctaaattcaactatggtttcgagtacttgggagtgcaggacaagctcgtacagacccctctgaccgacagatgctatctaaccatgacacaagcactggaggctaggctggggggttccccattcggcccagccggcaccggtaagacggaaagcgtaaaagccctggggcaccaactggggaggtttgttttagtctttaactgtgacgagacatttgatttccaggcaatgggacgaattttcgtcggcctctgccaggtgggagcgtggggctgttttgacgagttcaaccgtttggaggaacggatgctctctgccgtgtcacagcaggtacagtgtatccaggaggctcttcgggaacacagcaatcccaattacgacaaaacctccgccccgatcacctgcgaactgttgaacaaacaggtaaaggtgtctcccgatatggccatatttattacgatgaatcctggatatgccggcaggagtaacctgccagataatttaaagaagctgtttagatccttggccatgactaagcctgaccgccagctgatcgcccaggttatgctttattctcaggggttcagaacggccgaagtcctggctaacaagatcgtccctttctttaagctgtgtgatgagcagctttcctcacagtctcactacgacttcggactaagagcactgaaatctgtgcttgtgagtgccgggaacgtcaaacgtgaaaggatacagaagattaaaagagaaaaagaagaacggggggaggcagtggatgaaggagaaatcgctgaaaaccttccagaacaggagatcctgatccagtccgtgtgtgagacaatggtgcccaagctggtcgctgaagacatcccgcttcttttttcgctgctgagcgacgtgttcccgggggtgcagtaccaccgcggtgagatgaccgccctgagagaagagctaaaaaaagtgtgtcaggagatgtacctcacgtacggtgacggtgaggaggtcgggggcatgtgggtcgagaaggtccttcagttataccagatcacgcagattaaccacgggctgatgatggtcggtccctccggcagcgggaagtctatggcgtggagggtcttgctgaaggctctcgagaggctggagggcgttgagggcgtggcccatatcatcgacccgaaagccatcagcaaggaccatctgtacggaaccctggatccaaatacaagagagtggacagatggtctatttacccacgttcttcgcaaaataatagactctgtgcggggggaactccagaaacgccagtggattgtgtttgatggagatgttgacccagaatgggttgagaacctgaattccgtcctagacgacaataaattactgacactccctaacggagagcggttgagcctgccccctaatgttcggattatgtttgaagtgcaagatctgaaatatgctacactggcaaccgtgagtcggtgtggaatggtgtggttcagtgaagatgttctcagtactgatatgatctttaacaacttcctcgcgcgacttagaagcataccccttgacgagggcgaggacgaggcccagagaagacgtaaaggtaaggaagacgagggagaggaggcagccagcccgatgttgcagattcagcgggatgccgcaaccatcatgcagccatacttcacttcaaatggtctcgtcacaaaggctctagaacatgctttccagctggaacacatcatggatctcacccgcttgcggtgtttaggaagtctgttctctatgctacatcaagcctgccgcaatgttgcacagtacaatgcgaatcatcctgatttccctatgcaaatagagcagctcgagagatacattcagaggtacctcgtgtacgctattctctggtcactctccggagattctcggttaaagatgagggccgagctcggcgagtatatcagacggattactacggtcccactgcctaccgctcccaacatcccaatcatcgattatgaggttagcatttcaggggagtggtctccgtggcaagccaaggtgccccaaattgaggtggaaacacacaaggtggctgctccggatgtggttgtgcctaccctcgacactgtgaggcatgaggccttactgtatacttggttggcggaacacaagcccctggtgctctgcggacctccaggttcagggaagaccatgacattgttctctgctctaagagccttaccggatatggaggtggtgggactgaacttttctagtgccaccacaccagagctcctgttgaagacatttgatcattattgcgaataccggaggacacccaatggggtggtgctagccccagtccaattaggaaagtggcttgttctgttttgcgacgaaatcaacctgccggatatggacaaatacgggacccagagagttattagcttcatccgtcagatggttgaacacggcggattctacagaacaagcgaccaaacatgggtcaaactggaaagaatccaatttgtgggtgcttgtaaccctccgacggatccagggaggaagccactgtcccaccggtttttacggcatgtgcccgttgtgtacgttgactatcccggacccgctagtctcactcagatatacggaacatttaaccgggcgatgctccgcctcattccttccctgcggacctacgccgagcctctgactgcagctatggtggagttttatacaatgagccaggagcggtttacccaggacactcagccacactatatctactctcccagagagatgacaagatgggtgcggggcatctttgaggctcttagaccacttgagaccctgccagtggagggcctcatacgaatctgggcccatgaggccctccggctatttcaagataggctagtggaagacgaagaacgacggtggacggatgaaaatatcgacacagttgccctgaagcatttccctaatatagatcgcgaaaaggcaatgtcacgacccattctttattccaattggctttccaaggattacatacccgtagaccaggaagagctaagggactacgtgaaggcgcgcctaaaggtgttctatgaagaagagctggatgtgcctttggtgctgttcaacgaagttctggaccatgtgttgcgcatagaccggatctttagacagcctcaaggacacctgctcctcattggggtttctggggctggcaagaccactctttcaagattcgtggcatggatgaatgggttgtccgtataccagattaaggtgcaccgaaagtacactggcgaggattttgatgaggacctcaggacagtgctgagacgaagtggatgtaaaaatgagaaaatcgcattcatcatggacgaatctaacgtccttgactccgggtttctggagagaatgaacacgctgctggctaacggcgaggttcctggactgtttgagggggacgagtacgctactctgatgacccagtgtaaggaaggagcccagaaagaagggctgatgttggactctcacgaagagctgtacaagtggtttaccagccaggtgatcagaaacctgcacgtggtctttaccatgaacccctcctcagaaggcctgaaagatcgtgcagctactagtccggccctgtttaatagatgtgtgcttaattggttcggagattggtccacagaggccttgtatcaggtcgggaaggagtttaccagcaagatggatctggaaaagccgaattatatagtgccagattacatgcccgtggtgtacgataaactgccacaacctccctcacatcgcgaagccatcgtcaatagctgcgtgttcgttcaccagacactgcatcaggcaaacgcacggctggccaagcgaggcggtcgcactatggcaatcacaccccgtcattatctcgatttcattaatcattacgccaacttgttccatgaaaagagatctgaattggaggagcagcagatgcatttgaatgtgggccttagaaaaatcaaggaaaccgtagatcaggtggaagagcttaggagggatctgcgaattaaatctcaggaactcgaggtcaagaatgctgctgcgaatgataaactgaaaaagatggttaaggaccagcaggaggccgaaaagaagaaagtcatgtctcaggaaattcaggagcaattacacaagcagcaggaagtgatcgccgataaacagatgtctgtaaaggaggaccttgacaaagttgaaccagctgtgatcgaagcccagaacgcagtgaagagtattaaaaaacagcacttggtggaagtacgtagtatggcgaacccacctgccgctgttaagctcgcactagaatctatctgcttgctgctaggagagtctactaccgattggaagcagatacggtccatcatcatgagggagaacttcatccctaccatcgtgaatttctccgctgaagaaatttccgatgccattagagaaaaaatgaaaaaaaattacatgtctaacccaagctacaattatgagatagtcaatagagctagtctggcatgcggcccgatggttaaatgggcaatcgcccagttaaattatgcggacatgttgaagagggtggagcccctgcgaaatgaacttcagaagctcgaagatgacgctaaagataaccagcagaaagcaaatgaagtcgaacaaatgattcgggatcttgaggcatccatcgctagatataaagaggagtacgctgtgctgatctcagaggctcaggccattaaggctgacctcgcggccgtagaagccaaagttaatcgcagcactgctctgctgaagtctctgtccgccgaacgcgagagatgggaaaagacttccgagacttttaagaaccaaatgagcactattgctggcgattgccttctctccgccgcctttatagcctatgccgggtactttgaccagcagatgagacagaacttatttactacctggtcgcaccatctgcagcaggctaacatccagtttcgcaccgacatcgcccggaccgaatatctctctaatgctgatgagcgactccgatggcaggccagcagtttacccgctgacgatctgtgcacggaaaatgcaatcatgctgaagcggttcaatcggtatccgctgattattgacccttctggacaagcgacagagtttattatgaatgagtacaaagaccgcaagatcacacgcacatcgttcctggatgatgcttttcggaagaatctcgagagcgctctcagatttggcaacccactgctggtacaggatgtggagtcttacgacccagttctgaaccccgtgctcaatcgcgaagtgcggcggacaggtggtagagtcttgattaccttgggagaccaggacatcgacctcagtcccagcttcgtgatctttttgagcacacgcgaccctacagtcgaattccctcccgacctgtgctctcgggtgacttttgtgaatttcaccgtcacccggagttcgttacagagtcagtgcttaaatgaagtcctaaaggccgagcgccccgatgtggacgagaagagatctgatcttctgaagctgcaaggggaatttcagcttcgactgagacaactggaaaagagccttctgcaggccctcaatgaggtaaagggaaggatattagacgatgatactataataaccactttagagaacctgaaaagagaagctgcggaggttacgcgcaaagtcgaggaaaccgacatcgttatgcaggaagtagaaacagtaagtcagcagtaccttccgctctcgactgcctgtagttccatctactttactatggagtccctgaaacagatacatttcctctatcagtattccttgcagttcttcttagacatctatcataatgtgctctacgagaatcctaatctcaaaggagtgacagaccatacacaacgtctctcaatcattaccaaagacctcttccaggtcgcatttaatcgggtggcaaggggcatgctgcaccaggatcacatcacgttcgccatgctgcttgcccggatcaagctaaaaggcacagtcggggagcccacgtacgacgcagagtttcaacacttcctgagagggaacgagatcgtattgtcagctggttctacgcctcgcatccagggtctgacggtggagcaggctgaggccgtagtgcggctaagctgtctccccgccttcaaggacctcatagcaaaagtacaggcggacgaacagttcggcatctggttagatagctccagcccggaacagactgtgccttacttatggtccgaagaaacacccgccacacccataggacaggcaattcatcggctgctcctgattcaagcatttcggccagatcgcctgctggccatggcacacatgttcgtgtctaccaatctcggcgaatcctttatgagtattatggagcagcccctcgacctaacacatatagtcggaaccgaagttaagcccaacacccccgtgctgatgtgtagcgtgcctggatacgatgccagcggacatgtggaggatttagcggctgagcagaacacccaaattacctctatcgctatcggatcagcagaggggtttaaccaagcagacaaggctatcaacactgccgtgaaaagcggacggtgggtaatgttaaagaatgtccaccttgcgcctgggtggttgatgcagctggagaagaagctacatagtctccagccgcatgcctgtttccgcctcttcctgactatggaaatcaaccccaaagtccctgtgaacctgctccgtgcgggccgaatttttgtcttcgagcctcctccaggcgtaaaggcaaatatgctgagaactttctcaagtatcccggtgagccggatatgtaagtcacctaatgaacgtgcccgactgtactttttgctcgcctggttccatgctatcattcaggaaaggctcaggtacgccccactcggatggtcaaagaagtacgaatttggcgaaagtgacctccgcagcgcatgcgacactgtagatacatggttggatgataccgcaaagggaaggcagaatatctcaccagacaaaatcccctggtcagccttgaaaactctgatggcccagagcatctacggcggccgagtcgataatgagtttgatcagcggctgctgaacacgttcctcgaacgcttgtttaccactcgatcctttgatagcgagttcaaactcgcgtgcaaggtggatggacacaaggatatccagatgcccgacggcatcagaagggaggagttcgtgcagtgggtcgagctgcttcctgatacccagacaccaagctggctagggctgcctaataacgccgaacgggttctgctgacaacccagggcgttgacatgattagcaagatgctcaaaatgcaaatgctcgaagacgaagatgatctggcctatgcagagactgaaaaaaagacaaggactgactcgacaagcgatgggcgtccggcctggatgaggaccctgcatactacagctagcaattggttacacctgatccctcagaccctgtcacatcttaaacggacagtggaaaacattaaggatccactcttcagattttttgaacgggaagtgaagatgggggctaaattgctccaagacgtcaggcaggaccttgccgacgtggttcaggtatgtgagggcaaaaaaaaacagactaactacctgaggacactgatcaacgagctcgttaagggcatcctccctcgtagctggagtcactatacagtgccagcaggtatgacagtaattcagtgggtatcagatttcagcgaacggattaaacagctccagaacatcagtctggctgccgcctcgggaggcgcaaaagagctgaaaaatattcatgtctgcttgggcggcctttttgtgcctgaggcctacataactgcaaccaggcagtatgtcgcccaggccaattcgtggagtctcgaagaactgtgcttggaggtgaacgtgaccacttcacagggcgccacactggatgcttgttctttcggggtgacgggtctgaaattgcagggtgcaacatgcaacaataataagctctctttatctaatgcaattagcacagccctgcctctcacccagctccgatgggtcaaacagactaacacagaaaaaaaggcttcagtcgtgacgctcccggtatatttgaatttcacacgcgctgacctcatattcacagttgattttgaaattgccaccaaggaggaccccagaagtttttatgagcggggcgtggcggtgctatgcacagagtag

SEQ ID NO: 115278 - DNA, 1899 bp, Artificial Sequence
  Description of Artificial Sequence: Synthetic coding sequence
atgtcggataagagcgagctcaaggctgagctggagcgcaagaagcaacgcctggcacagatcagagaggagaagaaaagaaaagaagaagagcggaagaagaaggagaccgaccagaagaaggaggctgtggccccagtgcaggaggagtctgatctggaaaagaaacggcgcgaggcagaagccctgctgcaatccatggggttgacacccgagtcccccattgtgcctccacccatgagccctagctctaaatccgtgagcactccgtctgaggcggggtcacaggactcaggagacggggctgtaggtagtaggacccttcactgggataccgaccctagcgtcctacagttgcactcagattccgatcttggacgaggaccgattaaactggggatggcaaaaattacccaggtggactttccacctagggagatcgtcacgtatacaaaggagactcagacaccagtgatggctcaacccaaagaagacgaggaggaagacgatgacgtggttgcacccaaaccacccattgaacccgaagaagaaaaaaccttaaaaaaagatgaagagaatgatagcaaggcccctccccatgaactgactgaggaggagaagcagcagattcttcattccgaggagttcctatccttctttgaccacagtacccgcatcgtggaaagagccttgtccgagcagattaatattttcttcgattacagtggccgtgaccttgaggataaagagggcgaaatccaggcaggggctaagttaagtctgaaccggcagttttttgacgaaagatggtcaaaacacagggttgtatcttgcctggactggtcctctcaatatcccgaactcctggtcgcgtcatacaataacaatgaggacgcaccccatgagccagatggagtagccctggtctggaacatgaaatacaagaaaaccacacctgagtatgtgttccattgtcagagcgcagtaatgtcggccacgtttgctaaattccatccgaatttggtggtaggaggcacctacagcgggcagattgtcttatgggacaaccgctctaacaaaagaaccccagtgcagaggacccctctgagcgccgccgctcatacacacccagtctattgcgtgaacgtagtagggacacagaatgctcataacctcatctcaattagtaccgacggaaagatttgctcctggtccttagacatgttatcccacccacaagactccatggagctggtgcacaaacaaagtaaggctgtggccgtaacgtcaatgtctttccccgtgggcgatgtgaataattttgtggtagggtcagaggagggcagcgtttatactgcttgtagacacggctcgaaagcggggatttccgaaatgttcgagggccatcagggtcccattaccggcatacactgtcatgctgcagtgggcgcggtggacttctcccacctgtttgtgaccagctcttttgattggactgtaaaactgtggaccacgaaaaacaacaaacccctgtactcctttgaggacaacgcggattacgtttatgatgtgatgtggagccccacccacccagccctgttcgcatgcgtggatgggatgggccggttggatctctggaatctgaacaacgatactgaagtgcctaccgcttctatttctgttgaggggaacccagctctgaaccgcgtccggtggacacacagtggaagggaaatcgccgtaggtgactcagaaggacagatcgtgatctatgacgtgggggagcaaatcgcagtgcccagaaacgacgagtgggctaggtttggaaggacccttgctgagattaatgcgaaccgggctgacgctgaagaggaagccgccacccgaatccccgcgtag

SEQ ID NO: 115279 - DNA, 1839 bp, Artificial Sequence
  Description of Artificial Sequence: Synthetic coding sequence
atgagcgataagtccgaactcaaggccgagttggaacggaaaaaacagagactagctcagatcagagaggaaaagaaaaggaaggaggaggagcggaagaagaaggagactgaccagaaaaaggaagcagtggctcctgtgcaggaggaatcagatctggagaagaaacggcgtgaagctgaggcccttctccaatccatgggtctaactcctgagtcaccaattgttcctccgcccatgtctccgagctccaagagcgtctctacaccctccgaggctggcagtcaggactccggcgatggagccgttgggtccagaagaggacccataaagctcggcatggcgaagattactcaggtcgattttccaccaagagagatcgtgacctacacaaaagagactcaaacccccgtgatggctcagccaaaggaggatgaggaggaagatgacgatgtggtcgccccaaaacctcctatcgaacctgaggaagagaagacccttaaaaaggacgaagagaacgattctaaggcaccccctcatgagctaaccgaagaagagaagcaacagatactgcactcggaagagtttctgagtttttttgatcactctacacgtatcgtagagcgagccctcagcgagcagataaacattttctttgattattccggccgggacctggaagacaaagagggcgaaattcaagctggggccaagttgtccttgaacagacagttttttgacgaacggtggtcaaaacaccgcgttgtgtcatgtctcgactggtcctcccaataccctgaactgttggtggcaagttataataacaatgaagacgcacctcacgagcctgacggagttgccctcgtgtggaacatgaaatataaaaagacaacacccgaatatgtttttcattgccagagcgcagtgatgtccgccacattcgcaaagtttcaccctaatctggtcgtgggaggtacgtattctggtcagatcgtgctgtgggacaacaggagcaataagaggactccggtccagcggacccccctatctgccgctgctcatacccacccagtatattgtgtgaatgtggtgggcacccagaacgcacataacttgatttccatctcgaccgacggaaagatttgttcctggtccctcgacatgttgtcccatccacaggactcaatggagctcgtacacaaacaaagcaaagccgtggccgtgacatcgatgtcttttccggtaggcgacgtcaacaactttgtggtgggctccgaagaaggctccgtttatactgcatgccggcacggtagcaaagccggcattagtgaaatgttcgagggtcaccagggtcctatcacgggtatacactgccacgccgccgtgggagctgttgatttctctcacttattcgtgactagtagcttcgactggaccgtcaagctctggacgaccaagaataataagccactgtattctttcgaggacaacgcggattatgtttacgacgtgatgtggtcgcctactcatcccgccttgtttgcctgcgttgacggaatgggcaggctggatctgtggaacctcaacaacgataccgaagtgcctaccgcctccatatccgtcgaagggaatccagccttaaatcgcgtgagatggacccacagcggccgcgagatcgcagtcggggattcagagggtcaaatcgtcatctatgatgtcggggaacagatcgccgttccgagaaacgacgaatgggcccgcttcggccggactttggctgaaataaacgcaaatcgagctgacgccgaggaggaagctgcaacccggattcctgcttag

SEQ ID NO: 115280 - DNA, 1893 bp, Artificial Sequence
  Description of Artificial Sequence: Synthetic coding sequence
atgtctgataagagcgagctcaaagccgagctggagcgtaagaagcagagactcgcccagatccgtgaggagaagaagcgaaaggaggaggaacggaagaagaaggagaccgaccagaagaaagaagctgtcgccccagtacaagaggagtcggaccttgaaaagaagagacgtgaggccgaggcactgctgcagagcatggggctgaccccagaatcccccattgccgagcagcctctgcgagtggtcacagccgatacctgcttatttcactatctggtcccaccaccaatgtccccatcttccaaatcagtgagtacaccgtccgaggctggctcacaggattcgggggacggagcagtcgggtctagacggggaccaatcaagctgggcatggccaaaattacccaggtcgacttcccacccagggagatcgtaacgtacactaaagaaacgcagactcccgtgatggctcagcccaaagaggatgaggaggaggatgacgatgtggtcgccccaaaacctcccatcgaacccgaggaggaaaagaccttgaaaaaagatgaagaaaatgattcaaaggccccccctcacgagctaacggaagaggaaaaacagcaaatcctccactcggaggagttcctatcatttttcgatcatagtacccgaatagtggagagagcactgtcagaacagataaacatcttctttgattacagtggccgagaccttgaggacaaggagggcgagatccaggccggagctaaactgagtcttaaccgccaattctttgacgagcggtggtctaaacaccgcgttgtctcttgccttgactggtcgtctcagtatcctgaactcctagtagccagctataataataacgaggatgccccccacgaaccagatggagtggcgctggtgtggaacatgaaatataagaagaccactcctgaatacgtcttccactgtcaatctgctgttatgtccgcgaccttcgcaaaattccaccctaatctggtggttggcggcacctactccggccagatcgtattgtgggataaccggtccaacaaaagaactcctgtgcagaggaccccccttagcgctgccgctcacacgcatccagtgtattgcgtgaatgtggtagggactcagaacgctcacaatctaatttcgatctcaacagacggcaaaatctgttcctggagtttagacatgttgtcccacccccaggacagtatggaactggttcataagcaatctaaagccgtggccgtcacttctatgagcttccccgtgggagacgtgaacaattttgtggtgggttcagaggagggctcagtttatacagcttgcagacatgggagcaaggctgggataagcgagatgttcgagggacatcaggggcccatcaccgggatccactgtcacgcagctgtgggagccgtggatttctcacacctgtttgtcaccagctcatttgactggactgttaaactctggaccactaaaaataataagcccctttacagctttgaggataacgccgattacgtgtatgacgtcatgtggagcccaacccatccagcgctgttcgcttgcgtcgacggtatggggcggcttgatctgtggaacctgaacaacgacactgaagttcctaccgcatcaattagcgtggaagggaatccagcactgaaccgagtgcggtggacacattcgggacgagaaatagctgtgggcgattccgaagggcagatcgtgatttacgatgtcggggaacagatcgctgtgccgcgcaatgatgaatgggcccggttcggcagaacactcgctgagatcaatgcaaacagagcggacgctgaggaagaggcagctactcggattccagcttag

SEQ ID NO: 115281 - DNA, 1917 bp, Artificial Sequence
  Description of Artificial Sequence: Synthetic coding sequence
atgagcgataagtccgagttaaaggctgagctagagaggaagaagcaaaggttggctcagatccgagaggaaaagaagcgaaaagaggaggaaagaaagaaaaaggagaccgaccagaagaaggaggcggtggcccctgttcaggaggaaagtgacctggaaaagaaaagaagagaagccgaagcacttctccaatcaatgggcctgactccagagagtcccatcgtgttcagcgaatactgggtgcccccacctatgtcccccagctcaaaaagcgtgtcgaccccatccgaggctggcagtcaagattcaggtgatggggctgtcgggtcaagaaccctccactgggatactgatccctcagtgcttcagctacactcagattccgatcttggaaggggcccaataaagctgggcatggccaagatcacacaagtggacttcccacccagggagattgtgacctatacaaaagagacacagacccctgtcatggcccagcccaaagaagatgaagaggaggatgacgacgtggtcgcccccaagccgcctatcgaacctgaagaggaaaaaaccctgaagaaggacgaagagaacgacagtaaagcacccccacatgagctgactgaggaggagaaacagcaaatcctgcatagcgaggaattcttgtcctttttcgaccattccacacgaatcgtggaaagggcgttgtctgagcaaatcaatatattctttgattatagtggtagagatctggaggacaaagagggcgagattcaggctggggcaaaactcagcctgaacaggcaattcttcgacgaacgatggagcaagcatcgcgtggtgagttgcctcgattggagttcacaataccctgaactgcttgtcgcgtcatacaataataatgaggacgcaccccatgagccggacggggtcgctctggtctggaacatgaaatacaagaagaccactcccgaatatgtcttccattgtcagtccgccgtaatgagtgctacttttgccaaatttcacccgaatctagtggtcgggggcacttatagtgggcaaatcgtgctttgggacaaccggtcaaataagaggacaccggttcagagaacaccactctcggccgccgctcatacacatcctgtctactgcgtgaatgtggtaggcacacaaaacgctcataatttgatttctatttcaactgacgggaagatctgttcctggtctctcgacatgctgtcccaccctcaagactctatggaactggtgcataaacagagtaaagccgtggctgtaacctcaatgtctttccccgtcggcgacgtaaataattttgttgttggcagcgaagaaggaagtgtctacacagcttgtaggcacggaagtaaagcagggatctccgaaatgttcgaagggcaccagggccctatcacaggcattcattgccatgccgccgtgggcgccgtggactttagccatttattcgtcacgtcttcctttgactggacagtaaagctgtggacgaccaagaacaataagccactatactcatttgaagataacgcagactatgtttacgacgtgatgtggagccccacacatcccgcactctttgcctgcgtagacggtatgggtaggctggatttatggaacttgaacaacgacactgaagtcccaaccgcctcaatatcagtggaaggcaatcctgctctgaaccgcgtccggtggacacactccggtcgcgaaattgccgtgggcgactcggaggggcaaatcgtaatctacgatgtgggtgagcaaattgctgtgcctcggaatgatgaatgggcacggttcggaaggaccctggcagagattaacgctaacagagctgatgcagaagaggaggctgccacacgaatcccagcctag

SEQ ID NO: 115282 - DNA, 1839 bp, Artificial Sequence
  Description of Artificial Sequence: Synthetic coding sequence
atgagcgacaaatccgaacttaaagccgagctggaaaggaagaagcagcggctcgcccagattcgggaggaaaaaaagaggaaggaagaagagcgcaaaaaaaaagagacggatcaaaagaaggaagctgtcgcaccagtgcaagaagagtccgacctggagaaaaagcggagagaggccgaggctctgctgcagagtatgggcctcacacccgagagccccattgtacctcccccaatgtccccctccagtaagtctgtgtctactccgtcagaagctggaagtcaagactccggcgacggcgcagtcggatctagacgggggcctataaaactgggtatggcaaaaatcacccaggttgacttcccaccacgggagatcgtgacatatacgaaagagacccagacgcccgttatggcccagccaaaggaggacgaggaagaagacgatgacgtagtggcccccaagccccctatagagccagaagaggagaagacactgaaaaaagacgaggaaaatgactctaaggcccccccccacgagctgactgaggaggaaaagcagcagatcctgcatagtgaagagttcttgagtttttttgatcactctactcgcatcgtcgaaagggccttatctgaacagatcaacatcttcttcgattacagtggtcgagatttggaggacaaggaaggagaaattcaagcaggagcaaaactgtcgcttaatcgccagttctttgacgagcgttggagtaagcaccgcgtagtcagctgcctggattggagctcacagtacccggagctgctcgtggccagttacaacaataatgaggacgccccgcatgagccagatggggtggcactggtgtggaacatgaagtacaagaagaccacaccagagtatgttttccattgccagtctgccgtgatgagcgctacatttgcaaagtttcatccaaacctagtggtgggcggcacatattcaggacagattgtgctgtgggacaataggtcaaataagcgcacacctgtccagcgcacccccctcagcgcggccgctcatacccatcccgtctactgcgtgaacgtcgtgggaacacaaaacgctcataatctgatttcaattagcacagatggaaaaatctgcagctggagcctggatatgctgagccatccccaggatagtatggaactggtacacaaacagagcaaagcggtggccgtgaccagcatgtcctttccagtcggtgacgtcaataactttgtcgtcggctcggaagagggttcagtgtacaccgcctgccgccatgggagtaaggctggtatctcagaaatgtttgagggacatcaggggccaattaccgggattcactgccacgctgcggtcggagctgtcgattttagccacctattcgtgacatcgtcctttgactggacagtcaaattgtggacgacaaaaaacaataagccactgtacagtttcgaggacaatgctgactacgtctacgacgtcatgtggtcacccacacacccagccctgtttgcttgtgtcgacggcatgggacgtcttgacctctggaacctcaacaacgacaccgaagtgcctaccgccagcatttcagttgagggcaaccctgcgctgaacagagtccgatggacacactcagggcgggaaattgcagttggagacagcgaaggccaaattgtcatttacgatgtgggcgagcagatagcagtgcctcgaaatgacgaatgggcgagatttggacgtaccctcgcggaaattaacgccaatcgagcagacgcggaggaggaggctgccacacgtatccctgcctag

SEQ ID NO: 115283 - DNA, 1899 bp, Artificial Sequence
  Description of Artificial Sequence: Synthetic coding sequence
atgtccgacaaatccgaacttaaggctgagctcgagaggaaaaaacagcgtcttgcccaaatccgcgaggaaaaaaagaggaaggaggaagagcgtaagaagaaagagactgatcagaagaaagaggccgtggccccggtccaggaggagagtgacctggaaaagaaacggcgcgaagctgaagcattgctgcagagtatggggctcacaccagagagcccaatcgtgcctccacctatgtctccatcgagtaagtccgttagcacgcccagtgaggctggatctcaggacagtggtgatggagccgtgggcagccggacgctgcactgggatacagaccctagtgtcctacagctgcacagcgattcagacttggggcgtggtcccataaaacttggcatggccaagataacacaggtggacttcccaccaagggagatagtgacttacaccaaagaaactcagactcccgtgatggcacagcctaaagaagacgaggaggaggatgatgatgtggtcgctccaaaacctcctatcgagcccgaggaagagaagacactgaagaaagacgaagagaatgactcaaaggcccctcctcacgagctaacagaggaggagaaacaacagattctgcactctgaggaattccttagcttttttgaccattcaacaagaatagtggagagggctctgtccgaacagattaacattttctttgattatagcggaagagatctggaagataaagaaggtgagatccaggctggagccaaactgagtctgaatcgccagttcttcgacgagcgctggtctaagcatcgggtggtgtcttgtctggactggtctagtcaatatcccgaactgttggttgcctcctataacaacaacgaggatgcaccacatgagcctgatggagttgcccttgtgtggaatatgaagtacaaaaaaaccacgcccgagtatgtcttccattgccagagcgccgtgatgagcgctacctttgcgaaatttcacccgaaccttgtggtgggagggacctattcaggccagattgttctctgggacaacagaagcaataaacgaacccctgtacagagaacacccctgagcgccgcagcacatacccaccccgtttactgcgtgaatgtcgttgggacacagaacgctcacaaccttataagtatcagcactgatggaaaaatttgctcatggagcttggacatgctgtctcatccacaagattccatggagctcgttcataaacagtcgaaagccgtggcagtcactagtatgtcattcccagtgggggatgttaacaatttcgtagttgggtccgaggaaggttctgtatataccgcatgcaggcacggtagtaaagctgggatcagtgaaatgtttgaaggacatcagggccccataactggaatccactgccatgccgccgtgggggcagtggacttcagtcatctgttcgtgacctcatcgttcgattggaccgtcaaactgtggactaccaagaataataaaccactgtatagcttcgaagataatgctgactacgtgtatgatgtcatgtggagcccaacccaccccgcactttttgcgtgcgttgatggtatggggcgcttagacctgtggaacctgaacaacgatactgaagtgcccaccgccagtatctctgtcgaggggaatccggccctgaatcgggtgaggtggacgcacagcggtagagagattgccgtgggagatagcgaggggcaaatcgtgatctacgacgtgggcgagcagatcgccgtcccaaggaacgatgagtgggccaggttcggtaggacacttgccgaaatcaatgctaatcgtgctgatgccgaagaagaagctgcaacgcgcatccccgcctag

SEQ ID NO: 115284 - DNA, 1914 bp, Artificial Sequence
  Description of Artificial Sequence: Synthetic coding sequence
atgtccgataaatcagaactcaaagctgaactggagcgtaagaaacaaaggctggctcagataagggaagagaagaagaggaaggaggaagagcggaagaagaaggaaaccgaccaaaaaaaagaagctgtggctccggtgcaagaggaatcagatctagagaaaaagaggagggaggccgaggcactgctgcagagcatgggcctgactcctgagagccctatagtgttctccgagtactgggtgccaccacccatgagcccttcgtccaagagcgtgtctacgcccagcgaggctgggtcacaggactcaggggacggggccgtgggatcacggacacttcattgggacacagacccttcagtcttgcagctccattctgattcggacttaggtaggggacctatcaagctggggatggcgaagattacacaggtggatttccctcccagagagatagtcacatatactaaagagacacagacgcctgtcatggcccagccaaaggaggatgaggaggaagatgatgacgtagtggcgcctaagcccccaatcgagcctgaggaggagaagactttgaagaaagacgaggaaaacgacagtaaggcgccacctcatgagctgaccgaggaggagaagcagcaaatccttcactcagaggaatttctgtcattcttcgatcactctactagaatcgtagagagagccctgagtgaacagatcaacatcttcttcgattattcagggcgcgatctcgaagataaagagggagaaatccaggccggcgccaagctgagtctgaaccgccagttttttgatgagagatggtccaaacacagagtggtgagctgcctggactggagtagccagtaccccgagctgttggttgcgtcgtacaacaataacgaggacgccccacatgagcccgatggagtggctctcgtctggaatatgaagtacaaaaagactacccccgagtacgtattccattgccagagcgccgtgatgagtgccactttcgcgaaattccaccccaatcttgtggtcggcggaacctactcaggacagattgtcttgtgggataaccgttcaaataaacgcacgcccgtccagagaacccctttaagtgccgctgctcacacacacccagtgtactgtgtgaatgttgtgggcacacagaatgcacataacctcatctccatctccacagacggaaagatttgttcttggtcgttggacatgctatcgcaccctcaggactccatggagctcgtgcacaaacaaagcaaggctgtcgcggtgactagtatgtcttttcccgtgggcgacgtgaacaatttcgtagtgggctccgaggagggaagtgtgtacaccgcctgcaggcacgggtctaaggcaggaatttctgagatgttcgagggacaccaggggcccatcacagggatccactgtcacgcagccgtcggggctgtggatttttcccatctgttcgtgaccagcagcttcgattggacagtaaaactttggacgacgaagaataataagcccttatattcattcgaagataacgccgattacgtgtacgatgtcatgtggagccccactcaccctgctcttttcgcttgcgttgatggcatgggtcggctggatctctggaaccttaacaatgacacggaagtgcctactgcaagtatttcagtggaaggcaatcccgcattgaatcgtgttcggtggacacattcagggagggagatcgcagtgggggatagtgagggtcagattgtaatctatgacgtgggtgaaatcgccgtgcctcgtaacgacgagtgggctaggtttggtagaaccctcgcagaaatcaatgctaatagggccgacgccgaggaggaggcagccactcgcatccctgcctag

SEQ ID NO: 115285 - DNA, 1917 bp, Artificial Sequence
  Description of Artificial Sequence: Synthetic coding sequence
atgagcgacaagtccgagctgaaggctgagttggagcgcaaaaagcagaggctggcccaaatcagggaagaaaaaaagcggaaggaggaggagcggaaaaaaaaagaaaccgaccagaaaaaggaggctgtggcacctgtgcaagaggaatccgacctggaaaagaagcggagggaggcggaagccctgctccagagtatgggactgacaccggagtcgcctattgtgttcagcgagtactgggtgccgcctcctatgtcaccgtcgagcaaatccgtttcgaccccaagcgaggcagggtcccaggacagcggcgacggcgcggttggttccagaaccttgcactgggatacagacccatctgttttacaactccattccgattctgatctgggccgcggccccatcaaactgggaatggctaaaattacacaagtggacttcccccctcgtgaaatcgtcacctacaccaaggaaacccagacccctgtcatggcacagcccaaagaggatgaggaagaggacgacgatgtggtggcacctaagccccctatcgagccagaggaagaaaaaacactcaagaaggatgaggaaaacgattctaaggctcctccacacgagctgacagaggaggagaagcaacaaattctgcactctgaggaattcctgagtttttttgatcactctactcgaatcgtagagagggcgctgagtgagcaaattaacatcttttttgactattcaggcagagacctggaggacaaagagggggagattcaagcaggagctaagctctccctgaaccgccagttcttcgacgagaggtggtccaagcatagggtcgtttcttgtctcgactggtcatctcagtatcctgagctcctggttgcatcttacaacaacaacgaggatgctcctcacgaacccgatggcgtggctctagtctggaatatgaagtataagaaaacaacgccagaatatgtgttccattgtcagtccgctgttatgagcgccacttttgctaagttccaccccaaccttgtcgttggagggacatattctggccagatcgtcctctgggataataggtccaacaagcgtactcccgtgcagcgcacccccttatcagcagctgcccatacacaccccgtgtactgcgtgaacgtagtggggacgcagaacgcacataatctcatctctatatccacagatggtaaaatctgttcatggtcgctggatatgctcagtcacccccaggactctatggagctcgtgcacaagcagagcaaggctgtggctgttacttcaatgagcttccccgtcggagatgtgaataactttgttgtggggagtgaggaaggatccgtgtatacagcctgcaggcacgggtccaaggcaggcatttccgagatgttcgaaggccaccaggggcccatcactgggatccactgtcacgcggcagtcggggccgtggacttctcacacctctttgtcacttcctcctttgactggacagttaagttatggacaacaaaaaataataaacctttatattcatttgaagacaatgctgattatgtttatgatgtgatgtggtcccccacccatcccgccctgttcgcatgcgtcgacggaatgggacggctggatctgtggaaccttaataacgacacagaggtaccaaccgcctccatatcagttgaaggtaaccccgcgttaaaccgcgtgcggtggacccactcaggccgcgagatcgctgttggagacagtgaaggccagatcgtcatctatgacgtgggagagcagatcgcggtgcctcggaacgacgagtgggcccggtttggacgcaccctcgccgaaattaacgcgaatcgtgcagacgctgaagaggaagcagcgaccagaattcccgcatag

SEQ ID NO: 115286 - DNA, 1836 bp, Artificial Sequence
  Description of Artificial Sequence: Synthetic coding sequence
atgtccgataagtctgagctgaaggcagagctggagcggaaaaaacaacgactggcccaaattagggaggagaaaaagcgcaaggaagaagaaagaaagaagaaagaaacggatcagaagaaggaggccgtagctcctgttcaggaggagagtgacctggaaaagaagcgtagggaggccgaggctctgctacagagcatgggcttaactccagaatccccaatcgtacccccccccatgtctccttccagtaagtcagtaagcacccctagcgaagcggggtcccaagattcaggcgatggcgccgtcggcagccggaggggacctatcaagctcggcatggctaaaatcacacaggtcgactttcctccccgggagatcgttacttacactaaggagacccagacaccggtcatggcacagcctaaagaagatgaagaagaggatgatgacgtagtagcacctaaacctcctattgagccggaagaagaaaaaacgctcaagaaggatgaagaaaacgacagcaaagccccacctcatgagcttaccgaagaagagaagcagcagatcctgcattcagaagagttcttatcatttttcgaccatagtactaggatcgtggagagggcactcagtgaacaaataaacatattctttgactattcaggccgggatctggaagataaggagggcgaaatacaggccggagccaagctctcactgaacaggcagttttttgatgaaaggtggtctaagcacagagtcgtctcgtgcctggactggtccagtcagtatcctgaattgctcgtcgcaagttataacaataacgaggacgctccacatgaacctgatggtgttgcattagtgtggaacatgaagtataagaagacaacaccggagtacgtcttccactgtcagtcggccgtcatgtcagctaccttcgccaaattccaccctaacctcgtcgtgggcggaacatattcagggcagatagtcctttgggataatcgctccaacaaacgtacccctgtgcaacgcacgccattaagtgcggccgcccacacacatccagtgtactgtgtgaacgtcgtggggactcagaacgcccataacctaatcagcatatcaaccgatgggaaaatctgtagctggtcgctcgacatgctgagccatccacaggactcgatggagctggtgcacaaacagtcgaaagctgtcgcagtcacaagtatgtctttccccgtgggagatgtgaacaacttcgtcgtggggtctgaggagggtagcgtctacacagcctgtagacacgggagtaaggctggcatcagcgagatgttcgaggggcatcagggcccgataaccggtatccactgccacgcagcagtaggcgcagtggactttagccatctgtttgttaccagctcttttgattggacagtaaagctgtggaccactaagaataacaaacccctctattctttcgaggataatgctgactatgtgtatgacgtaatgtggagtcccactcaccccgccctcttcgcttgtgtagacggaatgggcaggcttgatctgtggaacctcaataacgacacagaagtgcccactgcaagcattagtgtagagggcaacccagcccttaatagagtgcgctggacgcacagcggaagggaaatcgccgtgggtgactccgaagggcagattgtgatctatgatgttggcgagatcgctgtccctcggaatgacgagtgggctaggtttggtaggactctggcagaaatcaacgccaaccgggccgacgctgaagaagaggcagcgacacgaattccggcgtag

SEQ ID NO: 115287 - DNA, 1917 bp, Artificial Sequence
  Description of Artificial Sequence: Synthetic coding sequence
atgtctgacaaatctgaattaaaagccgagctggaacggaagaaacagcggttggcacaaatacgggaagagaagaaaagaaaagaggaggaaagaaaaaaaaaagagactgaccaaaagaaggaggctgtagctcccgtccaggaggaatcagatctggaaaagaagcggagggaagcagaagcattactacagagcatgggactgacacccgagtcaccaatcgacatcgccgaataccttgttcctcctccaatgagcccgtcctctaagtcagtcagcacccccagcgaggcaggttcacaggacagcggagatggggccgtaggatccaggactctccactgggatacagaccctagcgttctacagttacacagcgacagtgatctagggaggggcccgattaaactggggatggcaaaaatcacacaggttgacttcccacctagggagatcgtgacttacacaaaagagacgcagacaccagttatggcgcagccaaaggaggacgaagaagaagatgatgacgtcgtggcaccgaagcccccgatagaacctgaagaggaaaaaacgctcaaaaaggatgaagaaaatgactcgaaggctccaccgcatgaactcacagaggaagaaaagcagcagatccttcatagcgaggaattcctatccttttttgaccatagcactagaatagtggagcgtgctctcagtgagcagatcaatattttctttgactattccggcagggacctggaagataaggagggtgaaatacaagccggggctaagttgtctctgaatcggcagtttttcgatgagagatggtccaagcatcgggtggtgtcatgcttggattggtcctcacagtaccccgaactcctggtggcttcttacaacaataacgaggatgctcctcatgaaccagatggagtagccttggtttggaatatgaagtataagaagacgactcctgaatacgtcttccactgtcagagcgccgtgatgagcgcgacatttgccaagttccaccccaacctcgttgtcggggggacatattccggccagatcgtattgtgggacaaccggtccaacaagaggacccctgtccaaagaacacctctgagcgccgcagctcatactcatcccgtctattgtgtcaatgtagttggaactcaaaatgctcacaatctgattagcatttctacagacggcaaaatctgcagctggagcctggacatgctttcccatccgcaagattcaatggagctggtacacaagcagagcaaggccgtggccgtaacgagcatgtcctttccagttggagacgtgaacaattttgtggtaggcagtgaggaaggttccgtttatacagcatgtcgacatggttcgaaagctgggatatccgaaatgtttgagggacaccagggccctatcactggtatccattgtcacgcagctgtgggtgccgtcgatttttcacacctgttcgttacatcctctttcgactggacagtgaagttatggacgacaaaaaacaataaacctttgtacagctttgaggacaatgctgactacgtgtacgacgttatgtggtctcccacacatcccgccctttttgcatgtgtagacggaatgggacggctggacctttggaaccttaataacgatactgaagtcccgacagccagtatatccgtggaagggaaccccgccctgaaccgcgtacggtggacacatagcggacgtgaaatagctgtgggcgattccgagggacaaatagtcatatacgatgtgggagagcagatcgccgtcccacgcaatgatgagtgggctaggtttggacggaccctcgctgagatcaacgctaacagagcagacgctgaagaggaggctgccacgcgcattcctgcgtag

SEQ ID NO: 115288 - DNA, 2763 bp, Artificial Sequence
  Description of Artificial Sequence: Synthetic coding sequence
atggccaacggtaccgcggacgtgcgaaaacttttcatctttacaaccactcagaattatttcggtttaatgtctgaactgtgggaccagccgttgctgtgtaactgtctggagatcaacaatttcctggatgatggaaatcagatgctcctgagggtgcagcgtagtgacgctgggataagtttctccaatacaatcgaattcggagataccaaagacaaggtgctggtattttttaaattgaggcccgaagtgattacggacgagaatcttcacgacaacattcttgtgagttctatgctagaaagcccaatcagctccctctaccaggcagtgcgacaggtattcgctccgatgctgctcaaagaccaggaatggtctcgcaactttgatccaaaactgcagaacctgctgagcgagttggaggctggcttaggaattgtgcttcggcgcagcgacactaacctaaccaagctgaaattcaaggaggatgatactagaggcatactgactccgagcgacgaattccagttttggatcgaacaggcccataggggcaacaaacagatttccaaagaacgggcgaattactttaaggaactgtttgaaaccatcgccagggagttttataacctcgattccctgagcttactggaagttgtggacctcgtggaaacaactcaggatgtcgttgatgatgtgtggaggcagaccgagcacgatcactaccccgaaagtagaatgctgcatctgttggatattatcggtgggtcattcgggcggtttgtacagaagaagttgggtacccttaacctgtgggaggatccctactacctcgtgaaagagtccttgaaggcaggtattagcatttgcgagcagtgggtcatagtctgtaatcacctcaccggccaggtctggcaacggtacgtcccccacccttggaagaacgagaagtatttccctgagaccctcgacaagctaggtaaacgcctagaggaagtgttagccattcggacgattcacgagaagtttctctactttcttcccgcttcagaggagaagatcatttgcctgacccgcgtattcgagcctttcacaggcctgaatcccgtgcagtacaacccgtatacagaaccattgtggaaggcggccgtgtcacagtatgagaagatcatcgcacctgcagagcagaaaattgccggcaagctcaaaaactacatttccgaaatccaggactctccacaacaattgctccaggcttttcttaaatacaaggagctcgttaagcgtcccacgatctccaaggagctgatgctggagagagagacactattggctagactagtggattccataaaagactttcggctggacttcgaaaacagatgccgtgggatccctggagacgcatcgggacccctctctggcaagaatctaagcgaggttgtcaatagcatcgtgtgggtgcgccagttggaacttaaagtggacgacacaattaagatcgccgaggccctgctttccgatttaccaggtttcagatgctttcatcagtccgccaaggacttgctggatcagctgaagctgtatgaacaagaacagtttgacgattggtcgcgggacatccagagcggtctgagcgattctaggtccggactgtgtattgaggccagttcccggattatggagctggattcaaatgacggattgctgaaggtccactactctgaccgtctagtgattttgctgagggaggtgagacaactgtccgctctgggcttcgttatccccgctaagatacagcaggtggccaatattgcccagaaattttgtaagcaagccatcatcctgaaacaagtggcccacttctacaactccatcgaccaacaaatgattcagtcccagaggcccatgatgctgcagtctgccttggccttcgaacagatcatcaaaaactctaaagctggctccggcggcaagtctcagatcacatgggacaacccgaaggagctcgagggatacattcagaaactgcagaatgccgctgaacggttagcgactgaaaatagaaaactccgcaaatggcatactaccttttgcgagaaagttgtagtgctcatgaatatcgacctattgaggcagcagcagagatggaaagacggcctgcaggagctcaggaccggcttggctacagtggaggcgcagtgtcctttggcttggcagtccaagtgggaagggcctgaagatccgttacagtatcttaggggcctggtcgcgcgcgctctcgcgatccaaaactgggtagacaaggccgaaaaacaggccctgctgtccgaaacccttgatctctcagagcttttccatcctgataccttccttaatgcccttcggcaggagaccgccagagccgtgggaaggtcagttgattcactgaaatttgtcgcgtcgtggaagggaagactgcaagaggccaaattgcagattaaaatttccggattactgcttgaaggttgcagcttcgacggaaatcaactctctgagaatcagctggacagcccttctgtttccagtgtgctgccatgtttcatggggtggatccctcaggatgcctgcgggccttactcaccagacgagtgtatctcactgccagtttatacctccgcagaacgcgatcgggttgtgacaaacatcgatgttccgtgtgggggtaatcaagaccagtggatacagtgcggggctgccttgtttctgaaaaaccaatag

SEQ ID NO: 115289 - DNA, 12924 bp, Artificial Sequence
  Description of Artificial Sequence: Synthetic coding sequence
atggccaacggcaccgccgatgtgcgaaagctcttcatttttaccacgacccagaactactttggactcatgagcgagctgtgggatcagcctctgctgtgcaattgtctggaaatcaataacttcctggatgacgggaaccagatgctgctcagggtacagcgcagcgacgccgggatttcttttagcaacacaatcgagttcggagatactaaggataaagtgctggtgttcttcaaactgcggccagaagttattaccgacgaaaatctccacgataacattttggtctctagcatgctggaatcccctatcagctccctctatcaagccgttaggcaggtgttcgcgcctatgctgctgaaggatcaggagtggagccgaaatttcgacccaaaactgcaaaatttactgagtgagctggaagctggactgggcatagtgctccggcggtctgacactaacctgaccaagctgaagttcaaggaagatgatactagaggcatcctcacacctagtgacgagttccagttttggatcgaacaggcccacaggggcaacaagcagattagcaaggagcgagcgaactattttaaagaactgttcgagacaattgcccgggaattttacaatctggacagtctctccttgctggaggtcgttgacttggtggagacaacacaggacgtggtcgacgacgtgtggcgtcaaaccgaacacgatcactaccctgagtcgcgtatgttgcacttgctggacattatcggtggatcattcggaagattcgtccagaagaagttagggacactaaatttgtgggaagacccctactatctggtgaaggagtcactcaaggccggaatctccatttgtgaacagtgggtgatcgtgtgcaaccaccttaccggacaggtgtggcagcggtatgtcccccatccttggaaaaacgaaaaatatttcccagaaacactcgacaaactgggtaagaggctggaggaagtactcgccatccggactattcacgagaagtttctttatttcctgcccgccagcgaagagaagataatctgtctcacgcgagtttttgaacccttcacgggcctgaatcccgtgcagtacaacccctacacggaaccattgtggaaggccgccgtgagccagtacgagaagattatagctcccgctgagcaaaagatcgccggcaagctaaagaactacatttcggagatccaggacagtccccagcagttgctgcaggcattccttaagtacaaggaactggtgaaaagacccacgatatcaaaggagctaatgctcgaaagagagacactgttggctcgtcttgtggactcaataaaggattttagattggacttcgagaacaggtgtcggggaatcccaggcgacgcctcaggtcctctgtccggaaagaacctgtcggaggtcgttaactccattgtgtgggtgaggcagctggagttgaaggtcgacgataccattaaaattgctgaagcgttactgagcgatctgcccggatttcgttgctttcaccaaagtgcaaaggatctgctggaccagctgaaactctacgaacaggaacaattcgatgactggagcagagacatccagagtgggctatctgactctaggtccggactgtgtatcgaggctagcagcagaattatggagttggactccaacgatgggcttctgaaggttcactattcggacaggcttgtgattctcttgcgggaggtcaggcagctgtccgccttaggttttgttatccccgctaaaattcaacaggtggctaacattgcccagaaattctgcaaacaggccatcatcctgaaacaagtggctcatttctataactccattgaccagcagatgatccagagtcaacgacctatgatgcttcaaagcgccctggcattcgaacagattataaaaaattctaaagctggatctggcgggaaaagtcagatcacttgggataacccaaaggaacttgaaggatacatccaaaaactacagaatgcagcagaaagactcgcaaccgagaacaggaagttgagaaagtggcacactactttttgtgagaaagttgtcgttctgatgaatatcgacctgctgaggcagcagcaaaggtggaaagacggactgcaggagttacgcaccggcctcgcaacagttgaagcccaaggcttccaggcctctgacatgcacgcttggaaacagcactggaatcaccagctttacaaggccttagagcaccaataccagatgggcctggaggctctcaatgagaatctacctgagataaacattgacctcacctataaacaagggaggttacagtttcggccaccctttgaagagatcagagccaagtactacagagaaatgaaaagatttatcgggatacctaatcagttcaaaggggtgggtgaggcaggcgacgagagcatcttctctatcatgatcgatcgcaacgccagtggattcctgactatctttagtaaagccgaagacctcttcaggaggcttagcgctgtcctgcatcaacataaggagtggatcgttatcggccaggtcgacatggaagcgttggtggagaagcaccttttcacagtacacgactgggaaaagaacttcaaagctctgaagatcaaggggaaggaggtcgagaggctgccctccgccgtgaaggtggactgtctgaatattaattgtaatccggtgaagacagtgattgatgaccttatccagaaactattcgatttgctcgtgctaagcctgaagaagtccatacaggcccacctccatgaaattgacactttcgttaccgaagcaatggaggttctgacgatcatgcctcaatcagtggaggagatcggagacgcaaacctacagtacagtaaactgcaggagcgcaagcccgagattctccctctgtttcaagaagctgaggacaaaaaccgcctgctccggactgtggccgggggcggcctggagacgatcagcaacttgaaggctaaatgggacaagtttgagctcatgatggagagccaccaattaatgattaaggaccagatcgaagtgatgaagggcaacgtcaagagccggcttcaaatttactatcaggagctggaaaagttcaaagctcgttgggaccagcttaagcctggagacgacgtgatcgagactggacagcataacacccttgacaagtccgcgaaactaatcaaagagaaaaaaattgaatttgacgacctcgaggtaacaaggaagaaattagtggacgattgtcatcactttcgccttgaggaacccaatttctccctggctagtagcatatctaaagatatagaatcatgtgctcaaatctgggccttttacgaagaatttcagcagggattccaggagatggccaacgaggactggattacatttcgaactaagacctacctgttcgaagagtttctgatgaactggcatgacagattaagaaaagtggaggaacactccgtcatgacggtcaaactgcagtccgaagtcgacaaatataagatcgtaatcccgatccttaaatatgtccggggagaacatttgtctccggatcactggctggacctctttaggcttctgggcttgccccgcggcaccagcctcgaaaaactgttgttcggagatttgctgcgcgtggcagatacaatcgtggcgaaagccgccgacctgaaagacctgaatagccgcgcccaaggcgaggtgaccatccgggaagccctgcgtgagctagatttgtggggcgtcggagccgtgtttaccctgatcgactacgaagattcccaaagtcggactatgaagttgatcaaagactggaaggacatcgttaaccaggtcggggacaatagatgcctcctgcaatctcttaaagacagcccctactataaggggtttgaggacaaagtctcgatttgggagcggaagctggctgagctcgatgagtacctgcaaaatctgaaccatatacaacgtaaatgggtttacctggagcccatatttggtaggggcgctctgcccaaggaacagacgcgcttcaatagggtggacgaggattttcggtccataatgactgacatcaaaaaggacaatcgcgtcaccaccctgacaacacatgctgggatcaggaatagcctcttgaccatcctggatcaacttcagaggtgtcagaagtctctcaatgagttcctggaggaaaaaaggtctgcatttccccggttctactttataggagatgatgacctgctggagatcctgggacagtcaaccaacccttcagtgattcagagccaccttaagaagctgtttgccggcatcaactcggtatgtttcgacgaaaaaagtaagcatattacggctatgaaaagtctggaaggggaagtagtgcctttcaaaaataaggttcctctctctaataacgtagagacctggctcaacgacctagctcttgagatgaagaagactttggaacaactgttgaaggaatgcgtcaccaccggccgaagcagtcaaggcgccgtggacccgagtctgtttcccagccaaatcctgtgcctggctgagcagatcaagttcacggaagatgtcgagaacgcaatcaaagaccattcactccatcaaatcgagacacagctcgttaataaactcgaacagtacacaaatatcgacaccagtagcgaggatcccggcaacaccgagagcggaatcctggagctaaagctgaaggcgctgattctcgatataattcacaacattgatgtggtcaaacagctgaaccaaatccaggtccatactaccgaggattgggcctggaaaaagcagctgcggttttacatgaaaagtgatcacacttgctgcgttcaaatggtcgactccgaatttcagtatacctatgaatatcagggaaatgccagtaaacttgtttacacgcctcttacagacaaatgttatctgacactgacccaggcaatgaagatggggctgggtggtaatccctatggccccgctggcacggggaaaaccgaaagtgttaaggccctgggcggcttactgggccgccaggtgctggtgttcaactgtgacgagggaattgacgttaaaagcatgggccgcatatttgttggacttgtaaagtgcggggcctggggatgttttgatgagtttaaccgcctggaagagagtgtgctgtcagctgttagtatgcaaatccagacaatccaagacgccttgaagaaccataggacagtttgtgagttgctgggcaaggaggtcgaggtgaatagcaatagcggcatttttataactatgaacccagccggcaaagggtatggagggcgccagaaacttcccgataacctgaagcagctgttccgcccagtggccatgagtcatccagacaacgagcttatagctgaggtgattctgtactcggaaggttttaaggacgccaaagttttgagccgcaaattagtggcgatctttaatctgagcagagagcttttgacaccacaacagcattacgattggggcttgagagcgttgaaaacagtcctgcgcggatcagggaacttgcttcgccagctgaacaaatccggcaccacgcagaatgctaacgagtcgcacatcgttgtgcaagcactcaggctaaacactatgtcaaagttcaccttcactgattgtacacgctttgacgctctgattaaagacgtattccctggcattgaattgaaagaggttgagtacgatgaattaagtgcagcattaaaacaggtgttcgaggaggctaactacgagatcattcctaatcagattaaaaaggcgctcgaactttacgaacagctctgccagcgaatgggagtcgtcattgtcgggccctcaggtgctggcaaaagcaccttgtggcgcatgcttagggcagctctgtgcaaaactggaaaagtggtgaaacaatatacaatgaatccgaaggcaatgcccaggtaccaactcctaggccatattgatatggacacgcgcgaatggtctgacggggttctgaccaatagcgctagacaggtggtaagggaacctcaagatgtatcctcgtggattatttgcgatggagatatcgacccagaatggatcgagtctttgaacagcgtgctcgatgacaaccgactgttaaccatgcctagcggcgagcgcatccagtttggcccaaatgttaatttcgttttcgaaactcacgacctctcctgtgcctcaccggctaccataagcagaatgggcatgatcttcctttccgacgaggagaccgacctcaattctctcataaagagctggttacgaaaccaaccagccgagtatagaaacaatttggagaactggataggagactactttgaaaaagctctgcagtgggtgctgaaacagaacgattatgtggtggaaacaagcctcgttggaaccgttatgaacggtttatcccacctccacggctgtcgcgaccatgacgagtttattatcaacttaatccgcggtctgggaggtaacctgaatatgaaatcccggcttgaatttactaaagaagtgtttcactgggcccgggagagtccccccgatttccacaagcccatggacacctattatgatagcacccgaggacggctggccacatatgtcttaaagaagcctgaggatcttacggctgatgactttagcaatggcttgacactacccgtgatccagacccctgacatgcagaggggattagactatttcaagccttggctgagcagcgatactaaacagcccttcatcttggtcggaccagaggggtgtggaaagggtatgctgctgagatatgcattctcccagttgcgaagcactcagatcgctacggtacactgcagtgcccaaacaacctctcgtcatttactgcagaaactgagccagacttgtatggtgatctctaccaatacaggccgcgtttaccggccaaaagactgcgaacgtctggttctctatctgaaagacatcaatctccccaagctggataaatggggaactagcacacttgtggcattcctacaacaagtgctgacctaccagggtttctacgatgagaacctggaatgggtggggcttgaaaatattcagatagtcgcgtccatgagtgcgggcggaaggcttggtcgacataaactaacaacacgttttactagtatcgttagactgtgcagtatcgattacccagagagagaacagctccagactatatatggagcctatctggagcctgtgcttcacaaaaacctgaagaaccactctatctggggatcctcctccaagatatacctccttgctgggtctatggtacaggtatatgagcaggtaagagcaaaattcacagtggatgactactcacactactttttcacaccatgcatccttacacaatgggtgctgggtttgtttaggtatgatctggagggggggagcagcaatcatcctctcgactatgtattagagattgtagcctacgaagcgcgtagactgtttagggacaagatcgtgggagccaaggaactgcatctgttcgacataatcctaacctcagtgtttcagggcgattggggtagtgacatcttggacaatatgagtgactccttttacgtaacatggggcgccaggcataattccggcgctcgagcagcacccgggcagccactgccccctcatggtaagcccttgggtaagctaaatagcacggatttgaaggacgtcattaaaaagggtctgattcactatggccgcgataaccaaaacctagatattctgctctttcacgaggtactggagtatatgtcgcgaattgaccgtgtgctgagcttccctggaggtagcttgctgctggctggccgaagcggcgtgggccgcagaacgataacctctctcgtgtcacatatgcacggggccgtgctgttttcccctaagatttccagaggctacgaattaaagcaattcaagaacgatctgaagcacgtactgcagctcgccggaattgaggcacagcaggtcgtcctgcttctggaggattaccagtttgtacatcctacttttctggaaatgattaacagtctattgagcagcggcgaggtacccgggctgtacacactggaggagctggagcctttgctcctgcccctgaaagatcaggcctcgcaagatggtttcttcggacccgtgttcaactatttcacatatagaatccagcagaacttgcacatagtgctaattatggactcggccaatagtaacttcatgattaactgtgagtctaacccagcacttcacaagaaatgccaggtcctatggatggaagggtggtctaatagctctatgaagaagattccggagatgcttttttcagaaacaggcggtggagaaaaatacaacgacaagaagcgcaaagaagagaagaaaaagaatagtgtggatcctgactttctgaagtcattcctcttgattcatgaatcttgtaaggcctacggcgccaccccatcccggtacatgaccttcctgcatgtctacagtgcaatatcatcctccaaaaaaaaagagctgcttaagaggcagagccacctccaagctggagtctctaaattaaatgaggcaaaagccttagtagacgaactgaatcgcaaagctggagagcagtctgtgctgttgaaaacgaaacaggacgaggctgacgctgcgttgcagatgattacagtatccatgcaagacgcaagcgagcagaagactgaacttgaacgtctcaagcaccgcatcgctgaggaggtagtgaagatcgaggagagaaagaataaaattgacgatgagctcaaggaagtccaaccactcgtgaatgaagccaagctggccgtggggaacattaagcctgagtctctcagcgaaattaggtccctgcggatgcccccggatgtgattagagatatccttgagggggtcctgcgactcatgggtattttcgatactagctgggtgagtatgaaatcgtttctggcgaaaaggggcgtaagggaggatatagctaccttcgacgctcggaacatttccaaagagatccgggagtccgtggaggaactactctttaagaataagggatcattcgaccctaagaacgctaaacgggccagtacagccgctgcccctctggccgcttgggtgaaagcgaacatacagtacagccacgttctcgaacgaatccatcctctcgaaacggagcaggccggcctggagtctaatctcaagaaaaccgaagatcggaagcgaaagctagaagaattgttgaattccgttggccagaaagttagcgaattgaaagaaaagtttcagagtcgcaccagtgaagcagctaagctcgaggccgaggtgtccaaggcacaagagactattaaggctgccgaggtgctgattaaccagcttgatcgtgagcataagagatggaatgcacaagtggttgagatcacggaagagctagccacgctgcctaagcgagctcagctagccgctgcattcattacctatctctctgccgcgcccgaatctctacggaaaacatgtctcgaagagtggacaaagagtgcgggactcgagaagtttgatctacgcaggtttttgtgcacagagtccgaacagctgatatggaaatcggaggggctcccctcagacgatctgtccattgagaacgcactggttattcttcagagcagggtgtgccctttcctgatcgatccctcctcccaagcaaccgagtggctcaaaactcacctcaaagattcccgcctcgaagtgatcaaccagcaggacagtaactttatcaccgccttagaattggcagtgaggtttggaaagacccttattatccaggagatggatggtgtggaacccgtcctttatcctctgctgcgccgggacctcgttgctcagggacccagatatgtggtgcagataggagacaagatcatcgactacaatgaagaatttagactcttcctgagcacccgcaatccaaacccattcatccccccggacgctgcctccatcgtgactgaggtcaatttcacaacgacacggtccggccttcgtggacaacttctggcattaactatccagcacgaaaagcccgacttggaggagcaaaaaaccaagctcttacagcaggaagaggacaaaaaaatccagttggccaaactggaggagagtctgcttgaaaccttggctacgtctcagggaaatattttagagaacaaggatctgatcgagagtctcaatcagacaaaggcgagtagcgccctcatccaggagtccctgaaggaaagttataaacttcagatttctctcgaccaggagagagatgcctacttacccttagccgaatcggcctccaagatgtatttcataatttcagacttatcaaaaattaataatatgtacagattctcattggcggccttcttgaggctattccagagagctttgcaaaataagcaggactctgagaacaccgagcagcgaatccagtcactcatatcctcactgcagcacatggtttatgagtacatctgcaggtgtctgttcaaggccgaccagctgatgttcgccctccacttcgttagggggatgcaccccgagctgtttcaggaaaatgaatgggacacatttacaggcgttgtcgtaggtgacatgctccgtaaggccgattcccagcagaagatccgagatcagctccccagctggattgatcaggaacggtcctgggccgtcgccactctgaaaatcgctttaccatccctataccagaccctgtgtttcgaagatgccgctctgtggcgcacctactacaataattcgatgtgcgaacaggagttcccttctatccttgccaagaaagtttccctgttccagcagatcctggtcgtgcaagcccttcgccctgacagactccagagtgcaatggcactctttgcttgtaagacactcggtttgaaagaggtctcaccactgccactgaacctgaaaaggctatataaggaaacgttagagattgaaccaattttgatcatcatttcaccgggtgcagatccctctcaagagctgcaggagctcgccaatgctgaacgcagcggggaatgttatcaccaagtggccatgggccaaggccaggctgatctggccattcaaatgcttaaggagtgtgccagaaatggggattggctttgtttaaaaaatctgcatctggtggtgtcatggttgcccgtgctggagaaggagctgaacactctgcaaccgaaggacacttttcgtctctggctgaccgccgaagttcaccctaatttcactccgattctgctgcagtcctctctgaagattacctacgagtctccccccggactgaaaaaaaatcttatgcgaacgtatgagagctggaccccagagcagatttcgaagaaggataatacccacagggcccacgctctgttctccttggcctggtttcatgcagcctgtcaagagcgccggaattacataccccaggggtggacaaaattctatgagttctctctgtctgacctgcgtgccggatataacattatcgaccgattatttgatggggcaaaagacgtccaatgggaatttgtccatggtttgttggagaatgccatctatggaggccgcatcgataactactttgatcttcgggtattacagtcttatctgaagcagtttttcaactcctcagtcatcgatgtgtttaatcaacggaataagaagtccatcttcccctacagtgtcagtctccctcagagttgttccatactggattatagggcagtcatagaaaagatccctgaggatgacaagccttcttttttcggcctgccagcaaatatcgcccgtagcagtcagagaatgatttcctcgcaagtgatttcgcagctcaggatccttggccgcagtattactgctggatccaagttcgatcgggagatctggtcaaacgaactctctcctgtcctaaacctttggaaaaaattaaatcagaattccaatctgatccatcagaaggtgccccccccaaacgaccgtcagggcagccctatcctgtcattcattatcctggaacagtttaacgcaattcggctggtgcagtcagtacaccagagtcttgccgctctttcgaaggtgatccggggaaccaccttgctgtcttcggaggttcagaagctagcctccgcacttctgaatcagaaatgtccgttagcctggcagtctaagtgggaggggcctgaggaccccctgcagtacctgcgtggccttgtggccagggcactcgctattcagaattgggtcgacaaggctgaaaagcaggcattgttgagtgagactttggacctgagtgagcttttccaccctgatacctttcttaacgcactgcgtcaggaaaccgcccgggctgtggggagaagcgtggactcgttgaagttcgtagcctcatggaaggggcgtttgcaggaggccaaactacagatcaagatctccgggttgctgctggagggttgctcattcgatggaaaccagctctcggaaaatcaacttgactcaccgtccgtttcatcagtcctcccatgcttcatgggttggattccacaggatgcttgcggcccttactctcctgacgaatgcattagcctcccagtatacacgtctgctgagcgggacagggtcgtgaccaacattgatgtcccttgtggaggtaaccaagatcagtggatccagtgtggcgccgcactgtttctgaagaatcagtag

SEQ ID NO: 115290 - DNA, 12945 bp, Artificial Sequence
  Description of Artificial Sequence: Synthetic coding sequence
atggcgaatgggacagctgatgttagaaagctattcattttcacaaccacgcagaactactttggcctcatgtctgaactgtgggatcaacccctgctttgcaattgcctggaaattaataattttctggacgacgggaatcagatgttgttgcgagttcagcggagtgacgccggaatcagcttctctaataccatcgaattcggcgataccaaggataaggttttggtgtttttcaagctgagacctgaagtgataaccgatgaaaatctgcatgacaacatcctagtgtcaagcatgctggagagccccattagtagcttgtatcaggcagtgcggcaagttttcgctcctatgttgctgaaggaccaggaatggagtaggaattttgaccctaagctgcagaatctgctttcagaattagaagccgggttaggaatagtgctgaggagatctgataccaatctcacgaaacttaagttcaaagaagacgatactagaggaattttgactccctcagacgagtttcagttttggatcgagcaagcgcaccgtggaaacaaacagatcagcaaagagcgtgcaaattattttaaagagttgtttgagactatagcacgcgagttttacaatttggacagtctgtctctcctagaggtcgtggacctcgtggagactactcaggatgtggtggacgacgtttggagacagacagaacatgaccattaccctgagagccgcatgctgcaccttctcgacatcatcggtggcagcttcggccgctttgtccaaaagaagcttggcactctaaatctgtgggaggatccttactatcttgtgaaagagagccttaaggcaggaattagtatctgcgaacaatgggtgatcgtgtgcaaccacttgaccggccaagtgtggcagcgatacgttccacacccctggaaaaatgagaaatatttcccggagacattggataagctaggaaaacgactggaagaagttttggccatcaggacgattcacgagaaattcttgtattttctgccggcctctgaggagaagattatttgcctcacccgggtgtttgagccctttaccgggctgaatcctgtccaatataatccatatacggagcctctgtggaaggcagctgtgtcacagtacgaaaaaattattgcaccagctgagcaaaaaatagcagggaaactgaaaaattacattagcgagattcaggatagcccccaacagcttctgcaagccttcctgaagtataaagaactggtgaaacgcccaacgatttctaaagaactgatgctcgaaagagagaccttacttgctagactcgtggacagcatcaaagacttcaggctggacttcgagaatcggtgccgtgggattcccggggacgcctcaggacccttgagcggcaagaacctatccgaagtggtcaacagtatcgtgtgggtcaggcagctcgagctgaaagtggatgataccatcaaaatcgccgaggctctgctctccgatctgccaggatttaggtgcttccaccaaagtgccaaagatcttctggatcagctgaaactttacgagcaggagcaattcgacgactggtccagggacattcaaagcgggctgtcagactcccgcagtggtctgtgcatagaagctagctcgcgcattatggaactcgacagcaatgacggcctcctcaaggtgcactattctgacaggttggtcatcctgttgcgggaggtacgccagttgtctgccctgggcttcgtaattccagccaaaatccaacaggtggccaatattgcacagaaattttgcaagcaagctattatattaaaacaagttgcacacttctacaactcgatcgatcagcaaatgatccagagccagaggccaatgatgctgcagtcggccttggcgtttgagcagattattaagaattccaaggcaggttctggcgggaagagccagataacctgggacaatccgaaagaattagaaggttatatccaaaagctgcagaatgcggctgaaagactggcaaccgagaataggaagcttcgcaagtggcacactactttttgcgagaaggtggtcgtcctaatgaatatagacctgctccgccagcagcagcgatggaaagacgggctgcaagagctgaggaccggactcgctacagtggaggctcagggattccaggcatcagacatgcacgcctggaagcaacattggaaccaccagctctacaaagccttggagcaccagtatcagatgggcttggaagcgcttaacgagaacttgcccgagataaacatagacctgacctacaaacagggacgcctgcagtttcgtcccccgttcgaggagatccgggcgaaatattacagagaaatgaaacgcttcataggcatccctaatcagtttaaaggggtgggagaagctggagacgaatctatcttttctattatgattgatcggaatgcatctggctttttgactatcttctcgaaggcagaggacctgtttcgccgcctgtccgccgttctccaccaacacaaggagtggatagtgattggccaggtggacatggaggccctggttgagaaacacttattcactgtgcatgattgggagaaaaatttcaaagcgttgaaaatcaagggcaaagaagtcgaaaggttacctagtgcagttaaagtggattgtcttaatattaattgcaatcctgttaagacagtcattgacgacctgattcaaaagctgtttgatttgctggtactttccttgaagaagtctatccaagcacacctgcatgaaattgataccttcgtcacagaggcaatggaggtcctcacaatcatgccacaatctgttgaagagattggcgacgcaaatttacagtacagcaaactgcaggagcgcaagcctgaaattctgccgctgtttcaggaggccgaggataaaaatcgcctccttaggacggtggctggcggtggcttagagacgattagcaatctgaaggccaaatgggacaagtttgagctgatgatggaatctcaccagctcatgatcaaagatcaaatcgaggtcatgaagggcaacgtgaaatcccgactgcaaatttattaccaggaactggagaagtttaaggcacggtgggaccaacttaagccaggagatgacgtcatcgagacaggtcagcataacactctcgataaaagcgcaaagctgatcaaagaaaagaagatcgaattcgacgacctggaagtgacacgaaagaagctagtggacgattgtcaccattttcggcttgaggagccaaatttcagtcttgcgagcagcatctccaaggacatcgagtcttgtgcccagatttgggccttttacgaagaattccagcagggcttccaggaaatggccaacgaagattggatcactttcaggaccaaaacttacctttttgaggaatttctaatgaactggcatgatcgattacgcaaggtggaggagcattctgtaatgactgtgaagttacagagcgaggtcgataagtacaagattgtcatcccgatcctcaagtacgtgagaggagaacatctctctcccgaccactggctggacctgttccgcctgctcgggctgccacgcggtacgtctctggagaaactgctgtttggcgacctcctcagagtagccgatacaatagttgctaaggccgccgatctgaaagacctgaacagtcgcgcccagggcgaagtgactatccgtgaggcccttagggaactcgatttgtggggtgtcggggccgtgtttacactcatcgattatgaggactctcagagccgaaccatgaaactgatcaaagactggaaggacattgtgaaccaggtcggcgacaataggtgccttttgcagagcctcaaggatagcccctactacaagggatttgaagataaggtctccatttgggaaagaaaactggccgaattagacgaatacctgcaaaatcttaaccacatccaacggaagtgggtgtatctggagcccatcttcggccgaggagcgctccccaaggagcagacacggttcaatagggtggatgaagatttccggagcattatgacagatattaagaaagacaatcgtgtgaccacattgacaacccacgccggcatccgcaattccctgctgaccatcctggaccagctccagaggtgccagaaaagcctgaacgaatttctagaggaaaagcgcagtgcattcccaaggttttacttcataggagacgacgatctgcttgagatattgggacagagtactaaccctagtgtgattcagtcacaccttaagaaactattcgcaggtattaactctgtgtgtttcgatgagaagtcgaagcatattaccgctatgaagtcactcgagggggaggtggtcccctttaaaaataaggtgcccctttccaataatgttgaaacctggctcaatgacctggccttggaaatgaagaagacgttagagcaactgttaaaggagtgtgtcaccacgggccgcagttctcagggcgcagttgacccgtccctattcccgtcgcagattctgtgcctggcagagcagatcaagtttaccgaggatgtggagaacgccatcaaggatcatagtttgcatcagatcgagacccagcttgtaaataagctggaacagtataccaacatcgatacatcaagtgaggaccctgggaacaccgaaagcggaatccttgagctgaagctgaaggctttaattctagacataatccacaacatcgacgtagtgaagcaactgaatcagattcaggtgcacacaaccgaagattgggcctggaaaaagcagctgcggttttacatgaaatcagaccacacttgctgcgtacaaatggtggattcagagtttcagtacacatatgagtatcagggaaacgcctccaaacttgtgtatacgcccctcacagacaaatgctatttgaccttgactcaggctatgaaaatgggtttaggaggcaacccctacggaccagctggcacagggaaaacagaatctgtcaaggcactgggcggcttactcggacgacaggtgctggtcttcaactgcgatgagggcattgacgtgaagtctatgggtcgcatctttgttggtctcgttaaatgtggggcgtggggctgttttgacgaatttaataggttagaagaatccgtgcttagtgctgtgtcaatgcagatacaaactatacaggatgctctgaagaaccatcggacagtatgcgaactgctcgggaaggaagtggaagtgaatagtaactccgggatatttattaccatgaatcctgccggcaaagggtatgggggccgccagaaactccccgacaacctcaagcagctgttccggcccgtcgccatgagtcaccctgataatgaacttatagccgaggtgatcttgtacagcgagggctttaaggatgctaaagtgctgagcagaaaattggtggcaatctttaacctctcgcgcgagctgcttaccccacagcaacattacgattggggcttacgagccctcaagacggtgctcagggggtcaggaaatctgttacggcagttgaataagagcgggacaacccagaacgctaacgaatcacacatcgtagtccaggccctgcgcctcaacactatgtccaagttcacgttcacagactgcacccggtttgacgctctgataaaggacgtgttccctgggatcgaattgaaggaggtagagtacgacgagctgtccgccgctctgaagcaggtgtttgaggaggcaaactacgagattatccctaaccagatcaagaaggctttggagctgtatgaacagttatgtcagaggatgggcgtcgtcatcgttggccccagcggagccggcaagtcaacactgtggcggatgctgcgggccgctctctgcaagactggcaaagtggtcaagcaatacacaatgaacccaaaggctatgccccgttatcagcttctgggccacattgatatggatactcgcgagtggagcgacggagtcttgactaattcagcccggcaggttgtgcgggagcctcaggacgtgtcatcctggataatctgtgacggtgacatcgatcccgagtggatcgagagtttgaattctgtgttggacgacaatcgtctgctgactatgccgtccggagagagaattcagttcggacccaatgtcaacttcgtgttcgagactcatgacttgagttgtgccagcccggcaaccatctctcgcatggggatgattttcctatctgacgaagagactgacctgaatagcctaatcaagagctggctgcgaaaccagcccgcagagtaccgcaataatctggagaactggatcggcgactattttgaaaaggcattgcagtgggtgctcaaacaaaatgattatgtagtcgaaacctctcttgtggggacggtgatgaacggtctctcacatctacatgggtgcagggaccatgatgagtttatcataaacttgatcagggggcttggtggcaatcttaacatgaagtctcgcctggaattcacaaaggaggtgttccactgggctcgggaatcacctccagattttcacaaacccatggacacctattacgattcaaccaggggacgtctggccacctacgtgctgaagaagcccgaggatttgactgctgatgatttcagcaatggcctcacactcccagtgatccaaactcctgacatgcagcgcgggctggattattttaagccttggctctccagcgacaccaaacaacctttcattctcgtcggacccgagggctgtggcaaaggcatgcttttgagatatgctttttcccagttgcgatcaactcagattgccacggtccattgctccgcacagacaactagcagacaccttctgcagaaactcagccagacgtgcatggtcattagcacgaacactggtcgggtataccggccaaaagattgtgagaggcttgttttatacctcaaggacattaatttgcccaagcttgataaatggggtacgagcaccctggtggcgtttctacaacaggtcttgacctatcaggggttctacgatgagaacttggagtgggttgggttggaaaacatacaaattgtggcgtccatgagcgccggagggagattgggaaggcacaaactcacaacacgctttacttctatcgtgcgcttatgctcaatcgattaccctgaaagggagcagcttcagaccatctacggggcttacctcgaacccgtgctgcataagaatctaaaaaaccactcaatatgggggagtagcagtaaaatttacttgcttgcaggctctatggtgcaggtgtatgaacaggtacgggccaagttcaccgttgacgactatagtcattacttttttaccccatgtatactgactcagtgggtgctgggcctctttcgctatgatctggagggaggctcctccaatcatccactggattatgtgctggagattgtagcttacgaagccaggagactcttcagggataaaatagtcggcgctaaggaactgcaccttttcgacatcattctgacgtctgtgttccaaggcgactgggggtcagacattctagataacatgtccgacagcttctatgtgacctggggtgcccgccacaattcaggcgccagggccgctccagggcagccactacccccccatgggaagcctttgggaaagctcaactccaccgatctcaaagatgtaatcaaaaaagggctgattcactacgggagggacaatcagaatctggacattttactgtttcacgaagtgcttgaatatatgtccaggattgatcgcgtactcagcttccctggagggtctctgctgctggccgggaggtcgggggtggggagacgtactataacaagcctggtgtcacatatgcatggggccgtattgttcagtccgaaaatctcccgcggctacgagctgaagcagttcaagaacgacctgaagcacgtccttcagctggccggcatcgaagctcaacaagttgtgctcctgctggaggactaccagttcgtgcatcccaccttcctcgagatgattaactctcttctctcttccggggaagtccccggtctgtatacgctggaagagctcgaaccactgctgctcccacttaaggatcaagcctctcaggatggtttctttggcccagttttcaactatttcacctacaggatacaacagaatctccatattgtgctgatcatggacagtgctaactccaactttatgattaactgtgagtctaaccccgccctccataaaaaatgtcaagtgttatggatggaaggatggtccaactcctcaatgaagaagataccagagatgcttttctcggaaaccggaggaggggaaaagtacaacgataaaaaaagaaaggaggagaaaaaaaagaacagcgtagatcctgactttttaaagtctttccttctaattcatgagtcgtgtaaagcttacggagctactccaagccgatatatgactttcttacacgtctattcagcgatttctagctcaaaaaagaaggagctgctaaagcgtcagagtcacctacaggcaggagtgtctaaactcaacgaggcaaaggcattagttgacgaattaaacaggaaggccggggaacagagcgtgctgttgaagactaaacaggatgaagccgacgcagccttacagatgataacagtctcaatgcaagacgcatccgagcaaaagactgagctagaacggctcaaacaccgcatcgctgaggaggtagtgaagattgaagaacgcaagaataaaatcgacgacgaactgaaagaagtccagccactcgtgaatgaggcaaaactagcagtcggcaacatcaaacctgaaagcctgagcgagatacgcagtctcaggatgccacctgacgtgattcgagacatcctggagggggttctccgcctcatgggtatttttgatacttcctgggtgtctatgaagtcctttctcgccaagagaggagtacgtgaggatatcgctacttttgacgcaagaaatatcagtaaagaaatcagggagtccgtcgaagagcttctctttaaaaacaagggctcctttgacccaaagaatgccaagcgcgccagtacagcagctgccccgctcgctgcttgggtgaaggcgaatatccaatactcccatgtgcttgaaaggattcacccccttgaaactgagcaggccgggctcgagtcaaatctgaaaaaaaccgaagaccgtaaacggaagctggaagaactccttaatagcgtggggcagaaggtatcagaactgaaagagaagtttcaatctcgtaccagcgaggccgccaaattagaggccgaggtgtccaaggcccaggagaccatcaaggccgccgaggtgcttatcaatcagctagaccgcgaacacaagcggtggaatgcacaggttgtagaaatcactgaagagctggccactctgccgaagagagctcaactggctgctgcatttatcacatatctgagcgcagctccagagagcctgcgaaaaacgtgcttagaagaatggactaaaagtgctggcctggagaaatttgatttgaggagatttctctgtactgagtccgaacagctaatttggaaatctgaaggcctcccgtctgacgatctgtccatcgagaatgccttagtaatcttgcagattattggtctgaagagttggtcacgtgtgtgtcctttcctcatcgatccttccagtcaagcaaccgagtggcttaagacccacctcaaagacagcaggctcgaggtgatcaaccagcaggattccaacttcatcacagccttggagctagccgtcagattcggcaaaactctgatcatccaggagatggatggggttgagccggtcctttaccctctcctgaggagggacctggtagctcaagggcccagatatgttgttcagatcggtgacaagataattgactacaatgaagaattccgcttgttcctttctaccagaaatccgaacccttttatacccccagacgctgccagcatcgtcaccgaggttaacttcacaaccacccgatctggcctgcgagggcagttgttagctctcaccattcagcatgagaaacctgatctggaggaacaaaaaaccaaattgcttcaacaagaagaggataaaaagatacagctggcaaagctggaagagagtctgctcgaaacattggccacatctcaaggaaatatactggaaaacaaagatctaatagagtcccttaaccaaacgaaggcttctagtgctttaatccaggagtctttgaaagagtcctataagttgcaaatcagcctggaccaggaacgagatgcttacctacccctggcagaaagtgcttccaagatgtatttcataatctctgacctgtccaaaattaataatatgtatcggtttagtctcgccgctttccttaggctgttccagagagcactccagaataaacaggacagtgaaaacaccgaacaaagaatccagtcgcttatctcatccctgcagcatatggtgtatgagtacatctgcagatgtctgtttaaggctgaccagttaatgtttgcacttcattttgttcgaggcatgcaccctgagctgttccaagaaaacgagtgggacactttcaccggagtggtagtgggcgacatgcttagaaaggcagattcacagcaaaaaatcagagaccagctgcccagttggatcgatcaggaacgcagctgggcagtcgctacgctgaagattgcactcccctctctgtaccaaacattatgcttcgaggacgccgcactctggcgcacttattacaataacagtatgtgtgaacaggagttcccctcgattctggctaagaaggtttcgttgttccagcagattctcgttgtccaggcattgcgaccggataggttgcagagtgcaatggccctcttcgcatgcaagaccctgggcctcaaggaagtgtctcctttacccctaaatctaaaaagactgtataaggaaacactagagattgaacccatcttaatcatcatttctcctggcgctgaccctagccaggaacttcaagaattggcgaacgccgagaggtcgggcgagtgctatcaccaggtcgcaatgggacaaggccaggctgaccttgccatccagatgctaaaagaatgcgctagaaacggtgactggctctgccttaagaacctgcacctggtggtctcctggctacccgtgttggagaaagaactcaacacattgcagccaaaggacacctttcggctgtggctaacagcagaggtgcaccctaatttcacaccaattctacttcaatcgagcctgaagattacctacgagtcaccgccagggctgaaaaaaaatcttatgcgcacttatgaatcttggacgccagagcagatcagtaagaaggacaatactcatcgagcccacgctctcttttccctggcgtggttccatgctgcttgccaggaaagaaggaattatatccctcagggctggactaaattctatgagttctccttatctgacctgagggccgggtacaatattatagatcggctgttcgatggcgcaaaagatgtccagtgggagttcgtacacgggctgttagagaatgcaatttacggcggacgtattgacaattacttcgatcttcgggtgttacagtcctatcttaaacaattttttaattcgtctgttatcgacgtcttcaatcagagaaacaagaaatccatctttccctattcagttagtctgccacaaagctgctccatactcgattatagagccgttattgagaagattcctgaagatgataagccttcgtttttcggtttacccgccaacatcgctcgcagctcacagcgcatgatcagcagtcaagtaatcagccagctgaggattctcggcagatcaataaccgcaggctcaaagtttgatagggagatttggagcaatgaactgagcccagttctgaacctatggaaaaagcttaaccagaacagcaaccttatccaccagaaggtccctccccctaatgataggcagggatcccccattctgagtttcatcattttggagcagttcaacgccattcgattggtgcagagtgtgcaccagtctctggctgcgctgtcaaaggttatccgcgggacgactctcctgtcctctgaggtccagaagctcgcgtccgctctgctgaatcagaaatgccctttagcctggcagagcaagtgggagggcccagaggacccattgcagtacttgcggggactggtggcacgcgcactggcaatccagaattgggttgacaaagccgagaagcaagcccttctgagtgagaccttggacctctccgaactgtttcatcctgatacgttcctgaatgccttaagacaagagactgcacgcgcggtgggtcggtccgttgactctcttaagttcgttgcctcctggaagggtagactccaggaggcgaagctgcagatcaaaatctccggactgctgctggagggctgttcctttgacggcaaccagttatccgaaaaccaactagactctccgagcgtgagtagcgttctgccctgcttcatgggctggattccccaggacgcttgcggtccttattctccggatgagtgcatttccctacccgtgtatacctcggctgagcgcgacagggtcgtcacaaacattgatgtgccttgtggcggtaatcaagatcagtggatccaatgcggcgcggctttgttcctaaagaatcagtag

SEQ ID NO: 115291 - DNA, 1515 bp, Artificial Sequence
  Description of Artificial Sequence: Synthetic coding sequence
atgggccagggccaagctgatctcgctattcagatgttaaaggagtgcgcgcgcaacggtgattggctgtgcctaaaaaatctgcatcttgtggtttcctggctccccgtgctggagaaagagctgaatacgttgcagccgaaggatacattcaggttgtggcttacagcagaagttcatcctaactttacacctattctgttacaatcctcacttaagataacatatgagagtcctcccgggttgaagaaaaatctaatgagaacctacgagtcttggacaccggagcaaatctccaaaaaagacaatacgcatcgcgcacacgctttattctctttggcttggttccacgctgcctgccaagagcgccgaaactacatcccgcagggctggaccaaattttatgaatttagtctgtcggatctgcgcgccggctataacataatcgacaggttgtttgatggcgctaaggacgtgcaatgggaatttgtgcatggacttttggagaacgcgatttatggcggtaggattgataactatttcgatctacgcgtcttgcagtcttacttaaagcagtttttcaattcttctgtcattgatgtgttcaatcagcgcaataagaagtcgatttttccctattcagtgtcgctgccccagtcctgtagcattctcgactaccgtgcagttattgagaaaattcctgaagatgataagccaagcttcttcggtctgccagcgaacatcgccagaagttcccagagaatgattagctcccaagtcatctcgcagctgagaatcctcggcaggtccattacagccggaagcaagttcgaccgggagatctggagcaacgagctctcacccgtgctgaacttatggaaaaagttgaatcaaaattcaaatctgatacatcagaaggttcctccaccaaatgaccgccaggggtctcccatcttgtcgttcatcattctggaacagtttaatgccattaggctcgtgcagtctgtacaccagtctttagccgcgctgtcgaaagttatcagaggcacaactctgctgtcttcagaggtacagaagttggcgtctgccttgctgaaccagaaatgtccattggcatggcaatcaaagtgggagggtccagaggaccccctgcagtatctgcgcgggctggtggcgcgcgcgctagctattcaaaactgggtggacaaagctgagaagcaggctttgctgtctgagacactggatctctcggagctgttccaccccgacactttcttgaatgccttgagacaggaaactgcccgggcggttggtcgcagcgtggattccttgaagttcgtggcatcttggaagggccgcctgcaggaggcaaaactacagattaagatctctgggctactgctcgagggatgcagtttcgacggcaatcagctcagtgaaaaccagctagacagtcctagcgtatcctccgttcttccttgtttcatgggatggatccctcaggacctattgtag

SEQ ID NO: 115292 - DNA, 270 bp, Artificial Sequence
  Description of Artificial Sequence: Synthetic coding sequence
atgtgtgaccgtaaggctgtaatcaaaaatgcagacatgtccgaagagatgcagcaggactcagttgagtgtgccacacaggcgttagagaagtataatatcgaaaaagatatcgctgcccatattaaaaaagagtttgacaagaagtacaaccctacctggcactgcattgtgggccggaatttcgggtcttatgtgacacatgaaacgaagcactttatatacttctacttgggacaagttgccatcctgctttttaaaagcggttag

SEQ ID NO: 115293 - DNA, 270 bp, Artificial Sequence
  Description of Artificial Sequence: Synthetic coding sequence
atgtgcgacaggaaggccgttattaagaatgcggacatgtcagaagagatgcagcaggattctgtggaatgcgcaacacaggccctcgagaaatataatatcgagaaggacattgcagcccacattaaaaaggagttcgataagaaatataaccctacatggcattgtattgtaggacgaaacttcggctcatatgtcacacatgagaccaagcacttcatctacttctatctaggacaggtcgcaattctgctatttaagagtggttag

SEQ ID NO: 115294 - DNA, 270 bp, Artificial Sequence
  Description of Artificial Sequence: Synthetic coding sequence
atgtgtgaccgcaaagcagtgataaagaacgctgatatgtcagaagagatgcagcaggattcagtagaatgcgcaacccaggccctggagaagtacaacattgaaaaggatattgcggctcacataaagaaagagttcgataagaagtataatccaacatggcactgcatcgtagggcggaacttcggttcctatgttacacacgaaacaaaacactttatctacttctatctgggccaggtggcaatactcctgttcaagtcgggatag

SEQ ID NO: 115295 - DNA, 270 bp, Artificial Sequence
  Description of Artificial Sequence: Synthetic coding sequence
atgtgcgaccggaaggctgtcatcaaaaacgccgatatgagcgaagagatgcagcaggactcagtggaatgcgcaacccaagctcttgagaagtacaacattgaaaaggatattgccgctcacatcaagaaagagtttgacaaaaagtataatcctacatggcattgcattgtaggaagaaacttcggctcctacgtgacgcatgagactaagcactttatctatttctacctgggccaagtggcgatactcctgtttaaatcaggttag

SEQ ID NO: 115296 - DNA, 129 bp, Artificial Sequence
  Description of Artificial Sequence: Synthetic coding sequence
atgtgcgatagaaaagctgtcattaaaaacgccgatatgtctgaggagatgcagcaggactccgtcgaatgtgctacacaggccctggaaaagtacaacatcgaaaaggatatcgctgctcatatatag

SEQ ID NO: 115297 - DNA, 270 bp, Artificial Sequence
  Description of Artificial Sequence: Synthetic coding sequence
atgtgcgacagaaaagcagtgatcaagaatgctgatatgagcgaagagatgcagcaggatagtgtcgagtgtgccacacaagcacttgagaaatacaatattgagaaggacatcgccgctcacattaaaaaagagttcgacaagaaatacaatcctacgtggcattgcatagtcggacgcaattttgggagttacgtcactcacgaaactaagcactttatctatttctacttaggacaagtggcaattctgctgtttaagtcaggctag

SEQ ID NO: 115298 - DNA, 270 bp, Artificial Sequence
  Description of Artificial Sequence: Synthetic coding sequence
atgtcagataggaaagccgtgataaaaaatgcggatatgtcagaggacatgcaacaggatgccgtagattgtgctacgcaggctatggagaagtacaacatcgagaaggatatagcagcttatatcaaaaaggaattcgacaaaaagtacaatcctacttggcactgcatcgttgggagaaacttcggtagttatgtaactcatgaaaccaaacattttatctatttctatctgggccaggttgcaatactacttttcaagagcgggtag

SEQ ID NO: 115299 - DNA, 144 bp, Artificial Sequence
  Description of Artificial Sequence: Synthetic coding sequence
atggccgaagtggaggagaccctgaagagactgcaaagccaaaagggcgtgcaaggtattatagtggtgaacaccgagggtggttgggagcccctgggtcattgcggagatcggtctagacctcctgctcagggctgtccctag

SEQ ID NO: 115300 - DNA, 291 bp, Artificial Sequence
  Description of Artificial Sequence: Synthetic coding sequence
atggcagaggtcgaggagactctgaagagactgcagtctcagaagggagttcagggcattattgtcgtgaataccgagggaattcctatcaagagcacaatggataacccaacaactacccagtatgcctctctcatgcactcgtttattctgaaggctagatcgaccgtgagggatattgacccacaaaatgatctgacatttctcaggatccgctctaaaaagaatgagatcatggtcgcccccgacaaggattatttcttaattgtcatacaaaaccccactgagtag

SEQ ID NO: 115301 - DNA, 366 bp, Artificial Sequence
  Description of Artificial Sequence: Synthetic coding sequence
atggctgaggtggaggaaaccctgaagcggctgcagagccaaaagggcgttcaagggatcattgtggttaatacagaagggatcccaattaagtctaccatggataatcccacgaccacccagtatgcatccctcatgcactcattcattctgaaggctcgctccactgtgagagacatagacccacaaaatgacctgacctttctgcggatcaggagtaagaaaaacgagataatggtggccccaggcaaaggcagctccacatccccctgccgtaaccgaccccatgggaccttctcagtcgcgcaccaggaatcatggcatagcggcgtaagccgaggatctaagcaaggcccgagatcctag

SEQ ID NO: 115302 - DNA, 291 bp, Artificial Sequence
  Description of Artificial Sequence: Synthetic coding sequence
atggccgaggtcgaggagactctcaagaggatccagagccacaaaggggtgatcggcaccatggtcgtcaacgctgagggaattccaattcgcactacactggacaattcaaccaccgtccagtacgccggtctacttcaccacctcacaatgaaggccaagagcaccgtacgcgacattgatccacagaacgacctgacttttctcagaatcagatctaagaagcatgaaattatggtagcacctgacaaggaatacctgctgatagtgatccaaaacccctgtgaatag

SEQ ID NO: 115303 - DNA, 165 bp, Artificial Sequence
  Description of Artificial Sequence: Synthetic coding sequence
atggcagaagtcgaagagactctcaagcgcatccagtctcacaaaggagttattggcactatggttgtcaacgccgaggaccctaggttcgttacgttcaagtatgccaggcaacttacagcctttcaaaggaagagcgggcaacagataactatcaaagattag

SEQ ID NO: 115304 - DNA, 486 bp, Artificial Sequence
  Description of Artificial Sequence: Synthetic coding sequence
atggacccaaacccccgggctgctctggaaagacagcagctgagactgcgggagcgacagaagtttttcgaggatatcctgcagcctgagaccgaattcgttttccctttaagtcatcttcatcttgaaagtcagcggccccctatcggctccatcagctctatggaggtcaacgttgacactctagaacaggtcgaacttatcgacctgggagacccagatgctgcggacgtgttcctcccttgcgaggatccacctccgacaccacaatccagtgggatggataatcatctcgaagagttatcccttccagtgcctacgagtgacaggactacaagtagaaccagctcgtcctcttcctctgacagctcaacaaacctacacagtccaaacccttcagatgatggcgcagacaccccccttgcccagtctgacgaagaggaggaacggggggatgggggggccgagccaggcgcctgcagttag

SEQ ID NO: 115305 - DNA, 486 bp, Artificial Sequence
  Description of Artificial Sequence: Synthetic coding sequence
atggatcctaacccaagagctgctctggagcggcagcaactgcggcttcgcgagaggcagaaattttttgaagatattctgcagccagagaccgaattcgtgttcccactctcccacctccacctcgaatcccagcggccccctatcggttctatcagcagtatggaagttaatgtagacacattggagcaggtagagttaattgaccttggcgatccagatgcagctgatgtgtttctgccctgcgaggacccacccccgactccgcaaagtagtggcatggataatcatctggaggagctgagtctgccggttccaacctcagaccgaaccacttcacggaccagctcctcctcaagttcagactctagcactaacctgcattcccctaatcccagcgatgatggcgcagacacccctctggcacagtctgatgaggaagaagagcggggggacggcggcgccgaacccggcgcctgcagttag

SEQ ID NO: 115306 - DNA, 792 bp, Artificial Sequence
  Description of Artificial Sequence: Synthetic coding sequence
atggaaagctgggccttagccgtattccctgaatatagagtcagcctcctatggtgtctggaactggcatcacctctgtggagcctgggtcaggcccctcccctccacgaaacttggttcgtcggccacacctggtttcaaggtcggggaaaacgctcccccagagccgaggtgtctcggccggagccaggcgcgcctttactgggatgttggctgcagtggggggcccctagcccaggccccctgtgtctactctttagactctgtagctgtacctgtttcgcaccactgccagctggcgccgatatggatcctaatcctagagccgctttggagagacagcagttaagactgagagaaaggcagaagtttttcgaagacatccttcagcccgaaaccgaattcgtgtttcccctgagccatctgcacctcgagtctcagcgtccgcccatcggaagcatctcgtcgatggaagtgaatgtggacactctggagcaagttgaactgatcgacctgggagacccagatgcagctgatgtttttttgccctgtgaggatcccccaccaaccccacaaagctctggcatggacaatcacctggaggagttgagtctccccgtaccaacctcggacagaacaacttctcgaacctctagcagctcgtccagcgattctagcactaacctgcactcaccaaacccctctgacgatggtgccgatacccctttggcccagtctgacgaggaagaagaaaggggcgatggaggtgcagagcccggagcttgttcttag

SEQ ID NO: 115307 - DNA, 486 bp, Artificial Sequence
  Description of Artificial Sequence: Synthetic coding sequence
atggatccgaatccgagggcagccctagagaggcagcaactgcgcctgcgggaacgtcagaagtttttcgaagacatactgcagcccgaaacggaattcgtgttcccccttagtcatctccatctggaatcacagcgccctccgatcgggtccatcagcagcatggaagtgaatgtggacaccctcgagcaggttgagctgattgaccttggcgatcccgacgctgctgacgtgttcctgccgtgcgaggaccctccgcccacgccccagagctccggcatggacaatcacctggaggagttgagcctccccgtgcctaccagcgaccggacaacaagccgcacctcttcaagttctagctctgattcaagtactaatctgcatagccctaatcctagcgacgacggagccgatacgcctttggcccaatcggacgaggaggaggaacgaggtgatggaggggccgaacctggggcgtgctcttag

SEQ ID NO: 115308 - DNA, 339 bp, Artificial Sequence
  Description of Artificial Sequence: Synthetic coding sequence
atggatcccaatccaagggctgccctagagaggcagcagctccgactgcgtgaacgacagaagttcttcgaagacatcttgcagcctgaaacagaatttgtctttccgctgagtcatctccaccttgaaagtcagcgacctccgatagggagcataagctctatggaagttaacgttgacactctcgagcaagtagagctcatagatcttggcgatcctgacgccgcagacgtgtttctcccttgtgaggatccccctcctaccccacagtctagcgggatgccactctgcttcggggacttctcagcctcgcagcctgaaccagatgtccgactctag

SEQ ID NO: 115309 - DNA, 780 bp, Artificial Sequence
  Description of Artificial Sequence: Synthetic coding sequence
atgggagctgggaacttcctgaccgcactggaagtcccagttgccgcgttagcaggggccgcctcagatagaagagcctcttgtgagcgggtgagcccaccacctcccctcccccacttccgtctgccgcctcttccaagatcgcggctgcctgggccagtcagcagacctgagcccggagctccactgctagggtgctggctgcagtggggggcccctagcccagggcccttatgcctgctgtttcgcctctgcagctgtacctgtttcgctccactccccgctggcgctgacatggatcccaatccacgcgccgctctggagcgccaacagcttcgtctgcgagagcgtcagaagttctttgaagacattcttcaaccagagactgagtttgtgttcccgttgtcccaccttcatcttgaaagccaacggcccccaatcggtagcatctcaagcatggaagtgaacgtcgacacactggaacaggtagaactgatcgacctaggtgatccagacgctgccgacgtcttcttaccttgcgaagaccccccaccgacaccgcaaagttctggtatggataaccatttggaggagctcagcttaccagttccaactagcgacaggaccacttcgaggacgagtagttcttcctcttcagacagttcaaccaacctccactcacctaacccttcagacgacggagctgatacccctctggcccaatcagacgaggaggaggaacggggcgatggaggcgctgagcccggggcctgctcttag

SEQ ID NO: 115310 - DNA, 339 bp, Artificial Sequence
  Description of Artificial Sequence: Synthetic coding sequence
atggatcctaatcccagagctgccctggaacggcagcaactccgacttcgcgaacgtcagaaatttttcgaagatatcctccagcccgaaacggaattcgtgtttcctttatcccatctccatctcgagtcccagaggccgccaattggaagcatcagctccatggaggtgaatgttgacacattagaacaggtagaattgatcgatcttggcgacccagacgccgcggacgtttttctgccatgtgaagaccccccccccacaccacagtcttcaggtatgcccctgtgcttcggagattttagtgctagccagcccgaacctgatgtgaggctttag

SEQ ID NO: 115311 - DNA, 486 bp, Artificial Sequence
  Description of Artificial Sequence: Synthetic coding sequence
atggatcctaacccacgagcagcacttgagagacagcagcttcggctgagggagagacagaaattctttgaggacattcttcaacccgagacagagtttgtatttcccctgtcccatttacatttggagagccagagacccccaattgggtcaatttccagcatggaggtcaatgtcgacactcttgaacaggtggagctgatcgacctgggcgaccctgacgcggctgacgttttcctaccctgcgaggacccacctcctaccccccagagcagcgggatggataatcacctggaggaacttagtctaccagtgccaacatctgatcgcactacctcgagaactagctcttcttcttcgtccgactccagcacaaacctgcactcccccaacccaagtgatgatggagccgacactcccttagcgcaaagcgatgaggaggaggagcgcggggacggcggggccgaaccaggagcttgctcctag

SEQ ID NO: 115312 - DNA, 519 bp, Artificial Sequence
  Description of Artificial Sequence: Synthetic coding sequence
tgaacttggtttcaagggagaggcaagaggagtcctcgtgccgaggtctctagaccagaaccaggtgcgcccctgctcggttgttggctacagtggggcgccccatccccaggacccttgtgcctgctgttcagattgtgcagctgcacatgctttgccccactgcccgcgggcgccgacatggaccctaatcctagggccgctttggagaggcagcagctgaggctacgcgagcggcagaagttctttgaggacatcctacagcccgagacagagttcgtgttccccctcagtcacctacacttagagtcgcagagaccaccaattggaagcattagcagcatggaagtgaatgtggacactctcgagcaggtagaactcattgatctgggagatccggacgccgctgacgtcttcctgccttgcgaggacccgccgccaactcctcagagtagtggcatgcccttatgttttggagacttttcggccagccagcctgagccagacgtgcggctgtag

SEQ ID NO: 115313 - DNA, 15516 bp, Artificial Sequence
  Description of Artificial Sequence: Synthetic coding sequence
atgcattcttcgagctactcctaccgctcctctgactctgtgttttccaacactacgtcaacacggaccagtctcgattctaacgaaaacctgcttctggttcactgcggtccaacgctgattaactcctgcatttcattcggatccgaaagcttcgacggacacagactggagatgctccagcagattgccaatcgtgttcagcgggacagcgtgatttgcgaagataaactcattctggcgggcaatgcactgcagtcagactcaaaacggctggaatctggggtgcagtttcaaaatgaggccgaaatcgcggggtacatcttagagtgcgagaacctcttaagacagcatgtgattgatgtgcagatcctaatcgacggcaagtactatcaagccgatcagttggtgcagcgggtggcaaagctgcgagacgagattatggcgctaaggaacgagtgttcttccgtttattccaaaggccggattcttactactgaacagaccaaattgatgatctcgggcatcacgcagtccctgaacagcgggtttgctcagaccctgcacccatcactcaccagcggcctgacgcaatccctgacgcccagcctgacctccagcagtatgaccagcgggctgtcctcaggtatgactagcagactgacacccagcgtcacacccgcctatacacctggtttccccagcgggttagtgccaaattttagtagtggtgtcgaacccaatagtctgcagactttgaaactcatgcagattagaaagcccctactgaaatccagcctcctagaccagaatctgacagaggaggagatcaatatgaagttcgtccaggaccttttgaactgggtggacgagatgcaggttcagctcgaccggactgagtggggcagcgacctgccatccgtggaaagtcatctcgagaatcacaaaaacgtgcaccgggcaatagaggaattcgaatcaagtttgaaagaggccaaaatctccgaaattcagatgactgccccactcaaattgacttacgcggagaaactccatcggttggagtcccagtatgctaagcttctaaataccagtagaaatcaggagaggcacctggacaccctccataatttcgtgagccgagctacgaacgaactgatctggcttaacgagaaggaagaagaggaggttgcgtacgactggagcgagaggaatacgaatattgctagaaaaaaggattaccacgcagagctgatgcgcgagcttgaccagaaagaggagaacatcaaatcagtccaggagattgccgagcagctgctcctggagaaccacccagcgcgactgacaatcgaagcctaccgggccgccatgcagacacaatggagctggattttacagctatgccagtgcgttgaacagcacattaaggagaacactgcatacttcgagttcttcaacgacgccaaggaggcgaccgactacctgcggaacttgaaagacgctatccagcggaaatatagctgcgacagatctagctcaatacataaactagaagatctggttcaggagtcgatggaagagaaagaggagcttctacagtacaagagcactatcgcgaatctcatggggaaggccaagacaatcatccagttgaagccccggaacagtgattgtcccctgaagacttcaatccctattaaagccatatgtgattatcgccagatcgagattacaatctacaaagacgatgagtgcgtgctggcaaataacagccaccgtgcaaagtggaaagtgatctctcctacaggaaatgaggctatggtgccatctgtgtgctttacagtccctcctcccaacaaggaggcagtggatctagctaaccgcattgagcagcaatatcagaacgttctcacactctggcacgaatctcatattaacatgaaatcagttgtgtcttggcattatctgattaacgaaatcgacagaattagggcgagtaacgtggcatctatcaagaccatgctgcccggcgaacatcagcaggtgctctcaaacctgcaatctaggttcgaggacttcctggaggattcacaggagtctcaggttttctcagggtccgacatcactcagctggaaaaggaggtcaacgtgtgcaaacaatactatcaagagctgctgaaaagtgctgagagagaggagcaagaagaatctgtgtacaacctgtacattagtgaggtgcgtaacatccggctccggcttgagaactgcgaggatcgcctcatcaggcagatccggaccccactagagagagacgacttacatgaaagtgtgtttagaattaccgagcaagagaaacttaagaaggaactggaacgcctaaaggacgacctggggacgattactaacaagtgcgaggaatttttctcccaggcggccgccagctcttccgtgcccaccctgagatctgagctgaatgtagttctgcaaaacatgaatcaagtgtattcaatgagcagcacatacatcgataagctgaaaactgtcaacctcgtgcttaagaatacccaggctgctgaggccttggttaagctgtatgagacaaagctgtgcgaagaggaagcagttatcgccgataaaaataacattgagaatctaatctccacgctgaaacagtggcggagtgaggtcgatgagaagcgccaggtgtttcacgctctcgaagatgaactccagaaggcaaaggcaatatccgatgagatgtttaaaacttacaaagagagggacctggacttcgattggcataaggagaaggcagatcaactggttgaacgttggcagaacgttcatgtacagatcgataacagactcagagacctggaaggaatcggtaaaagtcttaagtactatcgggatacttaccacccattggatgattggatccagcaggtggaaacaacccagaggaagatacaggagaaccaacccgagaactctaagaccctcgccacccagttgaaccaacagaagatgttggtgagcgaaatcgagatgaagcagtccaaaatggacgagtgccaaaaatatgcggaacaatactccgctaccgtgaaggactacgagctccagacaatgacctatagagcgatggtggacagccaacagaaatctcctgttaagaggcgacgaatgcagtcgtcggccgatcttattatacaagagttcatggacctgcgcacccgttacaccgcccttgtcacactgatgacgcagtacatcaagtttgctggtgattcactgaagagattagaagaggaggagaaatctttggaagaagaaaaaaaagagcatgtggaaaaggccaaagaactccagaagtgggtgtccaatattagcaagacccttaaggacgctgaaaaagccgggaagccccccttctcaaaacagaaaatctctagtgaggagatttccaccaaaaaggagcagctttccgaagctcttcaaaccatccaactctttctcgccaaacatggcgacaagatgaccgacgaggaacggaatgagctggaaaagcaggtgaagaccctgcaagagtcctacaatctgctcttttccgaatccctcaaacagctgcaagagtctcagacttcgggagatgtgaaagtcgaggagaagatcgtggccgagcgtcagcaggagtataaggaaaaattgcaaggaatatgtgatttactgactcagactgaaaacaggctgattggccaccaagaggcctttatgatcggcgatggcacggtagaacttaagaagtatcaatcaaagcaagaagaacttcagaaggacatgcagggttccgctcaagccttggccgaagtggttaaaaataccgagaatttcttaaaggaaaacggtgagaaactgtcccaagaggataaggccttgattgaacagaagcttaatgaggccaagatcaagtgcgaacagttgaacttaaaagccgagcaatccaaaaaggagctagacaaagtcgtgaccaccgcaatcaaagaagagactgagaaggtggccgccgtaaaacagctggaagagtcgaaaacaaagatcgagaatctcttggattggctgtccaatgtcgataaagattcggagcgggctggaacgaagcacaagcaggtcattgaacagaacggcactcactttcaggaaggcgatggcaagtctgccattggcgaggaggacgaagtaaacgggaatctgctggaaaccgacgtggatggacaggtagggacgacacaagaaaacctgaaccagcaataccaaaaagtaaaagcacagcacgagaaaatcatttcacagcaccaggctgtaattattgccacacagagcgcacaagtgctcctcgagaaacaggggcagtacctaagtcctgaggagaaagagaagctgcagaagaatatgaaggagttgaaagtccattacgagacagcattggctgaatccgagaaaaaaatgaaactgacacattctcttcaggaagaattggagaagtttgacgccgactataccgaattcgagcattggctccagcagagcgagcaggagctcgagaacctcgaagccggagcggacgatatcaacggcctcatgaccaagcttaagcgccagaaatctttttctgaagacgtcatctcccacaaaggcgatctgagatacatcactatatctggcaacagagtgctggaagcagctaaaagctgctctaagagggacgggggcaaggtggacacttctgccactcaccgggaagtacagcgaaagctggatcatgccaccgacagatttaggagtctttatagcaagtgcaatgtgcttgggaataacctaaaggaccttgtggacaagtatcagcattacgaagatgcctcgtgcggtttattagctgggttacaggcctgtgaagccactgcatcaaagcatctgtctgaaccgattgctgtagatcctaaaaatctgcagagacaacttgaagagaccaaagctctgcaggggcaaatttcatcccagcaggtggccgtcgaaaagctcaaaaagacagcagaggttttgctcgacgccagagggagtctgctgccagcaaagaacgacattcagaaaaccctggacgacatcgtgggcagatacgaagatttgtccaaaagcgtgaacgaacgtaacgagaagcttcaaatcacacttactcggtctttatccgtgcaggacggcctggacgagatgttagactggatggggaacgtagaaagcagcctgaaggagcaagggcaggtgcctctgaacagtactgctttgcaggatatcatttccaagaacattatgctggagcaggatattgccggcaggcagtcctccatcaatgctatgaatgaaaaagtgaagaaatttatggaaaccaccgaccccagtactgcaagctccctgcaggccaaaatgaaggatctcagtgcccgtttttctgaggcatcccacaaacacaaggagaccctcgccaaaatggaagagctgaaaacaaaggtcgaactgtttgaaaacctctccgagaaactacagactttccttgaaacaaaaactcaggctctgacagaggtggatgtacccgggaaagatgtgaccgaattaagtcagtatatgcaggagagtaccagcgagttcctggagcataagaagcacctggaggttctgcatagcctcttaaaggaaataagcagccacggtcttccttcagataaggccctggtgctagaaaaaacgaataacctgtctaagaagttcaaggaaatggaagacaccataaaggagaagaaggaagcagtaactagttgccaggagcaactggatgccttccaggttctggtgaaatctctaaagagctggatcaaagagaccacaaagaaagttccgatagtccagccctcatttggcgcagaggatcttggtaaatccctggaggacaccaaaaaactgcaggaaaagtggagcctgaaaacccccgagatccagaaagttaataatagtggcatttcactgtgcaatctcatcagcgctgttaccactcccgccaaggcgatcgccgctgtgaaatccggcggcgcggtgctcaatggcgaagggactgccacaaacactgaggagttctgggccaacaaaggtctgactagcattaagaaagatatgacagatatcagtcacggctacgaggatctggggctgctcctgaaggacaaaattgctgaattgaatacaaaacttagcaagctgcaaaaggctcaggaggaatccagtgccatgatgcagtggcttcagaaaatgaacaaaacggcaacgaaatggcagcagacacccgcacccaccgacaccgaagccgttaaaacacaggtggaacagaataagtctttcgaggcagaactgaaacagaatgttaataaagttcaggaactgaaggataagcttaccgaattgctagaggagaaccctgacactccagaagctcctaggtggaagcagatgctgacagaaattgattccaagtggcaagaacttaaccagctcaccatcgatagacagcagaagttggaggaatcttcaaataacctcacacagttccagactgtggaagcccagctcaagcaatggttggtagagaaagagctgatggtctccgtactgggcccactctcaatagaccccaacatgctgaacacacagcgccaacaggtgcagattttgttgcaggagttcgccacacgtaagccgcagtacgagcagttaacagcagctggccagggcatcctgagccgccctggcgaggacccctccctccgcggaattgtcaaggagcagctcgctgctgtcacccagaaatgggatagcctgaccggccaactgagtgatcggtgtgactggattgaccaagcgatcgtcaaatcaacgcaatatcagagtttgcttagaagtttaagtgataaactatccgatctggacaacaagctgagtagctcgctggccgtgagcacccacccagatgccatgaatcagcagttggagaccgcacaaaaaatgaagcaggagattcagcaggaaaagaagcagataaaggtggcccaggccctgtgcgaggatctgagcgctctcgtcaaggaagagtatttaaaggctgagctgagccgccagttggaggggatcttgaaaagtttcaaggatgtggaacagaaggccgaaaaccacgtgcaacatctgcagtccgcttgtgcgtcctctcatcagttccagcagatgtcgagagattttcaagcttggctggacactaagaaggaagaacagaataagtctcatccaatttccgccaaacttgatgtcttagagagcctgatcaaagaccacaaggatttctcaaagaccctgacagcccaaagccacatgtatgagaagacaattgccgaaggagagaacctgctcctgaagacccagggaagtgagaaggcagccctccagttgcaactaaataccatcaaaactaattgggacacattcaataagcaggtgaaagagagggagaacaagttgaaggagagcctggagaaggctctcaagtataaggagcaagtcgaaaccctttggccatggatagataaatgccagaacaatttggaggagattaaattctgcctggaccctgccgagggcgaaaatagcattgcgaaactgaaatccctccagaaggaaatggatcaacactttggcatggtggaactccttaataacactgcaaattcactgctgtccgtctgtgagatcgataaggaggtggtgacagatgagaataagagcctgattcagaaagttgatatggtgacagaacaactgcatagtaagaagttttgcctggagaacatgacccagaagtttaaagaattccaggaagtttcgaaagagtcaaagcggcagctgcagtgtgccaaggagcagctcgacattcacgactcactgggtagtcaggcatactctaataaatatttgacgatgcttcagactcagcagaaaagtcttcaagctctaaagcaccaggtagatctcgccaagaggttagctcaggacttggtggttgaagcatccgattccaaggggacctcagacgtactattacaggtcgaaacgattgcacaggaacactccacgctgagccaacaagtggatgagaaatgttcctttcttgaaaccaaattacagggcatcggacactttcagaacacaatcagggaaatgttctctcaattcgccgagtttgatgatgagttggatagcatggctccagttgggcgtgatgcggagacacttcagaaacagaaggagactatcaaagctttcctaaaaaaattggaggcgttgatggcctctaatgataacgcaaacaagacatgtaagatgatgcttgccacagaagaaaccagccccgatctggtcggcattaagagagatctggaggctctgtcaaaacagtgcaataaattgctcgatcgggcacaagcccgtgaggaacaggtggaaggaacgatcaagcgactggaggagttctacagtaagctgaaggagttttcaatcctgctgcagaaggcggaagaacacgaggagagccaaggcccagtggggatggaaaccgagacgattaatcagcagctgaatatgtttaaggtcttccaaaaggaggagatagagccactacagggcaagcaacaggacgtcaattggcttggacagggcctcatccagtctgccgctaaaagcacttcaacccagggtctggagcatgacttagacgatgtcaacgctagatggaagactctgaataaaaaagtagctcagagagctgcgcagctgcaggaagccctgctgcactgcggccggttccaggatgcactggaaagcctcctgtcctggatggtcgataccgaggaactggttgcaaaccagaagcccccgagtgcagagtttaaagttgtcaaagcccagattcaggaacagaaactcctgcagagattactggacgatagaaaaagcacggtcgaggtgataaagcgggagggggagaagatcgcaacaaccgctgaacccgcggacaaagtgaaaattcttaaacagctgtccctgctggacagcagatgggaagcactgctgaataaggcagaaaccaggaatcgacagcttgaggggataagcgtcgtagcccagcagtttcacgaaacactcgaaccactcaacgagtggctgactaccattgaaaagagactcgtcaattgtgagccgatcggcacccaggcatccaagttagaggagcagatagcacagcacaaggctttggaagatgatattataaatcacaataagcatctgcaccaggccgtttcaattgggcagagcctgaaagtcctgtcatctcgcgaagacaaggatatggtacagtctaagctggactttagccaggtatggtacatcgagatccaggaaaagtctcacagtcgatctgaactgctccagcaggcactctgcaatgccaaaatatttggcgaggacgaagtggaactcatgaattggctgaacgaggtgcacgacaagttgtccaaactctcagtccaggactacagtactgaaggcctgtggaagcaacagagtgaactcagggttctccaggaagatattttgcttcgaaagcagaatgtcgatcaagccttgttgaacggtctggagctgctgaaacaaacgactggggacgaagtgctgattatccaggataagcttgaggccatcaaagcacgctacaaagacataactaaattgagcactgacgtagccaagacccttgagcaggctttgcagcttgcacggaggctgcactccacccacgaagaactctgcacttggctagataaggtggaggttgaacttctcagctacgaaacccaggttctgaagggcgaggaggcctctcaggcacagatgagacccaaagaactcaagaaagaggcaaaaaataataaggccctgctggatagcctgaatgaagtgtcctcagctctcctagagcttgtaccatggcgggcacgggagggcctggaaaagatggtcgctgaagacaacgaaaggtacaggctggtcagcgatacaatcacccagaaagtcgaagagattgacgccgctatcctccgctctcagcagtttgatcaagcggccgacgctgaactgtcctggatcaccgaaacagagaagaagctcatgagcctcggtgacattagattggagcaggaccaaaccagcgcgcaactgcaagtacagaagaccttcaccatggagatactgaggcacaaggacatcatcgacgatcttgtaaaaagcggccacaaaatcatgactgcttgtagtgaggaagagaagcagtcaatgaaaaaaaagctggacaaggtcctgaagaactatgacacaatatgccagattaactccgaacgttatctccagctggagcgagcccagtccctggtaaatcagttctgggagacctacgaggaactgtggccttggctcaccgagacacaaagcataatctcgcagctgccagctcctgccctcgagtacgaaactctcaggcagcaacaagaagagcacaggcaactacgggagctgatagcggagcacaagcctcacattgacaagatgaacaagacaggcccacagctgttggaactctcccccggcgaagggttctctatacaagagaaatatgtcgcagccgataccctctactcgcagattaaggaggacgttaagaagagggccgtggccttggacgaggcaatttcacagtcaactcagtttcacgataagattgaccagatcctggaaagcctggagaggattgtagaaagactcagacagcctccttctatctcggccgaagtggagaagataaaagaacagatttccgaaaataagaacgtgagcgtagacatggagaagctccagccactgtacgaaacgttgaaacagagaggggaggaaatgatagcacggtccggtggtaccgataaggatatcagcgccaaagccgtgcaggacaaactggatcaaatggtcttcatttgggagaatatacacactctagtggaagaacgagaagccaaactgcttgacgtcatggagcttgcagaaaagttctggtgtgatcatatgtctcttatcgtcaccattaaagatacccaggacttcattcgtgacctggaggatcctggaatcgacccttcagtggtgaagcagcagcaggaggccgcagagacaattagagaggagatcgatggcttgcaggaggagttggatattgtaatcaatctcggctccgaactgattgcagcatgtggagagcctgataagcctatagtcaagaaaagcattgatgaactgaatagcgcatgggactcattgaacaaagcatggaaggaccgaatagataaacttgaggaggcaatgcaggctgctgtgcagtaccaggatggtctgcaggccgtgtttgactgggtggatattgccggcggaaagctggcctctatgtctcccatcggaacagacctggagaccgtgaagcagcagattgaggaactcaaacagttcaagtcagaagcctaccagcagcagattgaaatggagagactgaaccaccaagcggagctcttgctgaaaaaggtaacagaagaatctgacaaacatactgtacaggatcctttaatggaattgaaactcatttgggatagcttagaggaaagaataataaatcgacaacataagctggagggggccctgttagccctaggccagttccagcatgccttggacgaattgctggcttggcttacacacactgaaggtctgctgagtgaacaaaagcctgttgggggagatcctaaagcaatagaaatcgaactcgcaaaacatcacgtgctccaaaatgatgtccttgcccatcagagcaccgtggaggccgtcaataaagccggaaatgacctgattgaaagttccgcaggggaagaggcctccaacttacaaaataagctcgaggtgctgaatcagaggtggcaaaacgttctggaaaagaccgagcaacgcaaacaacaactcgatggcgccctgcgccaagcaaaggggttccatggcgaaatcgaggatctgcagcagtggctcactgacactgaacgacatctgctcgccagcaaaccattgggtgggttgccggaaacagccaaggagcaacttaacgtgcacatggaggtgtgtgctgcctttgaggcgaaagaggaaacgtacaaatccctcatgcagaaagggcagcagatgctggcgcgttgtcccaaaagtgcagagactaatattgaccaggatatcaacaacttaaaggagaagtgggaaagcgttgagacgaagctgaatgagaggaagaccaaactggaagaggcactgaaccttgctatggagtttcacaacagcttgcaagacttcatcaattggcttacgcaggccgagcagaccctcaatgtggcatcccggccttcactgattcttgatacagttctgttccagattgacgagcataaagtgtttgccaatgaggtaaattctcaccgcgagcagattatagagctcgacaagacgggaacccatcttaaatacttctcccaaaagcaggatgtcgtcctgataaagaatttgttgatctctgtgcagtcccggtgggagaaagtggtccagcgcctagtagaacgggggcgatcactagatgacgctcgcaaaagggcaaaacagttccacgaggcttggtcgaaactgatggagtggctggaagaatcagagaaaagtctcgatagcgagctggagatagctaacgaccccgacaagattaagacccaactggcacagcacaaggaatttcagaaatcgttaggtgccaagcactccgtctatgacaccaccaatagaactgggcgctcactcaaggaaaaaactagcctggccgacgataatcttaagcttgatgatatgttatctgaactcagagataagtgggacaccatttgcgggaaatcagtggaacgacagaataagcttgaggaagcattgctgttttctggccaattcaccgacgctttgcaggctcttatcgattggctgtacagagttgagccgcagcttgctgaggatcagcccgtgcatggagacattgatctcgtgatgaacctcattgataatcacaaggcgtttcagaaggagttaggtaagagaacaagtagcgtgcaggcgttgaagaggtctgctcgtgagctgatcgaggggagccgcgacgacagctcatgggtgaaagtgcagatgcaggagttgtcgacccgctgggagaccgtctgcgctctgtctatttccaaacaaactcggctagaagcagcacttcggcaggccgaagagttccattctgtggttcatgcgctgctggaatggcttgccgaggccgagcagaccctgaggttccacggcgttctgccagatgatgaggatgccttgcgaaccctgatagaccagcataaggagttcatgaagaagctggaagagaagcgggcagaacttaacaaggcaaccacaatgggcgatacagttctggctatttgccaccctgattccatcactaccattaagcactggattactatcataagagcgcgctttgaagaggttctggcctgggctaaacagcaccagcagaggttggcatcagcccttgcagggctaattgccaaacaggagctgcttgaggccctcctggcgtggctccagtgggctgaaacgaccctcactgataaggataaagaggtgattccacaagagatcgaggaggtaaaggcactgatcgccgagcatcaaacgtttatggaggaaatgacccggaagcaacccgacgtggataaagtgaccaagacctacaaacggcgggcagcagatcctagctcccttcagtcgcatatccctgtactcgacaagggtcgtgccggccgcaagcggtttccagcaagttccctttatccgtccggcagccagactcaaatcgaaaccaagaatccacgggtgaaccttcttgtttccaagtggcagcaggtgtggctactcgccctggaacgacgccgaaagctgaacgatgctctggacagactcgaggagctgcgagagttcgctaatttcgactttgacatttggcgcaagaagtacatgagatggatgaaccataaaaagagccgggtcatggatttttttcggcgaatcgacaaggatcaagatggcaagataacaaggcaggagttcatagacggtattctgagtagcaagtttccaacctctcggcttgagatgtccgccgtggcggatatattcgatagggatggagacggctatatcgactactacgagttcgttgctgcccttcatcctaataaagatgcttataagcctatcaccgatgctgataaaatcgaggatgaggtcacccgacaagtggccaaatgtaagtgcgctaagaggttccaggtcgagcagatcggggacaacaaatatagattcttcctggggaatcaattcggcgattcccagcagctgagattggtgcgcatcctccgctcaaccgtgatggtgcgagtggggggcggctggatggctctggacgaattccttgtgaaaaatgacccatgtcgtgcgaaaggtcggaccaatatggaactcagagagaaattcattctggccgacggggcctcccagggaatggcggcctttagacccaggggaaggcgtagtagaccttcctctcgaggcgcttctcctaacagaagtacgagcgtgtctagtcaggccgcccaagctgcctccccccaggtgcccgccaccacaacacctaagatcctccacccccttacccgaaactatggtaagccgtggctgacaaactccaagatgtccacaccttgcaaagcagctgaatgttcggactttccagtgccatccgccgagggtacacccattcaagggtccaagctccgtttacccgggtacttgagtgggaagggattccactcaggtgaggacagcggcctaatcaccaccgccgccgctcgagtgcgcacacagtttgcagacagcaaaaaaacaccaagtaggccaggctcacgcgcagggagcaaagccggctcgcgcgcctcaagcagaagaggcagtgacgctagcgacttcgacattagcgaaatacagagcgtttgttccgacgttgagaccgtgccacagacccatcgccccacaccaagggcagggagcagacctagcacagctaagccttccaagattcccaccccccagagaaaatcaccagcgtctaaactggacaagagcagtaaacgttag

SEQ ID NO: 115314 - DNA, 12603 bp, Artificial Sequence
  Description of Artificial Sequence: Synthetic coding sequence
atggctggctacctcagtccggcagcctatctgtatgtagaggagcaggaatatctgcaagcctatgaggatgtgctcgagcggtacaaggatgaaagggacaaggttcaaaaaaagacgtttactaagtggatcaaccagcatttgatgaaagtgagaaaacatgtgaacgatctatatgaggatctgagggacggccacaatctgatctccctcctggaagtgctctcgggggatacactgcctagggagaaaggtcgaatgagatttcaccggctgcaaaacgtccaaatcgcgctcgactatctcaaacgtagacaggtgaagctggtcaacattcgcaacgacgacatcaccgacggcaacccaaaactgaccctgggtttgatttggacgatcattctacatttccagatctcggacatccacgtgactggagagtctgaagatatgtcagccaaagaaaggcttctcctatggacccaacaggctacagagggctacgccggtatacgctgtgaaaacttcaccacctgttggagagacggcaaattgtttaatgccatcattcacaaatacagacccgacctgatcgatatgaatactgtcgccgtgcagagtaacctcgccaatctagagcacgcattctatgtcgcggaaaagattggagtgattaggctgttggaccccgaagatgtggatgtgtcgtcgcctgatgagaaatcagtcattacctacgttagtagcttgtacgacgcttttcccaaagtgcctgagggaggggaaggaatcggtgccaacgacgttgaagtgaaatggatcgaataccaaaacatggtgaattacctgatccaatggatccgtcaccatgtgaccacgatgtcagagaggaccttccctaacaaccctgtggaactcaaagccctctataaccaatacttgcagttcaaagagactgagataccacccaaagagacagagaagagcaagatcaaacggttgtacaagttgcttgagatctggatcgagttcggccgcatcaagctcctccagggttatcatccgaatgacatcgagaaagagtggggaaagctaataatcgctatgctcgaaagagaaaaggccttaaggcctgaggtagaaagattggaaatgctgcagcagattgccaatcgggttcagcgggattccgtgatctgcgaggataagctcatattggccggcaacgcgctccagtcagatagcaagcggttggaaagtggagtgcagttccaaaacgaggccgagatcgctgggtatatactcgaatgcgagaacctgctgcgccagcatgtgatcgatgttcagattttgattgatggcaagtattatcaagccgaccagctcgtgcagagggtcgccaaactaagggacgagatcatggcactgcgaaatgagtgttctagcgtttatagcaagggccggatcctcactacggagcagaccaagctgatgatttccgggattactcagtctctaaattcaggcttcgcccagacgttgcacccttcactcacctccggcctgactcagtccctgaccccctctctcacctcaagttctatgacttcaggactcagcagcggaatgacatcgagacttacacccagcgtcacccctgcctacacaccggggttcccatctggcctggttccaaacttctcgtctggagttgagcccaacagtttgcagacattaaagctgatgcagatacgaaaacccttgctgaagagctcacttctggatcaaaatttaacggaggaggaaatcaacatgaagttcgtgcaggatctgctgaattgggtagatgagatgcaggttcagctcgaccggacagaatggggaagtgacttgccatccgtagaaagtcacttagaaaaccacaagaacgtgcatagggctattgaggagttcgaaagcagtcttaaagaggccaagatttccgagattcaaatgactgcacctctcaaacttacctatgcagaaaaactgcaccgcctggaaagccagtacgccaagctgctgaacacaagccggaaccaggagagacacttggatacgctgcacaatttcgtgagcagagcgaccaacgagctgatctggctgaatgagaaggaggaggaggaggtggcctatgattggtcagagaggaatacgaacatcgcgcggaagaaggactaccatgccgagctcatgcgggaattggaccagaaggaggaaaacatcaaaagtgtgcaggagattgcagagcaactactgcttgagaatcatccagcccgcctgaccattgaagcctatagggcagcaatgcaaacgcagtggtcctggatcctgcagctctgtcagtgcgtggagcagcatattaaggagaatactgcttattttgagttttttaacgacgcaaaagaagcaaccgactatttgagaaaccttaaagatgcaatccagcgaaaatactcatgtgatcgcagttcaagtatacataagctcgaagacttggtgcaggaaagcatggaagagaaggaagaactgctccaatataagtctacaatcgctaatctgatggggaaagcaaaaaccatcattcagctcaaacctcggaactcggactgcccactcaaaacatcaatccctatcaaggcaatatgtgactacaggcagattgaaatcaccatttataaggatgacgagtgcgttcttgctaataatagccacagagccaaatggaaagtcatctctccgactgggaatgaagccatggtgccctccgtgtgttttactgttccccccccaaacaaagaggctgtggacttggccaatcgcatcgaacagcaatatcagaacgttctgaccctgtggcatgagtcacatattaacatgaagtccgttgtgagctggcattatctaataaatgagattgatcgcatccgggcctccaacgtggcctcaattaaaacgatgttgcccggtgagcaccagcaggttctgtccaatctccagagccgattcgaggactttctggaggactctcaggaaagtcaggtgttcagcgggtcagatataacacagctagagaaggaagtcaacgtctgtaagcagtattatcaggagctgctgaagagcgctgaacgcgaagagcaggaagagagcgtttacaacctgtacatcagcgaggtacgtaacattaggttacgtttggagaattgcgaggatcggctgatccgccaaatcagaactccgctggaaagagacgacctccatgaatctgtgttccgcattaccgagcaggaaaagctgaagaaagagctggagcgtctcaaagacgacttgggtaccatcacaaacaagtgcgaagagttctttagccaagccgcggcctcatcgtctgtgccaacgcttagatcagaactgaacgtggtactgcaaaatatgaaccaggtgtattcgatgtcaagtacgtacatcgacaagttgaagactgttaatctggtgttaaagaatacacaggccgctgaagctttggtgaaactttacgagaccaaattgtgtgaagaagaggcggtcatcgctgataagaacaacatagagaatctcatctccacacttaaacagtggcggagtgaggtcgacgaaaaaagacaggtattccatgcgctcgaagacgagctccaaaaagctaaagcgattagtgacgagatgttcaagacatacaaggaacgggacctcgatttcgactggcacaaggagaaagccgatcagctggttgagcgctggcagaacgtgcatgtgcagattgacaatcggctccgtgacctcgagggaatcgggaaatcacttaagtactatcgcgatacgtatcaccccttggatgactggatccaacaggttgaaacaactcagcgcaaaattcaggaaaaccagccggaaaattcaaaaacgctcgctactcagctcaaccagcaaaagatgctggtttcggaaatcgaaatgaagcagtccaagatggacgagtgccagaaatatgctgagcagtatagcgcaacagtcaaggattacgaactgcagacaatgacctacagagctatggtcgattcccagcagaaatcccctgtgaagcgacgccgaatgcaatccagcgcagacctcatcattcaagaatttatggaccttcggacaagatacacagctctggtaactctgatgacccaatatatcaagttcgccggtgactccctcaagcgacttgaagaggaagagaagagtttagaggaagagaaaaaggaacatgtggaaaaagccaaggaactgcagaaatgggtatcaaatatttccaaaactttaaaagacgccgagaaggccggcaagccgcccttttctaagcagaaaatttcatccgaggaaatttcaacaaaaaaggagcagctctctgaagcactccagacaatccagctgttcctcgcaaagcacggggacaaaatgacggatgaggaaaggaatgaattggagaagcaggtcaagacactccaagagtcctacaacctcttatttagcgagagtctaaagcagttgcaggaatctcagacatctggtgacgtgaaagtcgaagaaaagctcgataaagtcatagcggggactattgaccaaacaacaggggaagtgttgtcagtgtttcaggcagtcctgcgcggattgatagattacgataccggcatcagattgctcgagacacaactgatgatcagtgggctgataagtcctgagctgcggaagtgtttcgacctcaaagacgccaaatcacatggattgattgatgagcaaatcctatgtcagcttaaagagctctctaaagcaaaggagataatttccgccgccagccctactaccatccctgtgttagatgccttggcccagagcatgatcaccgagtctatggccataaaagtgcttgagatcttgctgagcacaggatcactcgttatccctgcaaccggagaacagttgacactgcagaaagcatttcagcagaatctcgttagcagtgcccttttcagcaaggtgctggagcgacagaacatgtgtaaggacctgattgatccatgtacctccgaaaaggtttctttaattgacatggtgcagaggtctaccctgcaagagaatacgggaatgtggctcctaccagtacggccacaagaaggaggacggattacactaaagtgcggcagaaacatatccatactgagagctgcccacgaggggctcatcgatcgcgagactatgtttaggctgctgtctgctcaattgctgtcgggcggtttaatcaatagcaactctggtcagcgcatgacggtagaggaggcagtcagagagggtgtcatcgatagagacaccgcctcttccatcctcacctaccaggtgcaaactggaggaatcatacagtctaatccggccaaacggctgaccgttgatgaggccgtgcaatgtgacctgataacctctagctccgcccttcttgtgctcgaggcacaaagaggatacgtggggcttatatggccacatagtggcgaaatattccccacgtctagcagcctgcagcaggagttgatcactaacgagctagcctacaagatcttgaatggacgccagaagattgccgcgctgtacatccctgaatcttcacaggttataggtcttgacgcagcaaaacaactgggcatcatagataataatactgctagtatcctaaagaacattaccctgcctgacaaaatgcccgatttaggtgacctagaggcttgcaaaaacgccaggcgctggttgagcttttgcaaatttcaaccttcgactgtgcacgactataggcaggaagaggacgtgttcgatggggaggaacccgtaaccactcagacctcagaggagacaaagaaattattcttgtcatacctaatgataaattcctatatggatgccaacacaggccaacgcctgctgctctacgatggtgacctggacgaggctgtcgggatgttactggaaggttgtcacgcagaattcgatgggaatacagccatcaaagagtgtctggacgtcctcagctcatccggagtttttctgaataacgccagtggtagagagaaagatgagtgcacagccactccctcctctttcaataagtgccattgcggggagccagagcacgaagaaactccagaaaacaggaaatgtgctatcgatgaggaattcaacgagatgcggaacacggtgataaactcagagtttagccagtccggaaagttagcgtcaacgatttcaatcgatccaaaggttaacagcagtccaagcgtctgtgttccttcgctgatctcctatctaacgcaaactgaactggccgatatttctatgttgagaagcgattcggaaaacatcttgactaactacgagaaccagtcacgggtggaaacaaatgagcgcgcaaatgagtgtagtcatagtaagaacatccagaactttccgagcgacctgatcgaaaatccaatcatgaaatccaaaatgagcaagttctgcggtgtcaatgagactgaaaatgaggacaacacgaatcgtgattctcctatcttcgattattcacctcgcctgtccgccttgctgtcccatgacaagctgatgcactcacagggctctttcaatgacacccatacacctgagtccaacgggaacaaatgtgaagcaccggccttatctttctcagacaaaactatgctttcagggcagaggattggcgagaagttccaggaccaatttctcggcatcgccgcaatcaatatcagcttgcctggtgaacaatacggtcagaagtctttgaatatgatctcctccaacccgcaagttcaataccataatgacaaatacatttcgaataccagcggagaggacgagaaaacccacccaggcttccagcagatgcccgaggacaaggaggacgaatctgagattgaagagtactcttgtgcggtgacccccgggggcgacacagacaacgccatcgtgagtctcacatgcgctactcccctgctcgatgaaacgatctccgcctcagattacgaaacatcgctgctcaacgaccagcaaaataataccggcactgataccgactcagacgatgacttctatgacacacctcttttcgaggatgatgatcacgactcactgctcctcgacggagatgaccgtgactgcttgcaccctgaagactatgatacccttcaagaagagaatgacgaaaccgcgagccccgccgatgtgttttacgatgtgtccaaggagaatgagaattccatggtgccacaaggcgcccccgtgggtagtctcagcgtcaagaacaaggcccactgtcttcaggattttctcatggacgttgaaaaggacgagctggatagcggggaaaagatccacctgaaccccgttggcagcgacaaagtcaatggacagtccctcgagaccggcagcgaacgcgagtgtactaacattctcgagggcgatgagagtgactccctcacggattacgatattgtaggcggcaaagagtcattcactgcaagccttaaatttgacgacagcggaagctggagaggaagaaaggaggagtatgtgaccggccaagagtttcattccgacactgaccacctggactcaatgcagtcagaggagtcctatggggattatatctacgatagtaatgaccaggatgacgacgatgacgatgggattgatgaagaagggggaggcattagagatgagaacgggaagccacgctgccagaacgtcgccgaggatatggatatccagctctgcgcttctatcctgaacgagaactcggacgagaacgaaaacattaacacaatgatcttgctggataagatgcactcttgttcctcgctcgaaaaacagcagagggtgaatgtggtccagctggcctcccccagcgaaaacaatttggtaacagaaaagagtaatctcccagaatacacaacagagatagccgggaagtcaaaggagaacctccttaaccacgagatggttttgaaggacgtactgcctccaattataaaagacaccgagtctgagaagacctttggaccagcttcaatctcccacgataataataacatatcttccacctcagaactgggtaccgaccttgcaaacactaaggttaagctcattcaggggagcgagttgcccgaactgacggacagcgtgaaggggaaagatgagtatttcaagaatatgacgcccaaggtcgatagctccttggaccacataatttgcacagaacctgacctcatcggcaaacccgctgaagagtcccacctgtcattaatagctagcgtcacggataaagatccccaaggtaatggcagtgatctgatcaagggaagagacggaaagtcggacatcctcattgaggatgagaccagtatccaaaaaatgtacctgggagagggagaggtgttggtagaggggttggtggaggaagagaaccgccacttgaaacttcttcccggcaaaaacactagggattcatttaaactcataaactcacagtttcccttcccacagataaccaataacgaagagcttaaccagaagggtagtctgaaaaaggctactgtaaccttaaaggatgaacctaataacctccaaatcatcgtgagcaagtccccagtccaatttgagaacctggaggaaatcttcgacacatccgttagcaaagagattagtgacgatatcaccagtgatatcacaagttgggaaggcaatactcactttgaagaaagcttcactgatggccctgagaaggaactggacttgttcacgtatctcaaacattgcgccaaaaacatcaaggcgaaagacgttgcaaagccaaatgaggacgttccttcccacgtgcttatcaccgccccccccatgaaggagcatctccagttaggtgtcaacaacactaaggaaaagtcaacaagcacccaaaaggattccccattgaatgatatgatacagagcaatgacttgtgctccaaggaatcgatttcaggaggaggaaccgaaatatctcagtttacccccgaaagcattgaagccaccctcagcattttgtcacgaaaacatgtggaggacgtcgggaagaacgacttcctgcagtcggagaggtgcgccaatggcctgggtaatgataactcctcaaacacccttaatacagattattcttttctagagattaataataagaaggagagaattgaacagcagctgccaaaggagcaggccctgtcgcctagatcacaagagaaggaagtgcagataccagaactgagccaggtgtttgtagaagatgtaaaggatattctcaaatctcgtttgaaggagggccacatgaatccccaggaggtagaggagccatcggcctgtgcggataccaagatcctcatacaaaatctgattaagaggatcactacatcccagttagtcaacgaggcgagcaccgtgcccagcgattcccagatgtcagactcctccggtgtgagcccgatgactaattctagcgagctgaagcccgagtctcgcgatgacccattttgtattgggaacctcaagagcgagttgctactgaacattctgaagcaggatcagcactctcagaaaataactggcgtgtttgagctgatgcgggaactgactcatatggagtatgatttagaaaaacgggggatcacttcaaaagttttgccactgcagctcgagaatatattctacaagctacttgcagacggatatagtgaaaagattgagcacgttggagatttcaaccaaaaggcgtgctccactagcgaaatgatggaagagaaaccacatatcctaggtgatatcaaatccaaagaggggaattattactctccgaacctcgagaccgtcaaagagatcggcctggagtcaagcaccgtatgggcctcgactctgccacgcgatgaaaaactgaaggatctatgcaacgacttcccaagtcatctggagtgtacatcaggcagcaaggaaatggcatctggggactcctccacggagcagttcagtagcgaattgcagcagtgcttgcagcacacggagaaaatgcatgaatacctcacactcctccaagatatgaaacctcccctggacaaccaagaaagcctggataataacttggaagccctaaagaatcagcttcggcagctggagaccttcgaactggggcttgcacccattgctgtgattctgcgaaaagacatgaaactggccgaggagtttctgaagagcctgcctagtgacttccctcggggccacgtcgaagagctttccattagccaccagtctctgaagaccgccttttcttctctttccaacgtttccagtgagcggacaaaacagattatgcttgcaatagattcagaaatgagtaagctggctgtaagtcatgaggagttcctgcacaagttgaagagtttttcagattgggtctccgaaaagagcaagtccgtaaaagacatcgagattgttaatgttcaggactctgagtacgttaagaagcgcctagagttcctcaagaacgtcctgaaggacctgggccacacaaaaatgcagctggaaactactgcctttgacgtgcagttcttcatttcagagtacgcacaggacctgtctcccaaccaaagtaaacagctcctccgattgctcaacactacccagaaatgtttccttgacgtgcaggaaagtgtaacaacccaagtcgagcggttggagacccagctccatctcgagcaggatctggatgaccagaaaattgttgccgagagacagcaagaatacaaggaaaagctgcaaggcatttgtgacttgctgacgcagacagaaaatcggttgatcgggcaccaggaggcttttatgattggagacggcactgtcgagctcaagaaataccagagtaaacaggaggaactgcaaaaggacatgcaggggagcgcacaagcccttgccgaagtggttaaaaacactgaaaacttcctaaaggaaaacggcgaaaagctgagtcaggaggataaagccctgattgagcagaagctcaacgaagccaaaatcaaatgtgagcagttgaacctcaaagcagagcagagtaaaaaagaactggataaggtcgttaccactgccatcaaagaagagaccgaaaaggtcgccgctgtcaagcagctggaggagtcaaagaccaagatcgaaaacctgcttgattggctgagtaacgttgacaaggacagtgaaagggcagggacaaaacacaaacaggtcatcgagcagaacggtactcacttccaggaaggcgacggaaaaagtgcaatcggcgaggaggatgaggtgaacggcaacctacttgagaccgatgtggacggtcaggtggggacaactcaagaaaacctaaatcagcaataccaaaaagtgaaggcccagcatgaaaaaatcatatcccagcatcaggcggtaataatcgccacacagagtgcacaggtactgctggaaaaacagggccagtacctcagccccgaagagaaagagaagctgcagaaaaatatgaaggaattgaaggtgcattatgaaacagccctggcagagagcgaaaaaaaaatgaaactgacccacagcctccaggaagagcttgagaagtttgatgccgattacactgaattcgagcactggctgcagcagtctgagcaggaactcgagaacctcgaggctggggcagacgatattaacgggctgatgactaaactcaaacgccagaaatcattttcagaggatgtcatttcccacaagggcgaccttaggtacattaccatctctggcaatcgggtactggaagctgcgaagtcctgtagtaagagggatggggggaaggttgatactagcgccacacacagagaagtccaacgcaaacttgatcacgctaccgacagatttagatcgctgtatagcaaatgtaatgtactcggaaacaatctcaaagatctggtggacaaataccagcactacgaagacgcctcgtgtggactgctcgcaggattgcaggcctgtgaggctacggcatcaaagcatctatctgagcccatcgccgtagatcccaaaaatttgcagaggcagctcgaagagactaaggctctgcagggccagatctcatcacaacaggttgccgtggaaaagcttaaaaaaacagccgaggtgctgctcgacgcacggggttccttgctgcctgcaaagaacgatatccagaagacactcgatgatatcgtggggaggtatgaggatctgtcaaagtccgtcaatgaaaggaacgagaagcttcaaatcacactcacccggtcactcagcgtccaagacggcctcgatgagatgctcgattggatggggaatgtggagtcctccctgaaggaacaggatgtcggcaccgggtactgtaggagcagtgaacagtataagtgccatgagtag

SEQ ID NO: 115315 - DNA, 22386 bp, Artificial Sequence
  Description of Artificial Sequence: Synthetic coding sequence
atggctggatatctgtctcccgcagcctacctgtatgttgaggagcaggaatatctacaagcatatgaggacgtcttagaacgctataaggatgagagggacaaagtgcaaaagaaaacatttaccaagtggatcaaccagcacctgatgaaagtgcgaaagcatgttaacgatctgtacgaggatctccgggacggccataatcttattagcttgctggaagtcctgtccggagatactcttccgcgagaaaaaggtaggatgcgattccataggctgcagaatgttcagatcgcactggactacctcaagagacggcaggtgaagcttgtgaatataagaaacgacgacatcacagacggcaaccctaagctcaccttaggtctgatctggaccatcatcctacactttcagatctccgacattcacgtcaccggtgaatcagaggacatgagcgcgaaagagcggctactgttgtggacccagcaggctaccgaaggatacgctggcattcgctgcgagaactttaccacctgttggcgcgacggcaagctgttcaacgccatcatccataagtacagaccggatctgatcgacatgaacacggtggcggtgcagtctaaccttgccaacttggaacacgcattctatgtcgctgagaaaattggagtgatcagattactcgatccagaagatgtggacgttagcagccccgacgagaagagcgtgatcacctacgtctcatctctgtatgacgcctttcctaaggtccccgagggcggggaaggaatcggggccaacgacgtggaggttaagtggatagaatatcagaatatggtcaactacttaatacagtggatccggcaccatgtaaccacgatgagcgaaaggacatttccaaataaccctgtggagttgaaggccctgtacaaccaatatctgcagttcaaagagaccgagattccacccaaggaaactgaaaagtctaaaatcaaaagactgtacaagcttttagaaatctggattgagtttggacggataaaactgctacagggctatcatcccaacgacattgagaaagagtggggcaaactcatcattgctatgctggagcgagaaaaggctctgaggcctgaggtggagcgtcttgaaatgttgcaacagatcgctaacagggtacagagagattcagtgatctgtgaggataagctgattttagcagggaatgcactccaatccgactcgaagagacttgaatcaggagtccagttccagaatgaggctgagatcgccggatacatcttggagtgcgagaatctactcaggcagcatgtgatcgacgtgcagatccttatcgacggaaaatattaccaggccgatcagctggtgcaacgagtggccaagttgagggacgagatcatggctctgaggaacgagtgctcatcggtgtatagcaagggaagaattctgaccaccgagcagactaaactaatgattagtggcatcactcagtctctgaatagtggtttcgcgcagacactgcaccccagccttacatctggcctcactcaatccctaactccaagtcttacctctagctccatgacctcaggcctgtcctcagggatgacatcacgtctgacaccatctgtaacgcctgcgtatacacccgggttcccctccggcctcgtgccgaatttcagctccggggtggaaccaaatagtctccagaccctgaagctgatgcagatcaggaagccgttgctaaaaagctcacttctggaccagaatctcactgaggaggagatcaatatgaaatttgttcaagacctgttaaattgggtagatgaaatgcaggtgcagcttgacaggacagagtggggctctgatctgccttcagtagagtctcatctagaaaatcacaaaaatgtacacagagcaatagaggaatttgagagctcactgaaggaggctaaaataagcgagatccagatgacagcaccactgaagctgacatatgccgaaaaacttcaccgccttgagagccagtatgccaagctgctcaacacttctagaaaccaggagaggcaccttgacactctgcataatttcgtcagtcgagccactaatgaactgatttggctcaacgaaaaggaagaagaggaagtggcatatgattggagcgagcgtaacacaaacatcgcacgcaaaaaagattaccacgccgagctcatgcgtgaattagatcagaaagaagaaaatataaagtccgtgcaagaaatagccgagcagctgttactagagaaccaccctgctagactgaccattgaagcctaccgggccgccatgcagacccaatggtcatggattctgcagctgtgccagtgtgttgaacaacatatcaaagagaatactgcttacttcgaatttttcaacgatgctaaagaggctaccgattatctgcgcaatctcaaggacgccattcaaagaaaatacagctgcgaccggagctcgagcatacacaaactggaagatttagtgcaggaatccatggaggagaaggaggagttactccagtacaaatccactatcgctaaccttatggggaaagcgaagacgataatccagctcaagcctagaaattccgattgccctttgaaaacgtcaatccccatcaaggccatctgtgactatcgccaaatagagattacgatttacaaagacgatgagtgcgttcttgcaaataattcccatcgggcaaaatggaaagtcatctctcccaccggcaacgaagcgatggttcctagcgtctgtttcacagtcccacccccaaataaggaggccgtcgacttggctaacaggatcgagcagcagtatcagaacgttcttacgctgtggcacgagtctcatataaacatgaaatctgtggttagctggcactacttaatcaacgagattgatcgaatcagggcatctaacgtggcttccatcaagacgatgttgccaggcgaacaccagcaggtcttgtccaatctccaatcccgctttgaggacttcctggaagacagccaggagagccaggtgttctcaggctcggatataacccagctcgaaaaagaagtgaatgtctgtaagcagtattaccaggaactgctcaaaagcgccgaaagggaagagcaggaggaaagtgtttataatttgtatatttcagaagttcggaatatcagactgcggctggaaaactgtgaggacaggttgataaggcagatccgcacacccttggagcgcgacgatttgcatgaaagcgtctttcgaatcactgaacaagagaagctcaagaaagagcttgagcggctgaaggacgatcttggcaccattacaaacaagtgtgaagagtttttctctcaagctgctgcgtccagctctgtccctacccttcggtcggagctgaacgtggtgctccagaacatgaaccaggtgtactccatgtcaagtacatacatagataaactgaagaccgtcaatctggtcctcaaaaacacccaggcagcggaggccctggtgaaactttatgagaccaagctctgtgaagaggaggcagtgatcgcggacaaaaacaatatcgagaatttaatcagcacgctgaagcagtggagaagcgaggtggacgagaagcgccaagtgtttcacgccctggaggacgagctgcagaaagctaaagccataagtgatgagatgtttaaaacatataaagagcgggacctcgatttcgattggcataaagaaaaggccgaccaattggttgagaggtggcaaaacgttcacgttcagatcgacaataggttgcgcgacttggagggcatcgggaagtccttgaagtactatagagatacctaccaccctctggacgactggatccagcaggtcgagaccactcagcgcaagattcaggaaaaccagcccgagaattctaaaaccttggccacgcaacttaatcagcagaaaatgctggtctccgaaatcgaaatgaagcagtccaaaatggatgagtgtcaaaaatacgccgagcagtactccgcgactgtgaaagattacgagctccagacaatgacttatcgagctatggtggattcacagcagaagagccctgtaaaacgccgcagaatgcagtcctccgcagatttgatcatccaggaatttatggatttgcggactcgctataccgcactggtgacactcatgactcagtatattaagttcgcaggggatagcctgaaacgcttagaggaggaggagaagtctctggaagaggagaagaaggagcatgtggagaaagccaaggagctgcagaaatgggtgtcaaatatctcgaaaaccctcaaggacgccgagaaagctggcaagcccccgttctccaagcaaaaaatctcatcagaggaaatctccaccaaaaaggagcagctgagtgaagcccttcagactatccagctcttcttggccaaacatggagacaaaatgactgatgaagagaggaacgaactcgagaagcaagtcaaaacattgcaggagtcttacaatctacttttctcagagtctctaaaacagctgcaagagtcccagacaagcggggatgtcaaggttgaggagaagctggataaggtgattgcaggcacaatagaccagaccacaggcgaagttttgagtgtgtttcaggcggtgcttagaggattgattgactacgatacaggtattcgtctgctcgaaacccagttgatgatcagtggcctgatatcccccgaattacggaaatgcttcgacttaaaggacgcaaagtcacatggactgatcgacgagcagatcctgtgccagctaaaggaactctctaaggcgaaagagatcattagtgcagcctcgcccaccacgatcccagtgctggacgctctggcacagtctatgatcaccgaatctatggctattaaagttctagaaatcctcctaagcacaggttcactcgtgatacctgcgaccggcgaacagctgacactccagaaggccttccagcagaacctcgtttcctcagcattgtttagcaaagtgctggaacgccagaacatgtgcaaagaccttattgacccctgcacaagcgaaaaagtatcactaatcgatatggtccagaggagtaccctgcaggaaaataccggaatgtggttactgcccgtcagaccacaggagggaggacgtattactctgaagtgcggaagaaacattagcatactgagagcagcacacgagggcttaattgacagagaaacaatgttcagacttcttagcgcccagttgctttctgggggactaattaattctaattcgggccagaggatgacagtggaagaggctgtcagggagggcgtaatagaccgagacacagctagttccatcctcacgtatcaggtgcagacaggcgggataattcagagcaatccagccaagcggttgactgttgatgaagcggtgcagtgtgacctgataactagttctagtgcgttactggttctggaggcccaaaggggctacgtcgggcttatctggcctcactccggcgagatcttcccgacatcttcgagtctccagcaggaactgatcacaaatgagctagcctacaagatactgaatggtaggcagaaaatcgcagccctctatattcctgaaagctcccaagtgatcggactggacgcagcaaagcagctgggcattatagataacaataccgccagcatcctgaagaatattactttgcctgataagatgccagatctgggggatctggaggcctgtaagaatgcccgaagatggctcagcttctgcaagttccaaccgtcaaccgttcacgattaccgacaggaggaggatgtttttgacggtgaggagcctgtaactacccagaccagtgaagagacaaaaaagctttttctgtcttacctgatgataaatagctatatggacgccaacacgggccagcggctgctgttgtacgatggagacctggatgaagctgtaggtatgctccttgaaggatgccacgccgagtttgacggaaataccgcaattaaagagtgccttgatgtgctctctagtagcggagtgttcctgaataatgcctctgggcgtgaaaaagacgaatgcacggccacgcctagcagtttcaataaatgccattgtggtgaaccagaacatgaggagacacctgagaatcggaagtgcgccatcgacgaagagtttaatgagatgaggaataccgttattaattccgagttcagccagtcgggaaaactcgcaagcacgatcagcatcgatcctaaggtaaactcctcaccatccgtgtgcgtgccatccctgataagctacctgacccagaccgaactcgcagatattagcatgctgagatccgactcagagaatattctcaccaattatgaaaaccagtccagagtagagactaatgaacgagccaatgagtgcagccactccaagaacattcagaacttcccatccgatctgatcgagaatcctattatgaaaagcaagatgtctaagttttgtggagttaacgagacggagaacgaggataatactaatagggactcccctatttttgactactctccccgcctgagtgccctcctgtcccatgacaagttgatgcattctcaaggctccttcaacgacacacacacccccgagtcaaatggaaacaagtgcgaggctcccgccctgtctttcagcgacaaaacaatgctatctggtcagcgaatcggcgagaaatttcaagaccaattcctgggcatcgccgctatcaacatctctctgccgggcgaacaatacgggcagaagagtctgaacatgatatcctctaacccgcaggttcagtatcacaacgacaagtacataagtaatacgtcaggcgaagacgagaagacacatccagggttccagcagatgccagaggataaagaggatgagagcgagatcgaggaatacagttgtgcagttacacccggcggagataccgataacgccattgtgtctttgacctgtgctactcccttactggatgaaaccatttctgcaagtgactacgagaccagccttttaaacgatcaacaaaacaatacaggaactgacacggacagtgacgatgatttttatgacacgcctttattcgaggatgacgaccatgattcccttctgttggacggggacgaccgggattgtctgcacccggaagactacgatacgctgcaagaggagaatgacgaaaccgcctcaccggcagacgttttctacgacgtgtctaaggaaaatgaaaacagcatggtgcctcaaggcgcaccagttgggtcattgtcggtgaaaaacaaggcacactgcctacaagactttctaatggatgtcgaaaaagatgaactggatagtggggaaaagattcacttgaatccggttggatcagacaaggtaaatggacagtctctggagaccgggagcgaaagagagtgcactaacatcctagaaggcgatgagtcagattccctgactgactacgatatcgtgggtggtaaggagtctttcactgcttctttaaagtttgacgacagcggttcatggagaggacggaaggaagaatatgttaccggccaggaatttcacagtgatacagaccacctagattcaatgcagagcgaggagtcctacggcgattatatttatgattcaaacgatcaggacgatgatgatgatgacggcatagacgaggaaggaggaggcattcgggacgagaatgggaagccaagatgtcagaacgtcgcagaggatatggacatccaattgtgtgcttccattctaaacgaaaactcagatgagaatgagaatatcaacacgatgatccttctagataaaatgcattcgtgctccagcttggaaaaacaacagcgcgtaaatgttgttcagttggctagcccatcagaaaataacctggtcacagagaaaagtaacctgcccgaatacaccaccgagatagccggaaaatccaaggagaacttgctgaaccatgagatggtgcttaaggatgtcttacctcccatcatcaaggacacggaatccgaaaagactttcggacccgctagtatcagccatgacaacaacaatattagttcaacttccgagctggggactgatctagctaatactaaggtgaagttaatccagggcagtgaattgccggagctgaccgattcagtgaaaggtaaagacgagtactttaagaacatgaccccgaaagtcgacagtagcctggatcacataatctgcacggaacctgatctgattggcaaacctgcagaggaaagccacctaagtctgatcgcctctgtgaccgataaggatcctcaggggaacgggagcgacctgatcaaggggcgagacgggaagtcagatatcctgatagaagacgagacctctattcagaagatgtacttgggcgagggggaagttctggtagaagggctagttgaagaggaaaacagacatcttaaactgctccccgggaagaacactcgggattcattcaagcttatcaacagtcagttcccctttccacagattaccaataacgaggagctgaatcagaagggttctctaaaaaaggccactgtgaccctgaaagacgagccaaacaatcttcaaattatcgtaagcaagtcccccgtccaatttgagaacctagaggagattttcgacactagtgtgagcaaagaaatctcggatgacattacgtcggatatcacctcctgggaaggtaatactcatttcgaggaatccttcaccgacggccctgaaaaggaacttgacctgttcacttacctcaagcattgtgcaaagaacatcaaagctaaggacgtggccaagccgaatgaggatgtgccttctcatgtgttgattaccgcaccgccgatgaaagagcatttgcagctcggtgtcaacaacactaaagagaaaagcacatcaacccaaaaagatagcccactgaacgatatgatccaatccaatgacctatgtagcaaggaaagcatttccgggggcggcacagagatttctcagttcacaccagaatctatcgaagcaaccctgagcattttgagtaggaagcatgtggaagacgtgggaaagaacgacttcctacagtcagagagatgtgccaatgggctgggtaacgataactcaagtaacacacttaacacagactacagctttctcgaaatcaacaacaagaaggagcgcatcgaacagcaacttcccaaggagcaggctctgtctcctagatctcaagagaaagaagttcagatcccagaactcagtcaggtgtttgtagaggacgtgaaggatattcttaaaagtagacttaaagagggccatatgaaccctcaggaggtggaagagccctcagcttgtgccgacaccaagattctgatccagaacttgatcaaaaggattaccacaagtcagctggtgaacgaggcctcaactgtgccaagcgattcacagatgtctgactcatcaggcgtcagtccaatgaccaatagctcagaactgaagcccgaatcaagagatgacccattctgcattggcaatctgaagagcgagctgctattaaatattttaaagcaggatcaacatagtcagaaaataacaggagttttcgagcttatgcgtgagcttacacacatggagtatgacctcgaaaaaaggggcattacttcgaaagtcttaccactgcagctcgaaaacatattttacaagctcctggcagatggctattcagaaaagattgagcatgtaggcgatttcaatcagaaagcctgctccacttccgaaatgatggaggagaaaccccacatcctgggtgacatcaagagtaaagaaggcaattactattctcccaacctggaaacagtgaaggagattggactagagtcatccacggtttgggcctccactctaccccgggatgaaaaattgaaggatctgtgcaatgattttccgtcccacctggaatgtacaagcggtagcaaggagatggcctcgggggactcaagtacagagcagttctctagcgagctgcaacaatgtttgcagcacactgaaaaaatgcacgagtacctcacactgctgcaggacatgaagcctcccctggacaatcaggaatcattggacaacaatctggaggccctcaaaaatcagctccgacagctcgaaaccttcgagcttggcttagctcctattgcagtaattctgcgcaaggacatgaagctcgcagaggaattcttgaaatcactaccaagtgattttccccgcggacatgtggaggaattgtccatctcacatcagagtctgaagactgctttttcatccttgtccaatgttagttctgagaggaccaagcagattatgttggccatcgactcggaaatgtccaagctggcagtttctcacgaggagtttctccacaagctgaaatcgtttagcgactgggtatccgagaagtcaaaatcagtgaaggatatagaaatcgttaatgttcaggacagtgagtatgtgaagaagcgactcgagtttctgaagaacgtgctgaaagacctgggtcacacaaaaatgcaactagaaactactgcttttgacgtgcagttctttatctctgaatacgctcaggacttatcccctaatcagagcaagcagctcttgcgactgctgaatactacccagaagtgctttctggatgtgcaggaatctgtgactactcaggtggagagattggaaactcagcttcaccttgagcaggatctggatgaccagaaaattgtggccgaaaggcagcaggaatataaagaaaagctccagggcatctgcgaccttctgacacaaactgaaaaccgtctgatcgggcatcaggaagccttcatgattggggacgggactgtcgagctgaaaaagtaccaatccaagcaggaggagttacaaaaggatatgcaaggtagcgcacaggccctcgccgaagtggtcaaaaatacagaaaacttcctcaaagaaaacggggagaagctctctcaggaggataaggcactaatcgaacagaagcttaatgaagccaaaattaaatgcgagcagctgaacttgaaagcagaacaatctaagaaggagttggacaaagtcgtcacaaccgccatcaaagaggagacagagaaggtggccgccgtcaagcagctcgaggaaagtaagacgaagattgagaacctactggactggctatctaacgtagataaggatagtgagagagctgggacgaagcataaacaggtgatcgaacagaacgggactcacttccaagagggagacggaaagagcgcaatcggagaagaagacgaggttaacggcaaccttttagagaccgacgtggatgggcaagtgggaaccactcaggagaatctaaaccagcagtaccagaaagttaaggcccagcacgagaaaattatttcacagcaccaggctgtgatcattgcaacgcaaagcgcccaggttctgttggagaagcagggacagtatctgtcacccgaagagaaggagaagctgcagaagaacatgaaagaactaaaggtgcattatgaaacagcactggcagaatcggagaagaagatgaagctgacacacagcctgcaggaggaactggaaaaatttgatgcagattatacagagtttgaacactggctccagcagtccgagcaggagcttgaaaaccttgaggccggcgcggatgacatcaacggcctcatgaccaaactcaagagacagaaatctttctccgaggacgtcatcagccacaagggcgatttacgctatattaccatctcaggaaatcgggtgctggaggccgccaagagttgtagcaaacgtgacgggggtaaggtggacacaagcgccacgcaccgcgaggtccagcgcaagctcgaccacgccaccgacaggtttaggtctctgtactcaaagtgcaatgttctcggcaacaacctcaaggacctggtggacaaatatcagcactatgaagatgccagttgcggtctgctagccggcctccaagcctgtgaggcaacagcgtccaaacatctatcagagccaatcgcagttgatcccaagaacctgcagcggcagcttgaggagaccaaggctttacagggacagatcagttctcagcaggtggcagttgagaaacttaagaaaacagctgaggttctcttggatgccaggggttcgttgttaccagcgaagaatgatattcagaaaacccttgatgacatagtgggccggtacgaggatttaagcaagtccgtgaatgagcgcaacgaaaagctccagatcaccctcactcggtctctctctgtccaggacggccttgatgagatgttggattggatgggcaacgttgagagcagccttaaagagcaagggcaggtccctctcaatagcaccgcgctgcaagatattatctccaaaaatatcatgctcgagcaggatatagcgggccgtcagagttctattaacgcaatgaacgaaaaagtcaaaaaatttatggagactacagatcccagtactgcctcttctctccaggcgaaaatgaaagatctatccgccaggttttcagaggccagtcacaagcacaaagagaccctggctaagatggaggagttaaagaccaaggtcgagctttttgaaaatctcagcgaaaagctacagacatttttggagactaagacccaggccctcacagaagtcgacgtgcctggtaaggatgtgactgaactgtctcaatatatgcaggaaagtacctccgagttcctcgagcataaaaagcatctggaggtgctgcattctctgctaaaagaaatctcaagccacggattacccagcgacaaggcactggtcttagagaagacaaacaacctctctaagaaattcaaggagatggaagacactatcaaagaaaaaaaggaggccgtcacttcttgtcaggaacagctggatgcttttcaagtgttagtgaagagcctgaagagctggatcaaagagaccaccaagaaggtgccaattgtccagccaagtttcggcgccgaggacctaggcaagtctctggaagacacaaagaagctgcaggagaagtggtctctgaaaacacccgaaatccagaaagtcaataatagtggaatttccttgtgtaacctgatctccgcagttactaccccagcaaaggccatcgcagctgtgaaaagcggcggtgctgtgttgaacggagagggaacagcgactaacaccgaagaattctgggccaataaaggactgaccagtatcaagaaggatatgaccgacattagccacgggtacgaggacctgggcctgttgctgaaggataagatagcagaactgaacactaagctctccaagctccagaaggcgcaggaggaatctagcgccatgatgcagtggctccaaaaaatgaataagacagctaccaagtggcagcagactcctgcccctactgacaccgaggcagttaaaacacaagtggagcagaacaagtctttcgaagctgaactgaagcaaaatgttaacaaagtgcaagagctcaaagacaagctgacagagctgctggaagaaaacccggatacaccagaagcccctcgttggaagcaaatgttaactgagattgattctaaatggcaggaactaaatcagctgacaattgatcggcagcagaagctagaggagtcaagcaacaaccttactcagttccagacagtagaggcgcagcttaaacagtggttagtggaaaaagagttgatggtgagtgtactggggccactctcaatcgatcctaatatgctcaatacacagagacagcaggtgcagatcctcttacaagagttcgccaccagaaaacctcagtacgaacaactgacagctgctggtcaggggatactttctagaccaggagaggatccctcgctgcggggaatcgtcaaggagcagttggccgccgttacacaaaaatgggattcactgaccggccagctctctgaccggtgcgattggattgatcaagccattgtgaaatccacccaataccagtccctgttgcgcagcctgagtgacaagctatctgatctcgataataagctgagctcctcactggcggttagcacccacccagacgcgatgaatcagcagctggagaccgctcaaaagatgaaacaagagattcaacaggagaaaaaacagatcaaggtggctcaagccttatgcgaggacctgtccgcccttgtgaaggaggaatatctgaaggctgagttgagccggcagcttgaaggaattctgaagagctttaaggatgtcgaacagaaggccgaaaaccacgtgcaacacctgcaatccgcctgcgcctctagtcaccagttccaacagatgagccgtgatttccaggcatggctggacaccaaaaaagaggagcagaataagagtcaccccataagtgccaaacttgacgtgctggaatcactgataaaggatcataaggacttcagcaagaccctcactgcccaatcccacatgtacgaaaaaactatagctgaaggagaaaatctcctcctcaagacgcaggggagcgaaaaggccgcccttcagttgcagctgaacactatcaagaccaactgggatacttttaacaaacaggtcaaggaacgagaaaacaagctgaaagagtcgctggagaaagctctaaagtataaggaacaggtggagacgctatggccctggatcgataagtgccagaataaccttgaagagattaagttctgcttggacccagccgaaggtgaaaattccattgctaagctgaaaagccttcagaaggagatggaccagcactttggcatggtcgaacttctcaacaacactgccaacagcttactgtctgtgtgcgagatagacaaggaagtcgtcaccgacgagaataagtccctgattcaaaaagtcgatatggtgaccgaacagctgcatagcaagaagttttgtctcgaaaacatgacccagaaatttaaagaattccaggaggttagcaaggagtccaaacgacagttgcagtgtgccaaggaacagctggacatccacgactccctggggtcccaggcttactcaaataaatacctgacgatgctccaaacgcaacagaagtcactgcaagccttaaagcaccaggtggaccttgcaaagagactggctcaggacctggtggtcgaggctagcgatagcaaagggactagcgatgtattgctacaggtcgaaacgatagctcaggagcactccactcttagccagcaggttgatgaaaagtgttcgtttctggagaccaagttacagggtatcggacactttcagaataccatacgcgaaatgttctcccaattcgctgagttcgacgatgagctcgactctatggccccagtaggacgcgatgctgagactcttcagaagcagaaggaaacgatcaaagcatttttgaaaaagcttgaagcattaatggcaagcaacgacaatgccaataagacctgcaaaatgatgctagccacagaggagacttctcccgacctggtgggcatcaaaagagacctggaggcattatcaaaacagtgcaataagttactcgaccgggcgcaggcacgggaggagcaggtggagggcaccatcaaaaggctggaggagttttactccaaactaaaggagttctccatcctgcttcagaaggcggaggaacacgaagagagccaaggacctgtaggcatggaaaccgagacaatcaaccaacaactaaacatgttcaaggtgttccagaaagaggagatcgaacctctacagggcaagcaacaggacgtgaattggctgggtcagggcctgatccaaagcgcagcaaaaagcacttcaacgcaaggcctcgagcatgacctggacgacgtgaatgccagatggaaaacacttaacaaaaaggttgcccagcgagcggcccagttgcaggaggctttactccactgtggccggttccaggacgccctggagagcctcctcagctggatggttgatacagaagaactcgtagccaaccagaagcctccctcagctgaattcaaagtagttaaggcacagatccaggagcagaagctcttacagaggctgttggatgaccggaaaagtacagttgaggtgatcaaaagggagggcgaaaagattgcgacgaccgcagaaccggccgataaggtgaaaattttaaagcagctgtctcttttggattcacgctgggaggcactgttgaacaaggcagagactaggaatagacagcttgaggggattagtgtggtggcacagcagtttcatgagactttagaacccctgaacgagtggttaacaactattgaaaagcggctagttaactgtgaacccatcggaacccaagcctcaaaactggaagaacagatcgcccaacacaaggtgttgcaagaggatatacttctgaggaaacagaatgttgatcaggcactgctgaacggactggagctcttaaagcaaacaacaggtgatgaggtgttgatcatccaggataaacttgaggccattaaggctagatacaaggatattactaaattaagcactgatgttgccaaaacccttgagcaggccctgcagttggcacgccgtctccatagtactcacgaggagctgtgtacctggttggataaagtggaggttgaactcctatcctacgaaactcaggtcctgaaaggcgaagaggcctctcaggcgcagatgcgacctaaagagctgaaaaaagaagcgaaaaataataaggccctcctggattctctcaacgaagtgtccagtgctctgctggagctcgtcccctggcgggcccgagagggactggagaaaatggtcgcggaagataacgagagatatcgccttgtgtcagacactatcactcagaaggttgaagagatcgacgccgcaatcctcagaagtcagcagttcgaccaagcggccgatgctgaactctcttggattactgaaaccgagaaaaagcttatgtcactgggggatatcagactggagcaggaccagacttctgcacagctccaggttcaaaagacatttaccatggagattctgaggcataaagacatcattgatgacctggtcaagtccggtcacaaaattatgaccgcttgtagcgaggaggaaaagcaatccatgaagaaaaagctcgataaagtgcttaaaaactatgacactatctgccagattaactctgagagatacttacaactggaacgcgcacagtcattagtcaaccagttttgggagacgtatgaggaactgtggccatggttgacagagacgcagtcaataatttctcaactgcctgcaccggcattggagtacgaaactctgcggcaacagcaggaggaacatagacagctccgcgaacttattgcagagcacaaaccacacattgacaagatgaataagaccggaccacaactcctcgaactgtcccccggtgaaggtttcagtatacaggaaaagtatgttgcagccgacacgctctattcacaaatcaaggaagatgtcaagaagcgagccgttgccctggacgaagccatctctcagagtacccaattccatgacaaaatcgaccagatcttggagtcgttagaaagaatcgtcgagcgactgagacagcccccgagcatatctgctgaagtcgaaaaaataaaagaacagattagtgaaaataagaacgtctccgtcgacatggagaagctgcagcctctatacgaaacactgaaacagaggggtgaggagatgattgctcgttctggcggaaccgacaaggatatcagcgctaaggccgtgcaggacaagctggaccaaatggtgttcatctgggagaatatacacactttggtcgaggagcgcgaggcaaagctgttagacgttatggagctggccgaaaaattctggtgcgatcacatgtcacttattgtaactatcaaggatacccaagacttcatacgcgacctcgaggaccctggaattgacccctcagttgtcaaacaacagcaagaggcagctgaaaccattagggaagaaatcgatggtctacaggaagagctggacattgtaatcaatctgggctccgaactgattgcagcctgtggcgaacccgataaaccgatcgtgaagaaaagcattgatgagctcaattctgcatgggattcacttaataaagcctggaaggatcgaattgataagcttgaggaggcgatgcaagcggctgtccaataccaagatggactccaagccgtgtttgattgggtggacatcgctggggggaaattagcatcaatgagccccatcggaaccgacttagaaaccgtgaagcagcaaatagaagagctgaaacagtttaaatctgaggcttaccagcagcagattgaaatggaaaggctgaaccaccaagccgagctgcttctcaaaaaagtcacagaggagtcagataagcacacagtgcaggatcctctgatggagttgaagctgatctgggacagtctggaagagcggatcattaaccggcagcacaaactggaaggagcactgctggcattgggacagttccagcacgccctggacgagctgcttgcctggctcacccatacagagggtcttttatcagaacagaagcccgtcggcggagatccaaaggcgattgaaatcgaattggcaaaacatcatgtactgcagaacgacgtacttgcccatcaaagtacagttgaggccgtgaataaggctggcaacgacctcatcgaaagttccgccggcgaggaggcttctaacctgcagaacaagttagaagtgcttaaccaacgatggcaaaatgttctcgaaaaaacagaacaaagaaagcaacagctggatggcgctctgcggcaggctaagggattccacggtgagattgaagacctgcagcaatggttaactgacacagaacgacacctcctggcttcgaaaccactcggcggactgcctgagaccgccaaagagcagttgaacgtgcacatggaagtgtgcgctgctttcgaggccaaagaggagacctataagtctctcatgcagaaaggccagcagatgctcgccaggtgtccaaagtcggcagagaccaacattgatcaggacatcaataatttaaaagagaagtgggaatccgtcgaaactaagctcaatgaaagaaagacaaaacttgaagaggctctcaatcttgccatggaattccataattctctgcaagacttcatcaactggctgacccaggcagagcagaccttgaacgtagcaagtaggcccagtcttattctggacacagtgctttttcagatagacgagcacaaggtctttgctaacgaggtgaattctcaccgcgagcagataattgaactcgacaagacaggcacacacctaaagtattttagtcagaagcaggatgtggttctcataaaaaatctactgatctctgtccagtcccgctgggagaaggtggttcagagattagtcgaacgcggcagatcgctcgacgatgcccgcaagcgtgcaaagcaattccacgaagcatggtcgaagttgatggagtggcttgaggaatctgagaagtcgctggatagcgaactcgagattgcaaacgaccctgacaaaatcaagacccaactggcccagcacaaggagtttcagaagagtctcggagcgaagcattctgtctacgacaccaccaatcgcaccggtagaagtctgaaggagaagacttcattggctgacgataacctgaagctggacgatatgctcagcgagttacgcgataaatgggacactatctgcggcaaatcagtggaacgacagaacaaactggaggaggctctacttttcagtggacagttcaccgatgccctacaagcactcatcgactggctgtaccgggtggaaccccagctggcggaggaccagcctgtgcacggtgacatagacttggttatgaacctgattgataatcataaagcgttccagaaggagctggggaagcgtaccagcagcgtccaggcactgaaacgctcggcaagggagctcatagagggatcacgtgacgatagctcctgggtgaaggtgcaaatgcaagagctgtccacacgatgggagactgtttgcgcactgagtatctctaaacaaaccaggcttgaggcagcactcaggcaggccgaggagttccacagtgtggtccacgcccttcttgaatggcttgccgaggccgagcagaccctccgatttcacggtgttctccctgacgacgaggacgcgctgcggacactcatagaccagcacaaggaattcatgaaaaagctcgaggagaaaagagccgagctcaataaagcaaccactatgggcgataccgtgctggccatttgtcaccccgacagcattacaaccattaagcactggatcactattattcgggcaagattcgaagaggtcctagcttgggctaaacagcaccagcagaggttagccagcgcgttagccggactgattgcgaagcaggagctgttggaggctttgttagcgtggttgcagtgggccgaaacaactttgaccgataaggataaagaagtgatcccacaggagatcgaggaagtgaaggccctgattgccgaacaccagacttttatggaagagatgacacgcaagcaacctgacgttgacaaagtgaccaaaacctacaagcgcagagcggctgacccaagctctctgcagagccacataccagtcctggataaaggcagagcgggaagaaagcgtttccctgcgagtagtttatacccgagcggctctcaaactcaaatcgagacaaagaaccccagggtgaatctcctggtttccaagtggcaacaagtgtggttactggctcttgagaggagaaggaaacttaacgacgctcttgatcggctggaagagctgagagagttcgcaaactttgatttcgacatttggcgaaaaaagtacatgcgctggatgaatcacaaaaagtcacgcgtgatggatttctttcgacgcatcgacaaggaccaagacggaaaaatcaccaggcaggaatttatcgatggaatccttagctccaaatttcctaccagtcgcctggaaatgagtgccgtcgccgacatcttcgacagagacggggacggctatattgattattacgaattcgtggctgctctccaccccaataaggatgcctataaacccatcactgatgccgacaagattgaggatgaagtgacacgccaggtggcaaagtgtaaatgtgcgaagcggtttcaggtggagcagatcggtgataataaataccgcttcttccttggcaatcagttcggcgactcgcaacagttacgattagtgaggattctgagatccaccgtgatggtgagagttgggggcggatggatggcgcttgacgaatttctcgttaagaacgacccatgcagagtgcatcatcatgggtccaagatgctgcggtcagagtcaaatagctctatcacaaccactcagccaactattgcgaagggaagaactaatatggaactacgggagaagttcattctggcggacggtgcttctcagggtatggccgcatttagacccagggggagacgatctcgcccaagttcccgtggagccagtccaaatcgctccacaagcgtgtcatcacaggcggcccaggcagcatcaccccaagttcctgcaactactacgcctaaaggtacgcctatccagggttccaagctgagacttcctgggtacctaagtgggaagggatttcattcgggcgaggatagcgggcttattactacagccgctgcccgggtacgaacccaattcgctgactccaaaaaaaccccttcaagaccagggtctagagcgggatccaaagcaggctcccgtgcttccagcagacgtggctcggatgcgtccgatttcgacattagcgaaattcagtcagtttgcagtgacgttgaaaccgtccctcaaacacataggcccacccccagagctggctcgcggccctcaacagcaaaaccctctaaaatccctactccacagcgcaagtcccctgcgtcaaaacttgacaaaagcagcaagaggtag

SEQ ID NO: 115316 - DNA, 23253 bp, Artificial Sequence
  Description of Artificial Sequence: Synthetic coding sequence
atgatcgcagcggcctttctggtactcctgagaccttactctattcagtgtgccctgttcttgcttcttctccttctggggactatcgcaacaatcgtctttttctgctgttggcataggaagctgcagaagggacggcacccaatgaagtcagtattcagcggccggtctcgctcacgagacgcagtgctgagatcgcaccacttccgctcagagggctttagggccagtcctagacacctgcggcggcgcgtggcagcagccgcagcagctcgtctggaggaagtgaagcccgtcgtggaggtccatcatcagagcgagcaggagacctcagtccggaaacggcggatcaagaaaagcagccgtgtgcagcccgagttctaccactcggtgcagggtgcctccatcagacgaccctcaagcgggaacgcctcatatcggtgctccatgtcgtcatctgcagacttttctgacgaggacgatttttcacagaaaagtgggagcgcatcccctgcacccggggacaccttaccatggaatctgccaaagcacgagagatcaaagcgaaaaattcaggggggttctgtacttgatccagcagagcgagccgtgctccgcatcgctgatgagagagataaggtgcagaaaaaaacttttacaaagtggattaaccagcatctcatgaaggtgcgcaagcatgttaatgacctctatgaggacctgcgcgatggccataatctcataagtctgctggaagttctgagtggagacacgctccctcgggaaaaaggccgcatgcgctttcacagactgcagaacgtccagattgccctcgactacctcaagcggcgccaggtaaaactggtcaatatcaggaacgatgacattactgatggtaaccccaaactcactctgggtctcatctggaccatcattcttcactttcagatttctgacattcacgtgacgggagagagtgaggatatgtccgcaaaggagcggctgttgctatggacacagcaagctacagaaggctacgcaggcatccgctgtgagaacttcacaacatgttggcgggatggcaaactcttcaatgcaataatccataagtacaggcccgacctgatcgatatgaacaccgttgcagtgcaatctaacctcgctaatctggagcatgcgttctacgtggccgaaaagataggagtgatccggctgcttgatcctgaggacgtggacgtttcatcacccgacgagaagtcggtcatcacctatgtatcttctctgtatgacgcgtttcccaaggtgcccgaagggggcgaaggaatcggcgctaatgacgtcgaagtcaagtggatcgaataccagaacatggtaaattacttgatccagtggatccgccatcacgtcaccaccatgagcgagaggacgtttcctaataaccccgtggagttgaaggctctttataaccaatatcttcagttcaaagagacagagattccccctaaagagaccgaaaagagtaagataaaaagactgtacaaacttctggagatttggattgaatttggcagaatcaaactgctgcagggttatcaccccaatgacatcgaaaaggaatggggaaaacttattatcgccatgctggagagggaaaaggcactcaggccggaggtagagaggctagagatgttgcagcagatcgctaatagggtgcagcgcgacagcgttatatgcgaagacaagctgatactggccggcaacgccctccagtcggacagcaaaaggctggagtctggggtacagtttcagaatgaagcagaaattgcaggttacatccttgagtgtgagaatctacttcgtcagcacgtgatcgatgtgcagatcttaatcgacggaaagtattaccaagctgaccagttagtccagagggtcgctaagcttcgggacgaaatcatggcccttaggaacgaatgctcctccgtgtactccaaggggaggatactgacaaccgaacagactaagttgatgatttcaggaatcacccaaagtctgaactccggattcgcccagacactgcaccctagtctcacctcagggctgactcagagtcttacaccctcactaacctctagtagtatgacttccggattgtcaagtgggatgacaagccgcctgacaccctctgttactcctgcttacactccaggattccccagcggcctcgtgccaaacttttcttcgggggtggagccaaactcccttcaaacgttaaaactaatgcagatccggaagcccctgctgaagagcagcctactggatcaaaacttgaccgaagaagaaatcaacatgaaattcgtacaggacctgctcaattgggtagatgagatgcaagtccagctcgataggacggaatgggggagcgatctaccatcggtcgagtcccatttagagaaccataagaacgtccacagagctatcgaggagtttgagagtagccttaaagaggctaagatcagcgaaattcagatgacagcccctctgaagcttacctatgctgagaagctacatcgcttagagtcccagtatgccaaactcctgaacacctcgaggaaccaggaaagacatctcgacaccctacacaactttgtgtcacgggccaccaatgagctgatttggctgaacgaaaaggaagaggaggaagtcgcctacgattggagcgagcgaaacacaaacatcgcgcgcaagaaagattatcatgcggagttaatgcgagaactcgaccagaaagaagagaatattaaatctgtgcaggaaatagcggaacaactcctgcttgaaaaccaccccgcccgccttactatcgaggcttatcgagcagccatgcagacacagtggtcatggattctccagctttgccagtgtgtcgaacagcacattaaagaaaacactgcgtattttgagttttttaacgacgccaaagaggctactgattacttgcggaacctaaaagatgctatacagcggaagtatagttgtgaccgttcttcatctatccataagctagaggacctagtgcaggagtccatggaagaaaaggaggagctgttgcagtataaatctaccatcgctaatctgatgggaaaggccaaaacaatcatacaattaaagccacggaactccgactgtcccttgaagacgagtatccccatcaaagcgatctgtgattaccgccagatcgaaattacgatctataaggacgatgaatgcgtgctggccaacaattctcatagagcaaagtggaaggtcatcagtcctactggcaacgaggccatggttcccagtgtgtgcttcaccgtgcctcctccaaataaagaagcagtagatctagcaaacaggatcgagcagcagtatcagaatgtgttaaccctgtggcatgaaagccacattaacatgaaatctgtggtcagctggcactatctaatcaatgaaatagatcggatccgtgcgtctaacgtggcttccattaagacgatgcttcctggggagcatcaacaagtgctgtccaaccttcagagccgcttcgaagacttcctggaggacagccaggagtctcaggtgtttagcgggtcggacatcacacagctcgaaaaggaggtgaatgtgtgcaagcagtactatcaggagcttctcaagtcggcagaacgtgaagaacaggaagagagtgtgtacaatctttacatatcagaggtacggaatatccgcctgcggttggagaattgcgaggacagactgataagacagatcagaacgccactggaaagggatgacctgcatgaatctgtctttcggatcacagaacaagaaaaactgaaaaaggagctagagcggctgaaggacgacctgggaactatcactaacaagtgtgaagaatttttttctcaagcagcggcttcctccagtgtgccgacactaagaagcgaactcaatgttgtcctgcagaatatgaaccaagtttactctatgtcctctacctacattgataaattaaaaacggttaacttggtgctgaagaacacacaagctgcagaagcactggtaaagctttatgaaaccaagctttgcgaggaagaggcagtgatcgccgacaagaacaatatagagaatctcatatccacattgaagcagtggcgatctgaagtcgacgagaagagacaggtgttccacgcactagaggacgaattgcagaaggccaaggctattagtgacgagatgtttaagacttacaaggagagagacttagacttcgattggcacaaggagaaagcagatcaactcgtggagcggtggcaaaatgtgcacgtacagatcgataacagactgagagaccttgaaggcatcgggaagagccttaaatattaccgcgatacctaccatcccctggacgattggattcaacaggtggaaactacacagagaaaaatccaggaaaaccagccagagaattccaaaaccctcgccactcaactgaaccaacagaaaatgctggtgtccgagatcgaaatgaagcagtccaaaatggacgagtgtcagaaatacgctgaacaatatagcgccacggtcaaagactatgagcttcagacaatgacatatcgggccatggtcgactctcagcagaagtccccagttaaaagaagacggatgcaatcatctgccgaccttataatacaagagtttatggacctgcgaactaggtatacagctttggtgacattgatgacacaatatataaagtttgcaggcgatagtctcaagagactggaggaagaagagaagtcccttgaagaggagaagaaggaacatgttgaaaaggccaaggagctgcagaaatgggttagtaacatctctaaaactttaaaggatgccgaaaaggcgggcaagccccccttcagcaaacagaaaatttcaagcgaagagatctcaaccaagaaagaacagctgagcgaagccctgcagactatccaattgttcctggccaaacacggtgacaaaatgaccgacgaggagcgcaatgagttagagaaacaggtgaagactctgcaagagtcatataacctcctattttcagagtctctgaaacagctgcaggaatctcagacctctggcgatgtgaaagttgaggagaagctggataaggtcattgccggaacaatcgatcagacaaccggcgaagttttgtcggtgtttcaggcagtcttgaggggtctcattgactacgacactggtattcgcctgctggagacgcagctcatgatatccggcttgattagtcccgagctgaggaagtgtttcgatctgaaggacgctaagtcccacggactgattgacgaacaaatcctgtgtcagctaaaagagctctctaaggcaaaggaaatcatcagcgccgccagtcccacgacaatcccagttttggatgccctcgctcagagcatgattactgagagtatggccattaaggtgctcgagatcctgctcagcactggtagccttgttatcccagctacaggcgaacagctaacccttcagaaagcatttcagcagaacctggtttcatctgcactgttctctaaagtgcttgaacggcaaaacatgtgtaaggacctcatcgacccgtgtacttccgagaaggtgtcgctgattgacatggtgcagcggtctactttgcaggaaaacactggaatgtggctgttgccagtgaggccacaagaaggtgggaggattacattaaagtgcggcagaaatataagtatcctgcgagctgcccatgagggtctcatcgaccgggaaacaatgttccgacttctttctgcacagttactcagcggtgggctcatcaatagtaacagtggccagcgcatgacggttgaggaagccgttcgtgaaggcgtgattgatagggatacagctagctccatcctgacgtatcaggttcagacaggtgggattatacaatccaaccccgcgaaaaggctgaccgtggacgaagcagtccagtgtgacctgataacttcatcaagcgcactgttagtcttagaggctcaacgcggctatgtggggctgatctggcctcatagtggcgaaatcttcccaacatcttctagcctccaacaagagctcatcactaatgaactggcatacaaaatattgaacggaaggcaaaagattgcagctttgtatattcctgaatcatcccaggtgatcggcttagacgctgcaaaacaactcgggattattgataataacactgctagtatattgaaaaacataaccttgcccgacaagatgccagacctcggggatttagaggcttgtaagaacgctcggaggtggctgtccttttgcaagtttcaaccttccactgtccatgattatcgacaggaggaggatgtctttgatggggaggagccggtcaccacccaaacttctgaagaaacaaagaagctgtttctctcctatctgatgatcaattcttatatggatgccaataccggtcagaggttgcttctttacgatggtgatttggacgaagcggtgggtatgttgctagagggttgccacgcagaattcgacggaaatactgctattaaggaatgcctggacgttctctcctcaagcggtgtgttccttaataatgcctcaggcagagaaaaggacgaatgcacagctacccccagctctttcaacaagtgccactgcggcgagcctgaacacgaagagaccccagaaaaccggaaatgcgccatagatgaggagtttaacgaaatgaggaatacggtaattaactccgagttttctcaatccggtaaactggctagcacaatcagcatcgacccaaaagtgaactcttccccctccgtctgtgtgccctccctgatctcttatttgacccagaccgaacttgcagacatcagcatgttgcggtctgatagtgagaacatacttacgaactacgagaatcaaagccgcgtagagacaaacgaacgggcaaacgagtgcagccatagcaagaacattcaaaatttcccctcagatctgattgaaaacccaatcatgaaaagtaaaatgtccaagttttgcggtgtgaatgaaaccgaaaacgaagacaataccaatcgggactcacccatttttgactatagcccccgccttagtgccctgctctcacacgacaaacttatgcactcccagggctcatttaacgacacccatactccggagtccaatggaaataagtgtgaggcccctgcactaagctttagcgacaagactatgctgtctggacaacgtattggggaaaaatttcaggaccagttcctcgggatagctgcaataaacatctcacttccaggcgagcagtacggccaaaagtccctcaacatgatatcttccaaccctcaagtgcaataccataacgataaatatattagcaacacatctggcgaagacgaaaagacgcaccccggctttcagcaaatgcctgaagataaagaagatgaaagcgaaatagaggagtattcctgtgccgttactcccggaggggataccgacaatgcgatcgtcagcctgacttgtgcaacccccctgctggacgaaaccatttccgcctctgattacgagacgagcctgttgaacgatcaacagaacaatactggcaccgacacggattctgacgatgatttctatgataccccactattcgaagatgacgaccacgattctttgctactggacggggacgacagagactgcttgcaccccgaggattatgacacactgcaggaggaaaatgacgaaactgcctcacccgcagacgtcttttacgacgtgagcaaggagaacgagaactccatggtccctcagggagcccccgtcggaagcctgagtgttaaaaataaagctcactgcctacaggactttctgatggatgtggagaaggatgagttagacagtggagagaagatacaccttaatccagtgggaagcgacaaggtgaatggccaaagcctggaaactggatccgagcgcgagtgtacgaacattctggaaggggacgaatctgactcccttactgattatgacattgtagggggaaaggaaagtttcaccgccagtttgaaatttgatgactccggatcctggcgcggcaggaaagaagagtacgtgacaggacaagaattccacagtgatactgatcacctggactctatgcagagcgaggaaagctatggggattatatctacgacagtaatgaccaggatgacgatgatgatgacgggattgacgaagagggcgggggtatcagagacgagaatgggaaacctcgctgtcaaaatgtcgcggaggacatggacatacagctgtgcgcttccatcctcaacgagaactcggacgagaacgaaaatatcaataccatgatcctgttggacaagatgcacagctgtagctcgctcgaaaaacaacagcgggtgaatgttgtgcagctggcatcaccgagtgagaacaatctggttacagaaaaaagcaacctacctgagtacaccaccgagatcgcaggaaagtccaaggagaacctgctgaaccacgagatggttttaaaagacgtcctaccgccaataattaaagacacagagagcgagaaaacttttgggccagcgtcaatcagtcacgacaataacaacatcagttccacctcagagttgggcacggacctggcaaataccaaggtgaagcttattcaaggctctgaactccccgaacttaccgattccgtgaagggcaaagatgaatattttaagaatatgacgccaaaagtggatagtagtcttgatcacatcatctgtaccgaacccgacctgattggaaagccagcagaggagtcacacctgtccttgattgcctcggtaaccgataaggacccccaaggaaacgggagcgatcttattaagggtcgcgacggcaaatccgatatactcattgaagatgaaacctcaattcagaagatgtatctgggggagggggaggtgctggtggagggtttagtagaggaagaaaacaggcacctgaaactgctacctggcaaaaacactcgggatagtttcaaactgatcaatagtcagttcccttttcctcagataacaaacaatgaagaacttaaccagaagggctcattaaagaaagccacagtcacattgaaggacgagccaaacaatctgcagatcattgtctctaaatctcctgtgcagtttgagaacttagaggagattttcgatacatccgtttccaaagagatcagtgatgacattaccagcgatatcacaagttgggaagggaacactcacttcgaagagtccttcaccgacgggccagagaaggagctggacctgtttacctacttgaaacactgcgccaagaacatcaaagctaaagatgtagctaagccaaatgaggacgtcccctcacacgtattaatcaccgcccctcctatgaaggagcacctgcaactcggggtgaacaatacaaaagagaaatctactagcacccagaaggattcccccttgaacgatatgatccagtccaatgacctgtgttcaaaggagagtatcagcgggggtgggactgagatatctcaatttacacctgagtctatcgaggcaactctgtccatactctcccgcaaacacgtggaggatgtcggaaaaaacgactttctgcagtcagaacgttgtgccaacggcttgggcaatgacaacagctcaaataccctcaacacagattacagcttcttagagattaacaacaaaaaggagcggattgagcagcagttaccaaaagaacaagcgttgtctccaaggtcacaggaaaaggaggtgcaaattccagaactgtcgcaagtgttcgtggaggatgtcaaggatattctgaagtccaggcttaaagagggccacatgaacccacaggaggtggaagagccctccgcgtgtgccgatacaaagattttgatccaaaatctgattaagcggatcaccacctctcagctggtgaatgaggcgtccacagtgccgtccgactcgcaaatgtctgattcatcaggggtgagccccatgactaacagctccgaactcaagccagagtcgagggatgaccccttttgcatcggaaacctaaagagtgagctgcttttgaatatcctgaaacaggatcaacactcccagaagatcactggtgtttttgaactcatgcgcgagctaacgcatatggaatacgacttggaaaagagaggtataactagcaaagtcctcccgctccagctggagaatatcttctataagctgctggctgatggctactcagagaagatagagcacgtgggcgacttcaatcagaaagcgtgcagcactagtgagatgatggaggagaagccacacatcctgggggatatcaagtccaaagaaggcaactattactctcctaatctggaaaccgtcaaggaaatcggtctcgaatcctcaacagtgtgggcaagcactcttcctcgggatgagaaattgaaggacctgtgtaacgattttccctcccacctcgagtgtactagcggatccaaagagatggcaagcggggacagcagtactgagcagtttagctctgagctccagcaatgcttgcagcataccgaaaaaatgcacgagtacctgacactgctgcaggacatgaaaccacccctcgataaccaggaatccttagataacaacctggaagctcttaaaaaccagctgcggcagctcgagaccttcgagctgggcttagcacccatcgctgtgatccttaggaaagacatgaagttagccgaggaattcctgaaatccctaccctcagacttcccacggggtcatgtggaggagttgtccatttctcaccagtcgcttaagactgcgttttccagcctttcaaacgtctcatctgagaggaccaaacagataatgctagctattgatagtgagatgagcaaactggccgtcagccacgaagagttcttgcacaagctgaagagcttctccgactgggtctctgaaaaatctaaatcagtgaaagacatcgaaatcgtcaatgtgcaggatagtgaatatgttaaaaaaagactggagtttctcaaggctaacaatgtgttgaaggatcttggacatactaaaatgcagttggagaccaccgccttcgacgtacagtttttcattagcgaatacgcccaggatttaagccctaaccagtctaaacagctgctgagacttttaaacaccacacagaaatgtttcctggatgtgcaggagtccgtgacaacccaggtagaaagactggagacccagctgcatctggagcaggacctggacgatcagaagatcgtggcggaaaggcagcaggagtacaaggaaaaactgcaagggatttgcgaccttctgacacagactgagaaccgactcataggtcatcaggaggctttcatgatcggtgacggcactgttgaactgaaaaaataccagagtaaacaggaagaactgcagaaggatatgcaggggtccgctcaggctctcgctgaagtcgtgaaaaataccgaaaacttcctaaaagaaaacggggaaaagctgtcccaggaagacaaggccctgattgagcaaaaactgaacgaggctaagatcaagtgtgagcagctgaacctgaaagctgaacagagcaagaaggagctggataaggtggtgaccacagccatcaaggaggagacggaaaaagtagcagctgttaagcagctcgaagaatccaaaaccaaaatagagaacctcctggattggctgagcaatgtggacaaagactccgaaagggcaggcacaaaacacaaacaagtcatagaacaaaacgggacacattttcaggagggcgatggcaagagcgccattggagaggaggacgaagtgaatggaaacctgctcgaaaccgatgtggacggccaggtaggtaccacccaagaaaatcttaatcagcagtaccagaaagtcaaggcccagcatgagaagatcatttcgcagcatcaggccgtgattattgctactcagtccgctcaggtcctgctggagaagcagggccagtatttaagtcctgaggagaaggaaaagttgcaaaagaatatgaaagagttgaaagtccactacgagaccgcactggcggagagtgaaaagaaaatgaagctcactcactcactgcaggaggaacttgagaagtttgacgcagactacactgaatttgagcattggctgcaacagtccgaacaggaattggaaaatctggaagccggcgccgatgacataaacgggctcatgaccaagctcaagagacagaaatccttttcagaggatgtaatctctcataagggagatctgagatatatcacgatttcaggaaatcgagttttggaggccgccaaatcttgctcgaagagagacggcggaaaggttgacaccagcgccacccatcgggaggttcagaggaagttggaccacgcaaccgatagatttcgatctctgtatagcaagtgtaacgtgcttggaaataacttaaaggatctcgtagataagtatcagcactatgaagacgctagctgtggtttactcgccggtctacaggcctgcgaggccactgcctctaagcatctgagcgaaccaatcgcagtggatccaaagaaccttcaacggcagctggaggagacaaaggcacttcagggacagatcagttcacagcaggtcgccgtggaaaaattaaagaaaactgccgaggttctgctcgacgcacgcggctcactcttacccgccaagaatgacatccagaagactctggacgacatcgttgggcggtacgaggatttgagcaaatctgtcaacgaacggaacgaaaaattacagattaccctaacgaggagccttagcgtgcaggatggattggacgaaatgttggattggatgggcaatgtggaaagtagtctgaaggagcagggccaggtcccactcaattctaccgcactgcaggatataataagcaagaacatcatgttagagcaggatatcgcaggtcgccagtcttcaatcaacgccatgaacgagaaggtcaagaagttcatggagactactgacccatccactgcaagttctctgcaggccaagatgaaggacctgtcagcgcgcttcagcgaggcaagccacaaacacaaggaaaccctcgccaaaatggaggaactcaagactaaagttgagctgttcgaaaacttgtcagaaaagctgcaaacattcttggagacaaagacccaagccctgactgaggtcgacgtgcccgggaaagacgtgaccgaactatcccagtacatgcaggaaagcacctcagaatttctcgagcacaaaaagcatcttgaagtgctgcattcactgctgaaagagatcagctcccacggcctgccctctgataaagcactagtccttgaaaagacaaataatctctctaaaaagttcaaagaaatggaggatactatcaaggagaaaaaggaggctgtcacttcctgtcaggaacagctcgacgcatttcaggtgcttgtgaagagcttgaagtcatggatcaaagaaaccactaagaaagtgcccattgttcagccgtctttcggtgccgaagacctagggaagagcctggaggataccaaaaaactacaggaaaaatggagtctaaagacaccggagattcaaaaagtgaacaactctggcatctcactgtgtaacctgatcagcgccgtgaccaccccagctaaggcaattgcggccgtgaagagcgggggcgctgtgctcaatggtgaaggcacagccaccaacacagaggaattctgggcaaacaaaggccttaccagcatcaagaaggacatgacagacatcagccatggctatgaagaccttgggttgctcctcaaggataaaatcgcagagttaaataccaaactcagtaaactgcagaaagcccaggaagaatcttctgctatgatgcaatggttgcagaaaatgaataagactgctaccaaatggcagcaaacaccagcccctaccgacaccgaggctgttaagacccaggtcgagcagaacaagtctttcgaggctgagctgaagcaaaacgtgaataaagttcaagagctgaaggataaattgacagagcttttggaagagaaccccgatacacctgaggcaccccgctggaaacaaatgctgacagagatcgatagcaagtggcaggaactgaatcagttgacaattgaccgacagcagaaactcgaggaatcaagcaataatcttactcaatttcaaaccgttgaggcccagctcaagcagtggctggtggagaaggagctcatggtgagtgtgctcgggccactaagtatcgatccaaacatgctgaatactcagaggcaacaggtgcagattctcctccaggagttcgcgactagaaaacctcagtacgaacagcttactgccgccggccaaggtatactgtcccggccaggcgaagacccctcacttcgcgggattgtgaaggagcagctggctgccgtgacccagaaatgggactccttaactggccagctgtccgatcgttgtgactggatcgatcaggccatcgtgaaatccacacagtatcagtcgcttttgcggtcactttcagacaaacttagtgacctggataataagttatcgagttcgctagcagtgagcacccaccccgacgccatgaaccagcagctcgagacagcccaaaagatgaagcaggaaattcaacaggaaaagaaacagatcaaagtggcccaggctttgtgcgaagatctgagcgcactagtgaaggaagaatacttaaaggccgagctaagtcgccagctcgaggggatcctcaagtcttttaaagacgtggagcaaaaggctgagaaccacgtgcaacatttgcagagcgcctgcgcctctagccaccaattccaacagatgagccgggattttcaggcttggctggacacaaaaaaagaagaacagaataaatcacaccctattagcgcaaagctcgatgtcctcgaatctctgatcaaagaccacaaagacttctccaagaccctgacagctcagagtcacatgtacgaaaaaaccatcgctgagggcgagaacctactgctgaaaactcagggctctgaaaaggccgccttacaactgcagctcaacacaattaaaactaactgggatacgttcaacaaacaagtgaaggagcgagaaaataaactcaaggaatctctggaaaaggccttgaaatataaggagcaggtagaaactctgtggccatggatagataagtgtcagaacaatctggaagagattaagttctgccttgacccagctgagggggaaaactctattgctaagctgaagtctttgcagaaggagatggaccagcatttcgggatggtggaactcctgaacaatactgccaatagcctgctgagcgtgtgcgaaatagacaaggaggtggttaccgatgagaacaaaagccttatccaaaaagttgacatggtgactgaacagctccattcaaaaaaattctgcttagaaaacatgacacagaaatttaaggaatttcaagaggtgtctaaggagagcaagcgacagctgcagtgcgccaaggagcagctggatattcacgatagcctgggatcccaagcctacagcaataaatatctcactatgttgcagacgcagcagaagagtttacaggcgctgaaacatcaggtggatctggccaagcggctggcacaggatctggtggttgaagcaagtgactcgaagggcaccagtgatgttctcctccaagttgagacaatcgcccaggagcacagtaccctctctcagcaggttgatgagaagtgctcctttttagagacaaagctacaggggatcggacatttccagaataccatcagggagatgttctctcagttcgcagaattcgatgacgaactagattccatggccccagttgggcgggacgctgagacactgcagaagcagaaagagacaatcaaggccttcctcaagaagctggaagccctcatggcctccaacgacaatgctaacaagacttgcaagatgatgctagcgactgaggaaacatccccagatctggtggggatcaagcgcgacttagaggctctttccaaacagtgtaataagctgcttgaccgggcccaagcccgtgaagaacaggtggagggaactatcaagcgacttgaggaattttacagtaagctcaaggaattcagcatattgctgcagaaagcagaggaacacgaggagagtcaaggccccgtgggcatggagaccgagactatcaatcagcagctgaacatgtttaaggtgttccagaaagaggagattgagccattacaggggaagcaacaggatgtcaactggttgggccaaggcctgattcagagcgctgcaaagagcaccagcacgcaaggtctggagcacgacctagatgatgtcaatgcccgatggaaaactctgaacaaaaaggtggcgcagcgcgcggcacagttacaagaagccttgctacattgcggaagattccaagatgctctcgaatccttgttgtcctggatggtggacaccgaggaacttgtcgctaaccagaagccaccgagcgctgagtttaaagtggtcaaagcccagattcaagagcagaagctcttgcagaggctacttgacgacaggaagtctactgtagaagtgatcaaacgggagggggagaagatcgccacaacggcggagccagctgataaagtaaagattctcaaacaattaagcctgctggactcccgttgggaggcccttctgaataaagccgaaactcgtaaccgacagctcgagggtatctccgtggttgctcaacagttccacgagaccctggaacctctgaatgagtggctgacaaccattgaaaagagacttgtgaattgtgagccaatcggaacacaggcctccaaactggaggaacagattgctcagcacaaagcacttgaggacgatatcattaatcataacaaacacttacatcaagcggtttccataggtcagagcttaaaagtcctttccagcagagaggataaggatatggtgcagtctaagcttgatttttcgcaggtttggtatattgagattcaagaaaagtctcacagccgtagcgaactcctccagcaagcgctatgcaatgccaagatttttggagaagatgaagtggagctgatgaactggctgaatgaggtgcacgacaaactctctaaactgagcgtgcaagactatagcacagaggggttgtggaaacaacaaagcgaacttcgggtccttcaggaagatatcttattacgtaaacagaacgtggatcaggcgcttttaaatggactcgagcttctgaagcagacgaccggcgatgaggttcttatcatccaggacaaactcgaagccataaaggcgaggtataaggatatcaccaagctgagcacagacgttgcgaagacactagagcaggccctgcagctagcccgacggctacatagcacccatgaggagctctgtacttggctggacaaagtggaggtggaattactgtcttacgagactcaggtgctgaagggcgaagaagcctcacaggctcagatgcgccctaaagagctgaaaaaggaggctaaaaacaacaaggcactgctggattccctgaatgaagtcagcagcgccctgctggaacttgtgccctggcgcgcaagagagggcctcgagaaaatggtggccgaagacaacgaacgttacaggcttgtttccgacacaataacacaaaaggttgaggaaattgatgctgctattctacgcagccagcaatttgaccaggcagccgacgcagagctcagttggattacagagaccgaaaaaaaacttatgtctttgggggacatccggctggagcaggaccagacatcagctcaattgcaggtgcaaaaaaccttcaccatggagattctgcgccacaaagacatcatcgacgatctggtaaagtccggccacaagattatgaccgcgtgtagcgaggaggaaaagcagtcaatgaagaaaaaactcgacaaggtattgaaaaattacgatacaatctgtcagatcaactcagagaggtatcttcaactagaacgggcacagagtctggtgaatcagttttgggaaacctacgaagagctgtggccctggctcaccgagacacagagtatcatttctcagttgcccgctcctgcgttagagtacgagacgctgcgccaacagcaggaagagcacagacagttaagagaactgatcgccgagcacaagcctcacatcgacaaaatgaataagactgggccgcagctactggaactaagtccaggagaaggcttttctatccaggagaagtacgtggccgcagacaccctctactcacaaattaaagaagacgtgaagaagagagccgtggcattggatgaagctatatcccagagcacacaatttcacgacaaaatagatcagatcctggaatccctggagagaattgtcgaacgcctgcggcagcctccatctatatctgccgaggtcgagaaaataaaggaacagatcagcgagaacaagaatgtcagtgtcgatatggagaaacttcaaccgctttacgaaacgcttaaacaaagaggcgaagaaatgatcgctcggtcaggcggaacagacaaagatatatcagccaaagcagtgcaggataagctggaccaaatggtgtttatttgggaaaacatccatactctcgtggaggaaagagaagctaagctcctcgatgtcatggagctagctgaaaagttttggtgcgaccacatgtccctcatcgtaactattaaggatactcaagacttcatccgggatctggaagaccccggaattgatcccagtgtggtcaagcagcaacaggaggcagctgagaccattcgcgaagaaattgacgggctacaagaggaattagacatagtcatcaatctcggttctgaactgatcgcagcgtgcggcgagcccgacaagccaattgtcaagaagtcaatcgacgagctcaacagcgcctgggatagtctgaataaagcatggaaggataggattgacaagttagaagaagccatgcaagcggctgtgcagtaccaggacggattacaggcagtgtttgactgggttgatatcgctggaggaaagctggccagtatgagccctattggtaccgatctggagactgtgaaacaacagattgaggagcttaaacaatttaaaagcgaggcctaccagcagcagatcgagatggaaagactgaatcatcaggcagagctgctgttaaaaaaggtgactgaagagtccgataagcacactgtgcaggacccactcatggagctgaaactcatttgggactccctggaagagcgtataataaatagacagcacaagctggagggtgccctgctcgcacttggccagttccagcacgccctggatgaactcctggcctggctgacacatactgaaggcctcttgtccgaacaaaaaccagtggggggtgatcccaaggcaattgaaatcgagctcgcaaagcaccacgttctccagaatgacgtcctggcccatcagagtactgttgaggcagtgaacaaagctggcaacgacctgatagagtcttcagcgggggaggaagcaagcaaccttcaaaataagcttgaagtattgaaccaaaggtggcagaacgtgctggaaaagaccgagcagagaaaacagcagctcgatggagccctgagacaggccaagggattccacggtgaaatcgaagatttacaacagtggctgacggacacggagcgccacctgcttgcctccaagccattggggggtctgcccgagacggcgaaggaacaactaaacgtacacatggaggtttgtgccgcctttgaggcgaaggaggaaacatataagtctctgatgcagaaggggcaacagatgctggctcgctgtcctaagtcagctgagaccaacatcgatcaggatatcaacaatctaaaagagaaatgggagagtgtcgagacaaaactgaacgagcgcaaaaccaaactagaagaggctctcaatctggcgatggagttccataactcccttcaggatttcattaactggctgacacaggcagagcaaactctgaatgtggcgagcaggccttcactgatactcgataccgtgttgtttcaaattgatgaacacaaggtctttgccaatgaggtgaactctcaccgggaacaaattattgagctcgacaagacggggactcacctcaagtatttttcccagaaacaggacgtggtgttaataaaaaatttgctgatcagtgtccagtctcggtgggagaaagtcgttcagcggcttgttgaaagagggcggagcttggatgatgctcgaaagagagcgaaacagtttcatgaagcctggtctaaattgatggagtggctcgaagagtccgagaaatcactggatagcgagttggaaattgctaacgacccagacaaaataaagactcaactggcacagcataaagagtttcaaaagtcgctgggcgctaagcatagcgtttacgacaccaccaaccgaaccggacggtctctcaaggaaaaaaccagcttagcagatgacaaccttaagctcgatgatatgctaagcgaactgagagacaagtgggacaccatatgcggcaaatccgttgagcgccaaaacaagctcgaggaagcgctgcttttcagtggccagtttaccgacgccctgcaagcactgattgattggctgtatcgggtggaaccacagctcgccgaagaccagccagtgcacggggacatcgatttagtgatgaatctgattgacaaccataaggcttttcaaaaagagctgggcaagaggacatccagtgttcaggccctaaagaggagcgcccgggaacttattgagggctccagagatgactcctcatgggtgaaagtccagatgcaagaactttctacccgatgggagacagtgtgcgccctctcaatttcaaagcaaactcgactggaggccgccctacggcaggcagaagagttccatagtgtggttcatgcactccttgaatggctcgcagaggccgagcagacactgcgattccacggggttcttcccgatgatgaagatgctcttcggaccttaatcgaccagcacaaagagttcatgaaaaagttggaggagaaacgtgcagaactgaacaaagcgacaacaatgggagataccgtgctggccatatgtcaccctgactcgattacgacaataaaacattggattaccatcatccgagcacggttcgaagaagtgctcgcttgggccaaacaacatcagcagcggttagcctccgccctcgctggtcttatcgccaaacaggaactgctcgaggctctgctggcctggcttcagtgggccgagactacactaaccgataaagataaggaagttattccacaagagattgaagaagtcaaggccctcattgcagagcaccaaacttttatggaggagatgacaaggaagcagcccgatgttgacaaggtcacaaagacttacaagcggcgggcagcagatccaagctccctccaatcgcatattcccgtgctggacaaaggcagggctggacgaaagagattccctgcttcatctctttaccccagcggctcccagacgcaaattgagaccaaaaaccctcgcgtgaacctgttggtcagcaagtggcagcaggtgtggctcttagcgctggagcgtagaaggaaattgaacgatgctcttgatcgcctggaagagctcagggagttcgcgaattttgatttcgacatttggcgcaaaaaatacatgcgttggatgaatcataagaaaagccgggtaatggacttttttcgccgaatcgataaggaccaggacggcaaaattacaagacaggaatttatcgacggtatcttgtccagcaagtttcctacatcaaggctggaaatgtctgcggtggccgatatcttcgacagggacggggacggttatatcgattactatgagtttgtggcggccttgcatcctaacaaagatgcctacaagccgatcactgacgcagataagatagaggatgaggtcacaaggcaggtggcaaagtgcaaatgtgccaaacgcttccaggtggaacagatcggtgacaacaaataccgggtgtcttttcagtctaatttcggagactcccagcagctgcgcctcgtgagaatacttcggagcactgtgatggtgcgcgttggggggggttggatggcgctcgatgagtttttagtcaagaatgatccatgccgggttcaccaccatggctcaaaaatgctgcggagtgaatctaattcttcaatcaccactacacagccaactatcgcaaagggccgaaccaatatggagctgagggaaaagttcatactggccgacggtgcctcacaggggatggccgcttttcgcccaaggggcagacgctcccgtccgtccagcagaggtgcctcccctaataggtccacctctgtaagtagtcaggccgcccaggccgcctccccacaggtgccagccacaactaccccgaaagggactcccatccagggctccaaactgaggctgcccggatatcttagcggcaaggggttccactctggcgaggactcaggcttgatcactaccgctgcagcaagggtccggacccaatttgctgattctaagaagactccctcaagaccagggtctcgggcggggagcaaggcgggatctcgggctagctcccgcagagggagtgacgcctcagactttgacattagtgagatccaatcagtttgttctgatgtagagacagtcccacagacccataggcccactcctcgcgctgggagtagaccctctaccgcaaaaccaagcaagatccctactccgcagcgcaagagtccggcgagtaagctggacaagagtagcaagagatag

SEQ ID NO: 115317 - DNA, 7950 bp, Artificial Sequence
  Description of Artificial Sequence: Synthetic coding sequence
atgcattcttctagctacagttataggtcgtccgacagtgtgttttccaacacgaccagtacacggactagcctggactccaacgagaacttgttactcgtccattgtggccccaccctgattaattcatgcatcagctttgggtccgaatcattcgatggccatcgcttggagatgctccaacaaatcgcaaatcgcgtgcagcgcgactcggttatttgtgaggataagctcattcttgctggtaacgctttacaatctgattcaaaaagactggagtccggtgttcagttccagaacgaagcggagatcgctggttatatcttggagtgtgagaacctgctcagacagcacgtcatcgatgtccaaatactgatcgacggaaaatactatcaggccgatcagttggtgcagcgcgtggccaaactgcgcgacgaaattatggcgctccgaaacgagtgctcgtccgtttatagcaagggccgcatcctcactaccgaacagacaaaattaatgatttccggtatcacacagagcctgaacagcggttttgcccagactcttcacccatcgcttacctctggactgactcagtcactgaccccgtccctcacgtcctcatctatgacctcaggcctctcgtcaggtatgacatcaagactgaccccctcagtcacccccgcatatacacccggcttcccttccggacttgtgcctaatttctcttcaggtgtggagccaaacagtctgcagacactcaagctgatgcaaattcggaaacctctgctcaagtctagtctgctggaccagaacctcactgaggaagaaatcaatatgaagttcgtccaggacctcctgaactgggttgatgaaatgcaggtgcagttggacagaaccgagtgggggagcgacctcccctctgtagagagccacttggaaaatcataaaaatgtccaccgggccatcgaggaattcgaaagcagcctgaaggaagccaagatatctgaaattcagatgacagcaccccttaaactcacgtacgccgagaagctccaccggcttgaatcccagtatgccaaactactaaatacttcgaggaaccaggaacgccatctggacaccctgcataactttgtatcccgtgccacaaacgagctgatctggctgaacgagaaggaagaggaggaagtggcctatgactggagcgagaggaataccaatattgcacgaaaaaaggactaccacgccgagctgatgcgagaattggaccaaaaagaagaaaatatcaagtcagtacaggagattgccgagcagctattactggagaatcacccagccagacttactattgaggcatatcgggccgccatgcaaactcaatggtcatggattctccagctgtgtcaatgcgttgaacagcacataaaggagaacacggcctactttgaattcttcaatgacgcaaaggaagccacggactatcttcgtaatctgaaagatgctattcagcgaaagtattcatgtgaccgaagctcgagtattcacaagctagaggatcttgttcaggaatcgatggaagagaaagaggaattgctccaatataagagcacaatagccaacttgatggggaaggctaaaaccatcatccagctgaagccaaggaactcagattgccccttaaaaacttctattccaattaaagccatttgcgactatcggcaaatcgagataactatctacaaagatgacgaatgtgtgctggccaacaactcgcaccgggcaaaatggaaagtgatcagtccaaccggcaacgaagcaatggtcccttccgtctgcttcacagtgccaccacccaacaaggaggccgtggatctagctaatcgcatcgaacagcaatatcaaaacgtccttacgctctggcatgaatcccacataaacatgaagtccgtggtgtcttggcactatctgattaatgaaattgatcgcattagggcaagtaacgttgcaagtatcaagacaatgttgcccggtgaacatcagcaggtgctttccaatctgcagtctagattcgaagacttcctggaggattcccaggagtctcaggtctttagtgggtcagacataactcagcttgagaaggaggtcaatgtatgtaaacagtactaccaggaactcctgaagagcgctgaacgagaggaacaagaggaatccgtctacaacctctacatttccgaagtacgcaatattcggctgaggctggaaaactgcgaagaccgcctgatccgccagatacgtacgcccctggagagggacgacctgcacgagtcagtattcagaatcactgagcaggaaaagcttaaaaaagaactcgaaaggctgaaagacgaccttggtaccataaccaataagtgcgaggagttcttttctcaggctgccgcctccagttccgtgccaaccctgcggagcgagttaaatgtggttttacagaacatgaaccaggtgtactccatgtcctcaacatacatcgataaattgaagaccgttaacctggtgctcaagaacacacaggccgcagaggccttggtaaaactgtacgagactaaattgtgcgaagaggaggccgtgatcgccgataagaacaacattgaaaatctcatcagcactttgaagcagtggcggagtgaggtcgacgaaaaacgccaggtgttccatgccctggaagatgaactccagaaagccaaggccatctcagatgagatgtttaagacctacaaggaaagggatctcgatttcgactggcataaagagaaggcagaccagctggtagaacggtggcaaaatgttcacgtacaaatagacaatagattgagggatctagaggggattggaaagtcgctgaaatactatcgcgacacctatcaccctcttgacgattggattcaacaagtcgagacaacgcaacgcaagatccaagagaaccagccggagaattccaaaaccctggccactcagctcaatcagcagaaaatgctcgtcagcgagattgagatgaagcaatccaaaatggatgagtgtcagaagtacgctgagcagtactctgcaactgttaaagattacgagttacagaccatgacctatcgcgccatggtggactctcagcagaaaagcccagtgaaaaggaggaggatgcagagttccgctgatctgattattcaggaatttatggacctgaggactcgatataccgctctcgtgactttaatgacgcagtacataaagttcgcaggggactctctgaaacggctcgaggaagaggagatcaaaagatgtaaggaaaccagcgaacacggcgcctatagcgatttactgcagaggcaaaaagcgacggtgctcgaaaactccaagctgacagggaagatcagcgaactagaacggatggtcgcagagctgaaaaagcagaagagtagggtcgaggaggaacttcccaaggtccgggaggccgccgagaacgaattgcgcaagcagcagcggaatgttgaggacatttctctccaaaagatcagggccgagtcagaggctaaacagtaccgccgtgaactggagacaatcgtgcgagagaaggaagctgccgaaagggagttggagagagtgagacaattgaccattgaggccgaggcaaaacgagctgccgtcgaagaaaatttgctcaactttagaaaccagttggaagagaatacttttactaggagaaccctggaagatcatttaaagaggaaagatctgtctttgaacgacctggaacagcaaaagaacaagttaatggaagaactgaggcggaagcgagacaatgaagaggagttgctaaaactgattaagcagatggagaaggacctggcatttcaaaaacaagtcgccgaaaagcagctcaaagagaagcagaagatcgagctcgaggcccgacggaaaataacagagattcagtacacgtgccgagagaacgcgctgcctgtgtgccccataacccaggcgacatcttgccgggctgtgactggcttacaacaggaacacgacaagcagaaggccgaagaattaaagcaacaggtggacgaattaaccgcggcaaacagaaaagcagaacaggacatgcgtgagctcacctatgagctcaatgccctccagttggagaagacttcctctgaagagaaggcccgattgctgaaagacaagctcgacgagactaacaatacacttcgttgtcttaaactcgaacttgaacgaaaggaccaggcggagaaggggtatagccagcagctgagagagttggggcgtcagttgaatcaaactacaggtaaggcggaagaagcaatgcaggaggcttctgacctcaagaagattaaacggaactatcagctggagctcgagagccttaatcatgaaaaaggaaagttgcagagggaagtggatcgtatcacgagggctcatgccgtcgccgaaaaaaatatacaacacttgaacagccagatccacagcttccgtgacgagaaagagttagagaggctgcagatttgccagaggaaaagcgatcacctgaaggagcagttcgaaaagagccatgagcagctgctgcagaatattaaggctgaaaaggaaaataatgataagatccagcggcttaacgaggaactggaaaaaagtaatgagtgtgccgaaatgctgaaacagaaagtggaagagctaacacggcaaaacaatgaaaccaagttaatgatgcagaggattcaggctgagtccgagaacatagtgctggagaagcagactattcagcagcgttgtgaagccctgaagatccaggcggacgggtttaaagaccagctcagatcgaccaatgagcacctgcataaacagacaaagactgagcaagattttcagcggaaaataaagtgcctggaagaggatctggccaagagccagaacctagtctcagagttcaagcaaaagtgtgatcagcagaatataattattcagaataccaaaaaagaggttcgcaatctcaatgcggagctgaacgctagtaaagaggagaagcgcaggggtgagcaaaaagtgcagctgcagcaggctcaggtgcaggaactcaacaacagactcaagaaggtacaggacgaactgcacctcaagactattgaagagcagatgacacacagaaagatggtgctcttccaggaggaatccggcaagtttaaacagtccgctgaagagttccgtaagaaaatggaaaaacttatggaatctaaggtgatcacagagaatgatataagcgggattaggctcgatttcgtgtctttgcagcaggaaaacagccgggcccaggagaatgctaagctctgtgagaccaacatcaaggaattggaaagacagctgcagcaatatagggaacagatgcagcagggccagcacatggaggcgaatcactaccagaagtgtcaaaaactggaggatgagttgatcgcacagaaacgggaggtggagaatctgaaacaaaaaatggaccagcagattaaagaacacgaacaccagttggttctgttacaatgcgaaatccaaaagaagagcacggccaaagattgtacattcaaacccgatttcgaaatgactgttaaagagtgccagcattccggggaactcagctctcgcaataccggacatctgcatccgaccccacgcagccctctgctgcgatggacacaggaaccccaaccactcgaggaaaaatggcagcatcgggtggtcgaacagattccaaaagaagttcagtttcagccccccggcgcccctctggaaaaagagaaatctcagcaatgctatagtgaatacttctctcagacgtcaactgaactgcaaatcacgttcgatgagaccaacccaattacacggctgtctgaaatcgaaaaaattcgggatcaggccttgaataactctagaccaccagtacgctatcaggataacgcctgcgaaatggaactggtgaaggttttaactccgctggagattgcaaagaataagcagtacgacatgcacaccgaagtcaccacgctgaaacaggagaaaaatccagtgccaagcgctgaagaatggatgcttgagggctgccgggccagcggcgggcttaagaaaggagactttttgaaaaaaggcctcgaacctgaaacttttcagaactttgacggagatcacgcgtgtagcgtgcgcgatgacgagttcaagttccaaggactcaggcatactgtgacggctcgacagctagtggaggccaaactgcttgacatgcgaacaattgagcagctgaggttggggcttaaaacagtcgaagaagtgcagaaaaccctgaataagttcctaaccaaggccacgtccattgctggcctataccttgagtccaccaaagaaaagataagtttcgcctccgccgcagagcggattattatagacaaaatggtggcgttggccttcctggaggcgcaagccgcaacaggctttatcattgacccaatttcgggacaaacatactcagtggaggatgctgtgctgaagggggttgtcgacccggaattcagaatccgtcttctcgaggccgagaaggccgcggttggctacagctacagttccaagacccttagcgttttccaagcaatggagaatcggatgctggataggcaaaagggcaaacatattcttgaggcacaaatcgcctccggaggtgtcatcgaccccgtgagagggatcagagttccaccggagatagcgctgcagcaggggctgctgaataatgccatcctgcaatttctgcatgaaccttccagtaataccagagtgtttccaaaccccaataacaaacaggccctatattactccgaactgctgcgtatgtgcgtctttgacgtcgagtcccagtgcttcctgtttccattcggcgaaagaaacatcagtaacctcaacgtgaaaaagacacaccgaatttctgtcgtcgatacaaaaacagggagcgagctcaccgtctacgaggcatttcagaggaatctgattgagaagtccatctacctggagctgtctggacagcagtatcagtggaaagaggccatgtttttcgaatcctatgggcactcttcccatatgctgacagatacgaagactgggttgcacttcaacattaacgaagcaatcgagcaaggcactatcgacaaggcactggtcaagaagtatcaggagggactgattaccctaacagaactcgccgatagcttactttctagactggttccaaaaaaggatctgcattcaccagtggcaggatattggctcacagcgagcggcgaaaggatctctgtgctgaaggcctcacgtagaaacttggtggatagaattacagccttgagatgtctggaagctcaggtgagcacgggaggtattatcgacccactgaccgggaaaaagtaccgcgtcgctgaagctctgcatcggggcctggtggatgaagggttcgcacagcagctcaggcagtgtgaacttgttatcaccggcattggccaccctatcacgaataagatgatgtccgttgtggaggctgtgaacgctaacattattaacaaggagatgggaatccgctgtttggagttccagtatttaactggagggctgattgagccccaagtgcattctcgcctgtctatcgaggaagcactgcaggtgggcatcattgatgtgttgattgctactaaactgaaagaccagaagtcctacgtacggaacatcatttgcccacagacaaaacggaaactcacctataaagaggccttggagaaagcagactttgatttccacacaggtttgaagctcctagaagtcagcgagcctctgatgacaggaatttccagtctgtattacagcagttag

SEQ ID NO: 115318 - DNA, 22719 bp, Artificial Sequence
  Description of Artificial Sequence: Synthetic coding sequence
atggcaggctacttgtcccctgctgcatacctctacgtggaggaacaggagtacctgcaagcttacgaagacgtccttgaaagatacaaggatgaaagagataaggtgcaaaagaaaacctttactaaatggattaatcagcacctcatgaaggttagaaagcacgtaaacgatctgtatgaagacttacgggatgggcacaatctgatctctctgctcgaagtgctgtccggggataccctgccccgcgaaaagggccggatgcgtttccaccgcctgcaaaacgtacagatagccttggattaccttaagaggcgtcaagttaagcttgtcaacattcgcaatgacgacattacggacgggaatcccaagctgacattgggtctcatatggacgataatactgcattttcaaatctccgacatccatgtcactggagagtctgaagatatgtcggcaaaggaacgtctgcttctctggacacagcaagctaccgaaggttatgctggcatcaggtgcgaaaatttcacaacgtgttggagggatggcaagctgttcaacgcaatcatccacaaatatagacccgaccttattgatatgaataccgtagccgtccagagcaacctggccaatttggaacatgcattctatgttgccgaaaaaatcggtgtgattcggctccttgaccctgaagacgtggacgtcagctccccagatgaaaaaagcgtgatcacctatgtgagcagcctttatgatgcctttcctaaggtacccgaaggtggagaggggattggtgcgaacgatgtcgaggtgaaatggattgaataccaaaatatggtgaattatctgatacagtggatccgccatcacgttacaaccatgtctgagcgtacattcccaaataatcctgtcgagctcaaggctctatataaccagtaccttcagtttaaggagaccgagataccaccgaaagaaaccgaaaagtccaaaatcaagcgcctctacaaattgctggaaatttggatcgagtttgggcgaattaaacttttacagggttaccatcctaacgacatcgagaaggagtggggtaagctgatcatcgcaatgttagagcgcgaaaaagccctgagacctgaggtcgagcgcctggagatgttgcagcagattgctaacagagtgcagagggactccgtcatttgtgaagataaacttatccttgccggaaacgccctgcaatcggactccaagcgattagagtccggggtgcagtttcagaatgaggcagagattgccggttacattctcgagtgcgagaacctgctcaggcaacatgtcatcgatgtccagattctgatagacggcaagtactaccaggccgaccaactggtgcaacgcgttgccaaacttcgggacgaaatcatggcacttagaaacgagtgttcatctgtctattcaaagggtaggatcttgacgaccgaacagacaaagctgatgatttcgggcataacccagtccttgaattctggtttcgcacagaccctccatccctccctcaccagtggcctcacacagagtttgacgcccagcttgacctcttcaagcatgaccagtgggctgagcagcggcatgacaagtaggctcactccgtcagtaactcctgcgtatacacctgggtttccttcagggctcgtacccaacttctcctcaggagtagaaccaaactccctgcagacacttaaactgatgcagatcaggaagccattattgaagagcagcttgcttgatcagaacttaacagaagaggagatcaacatgaagttcgtgcaagaccttttgaactgggttgacgaaatgcaagtgcagctggataggactgagtgggggtctgacctgccgagcgtggaatcccatttagagaatcataagaatgttcatcgagccatagaggagttcgagtcgtccttgaaagaagcaaagatctccgaaatccagatgactgcacccctgaaactgacatacgccgagaaactccaccggctggagtcacagtacgctaaactgctgaatacctctcgaaaccaggagagacacctggacaccctgcacaactttgtgtcaagggccaccaacgagctgatttggctgaacgagaaagaagaggaggaagtagcctatgattggagtgaaagaaacactaacattgcaagaaaaaaagactaccacgctgaattgatgagagagttggatcagaaagaggagaatataaaatccgtacaggaaatagcagagcagcttctgctagagaatcacccagcaagactaaccatagaggcgtacagagccgccatgcagactcagtggtcgtggatacttcagctgtgtcagtgtgtagaacagcatattaaggagaacactgcctacttcgagttttttaacgacgcaaaggaagccacggactacctgcgcaacctcaaagatgctattcagaggaagtattcctgtgatcgctcgagcagtatccacaaattggaggatctagtccaagagtccatggaggagaaggaggaactgttgcaatacaagtccaccattgccaacctgatgggcaaggctaaaacaattattcagctgaagcccagaaactctgactgtccactgaagacatctatacctattaaggcaatttgtgattaccggcagattgagattacaatctataaagacgatgagtgcgtgctggccaacaattcccacagagctaaatggaaggtgatcagccccactggtaatgaagctatggtacctagcgtatgttttacagtacctcctccaaataaggaagctgtggatttggccaaccgcattgagcagcagtatcagaatgttctgactctgtggcatgagtcccacataaatatgaagagcgtcgttagctggcactatctgattaacgaaattgaccggatacgggcatccaatgtcgccagcattaagaccatgctcccaggcgaacaccagcaggtgctgtctaacttgcagagccgctttgaggatttcctcgaagattctcaggagagccaggttttctctgggagtgacataacacagctggagaaggaggtgaacgtgtgcaaacagtactaccaagaactcttgaagtccgccgaacgtgaagagcaggaagagtccgtttataacctgtacatcagtgaggtacgcaacattagacttcggttagagaattgtgaagaccgattgatacggcagatccggacccctctggaacgggatgatctgcatgagtctgtttttaggattacagagcaagaaaagcttaagaaggaactagaaaggttgaaggatgacctcggtaccatcacaaacaagtgtgaggaattcttctctcaagctgccgcttcttccagtgtgccaaccctgcgatccgaactcaatgtagttttgcagaacatgaaccaagtgtactcaatgtcctctacctatatcgacaagctgaaaactgtgaatttggtactaaagaatacccaagccgctgaagccctggtaaagctgtacgagactaagctgtgcgaggaagaagctgtcatagccgataaaaacaacatcgagaaccttatcagcacactgaaacaatggcgctccgaggtcgatgagaagcgccaggtctttcacgccctggaagatgagttgcagaaggccaaggcgatatccgatgagatgttcaagacctataaggaacgcgacctggacttcgactggcataaagaaaaggccgatcaattggttgaaaggtggcaaaatgtccatgttcaaattgataatcggttgagggacttagaaggtatcggaaaatctttaaagtactacagagacacatatcatccacttgacgattggatccaacaggtggagaccacccagagaaaaattcaggaaaatcagcccgagaatagcaaaaccctggccacccagctaaatcaacagaaaatgctcgtcagcgagattgagatgaagcagtcaaagatggatgagtgccagaaatatgccgaacaatactctgccactgtaaaagattacgaactgcagacaatgacctaccgtgcgatggtggactcacagcagaaaagtcctgtgaagaggaggaggatgcaatccagcgcagacctcattatccaagagtttatggacctccggacccgttataccgcactcgtgaccctcatgacccaatatattaagtttgcaggcgattcattgaagcgactcgaagaggaggaaaaatcgctcgaggaagagaagaaggagcacgttgagaaagctaaggagctccagaagtgggtgagcaatatctccaaaaccctgaaagatgccgagaaagcaggaaaaccaccattctccaagcagaagatctcttccgaagagatttccactaaaaaagagcagctgtcagaggctctacaaaccattcagctgttcctagccaagcacggtgataagatgacggacgaggagcgaaatgaactggaaaagcaggtgaaaaccctgcaggaaagttataatctgctgttcagcgagtccctgaagcagttgcaggagtcgcagacttcgggggacgttaaggtggaggagaaactggacaaggtgattgctggtaccattgatcaaactacaggcgaagtcctgtccgtcttccaagccgtactgcggggtctcatcgattacgatacaggcattcggctactcgagacccagctgatgatctctggcctgatttcacccgaactgcggaaatgttttgaccttaaggacgctaagagccatgggctgatcgacgagcagattctgtgccagttaaaggaactctcaaaggcaaaagagatcatttcagcagcttcccccactacaatcccagtgttggatgctctggctcagagcatgattacggagagtatggccataaaggtactggagattctgcttagtactggtagcctcgtgattccggctaccggggaacaactcaccctgcagaaggcattccaacagaatttggttagctctgctctgtttagtaaagtgttggaacgccagaacatgtgcaaggatctgattgacccttgtaccagcgaaaaagtgagtcttatcgacatggtgcagcgatctactctgcaggaaaacaccggcatgtggcttctgcccgttcgcccgcaggaaggaggaagaatcactttgaagtgcggtaggaatatttctatcttgcgggcggcacacgaagggctgatcgacagagagacaatgttccgcctgctgagcgcacagctgctgagcgggggtctaattaacagcaacagtggacaacgaatgactgtggaagaggctgtgcgggagggagtgatagaccgggatactgcaagctccatcctgacctaccaggtccaaacaggcggaatcattcagagcaacccggccaaaaggctcaccgtggatgaggcagtgcaatgtgacctgatcacatcttcaagcgccctgcttgtgcttgaggcccagcggggttatgtgggactgatctggccccactctggagaaatctttcccacgagttcttcgctgcagcaggagcttatcaccaatgagttagcatacaaaatcttgaatggtaggcagaaaatagctgcgctatatattccagagagcagccaggtgatcggactggacgcggccaagcagctggggatcatagataataataccgctagcatcttgaaaaatatcaccctcccagataaaatgcctgatctgggtgatcttgaagcgtgtaaaaacgcccggcgatggctttctttctgtaaattccaaccgagcactgtgcacgactatcggcaggaagaggatgtgttcgatggcgaggaacctgtgaccacccagacttctgaggagactaagaagctttttctcagctatctaatgattaattcctacatggacgccaacactggccaaagattattactttacgacggcgatctggatgaagcggtggggatgctgctagagggctgccacgccgagttcgatggcaatactgcaattaaagaatgcctagacgtactttcaagtagtggtgtcttccttaacaacgcctcaggacgagaaaaggatgagtgcaccgcaacacctagctcttttaacaaatgccactgcggcgaaccagaacatgaggagacaccagaaaatagaaagtgcgctatagatgaagagttcaatgagatgaggaatactgttatcaattccgaattcagtcagagtggtaaactggcttcaaccattagtatcgaccccaaagtcaattcatcaccatcagtgtgcgtgccgagcctaattagctatttgactcagactgaacttgcagacatttctatgttaaggtcagacagcgagaacattctgaccaactacgagaatcagtccagggtggaaacaaacgaacgtgccaatgagtgtagtcactcaaaaaatatacagaacttcccatctgatctgatcgagaatcccatcatgaagtcaaaaatgagtaaattctgtggtgttaacgaaacggagaacgaggacaataccaatcgagactcccccatctttgactactcccctcgactctccgcactgctgtctcacgataagctgatgcacagtcaaggatcatttaacgatacccacacacccgagagtaatggaaacaagtgcgaggctcccgcgctgagcttcagcgataaaactatgctctccgggcagaggataggcgagaagtttcaggatcagttcctcgggatcgctgccatcaacatttctctccctggggagcaatacggacagaagtcattaaacatgattagctccaacccacaagtccagtaccataatgataaatatataagcaacacaagcggcgaggatgagaagactcaccccgggttccagcagatgccggaggacaaggaggatgaaagcgagatagaagagtatagctgcgccgtgacaccaggcggcgataccgataacgccatcgtcagcctgacatgtgcaactcctctgctagacgaaactatttctgcatccgactatgagacctccctgctgaatgatcagcagaataacactgggacagacacagattctgacgatgacttctacgacactccactgttcgaggacgatgatcatgactccctccttctggatggtgatgaccgcgactgcctccaccccgaagactacgacaccctgcaggaggagaatgacgaaaccgccagccccgccgacgtgttctatgatgtctctaaagaaaacgagaactccatggtacctcagggggccccggtcgggtcgctctcagttaagaacaaagcgcactgtctgcaagacttccttatggatgtggagaaagatgaattagactccggggaaaagattcacctgaatcctgtgggatcagacaaggtgaatggacaaagcttagaaaccgggagcgaaagagagtgcactaacatcctggagggagatgaatcagatagtctcacagactatgacatagttggaggaaaggagtccttcacagcaagtctcaaatttgacgattcaggtagctggcgcggaaggaaagaggagtatgtaacgggacaggaattccatagtgacacggaccatctcgatagcatgcaatctgaggagtcctacggcgactatatctacgacagtaatgatcaggatgatgacgatgatgacgggattgacgaggagggtgggggaattagagacgagaacgggaaaccccgctgccaaaatgtagccgaggacatggatatccagctgtgtgcctctatcctcaatgagaacagtgatgaaaatgagaatatcaacaccatgattttgctcgacaaaatgcacagttgctccagtctagagaagcagcaacgggtgaatgttgtccaacttgcttccccgtctgaaaacaatctggttacagaaaagagtaacctgccggaatacaccaccgaaattgccgggaagtctaaagaaaatctgctgaatcatgaaatggtgctcaaagatgtcttaccacccatcatcaaagatactgagtctgagaagacgttcggccccgcgagtatctcacacgacaacaacaacatctccagcacatccgagctgggtaccgacctggcaaacacaaaagtgaagctgatccagggcagtgagctgcccgagctgactgactccgtcaaaggaaaggacgaatatttcaaaaacatgactcccaaggttgactccagcctcgaccatatcatatgtactgagccggatcttattggtaagcccgccgaggagtcccacttgtccctgatcgccagtgtgactgataaggatcctcaagggaatgggtcagatttgattaaaggacgtgacggcaaatctgatatccttatcgaagacgaaacttcaatccagaagatgtacttaggcgaaggggaggtgctggtggagggtctggtggaggaggagaatcgccatctgaagctcctccctggcaagaatacgagagacagctttaaactaattaattcacagttccccttcccacagatcactaataacgaggagctaaaccaaaaagggtctttgaagaaagccactgttaccctcaaagatgagcccaataatctgcagatcatagtctcaaaatcccctgttcaattcgaaaatctggaagagatatttgacacgagcgtttcaaaggagattagtgacgacattacaagtgatatcacaagttgggaaggaaacacacacttcgaagaatccttcaccgacggcccagagaaagagctggatctttttacatacctgaagcactgcgctaagaacattaaagcaaaagacgttgcgaagcccaacgaagatgtgccctcccacgtgctcatcacagcgccccctatgaaggagcacctccagctgggcgtcaacaacacgaaggaaaagtcaacctcaacacagaaggactctcccctaaatgacatgatacagagcaacgatctgtgctctaaggagagcatctctggtggtgggacggagatcagccagttcacccccgagtcgattgaggcaaccctgtccatactttctcggaaacacgtggaggacgtcggcaaaaacgattttttgcagtccgaacgttgtgcaaacgggctcggaaatgacaattcctcgaacacactcaatacagattattcctttcttgaaattaataataaaaaagagcgcattgagcagcaactgcctaaagagcaagctctctccccaaggagccaggagaaggaggtccagatccccgagctgtcacaggtgttcgtggaagacgtgaaagatattctcaagagtcgtctaaaagagggacatatgaacccgcaggaggtagaggagcctagcgcatgtgccgacaccaagatactgatacagaatttgattaaacggatcaccaccagtcaactcgtgaacgaggcgtcaacggtgcccagcgatagtcagatgtcggacagcagtggcgtgagccccatgaccaactcttcagaactgaaaccagagagcagggacgaccccttctgcattggcaatctgaagtccgagctgctcctcaacattttaaagcaagatcaacatagccaaaaaattactggtgtgttcgaactcatgcgtgaactgactcacatggaatacgatctagaaaaacgcggaattacttctaaggtgctgccgctgcagctggaaaacatcttctacaagcttcttgccgacgggtatagcgagaaaatcgagcacgttggggattttaatcaaaaagcctgcagcactagtgagatgatggaagagaagcctcacatcctgggagatatcaagtcaaaagaaggaaattattactcccccaatctggagaccgtcaaggagattggcctggaatcttccacagtttgggccagcacactgcctcgcgacgaaaaactgaaggacctgtgcaacgactttccgagccatttggagtgcacaagtggatccaaggagatggctagtggagacagttctacggagcagtttagcagtgagctgcagcagtgcctccaacacaccgaaaaaatgcacgagtacctgacattgctccaggatatgaaaccgcctcttgataatcaggaatctctagataataaccttgaagctctgaagaatcaactccgccagcttgagaccttcgaactgggtttggcacccattgccgttatcctgagaaaagatatgaaactggctgaagaatttcttaagtcactcccctctgacttcccccgcggacatgtggaggaactgagcatatcccaccagtccctaaagacagctttctcaagcctatcaaatgtgtctagcgaacgcactaaacagatcatgctggccattgattccgagatgtcaaagttagctgtttcccatgaggaattcctgcacaagttaaaatcctttagtgattgggtgtccgagaaaagcaagtccgtgaaagacatagagatcgtaaacgtgcaagactccgaatacgtgaaaaaaagactggaatttctaaaggccaacaatgtgctcaaggacctcggccataccaagatgcaactcgaaacaactgccttcgatgtgcagttcttcatcagcgagtatgcccaggatctgagccctaaccagtctaaacagttgctccggctgctgaacacaacacagaaatgttttctggacgtgcaggagtctgtaaccacacaggtcgaacgcttagagacacagctccatctggagcaggatctggatgaccaaaagattgtggccgaacgccagcaggagtacaaagaaaagctgcaagggatctgcgatctactgacacagactgagaaccgcttaataggtcaccaggaggccttcatgataggggacggcacagttgagctgaagaaatatcagagtaagcaggaggaactccaaaaagatatgcagggctccgcacaggccctcgcggaggtggtcaagaatactgagaacttcctgaaagagaatggtgagaagctgagccaagaagacaaggccctcattgagcagaagctaaatgaagctaaaataaaatgtgagcagctgaacctgaaggccgagcaatcaaagaaggagctggacaaggtagtcacaactgccatcaaagaagagacagaaaaggtggcagcggttaagcagctggaggaaagcaagacaaaaatagagaatctgctggattggctcagcaatgtggacaaagacagtgaaagggcggggaccaagcataaacaggttatcgaacaaaatggcacacacttccaggagggtgacgggaagtctgctattggcgaggaagacgaggtcaacgggaatctgctggagactgatgtggacgggcaggttggcactacacaagagaaccttaatcagcagtaccaaaaagtaaaagctcagcacgaaaagattattagtcagcaccaagcagtcattatcgcgactcagtccgcccaggtgctgctggaaaagcagggtcaatatctttctccagaggagaaagagaagctgcagaagaacatgaaagaactgaaagtccactacgaaaccgcactagctgagagcgagaagaaaatgaaattgacacactcactgcaagaagaattagagaagttcgatgcagactacacggaatttgagcactggcttcagcagtccgaacaggaactggaaaacctggaagccggggccgacgacataaacggactcatgacaaaactgaagcggcaaaagagcttctctgaggacgtcatcagtcacaagggagacttgcgatatataacaatctccggtaaccgagttctggaagctgctaagtcctgttcaaagagggatggaggtaaagtggatacatccgccactcatcgagaagttcaacgtaaattagatcacgctacggatagattccgctcactgtattctaaatgcaacgtgctgggcaacaacctgaaggacctcgtggacaaataccagcactatgaagacgcatcgtgtggactcctggcaggtttacaggcttgcgaggctaccgcttccaagcatctcagcgagcccattgctgttgaccctaagaatctgcagcgccaactggaggaaacaaaggccctccagggacaaatctcctcacagcaggtcgcagtggagaaactcaaaaagacggctgaggtgctgctggacgccagaggctccttactccctgctaagaacgacatccagaagactcttgacgatatcgtgggccggtatgaggacctctccaagtcggtgaatgaaaggaacgagaagctacaaatcaccctcactagaagcctgtcagtccaggatggactagacgagatgcttgactggatggggaatgttgagtctagcctcaaggaacagggccaagttccactgaacagcacagccctccaggacattattagcaagaacatcatgctcgagcaagacattgccggacgtcagagcagcataaacgctatgaatgagaaggtgaaaaaatttatggagactacagatccgtctactgcctcatctttgcaggccaagatgaaggatttgtctgcaagattcagcgaagcctcgcataaacataaagaaaccctggctaagatggaagagctcaaaaccaaagtcgaactgttcgaaaacttgagcgagaaactgcagacattcctggaaactaagactcaagctctaaccgaggttgatgtgccaggcaaggatgtgactgaacttagtcagtatatgcaggaaagtactagcgaatttcttgagcacaaaaagcaccttgaggttctgcacagcctcctaaaagagatcagctcccacggccttccgtctgataaagctctggtgttggagaagaccaacaacctttcaaaaaagtttaaggagatggaggataccataaaggaaaagaaggaagcagtgacatcctgtcaggaacagctcgacgcttttcaggttctcgtcaagagcctaaagtcgtggatcaaggaaaccacgaagaaagtgcccattgttcagcccagtttcggggctgaagacctgggaaaaagtctggaggacacaaagaagctgcaggagaagtggagcttaaaaacacccgaaatacagaaagtaaataattcaggcatatcgctgtgcaacctgatcagcgctgtgacaacacctgctaaggccattgcggccgtgaaatccggaggggctgtcttgaacggcgaagggaccgccaccaatacagaggagttctgggcaaataagggcctcacttctattaagaaggacatgactgatattagtcacggatatgaggatttgggtttactcctgaaagataaaatcgccgaacttaacaccaagttatccaagctacaaaaagcccaagaggagagctccgccatgatgcagtggttacagaagatgaataaaactgcgaccaagtggcagcagaccccagctcccaccgacaccgaggccgtaaagactcaagttgaacagaataagtcctttgaagcagagctgaagcaaaacgtgaacaaggtgcaagagcttaaagacaaactcacagagttgctggaggaaaaccctgatactccggaggcccctcggtggaaacaaatgctgaccgaaatcgactctaagtggcaagagcttaaccagttaaccatcgatcgccagcagaagttggaggaatcctccaataacctgacacaattccagacagtcgaggctcagctgaagcaatggctggtggagaaggaattgatggtgtctgtgttggggccactttctatcgacccaaatatgctcaacactcagaggcaacaggtgcaaatactgttacaggagtttgccactcgcaagcctcagtacgagcagttgaccgccgcagggcaaggcatactgagccgtcccggagaggacccttccctgcgagggatcgtgaaggagcaattggccgcggtgactcaaaagtgggatagcctcaccggccagctctccgaccgctgtgactggatcgatcaggcaattgtgaagtctactcaatatcagtctctcctgagatctttatcagacaagctcagcgacctagacaacaaactgtctagttcactggccgtctccacacaccccgacgcaatgaatcagcagcttgagacggcacagaaaatgaaacaagaaattcagcaggagaagaagcagataaaggtggcccaggctctgtgcgaggacctgtccgctctggtgaaagaggaatatttgaaagccgaattgtctcgtcagctggagggaatactgaagagcttcaaagacgtcgagcagaaagcagaaaatcatgttcagcatctgcaatcagcatgtgcgtcttcccatcaatttcaacagatgagtagagatttccaggcgtggcttgacactaagaaggaggagcagaataagagccaccctatcagtgctaaactggatgttctggaaagtctgatcaaagaccacaaggatttctccaaaacgctgaccgcacagagccacatgtacgagaagactattgccgagggcgagaatctgctgctcaagacgcagggcagcgaaaaggctgccttgcagctgcagctgaatacaatcaaaacaaactgggacacattcaacaaacaggtcaaggagcgtgagaacaaattgaaggaatcacttgagaaggcattaaaatacaaagaacaggtggagacactgtggccatggatcgacaagtgccagaacaacctggaggaaatcaaattttgtctggatccagcagagggtgagaactccatcgctaaactcaagtcactgcaaaaggagatggatcagcacttcggcatggttgagctgctgaataataccgccaacagtctgctatcagtgtgtgagattgataaagaggtagtcactgacgagaataaatcactcattcagaaagtggacatggttacagagcagttgcactcgaaaaagttttgcctcgaaaatatgactcagaaatttaaagagttccaggaggtcagcaaggaatctaaacgccaactgcagtgtgcgaaagagcagctggacattcatgattccctgggcagccaggcctatagcaacaagtacctcacaatgttgcagacccagcagaagtcactgcaagccctgaagcaccaggtggacctggctaaacgcctggcccaggatctggtagtggaggcatccgactccaaaggtacaagcgacgtcttgttgcaagtggagacaatcgcccaggagcacagcactcttagccagcaggtggacgaaaagtgctctttccttgagacaaagctgcagggcatcggacatttccagaatactattcgtgaaatgttctctcaattcgctgagttcgacgacgaactggattcgatggcaccagttgggagagatgctgagacattacagaagcagaaggaaactattaaggcctttctaaaaaagctggaggcgctcatggccagcaatgataacgctaataaaacctgtaagatgatgctggcaacagaggaaacgagtcccgacctagtcgggatcaagagggatctggaagctctatctaagcaatgcaataaattgttggatagagcccaggcgcgagaagaacaggtggaggggaccataaaacggctcgaagagttttactctaaattaaaggagtttagcattctgctgcagaaagcggaggaacacgaggagtctcaggggccagtgggaatggaaaccgagacaatcaatcaacagcttaacatgtttaaggttttccaaaaggaggaaatagagccattgcaggggaagcagcaggacgtaaactggctgggacagggactgatacagtccgctgccaagagcacgagtacgcaggggctggagcacgacctggatgacgtcaacgctagatggaaaactctcaacaagaaggtcgcacaacgagcggctcaactgcaagaggcgctactccactgcgggaggtttcaggatgcgctggaatcactactctcgtggatggtggatactgaagagctggtggccaatcagaaaccaccatctgccgagtttaaagttgtgaaggctcagatccaagagcaaaagctgttgcaaaggctgctggatgaccggaagagcaccgtggaagtgatcaagcgtgagggagaaaagatcgccacaaccgctgagccagccgacaaagttaagattctgaaacagttgagcctgctggacagtcgctgggaggcccttctgaacaaagcagagaccaggaacaggcagctggaagggatctccgttgtggctcagcaattccacgagacacttgagccccttaatgagtggctgactaccatcgaaaaaagattagtcaattgtgaacctatcgggacccaggcgtccaagctcgaagaacagatcgctcagcacaaagccctggaagatgacatcatcaaccataataagcacctccaccaggcggtctccattggacaaagcctgaaagttctgtcatcgcgcgaggataaggacatggtgcaatctaagctggacttctctcaggtgtggtatatcgagatccaagagaaatcccattcacgtagtgagctgcttcagcaagccctctgtaacgccaagatttttggggaagacgaggtggagctgatgaactggctaaatgaagtgcacgataaactaagcaagctgagcgtgcaggattactctaccgaagggctatggaagcagcagtccgagctgcgagtactccaggaagatatccttttaagaaaacagaacgttgatcaagcactgctgaatgggctcgagctcttgaagcagacgacaggggacgaggtactcattattcaggataaattggaggcaatcaaagcacgatacaaagacatcaccaagctgtccactgacgtggccaagactctagaacaagccctgcagcttgcacgccgcctacacagcactcacgaggaattgtgtacctggctggacaaggttgaggtggaattgctgagctatgagacccaggtgcttaagggggaagaggctagccaagctcagatgcgccccaaagagttgaagaaggaagccaagaacaacaaggccctgctggattcgttgaacgaggtgtcaagtgctctactggaactggtgccctggagagcccgggaggggctggagaaaatggtggccgaggataatgagaggtaccggctggtctcagacacaataacccagaaggtagaggaaattgatgccgccatcctaaggtctcaacagtttgatcaagcagctgacgccgaattaagttggattacggaaacggaaaaaaagctcatgtcactgggcgatatccggcttgaacaagatcaaacctcagcccagttgcaggtgcagaagactttcaccatggaaattcttaggcacaaggacattattgacgatctcgttaagtctgggcacaaaatcatgacagcctgcagcgaggaagagaaacagagcatgaagaagaaactggataaagtgttaaagaattacgacaccatatgccaaataaactcagagcggtatctccagttagaacgggcccagagcctcgtcaatcagttctgggaaacctacgaggagttgtggccttggctgaccgaaacccagagcatcatctcccagctgcccgcgcccgccttggaatacgagaccctcagacagcaacaagaggaacaccgccagctccgcgaactgatagccgagcataaaccgcatattgataagatgaacaaaacgggtccccaattgctggagctgtccccgggggagggatttagcattcaggagaagtatgtggcagctgatacactgtactcacagatcaaggaagatgtcaaaaagagagctgttgcgctggatgaagctatttcacagagtacacagtttcacgacaaaatagatcagatactggaatctctggagcggattgtggagcgtttgcgtcaacccccaagcatctcagcagaagtcgagaagatcaaagaacagatttctgaaaataagaatgtgtcagtcgacatggagaaactgcagcccctgtacgagaccctgaagcaacgaggcgaggaaatgattgcgcgttcgggcgggaccgataaagatattagcgctaaagccgtccaggataaactcgatcagatggtctttatctgggaaaacatccataccctcgtcgaagagagggaggccaagctgctcgatgtgatggaactggcagaaaagttttggtgtgatcacatgtcccttatagtcaccatcaaagacactcaagactttattagagacctggaagaccccggaattgacccatctgtagttaaacagcaacaggaggccgcagaaaccatacgcgaagagatagacggattgcaggaggaattagatattgtgatcaatctggggagcgaacttattgccgcttgtggggaacctgataagcctatagtaaagaagtccattgacgaacttaattctgcttgggacagcttaaacaaggcatggaaggataggattgataagctggaagaggcgatgcaagctgcagtacagtaccaagatggcttgcaggcagtgtttgattgggtggacattgccggcggcaaactggcaagtatgtccccaatagggaccgacctggagacggtcaagcagcagatcgaggaactcaagcagtttaagtctgaagcctatcaacaacaaatagagatggaacgcctgaatcaccaggcagagctgcttcttaagaaagtcacagaggaatctgataagcacacagttcaagatccccttatggagctcaaactcatctgggacagtctcgaggaacgcattattaaccggcaacataaactggagggcgctctgctggcattaggacagttccagcacgcacttgacgaattactcgcctggctcactcacactgagggcctgcttagtgagcaaaaacccgtgggtggagatccaaaggcaatcgagattgagctggctaagcatcacgtgctgcaaaatgacgtcttggctcatcaaagcactgtcgaggccgttaacaaagcaggaaacgatctcatcgagtcctctgccggagaagaggcatctaatcttcagaacaaactcgaggtgctcaatcagagatggcagaacgtgctagagaagactgagcagcggaaacagcagcttgatggagcactgaggcaggcaaaaggtttccatggggagatcgaggacctccaacagtggctgacggacactgaacggcacttactcgccagcaagcctctggggggccttcctgaaaccgcaaaggagcaactaaacgttcacatggaagtgtgcgccgctttcgaagccaaggaggagacctacaaatccctgatgcaaaagggtcaacagatgctggctaggtgtccaaagtccgccgagactaacatagaccaggatataaacaatctcaaggaaaagtgggagtccgttgagactaaactcaatgagcgcaagaccaaactcgaagaagctcttaacctcgcaatggagttccataatagtttacaggactttattaattggctgacacaggccgaacaaaccctgaacgtagcctcaaggccctcccttattctagatacagtgctttttcagatcgacgaacataaggtgtttgccaacgaagtcaattcccatagagaacagataatcgagttggacaaaacggggacgcaccttaaatacttcagccagaagcaggatgtggtactgatcaaaaatttgttgatctcagtgcagagcaggtgggaaaaggtcgtacagcgcctcgtcgagagaggtcgatcccttgacgacgctcgaaaaagagcgaagcagtttcatgaggcatggagcaagcttatggagtggctggaggaatccgaaaaatctcttgacagcgaactcgagattgcgaatgaccccgataagatcaaaacacagctcgcgcagcacaaggagtttcagaagtctcttggtgccaagcatagcgtttacgatacaaccaatagaacaggtcgctccctgaaggaaaagacatctctggccgacgacaacctgaaactggacgacatgctcagcgagcttcgcgacaagtgggacaccatttgtggaaaatcggtcgagagacagaacaagctggaggaagctctcttatttagtgggcaattcacagacgcccttcaggctctcatagattggctgtaccgcgtggagccccagctagctgaggaccaacctgtgcacggtgacattgaccttgtgatgaacctcatcgataatcacaaggcctttcagaaggaactgggaaagcgtacttcaagtgtacaggctctgaaaaggtctgctagggaattaattgagggctcccgggacgacagcagctgggtcaaggtgcaaatgcaagaactgagtacacgctgggagaccgtgtgtgccctgtcaattagtaagcaaacaagattagaagctgctctgagacaagctgaagagttccactccgtggtgcacgcacttcttgagtggcttgctgaagcagagcaaactttaagattccacggcgtgctacctgacgacgaggacgcacttcgaacccttattgatcagcacaaagagttcatgaaaaagctggaagagaaacgcgcagagctcaacaaagccacaaccatgggggacacagtgctggcaatctgccacccagactctatcactactattaagcactggattaccattatacgggccagatttgaggaggtcctggcctgggctaagcagcaccagcagagactggcctcagctctggcgggcttgatcgcaaagcaggaactactggaagccttgctggcatggcttcagtgggccgagaccacgctcacagacaaggataaagaggtgatcccacaggagattgaagaggtcaaggcacttattgccgaacaccagactttcatggaggagatgactcggaagcagccagacgtagacaaggtaacaaaaacgtacaaaagaagggctgccgatccttcaagcttacagtcacatataccagtgttggacaagggtcgagccggtaggaagcggtttccagccagcagcctttatccttctggctcccaaacccaaatcgagaccaagaatcctcgagtgaatcttctggtcagcaaatggcagcaggtctggttgcttgcattagagcggaggcgaaaattgaatgatgctctggaccgcctggaggagcttagagaattcgcaaatttcgacttcgatatctggcgtaagaaatacatgcgctggatgaaccataagaaaagccgggttatggacttctttaggagaatagacaaagatcaagatggaaaaatcacacgtcaggagtttattgatggcattttgtcgagcaaatttcctacatcgagactggagatgtccgccgttgcagacatatttgatcgggatggagacgggtacatcgactattacgaatttgtggccgccctacaccccaacaaggatgcctacaaaccgattaccgatgcagacaagattgaagatgaggttacccgccaggtggccaagtgtaaatgcgccaagcgctttcaggtcgaacagataggcgacaacaaatatcgcgttagcttccagagtaatttcggtgattcccaacaattaaggctcgtacgtattctcaggagtaccgtgatggtccgagttggagggggatggatggctttagatgaatttttggtcaagaatgacccttgtcgcgtccatcatcatgggtcaaagatgctccgaagtgaaagcaacagctccattactaccacccagccaacaatcgctaaaggtagaactaacatggagctgagggaaaagtttatcctggccgatggggcttcacagggtatggctgcctttcgtccccgcggacgcaggtcccgtccgtccagcaggggagcatcccccaatcgcagtacatccgtttcctcgcaggctgcccaggctgcttctcctcaagtcccagcaacaacaaccccaaagggcactccaatccaaggttctaaacttcggcttcccggatatctgtccggcaaaggtttccactccggagaggatagtgggctcatcaccacagctgcggcccgcgtgaggacgcagtttgcagactccaaaaagacaccttctcgacctggatctcgagcaggcagcaaggcgggcagcagagcgagctcacgcaggggatcggacgcttccgacttcgatatctcagagatccaaagcgtgtgcagcgacgtggaaacagtcccacaaacccaccggcccactccccgcgctggatcgagacccagcacagctaagccatccaaaattcccaccccacagaggaagtctcccgcttcgaagctagataagagctctaaaagatag

SEQ ID NO: 115319 - DNA, 16374 bp, Artificial Sequence
  Description of Artificial Sequence: Synthetic coding sequence
atggctggctacctgtcgccagctgcctacttgtacgtagaagagcaggaatatctgcaagcgtacgaagatgtcctggaaagatacaaagatgagcgggacaaggtgcagaagaaaacattcaccaaatggatcaaccaacacctgatgaaagtccgtaaacatgtcaacgatctttacgaggacctccgcgacggacacaacctcatttctcttctggaggtactcagtggggacacactgccccgtgaaaaaggacggatgcgtttccataggctccaaaatgtgcagatagccctggactatctgaagaggcggcaggttaagcttgtcaacattaggaacgacgacattaccgatggtaacccgaaactgaccttggggctgatctggacaattattctgcactttcaaatcagtgatattcacgtgaccggggagtctgaggatatgtccgccaaggaaaggctattactgtggacgcaacaggccaccgaaggctacgcagggattagatgcgaaaattttaccacgtgttggcgtgacggcaagctgttcaatgcaatcatccataagtatcgacccgatctcattgacatgaacacggtggcggtgcaatctaatctcgccaatctggaacacgcattttatgttgctgaaaagattggggtgatacgcttgctggaccctgaggatgtggacgtgagctcgccagacgaaaaatctgtgattacctatgtgagttcactttacgacgcttttcctaaggttccggaggggggggaagggatcggggctaacgacgtggaggtgaaatggattgagtatcagaacatggtgaactacctgattcagtggatccggcaccatgtaactacaatgtcagaacgtacttttccaaataatcccgttgagctgaaggctctgtataaccagtatctccagtttaaggaaaccgagatcccaccgaaagaaacggagaagagcaagatcaaaaggctttataagctcttggaaatctggatagaatttggtcgtatcaaattgctacagggttatcacccgaatgacatagagaaagagtggggaaaattgataatcgctatgctcgagcgggagaaagccctccgacctgaggtggagcgtctcgaaatgctgcaacagattgccaaccgggtgcagcgggattctgtgatttgcgaggataagctaatcctggccggaaacgccctgcagagtgatagcaagcggcttgagtcgggagtgcaattccagaatgaagccgagatcgctggatatattctcgaatgtgaaaatctgcttaggcagcacgtcatcgacgtgcagattctgattgatgggaagtactaccaggccgaccaactcgtgcaaagagtggctaagttgcgggacgagattatggccctgaggaacgagtgctcctccgtgtatagcaaaggccgcattctcaccaccgaacagacgaaactgatgataagtggcataacacagtcactgaattctgggtttgctcagaccctccatccgagcctaacctccggtctcacacagagcctaacacccagcctgaccagttcttcaatgacttcaggccttagctctggaatgacctcccggcttacacctagtgtgacacctgcctacacgcctggctttccctcaggcctggtacccaacttttctagcggcgtcgaaccaaactctctgcagactctgaagctgatgcagattagaaaaccgttgctgaagtcctccctcctggatcaaaatttgactgaggaagagataaatatgaagtttgttcaggatctgttaaactgggtagacgagatgcaggtacagttagataggactgagtggggatcggatttgcccagtgtcgagtcacacctcgagaaccataagaacgtccaccgggccattgaagaattcgagtcttccctgaaggaggccaaaatcagtgaaattcaaatgacagcaccgcttaagctcacctacgcagaaaaactgcacaggctagagtcacagtatgccaaacttctgaatacctcccgcaatcaggaacgccaccttgacacactccataacttcgtgagtcgggcaactaatgagctgatttggttgaacgaaaaagaggaggaagaagttgcctacgattggtcagaacgcaataccaacatcgccagaaaaaaggattatcacgccgagctcatgagggagctggaccagaaggaggaaaacattaagtcagtccaggagattgccgaacagctgctgcttgaaaatcatcctgcccgtctgactatcgaggcataccgggccgctatgcagacacagtggtcctggatcctacagctgtgccaatgcgtggagcagcacatcaaggagaatacagcctatttcgaattttttaacgatgccaaggaggcgacagattatcttcgcaacctgaaagatgctatacaacgaaagtatagctgcgaccggtccagctcaatccacaagcttgaggacctggtgcaggaatctatggaggaaaaagaagagctgttgcagtataaatcaacaattgcgaaccttatgggaaaagcgaagactatcattcaactgaagcccagaaatagcgactgccctctcaagacttccatcccgattaaggccatctgcgactataggcagatcgagattacaatctataaagacgacgaatgcgtgctggccaacaacagccatcgagcaaaatggaaagtgataagccccactggtaatgaagccatggtcccatctgtgtgtttcaccgtgcctccccctaacaaagaggccgtcgacttagcaaatagaatcgaacagcagtatcagaatgtgctaacactgtggcatgagtctcacatcaatatgaagagtgtggtgtcttggcactatttgattaatgagatcgatagaatcagagctagtaacgtcgctagtattaagactatgcttcctggcgagcatcagcaggttctctcgaacctgcagtccaggttcgaagacttcttggaggactctcaagaatcacaggtgttctcaggtagcgatataacccaacttgagaaggaagtgaatgtctgcaaacaatactaccaggagctcctcaaaagtgcggaacgcgaggagcaggaggagagtgtttacaatctctacatcagcgaagtgagaaatatcaggctccgcttggagaactgtgaggaccggcttattagacagattcggacgcccctggaacgggacgatttgcatgaaagtgtgtttcgaataactgagcaggaaaaactgaagaaagaactggagagactgaaggacgacttaggtactatcaccaacaagtgtgaagagttcttctctcaagcagctgcaagttcctccgtcccaacattgagatccgagttgaacgtggtgctgcaaaatatgaaccaagtgtatagcatgtctagcacctacattgacaaacttaaaactgtcaacctagtccttaagaacacacaggcagcagaggcgcttgttaaactctacgagactaagctctgtgaggaggaggccgtcatcgcagacaagaataatatcgaaaatctgatcagcacattaaaacaatggcggagcgaggtcgacgagaagagacaggtgttccacgccttagaagacgaactccagaaggcaaaagctatatccgatgagatgttcaagacttacaaggaacgagatttagattttgattggcataaggaaaaagccgatcaactggttgagcggtggcagaacgtgcacgtccaaatcgacaaccggctgcgagacctggaaggaattggaaaaagtttaaagtactatcgagatacctaccaccccctggacgattggatccaacaggtcgagacgacccagcgaaaaattcaggaaaaccaacccgaaaatagtaagactctcgctacccagctaaaccagcagaagatgttggtgagtgagattgagatgaagcaatcaaaaatggatgaatgtcagaagtatgccgagcagtactctgctactgtgaaggactatgaacttcagactatgacctaccgcgcgatggtggactctcagcagaagagtcctgttaaacgccggcgtatgcagagctccgctgatcttatcatccaggagttcatggatctgcggactagatataccgctttagttacccttatgactcagtacatcaagtttgcgggagatagcctgaagcggctggaagaggaagaaaaaagcttggaagaggaaaaaaaggagcatgtggaaaaggccaaagaactgcagaaatgggttagtaatatcagcaagacactcaaagatgccgagaaggccggcaagccccctttcagtaaacaaaagatttcctccgaggagattagcaccaaaaaggagcaactctctgaggctctgcagactatccaactatttctggctaaacatggggataagatgaccgatgaggagagaaatgagctcgagaagcaggtgaagaccctgcaggagtcttacaacctgctgttctccgagtctttaaagcagctgcaggagtcacagaccagtggagatgtaaaagtggaggaaaagatcgtagcagagcgtcaacaagaatataaggaaaaattgcaagggatctgtgatctgcttacccagaccgaaaacagactgatcggccaccaggaggcattcatgataggagacggcactgtggagttgaaaaaataccagagcaagcaggaggagttacagaaggacatgcaggggagcgcccaggccctggccgaggtggtgaaaaacactgagaattttttaaaagaaaacggggaaaaactgagtcaggaagacaaggcattaattgagcagaagttaaatgaggcaaaaattaaatgcgaacagttgaacctgaaggctgaacagtcaaaaaaagagctggacaaagtcgtgaccaccgccattaaagaggaaactgagaaggtcgcagcagtgaagcagcttgaggagtctaaaacgaaaatcgaaaacttgctagattggctgtcaaacgtggataaggactctgagcgggctggcacaaagcataagcaggtgatcgaacagaacggcactcactttcaagagggagacggaaaatctgctatcggggaagaagatgaggtaaatgggaacttgctcgaaacagacgtcgacggccaggttggcacgactcaggagaacttaaatcaacagtaccagaaagtaaaggctcaacatgagaaaatcatttctcagcatcaggcggtgatcatcgccactcagtcggcccaggtgctcctcgaaaagcaaggccagtacctgagtcctgaggagaaagagaaactccagaagaatatgaaagagctgaaggttcactacgaaaccgctctagcagaatctgaaaagaaaatgaagcttacacatagtttgcaagaagaactggaaaaattcgacgccgactatacagagtttgagcattggctacaacaatctgagcaggaacttgagaacctggaagcaggtgctgatgatattaacggtctcatgactaagttaaaaaggcaaaagtctttctcagaagacgttatctcgcacaaaggcgatctgcggtacatcacaataagtgggaaccgcgtgttagaggccgccaaatcttgctctaagcgggacggaggcaaggtggacacatccgccacacatagagaggtccagcgcaagttggaccacgcgactgatagattccggagcctgtacagcaaatgcaacgtcctggggaataacctgaaagatctagtggataagtaccagcattacgaagatgccagctgtgggctgctggcaggcctgcaggcttgcgaggctactgccagcaaacatttgtctgaaccgatcgctgtggaccctaagaacctgcagcgtcagctggaggaaaccaaggctctacaagggcagatcagcagccagcaagtcgctgtggagaagctcaaaaagacagcagaggtgctgcttgatgctagaggaagcttgcttcccgcgaaaaacgacatccagaaaacacttgatgacatcgtaggacgttacgaagatctgagcaagagcgtcaacgagcggaacgaaaagctgcagattactctgacccggtcattgagtgttcaagacgggctggacgaaatgctcgactggatggggaatgtggaatcatctcttaaggagcagggacaggttcccctgaactctacggcgctccaggacatcatttctaagaatatcatgttagagcaggacatcgcgggaaggcagtcatctatcaacgcgatgaatgaaaaggtgaagaagtttatggaaacaacagacccttctactgcgagctcactgcaagctaagatgaaggacctgagcgcaagattctctgaggcatcacacaaacataaagaaaccctagcgaagatggaagaactgaaaactaaggtcgaactttttgaaaatctgagcgaaaaattgcagacattcttggagacaaagacccaggcccttaccgaagtcgacgtgcctggcaaagacgtaaccgagttgtctcaatacatgcaggaaagcaccagcgagtttctcgaacataaaaaacacctggaagtgttgcatagtctgttgaaagaaataagcagccatggcctccctagtgataaagcattggtgttagagaagaccaataacctgtccaaaaaatttaaagagatggaagatacgattaaggagaagaaggaagccgtgactagttgccaggaacaactagacgctttccaagtcctcgtcaagtccttaaaatcttggataaaagagaccaccaaaaaggtccctatcgtccagccttctttcggcgctgaggatttgggcaagtccctggaggacaccaaaaagctccaagagaagtggagtctcaagacccccgagatacagaaagtgaataacagtggaatatcgctatgcaatctcattagtgccgtgaccacccccgctaaagccatcgcggctgtgaaaagtggtggggccgtacttaacggagaaggaacggcaaccaataccgaagagttttgggccaacaaggggttgacatcaataaagaaggacatgaccgatattagtcatgggtatgaggaccttgggctacttctcaaggacaaaatcgccgaactcaatactaaactttcaaaactgcaaaaggctcaagaagaatcatccgctatgatgcagtggcttcagaagatgaataagactgccaccaagtggcagcaaacaccggctcctactgacactgaggccgtgaagactcaagtcgaacagaataagtcattcgaggctgagttgaagcaaaatgtgaataaggtacaggaactcaaagacaagctgaccgagctgttggaagaaaaccctgataccccagaagcaccacggtggaaacaaatgcttactgaaatcgattcaaagtggcaggagttgaaccagctgaccatcgatcgtcagcagaagctcgaggagtcttcaaacaaccttacacagttccagactgttgaagctcagcttaagcagtggttggtcgaaaaagagcttatggtaagtgtactaggacctctgagtattgatccaaatatgttaaatacacagaggcagcaagtgcagatcctgcttcaggaattcgctaccaggaagccccagtatgaacagctcacagcagcaggacagggcatcctctcccgccctggggaagatccctctttgcggggcattgtcaaagaacagctggcagctgtgacccagaaatgggactctttgactggccagttgtcagatcgttgcgactggatcgatcaagcaatcgtgaagtccacacagtatcaatctctcctgcgcagcttgagcgataagttgtccgacctagacaataagctgtccagttctctcgccgtcagcacccatcctgatgcgatgaaccaacagctggagaccgcacagaagatgaaacaggagatccaacaggaaaaaaagcagattaaggtggcccaggccctttgtgaggacctgagtgcccttgtgaaggaggaatatctgaaggctgagctgtcccgtcagttggaggggatcttaaagtcattcaaggacgtggaacagaaagctgagaaccacgttcagcatttacaaagtgcctgcgcatcctcacaccagttccagcagatgtcaagggattttcaggcttggcttgacaccaaaaaggaggagcagaacaaaagtcatccaatctccgcaaagctagacgtgctggagtccctcattaaggaccacaaagacttctctaaaacgctcacggctcagtcccatatgtacgagaagacaatcgctgagggggagaacctgttactgaagacccagggcagcgaaaaagccgccctccaactgcaactgaatactatcaagactaattgggataccttcaacaagcaggttaaggagagagaaaataaactgaaggagagcttagagaaggccctgaagtataaagagcaggtagagaccctgtggccctggatagacaagtgccagaacaatctcgaggagatcaagttttgcttagaccccgcagagggcgagaatagcatcgctaagttgaaaagtctacaaaaagaaatggatcagcattttggtatggtcgagctcctcaataatacagcgaattccctcctctcagtgtgcgagatcgacaaggaggtggtcactgatgaaaataaatccttaattcaaaaggtggacatggtcacagagcagcttcattcgaagaaattttgcctcgagaatatgacgcagaagttcaaggagttccaggaagtgtccaaagaatcaaagaggcaattgcagtgtgccaaagagcagctggatatacacgattccttgggaagtcaggcttactccaacaagtaccttacaatgctgcagacccaacaaaagtcccttcaggccctcaagcaccaggtggatctcgccaagaggctggcccaggacctggtggtggaggcatctgatagtaagggcacgtcagacgtactgctgcaggtggaaacaatcgcacaggagcattccacattgtcacagcaggtggacgaaaaatgtagtttcctggagactaagctccagggaattggacattttcaaaacacaatacgggaaatgttcagtcagtttgctgagttcgacgatgagctcgacagcatggcccccgtgggacgagacgccgaaaccctgcagaagcagaaggagacaataaaggcattccttaagaagctggaggccctgatggcttccaacgataacgccaacaagacatgcaagatgatgctcgccactgaagaaacttctccagaccttgtcgggatcaagagagacctcgaggccctgagcaaacagtgcaataaacttctggaccgcgcgcaggctcgggaagagcaggtagaaggcaccattaagaggctggaagaattctatagcaagttgaaggagttctctatcctgctgcaaaaggctgaagaacacgaagaaagtcagggtccagtgggaatggaaactgagacgatcaaccagcagctcaacatgttcaaggttttccaaaaggaagagattgaacccctgcagggcaagcagcaagatgtgaactggctcgggcagggactgatccagtccgccgccaaatcgacctcaacgcagggcctcgagcatgatctggatgatgtgaacgctcgatggaaaaccctgaataaaaaggtggcccagagagctgctcagttacaagaggccctcctccactgcggccgattccaggatgcacttgagtcacttctcagttggatggttgataccgaagaacttgttgcgaaccaaaaacctccaagcgccgaattcaaggtggtcaaggcccaaatacaagaacagaagctgttacagcgactactcgacgacagaaaatcgactgttgaggtgataaagcgagagggagaaaagattgcaaccacagccgaaccagctgataaagtcaagatcctgaagcagctgagtctcctcgattctcgctgggaagctcttctcaataaggcagagacccgaaatcgacaattggagggcatatccgtggtggcccagcagttccatgagacgttagagcctctgaatgaatggttaaccacaatcgagaagaggctggtcaattgcgagcctataggcactcaagcaagtaagctggaggaacagatagcccaacacaaggcgctcgaagacgacatcattaaccacaataagcacctgcaccaggccgtctcgatcgggcagagccttaaagtgctctcatctagagaagacaaagatatggtgcagagcaagctcgactttagccaagtgtggtatatcgaaatccaagagaagtcccatagtaggtctgagctgttacagcaggccctgtgcaacgccaaaatatttggagaggacgaggtagagctcatgaactggcttaacgaggtgcacgacaagctgtctaaactctctgtgcaggactatagtaccgaagggctctggaagcagcagagcgaactacgcgttctccaggaggacattctgttgcgaaaacaaaacgttgatcaggcattgttgaatggccttgagctccttaaacagacgaccggcgacgaagtgttaatcatccaagacaagttggaagctatcaaggctcgttataaggatataaccaaactgtccacagatgttgcaaagacattggagcaggcgctgcagctggccaggcggttacatagcacccatgaggagttgtgcacctggctggataaagtcgaagtcgaacttcttagttacgaaacgcaggttctgaagggggaggaggcaagtcaagcccaaatgcgacccaaggaactgaagaaggaggctaagaataacaaagccctgttggattcactgaatgaggtcagctctgctctcctggagctggtcccatggcgagctagagaggggctcgagaagatggttgctgaggataacgaaaggtataggttggtcagtgacacaatcactcagaaagtggaagagatcgatgctgcaatcctgaggtctcaacaatttgatcaggctgctgacgccgaattgagttggattacggaaaccgaaaagaagctgatgagcttgggcgatatccgactcgagcaagatcaaactagtgctcagttacaagtccagaaaacatttaccatggagattctgcgacacaaggacataattgacgatttagtgaaatccgggcacaaaatcatgactgcttgttccgaggaggaaaagcagtccatgaaaaagaaacttgacaaggtgctcaaaaattacgatactatttgtcagattaatagcgagcgctatttacagctggaacgcgcccagtcactcgtcaatcagttctgggagacctatgaggagctttggccatggttgacagaaacacaatcaatcatttcccagctcccagccccggctctcgagtatgaaaccttgagacagcagcaagaggagcaccgtcagttgagggagctgattgccgagcataagccacatattgataaaatgaacaagacaggtccacagctgttagagttgagtcctggggaaggcttctccatccaggagaagtatgtggctgcagataccctgtacagtcagattaaagaggacgtaaaaaagagagctgtggcactcgacgaggcaatcagtcaatcgacacagttccacgacaagattgaccaaatccttgagagtttggagagaatcgtggaaagattgagacagccaccatccatcagcgccgaggtggaaaagatcaaagagcagatatcagagaataaaaacgtgagcgtggacatggaaaaattgcaacctctatatgagaccctcaagcagaggggcgaggagatgattgctcgttctggaggaaccgacaaggacatttcggctaaggctgtccaggacaaattagatcagatggtgttcatttgggagaacatccatactcttgtcgaggagagggaggctaagcttcttgacgttatggagctcgccgaaaaattttggtgcgatcatatgtctctcattgtcaccatcaaagacacacaggattttattcgcgatctggaggatccagggatcgacccttccgttgtgaaacagcagcaagaggcggccgaaacaatacgagaggaaatcgacggtctgcaagaggagctggatatcgtcattaacctcggaagtgagttgatcgctgcttgtggtgagcccgacaagcccatcgtcaaaaaatcaattgatgaactgaactccgcttgggattctttaaacaaggcatggaaagatcggatcgataagctggaggaggctatgcaggcagcagtacaatatcaggatgggctgcaggctgtcttcgactgggttgacatcgccggtggaaagttggcatccatgagccctatcggcaccgatctggagaccgtgaaacagcaaattgaagaattgaagcagttcaagtccgaggcctaccagcagcagattgaaatggagagattaaaccatcaagcggaattgttacttaaaaaagtaaccgaggaatccgacaaacacaccgtgcaggatcccttgatggaattgaagctgatttgggattctctcgaggagaggataatcaatcggcaacacaagctcgagggagccctgctggcgctgggccagtttcagcacgccctggacgaactgcttgcctggctgacccatacagagggcctcctgtctgagcaaaaaccagtaggaggcgaccctaaagcaatagagatcgagctggctaagcatcacgtgctgcagaatgacgtgctggctcatcagagcacagtcgaggcggtgaacaaggccggaaacgacctcatcgaatcatccgctggggaggaggcctctaacctgcaaaacaaacttgaggtcctgaatcagcgctggcagaatgtattagagaagactgaacagcgcaagcagcaacttgacggagccttacgccaggctaaaggtttccacggcgagatcgaagacctgcagcagtggctgaccgacaccgagagacacctcttggcgtcaaaacctctcggcggactcccagagacagcaaaggagcagctcaacgttcacatggaagtgtgtgccgctttcgaagcaaaagaggaaacatataagtccctgatgcagaagggccagcaaatgctagcacgttgtcctaaaagtgcggaaaccaacatagatcaggacatcaacaatcttaaagaaaagtgggaaagtgtggagaccaagctgaatgagcggaaaaccaaacttgaagaagccctaaatctcgcaatggagttccacaactcactccaagactttataaactggctaacccaggctgagcagacacttaatgttgcgagcagaccctctcttatcctggacacagtcctattccagatagacgaacacaaagtctttgcaaatgaagtgaacagccaccgcgaacagatcatcgaacttgacaagacagggacgcacttgaaatactttagccagaagcaggatgtcgtgctaatcaagaacctgctgatcagtgtccagtcgagatgggagaaggtggtgcaaagactggtcgaaagagggcgttccctagatgacgcgcggaagagggcaaagcagttccacgaagcctggagcaaattaatggaatggctcgaagaaagcgagaagtcgcttgattctgagctcgagattgctaacgaccctgacaagataaagacgcaactggcccagcacaaggaatttcagaaatcccttggcgcgaagcactctgtgtatgacacgactaaccgaactgggcggagcctgaaagagaagacctcattggccgatgataatttgaaactcgatgatatgctgtccgagctgcgggacaaatgggataccatatgtggaaagtccgtcgaacgccagaacaaactggaggaggctctcctcttcagtggccagtttaccgatgccttgcaggcgctgatagactggctatatcgggtggaaccccagctcgccgaagaccagcctgttcatggggatattgatctcgtgatgaacctgatcgataaccacaaagcattccaaaaggaactggggaagaggacatccagcgtgcaggccctgaaacgctcggctagggagctcatcgaaggctctcgggacgatagctcttgggtgaaagtgcagatgcaagagctgagcacccggtgggagacagtgtgtgcgctgtccatcagcaagcaaacccgcctcgaagctgcattgcggcaggcagaggaatttcactctgtcgtgcatgcactgctagaatggctcgccgaagcagagcaaactctgagatttcacggagtgctgcccgacgatgaggacgccctacggactctgatcgatcagcataaggaattcatgaaaaagcttgaagagaaaagagctgagttaaacaaggccaccaccatgggggataccgtattggccatctgccaccctgacagcattactaccattaaacactggattactattattagagcgaggttcgaggaggtgctggcctgggccaaacagcaccagcagaggctggctagcgcacttgctggtctcattgcgaagcaagagttgctcgaagcattgctggcatggctgcagtgggccgagactaccctgacagataaggataaggaggttattccccaagagattgaagaagttaaggcccttattgcggagcatcagaccttcatggaagaaatgacccgaaaacagcctgacgtggacaaggttaccaagacatataagcgaagggcggccgacccatcctctctgcagtctcacattcccgtgctggataaaggcagggccgggagaaagagatttcccgcctcttccctctatccttccggctcacagacacagatagagactaagaatccaagggtcaacctccttctgagggaattcgcaaacttcgatttcgatatctggcgtaaaaaatatatgaggtggatgaaccataagaagagtcgcgtgatggatttctttcggcggattgataaagatcaagacggcaaaatcactagacaggagtttatcgacggcatattgtcaagtaaatttcctaccagccggctagagatgtccgccgtggcggatatttttgaccgggacggagacggctacattgattactacgagttcgttgctgcgctgcaccctaataaagatgcctacaaaccgatcaccgatgctgacaagatcgaagacgaagtgacgcggcaggtggctaaatgcaaatgcgcaaaaagattccaggtagagcagatcggggacaacaaataccgggtgtccttccagagtaactttggagacagtcaacagttaagattggtcagaatactgcgaagtacagttatggttcgcgtaggcggaggctggatggcactggacgagttcctcgtgaagaatgacccatgcagggtgcaccaccacggaagcaagatgctaagaagtgagagtaactcctctatcacaacaacacagccaactattgccaagggcagaaccaacatggaattgcgtgagaagttcatcctggctgatggcgcttctcaaggaatggccgcatttagaccacgaggacgccgatccagaccatcaagccggggcgcctctccgaacagatctacatcggtaagttcacaagctgctcaggccgccagtccacaagtccctgccacgactacccccaaggggacccctatacaaggctcgaaactccggctgcccggctatctgtctggaaagggcttccactctggagaagacagtggcctgattactacagctgccgcccgcgtccggactcagttcgccgattcgaagaagactcctagtaggccaggctcccgagctggcagtaaagctggcagcagagccagttctcgaagaggcagcgacgcctcggattttgatatttcagagatccagtccgtctgttctgacgttgaaacagtgccacaaactcatcgaccaaccccccgtgctgggtctcgtcccagtacagccaaaccatcgaagattcctacaccacagaggaagtcgcctgccagtaaactggataagtcttctaagagatag

SEQ ID NO: 115320 - DNA, 9183 bp, Artificial Sequence
  Description of Artificial Sequence: Synthetic coding sequence
atgcatagttcctcttactcttatcgctcctcagactccgtcttttctaacaccacctccacccggacttctttggacagcaatgaaaaccttcttttggttcattgcggacctaccctgataaatagttgtatctcattcggttccgagtcattcgacgggcacagactggagatgctccagcagatagcaaaccgggtccaaagagactccgtgatttgtgaggacaagctcatcctggccggaaatgccctccagagcgacagcaaaagacttgagtccggagtccagtttcagaatgaagccgagattgccggatacatcctagaatgcgagaacctgctgaggcagcacgtcattgatgtgcaaattcttattgatggcaagtattaccaggctgaccagctggtccagagggttgctaaactcagggatgagattatggctctaaggaacgaatgctcatccgtgtatagcaaaggccgcatcctgacgactgagcagactaagctcatgatctctggaataactcagagcctgaattccggattcgcccagacacttcacccatctctgacgtccggtctgacccagtcccttacaccatctctgaccagctctagtatgacctccgggttaagttcaggcatgacatcaaggctgaccccttccgtgacccccgcatatacacctggctttccgtctggtctcgtgcctaatttcagctccggagtggagcctaactcacttcagacactgaaactgatgcagatcagaaaaccccttttaaaaagcagtttgcttgatcaaaacctcactgaggaggaaattaacatgaagtttgtgcaagacctgcttaattgggtggacgagatgcaagtacagctcgaccggacagagtggggctccgacttgcccagcgtcgagtcacacttggagaatcataagaacgttcaccgtgccatcgaggagtttgagtcttccctgaaggaggccaagatttccgagattcagatgacggcacccctgaagcttacgtatgctgagaaattgcaccgcctagaatctcagtacgccaagctcttaaatactagccgcaatcaagaaagacaccttgatactcttcacaactttgtgagccgagcgaccaatgagctgatatggctgaacgaaaaagaggaggaagaggtggcctacgattggtctgagaggaataccaatattgcaaggaagaaggactatcatgcagagttaatgcgagagctggaccagaaggaggaaaatattaagtcagtgcaggagattgcagagcaactgttattagagaatcacccagctcgtctgacgatcgaggcctatcgagcagcaatgcagacccagtggtcctggattctgcagctgtgtcaatgtgtggagcagcacattaaggagaatacagcatattttgaattcttcaacgatgcgaaggaggccacggattatttacgaaacctaaaagacgctattcaacgcaaatattcttgtgatcgttccagctccatacacaagctggaggacctggtgcaggagagtatggaagagaaagaggagctactgcaatacaaaagcaccattgcaaatctgatgggaaaagccaagacgattattcagctgaaaccccgtaactcagactgccctctcaaaacaagcatcccaattaaagcgatctgtgactacagacagatcgaaatcacaatctacaaggacgacgagtgcgttctggccaataactctcaccgcgccaaatggaaggtgatctctcctaccgggaacgaggctatggtgcccagtgtgtgcttcaccgtgccaccacccaataaggaggcagtcgatttggccaatagaatcgaacagcagtaccagaatgtacttactttatggcacgaaagtcacattaacatgaagtccgtcgtctcctggcattacctgataaacgagatcgacagaattagggccagcaacgtggcttcaattaaaacaatgctacccggagaacaccaacaagttctgagcaacttgcagagtagattcgaggattttctcgaagattcacaagagagccaggttttttcaggttcagacattacccaacttgaaaaagaggtgaacgtctgcaagcagtactaccaggagcttctcaaatccgctgaacgggaggagcaggaggagagcgtatataacctgtacatcagtgaggtgcgcaatatcaggctgaggctggaaaattgcgaagatcgtctgattcgacagatacggactcctttggagcgcgatgatctgcatgaaagtgtatttcgcatcaccgagcaggaaaaattgaagaaggaattggagcgactgaaggatgatctgggaactattaccaataaatgcgaggagttctttagtcaggcagctgcgtcctccagcgtgcctacactgaggagtgagctgaacgtggtgttacagaatatgaatcaggtgtactcaatgtcaagcacgtacatagacaagctgaaaacagtgaacttggtgctaaaaaacacccaggccgcagaagccctcgtcaaactgtacgagacaaagctatgcgaagaggaggccgtgattgcggacaaaaacaacatcgaaaatctcatcagcaccctgaagcaatggaggtctgaagttgacgaaaagcgacaagtatttcatgccctcgaggacgagctgcagaaggccaaagctatatccgatgagatgttcaaaacctataaagaacgcgacctggactttgactggcataaggaaaaagccgatcagcttgtagagcggtggcagaatgtccatgtgcagatcgataatagactcagggacctggaaggaattggaaagtcccttaaatattacagagacacataccatcctcttgacgattggatccagcaggttgaaaccactcagaggaagattcaggagaatcaacccgagaattcaaagaccctggcgacacagcttaatcaacaaaaaatgttggtttcagaaatcgaaatgaagcagagcaaaatggatgagtgccagaaatacgccgaacagtacagcgcaactgtgaaggactatgagctccagactatgacatacagggctatggtggattctcaacagaaatcccctgtgaagcggagacgaatgcagtcaagcgctgacctcattatccaggaatttatggatctgagaacacggtataccgccttggtgactttgatgacacagtatataaagtttgccggagacagcttaaagcggctcgaagaggaggaaaaaagcctcgaggaggaaaagaaggagcatgtggagaaagctaaggaacttcaaaaatgggtaagtaacatctctaagacgctaaaagacgcagaaaaagcagggaaaccaccatttagcaagcagaagatcagctcagaggagatctccacaaaaaaggagcagctcagtgaagccctgcagaccattcaactgttcttagctaaacatggcgataaaatgaccgatgaagagaggaatgagctggagaagcaggtcaaaaccctgcaagagagctacaacctattgttcagtgaaagtctgaagcagttacaagagagccagacttccggcgatgtgaaggtcgaggagaagttagataaagtgatcgctggaaccatcgaccagaccaccggtgaagtgctgagcgtgtttcaggcagtgctgaggggactaatagattatgacactggaattagacttcttgagacgcagttgatgatcagcgggcttatctcgcccgagcttaggaagtgctttgatcttaaagatgcgaagagtcacggtctgatcgatgagcagattctttgccaactcaaagagctttcaaaggccaaagagattatctctgcagcatctccaaccactattccagtcttagatgccctcgctcaaagcatgatcaccgagtccatggcaattaaagtactggagatcctactgtcgactggctcactggtgatcccagccactggggagcagctgacacttcaaaaggctttccagcaaaatttggtgtcaagtgcccttttttctaaggtcctggagaggcagaatatgtgcaaggatctcattgacccctgcaccagcgaaaaagtctctctcatcgacatggttcagaggtcaacgctgcaggagaacactggcatgtggctcttgccagtgcgtccccaggagggcggccggattaccctgaaatgtggtcgaaacattagcatcctccgcgctgctcatgaaggtctgatagatagagagactatgtttaggttgctttcagcccagctgttgagcgggggcctgatcaactcaaactccggccagagaatgactgtggaagaagcagtcagagaaggtgtgattgaccgtgacacagctagttcaatactcacatatcaggtgcagacagggggaattatacaaagcaaccccgctaagaggctgacagtggacgaggcagtgcaatgtgacctgatcaccagttcctcagcccttctggtgctggaagcccaaaggggttatgtgggcctcatatggcctcattccggagaaattttccccacaagcagcagtctgcagcaggagctgattacgaacgagcttgcttataagatccttaatggccgccagaagatcgcggccctgtacatcccagaatcatcccaagtcatcgggctggacgcagcgaagcagcttggcatcatagacaataatacggctagcatccttaagaatattacactccctgataagatgccagacctgggcgatttagaagcttgtaaaaatgcaagaagatggctcagcttctgcaagtttcagccctctaccgtgcacgactatcgacaagaggaggatgtgttcgacggagaagaacctgtgactacccaaacctccgaggagaccaaaaaactgtttctctcatatttgatgattaactcttacatggacgctaatacaggccagcgtctgctgctgtacgacggcgacctggacgaggcagtggggatgttgctggagggttgccacgctgagttcgacggaaacactgcaatcaaggaatgcctggacgtgcttagcagttctggcgtattcctgaacaacgcctccgggcgcgagaaggacgagtgcaccgcaaccccttcctccttcaacaaatgtcactgcggagagccagaacacgaggagacaccggagaaccgcaagtgcgcaatcgacgaagagttcaacgaaatgcggaatactgttattaactcagaatttagtcagtcaggtaagttggcctcaactatctctattgacccaaaagtgaacagttctccctccgtgtgcgtgccttccctgatatcctatctgacacagactgaactggctgacatctctatgctgaggagcgactcagagaacatattgaccaactatgaaaaccagtctagagttgaaaccaacgagcgggctaatgagtgttctcattccaaaaacattcagaattttcctagtgatttaattgagaaccccatcatgaaatcaaagatgtccaaattttgcggcgtcaacgaaactgagaatgaagataacaccaacagagattcccccatcttcgattatagccctcggttaagcgccctcctcagccacgataaattgatgcactcacagggatcttttaacgacacccacactcctgaatccaacgggaacaagtgtgaagccccagcactttcctttagcgataagaccatgctgtccgggcaacggatcggggagaagttccaagatcaattcctgggaattgctgcaatcaatattagccttccgggcgaacagtacgggcagaagtcccttaatatgatatccagtaatcctcaggtacagtaccacaatgataaatacataagcaacacatcgggagaagacgagaagacccaccctggcttccagcagatgccggaagataaagaagacgagtccgaaatagaggagtactcttgtgcagtgactccaggaggggatactgacaacgcgatcgtgagcctgacatgcgccacacccttacttgacgagacaatctctgcctctgattacgaaacaagtctcctgaatgaccaacagaataataccggcactgacacagatagtgacgatgacttctacgacacgcccctgtttgaagacgacgaccacgattccctgctgcttgatggggacgacagggactgccttcacccggaggattacgatacgcttcaggaggagaacgacgagacggcatcccctgctgatgtgttttacgatgtctcgaaagagaacgagaacagcatggtcccacagggcgcgcccgtcggcagcctcagcgtcaagaataaggcccactgtctccaggattttctgatggacgtggaaaaagacgagcttgactcaggtgaaaagatccacctcaaccccgtcggtagcgacaaggtgaatggacagagtctggaaactggctctgaacgcgaatgcactaatatcctagaaggagacgagtccgacagtctcactgattatgacatcgtgggtggcaaggagtccttcacagcctccttgaagtttgatgatagcgggtcctggagaggccgcaaagaggaatacgtcacaggccaggagtttcattctgataccgaccacctggatagcatgcagtcagaggagagttatggagactacatctacgatagtaatgatcaggacgacgacgatgacgacggaattgacgaggaaggaggcggcatccgggatgagaatggtaaacctaggtgccagaatgtagccgaagacatggacatccagttatgcgctagcatactgaatgagaactctgatgaaaacgaaaacataaacactatgattctcctagacaagatgcacagctgctctagcctcgagaaacaacagagggtcaacgtcgtgcaactcgcctcgccctcagaaaataatctggtcaccgagaagtccaaccttcctgaatacaccaccgagattgccggcaagtcaaaagaaaacctgctgaaccatgaaatggtgttgaaggacgtcctccctccaatcattaaggacaccgaatctgaaaagacatttggcccggcttccataagtcacgataataataatattagctccacctcagagctgggaacagacctcgctaacaccaaagtcaagctgatacagggatctgagctaccagaactcacagatagtgttaaggggaaggacgaatacttcaagaacatgacccccaaagtggacagcagcctcgaccatattatttgcacggagcccgacctcataggcaagcctgctgaggagagccacctgtctctaattgcatctgtgacagataaggatccccagggaaatggcagcgacttgattaagggccgcgacggaaagagtgatatcttgattgaggatgaaacctcaatacagaagatgtacctcggagaaggggaggtattagtcgaggggctcgttgaggaggagaatcgccacctgaaactgctccctggaaagaacaccagagatagctttaaactcatcaattcacaattcccttttcctcagataaccaacaatgaggagctgaatcaaaaagggagcctcaaaaaggcaacagttaccttgaaggacgagcccaacaacctacagataattgtgtccaaatcaccagttcagttcgagaacctggaggagattttcgacacatctgtctccaaagagatctccgacgatatcaccagtgacattaccagctgggaagggaacactcactttgaggagtcttttacagatggacctgaaaaagagctggatctgttcacatacctgaagcactgcgcaaaaaatatcaaggcaaaagatgttgcgaagcccaatgaggatgtgccgtcccatgttctgattacagctcccccaatgaaagagcacttgcagttaggcgtgaacaacactaaagagaagtccacatctactcagaaggattctcccctgaacgacatgatccagtccaatgacctttgctcaaaagaaagcatttccggcggtggcactgagataagtcaattcactccagaatccatagaggccacccttagtattctgtcaaggaagcacgtggaagacgtcggaaagaacgattttctgcaaagcgagcgctgtgccaacggtctcggaaatgataactcctctaacaccctgaatacagactactcctttctggaaatcaacaataagaaagagaggatcgagcagcaactgccaaaagagcaggccctgagcccacggtcccaggaaaaagaggttcagatccccgagctctcgcaggtgttcgttgaagatgttaaggacatactcaaaagccgactgaaggaaggacacatgaatcctcaggaagttgaggagccttccgcctgcgccgataccaagatccttatccagaacttgattaagcgcatcacgacctcacaactggtaaatgaagccagtacagtgcccagtgacagtcagatgtccgatagtagcggcgtctcccctatgacaaattctagcgaactgaaaccagagagcagagatgatcccttctgcatcgggaatttgaaatctgagctgctcctgaacatcctgaaacaagatcagcactcacagaagattaccggggtcttcgaactgatgcgggaactcacccacatggaatacgatctggagaagagaggtatcacgtccaaggtactccctttgcagttagaaaatattttctacaagctgctggcagatggctatagcgagaaaattgagcacgtcggcgacttcaaccagaaggcgtgttctacgagcgagatgatggaggaaaagcctcacatcttgggggatattaaaagcaaagaagggaattattacagccccaatttggagaccgtgaaagaaataggtctggagtcgtcaaccgtgtgggccagcactcttccgcgagacgaaaagttgaaagacctgtgtaatgactttccctcccatttggagtgcacatctggatccaaggaaatggcaagtggcgacagcagtaccgaacagtag

SEQ ID NO: 115321 - DNA, 21741 bp, Artificial Sequence
  Description of Artificial Sequence: Synthetic coding sequence
atgcactctagttcatacagctatcgtagtagcgacagtgttttttccaatactaccagtactcggaccagcctggactcaaacgaaaacctactgctcgttcactgtggccccaccctgattaattcatgcatatcgtttggtagtgagagttttgacggccacagactcgaaatgctgcaacagatagctaatcgggtacagagggactctgtgatctgtgaagataagctgatcctcgccggcaacgctctccagtccgacagtaagcgactcgagagtggggtgcaatttcaaaacgaggccgagatcgcagggtatatcttggagtgtgaaaacctgttgcggcagcatgtgatcgatgtgcaaattctgatcgacggaaagtactaccaggcagatcagctcgtccagagggtcgcaaagctgcgcgatgaaatcatggcactcagaaacgaatgtagctcggtctattccaaaggacgcatcctcacaacagaacagaccaagctgatgatctctggaattacacaaagtctaaacagtggctttgcccaaactctacatccttcgctgaccagcggccttacccagtccctcactccttccttgacctccagttcaatgacatcagggctgtcctcaggtatgacaagccgtctcactccttctgtaacacccgcatacacacctggatttccaagcggtctcgttcctaatttttcatcaggtgttgaacctaatagcctgcagactctaaagttaatgcagatcaggaagcccttacttaagtcaagccttcttgatcagaatctgaccgaggaggagatcaacatgaaattcgtgcaggaccttctgaattgggtggatgaaatgcaggtgcaacttgacaggaccgaatggggcagcgatcttcccagtgtggagagccacttggaaaaccataagaatgtgcaccgggccatcgaagaattcgagtcctctctcaaggaggccaagatctccgagattcaaatgaccgccccgttgaaattaacctatgctgaaaagctgcaccggcttgagtctcagtacgccaagctactgaacacaagccggaaccaagagcggcacctggatacactgcacaactttgttagccgagcgacaaatgagctgatttggcttaacgaaaaagaagaggaggaggtggcgtatgactggtcagagaggaatactaacatcgccaggaagaaagactaccacgcagagctcatgagagaactggaccagaaagaggaaaatatcaagtcagtccaggagattgctgaacagctcctcctcgagaaccaccccgctcgactgacaatcgaggcctaccgcgctgcgatgcagacgcagtggtcgtggatcctgcagctttgtcaatgcgtcgaacaacatattaaggaaaacactgcttatttcgagttctttaacgatgcaaaagaggcaaccgactatctgagaaatcttaaagacgcaatacagaggaagtatagttgcgaccgctccagctctatccataaactggaagatctggtccaggaaagcatggaagaaaaggaagaacttctacagtacaagagcactatagccaatcttatggggaaggccaaaactatcatacagctgaagcctcggaatagcgactgccccctgaaaactagcattcctatcaaagcaatctgtgactataggcagatagaaatcactatctacaaggacgatgaatgtgttcttgcaaacaattcccatcgggctaaatggaaagtgatatctcctaccggcaacgaagccatggtcccgagcgtgtgttttacggttcctcctcccaacaaggaggctgtcgatctggccaataggatagaacagcagtaccagaatgtacttaccctctggcacgaaagccacatcaatatgaagagcgtggtcagctggcactatctaataaacgagatcgataggatccgggcgagtaacgtggcttcaataaagaccatgctgcctggggaacaccagcaggtcctgagcaacctccagagcagatttgaagacttcctggaagatagccaggaatcccaggtgttctccgggagcgatatcactcagctcgagaaggaagtgaatgtttgcaagcaatactatcaggagctactgaagtccgctgaaagggaagagcaggaagaaagtgtgtataatctgtacattagcgaagttcggaacattagactgcggctggaaaattgcgaggatcggttaatccggcaaattagaactcctctggaaagggatgatctccacgagtccgtgtttcgaataactgagcaggagaagctgaaaaaagaactggagcgtctgaaggatgacctcggcaccatcacaaataagtgtgaggaattcttttcccaggccgccgccagttctagcgtccctactctgcgctctgaactaaacgtggtattacagaacatgaatcaagtctactccatgtcctccacttacatcgacaagttgaagaccgttaatctcgttctgaagaacacccaggctgcagaagccctggtcaagttgtatgagacgaagttgtgcgaggaggaggccgtgatcgccgacaagaataacatcgagaatctgatctcgactctcaaacagtggcgctcagaagtggacgagaaacgtcaggtgttccacgctctcgaggatgaattgcagaaggcgaaagcaatatcagatgagatgtttaagacatataaggagagggacctagacttcgactggcataaggaaaaggccgaccagttggtggaacgatggcaaaatgtgcacgtgcagattgacaatagactgcgggatttagagggcatcggcaagagcttgaaatattacagagacacttaccaccccctagacgattggattcaacaggtggagaccacacagagaaaaatccaagaaaatcagcctgaaaactctaaaactttggctacacagctcaatcaacagaaaatgctagtgagtgagatcgaaatgaaacagagtaagatggacgagtgtcagaagtacgccgagcaatactccgcgacagtcaaggactacgagcttcagaccatgacgtaccgagctatggtcgatagccagcaaaaaagtcccgttaagcgcagaagaatgcagtccagcgctgacctgatcatacaggagttcatggacttgcgcacacgctataccgcactggtgacactcatgacccagtacataaagtttgccggcgattccctaaaacggttagaggaagaagagaaatctctagaggaggagaagaaggagcacgtggagaaagccaaagaactccagaaatgggtgtcaaacatatctaaaacattaaaggatgccgagaaagcaggcaagccacccttttcaaaacagaaaataagtagtgaagaaatcagcacaaagaaggaacaacttagtgaggctttgcagacaatccaactgttcctagctaagcatggggacaaaatgacggatgaggaaagaaatgaactggaaaagcaggtgaagacgttgcaggaaagctacaacctgctgttcagcgaatcccttaagcagctacaggagtcccagacttcaggagatgtaaaggtggaagaaaagcttgacaaagttattgcagggaccattgatcagacaaccggggaggtgttaagtgtcttccaggccgttttacgcggcctaattgattacgacaccggcattaggctgttagagacacagctgatgatcagcgggctcatctcccccgaactgaggaaatgttttgatctgaaagacgccaaatctcacggcctgatcgatgagcagattctttgccagttgaaggagctatccaaagcgaaggagatcataagcgccgcttcacccaccactattccagtgcttgacgctctcgcccaatctatgatcactgagagcatggcgatcaaagtgctggagatacttctgagcaccggtagtttagtgattccagcaactggcgagcaactcacactgcagaaagcctttcaacagaaccttgtttcttctgcactgttttcaaaagtgcttgaaagacagaatatgtgcaaggacctgatcgacccttgtaccagcgagaaggtgagcctgatcgatatggtccagagaagcacgctgcaggagaacacaggcatgtggctcttgccggtccgaccccaggaggggggccggataaccctcaaatgcggacggaacatctcgattctgcgggcagcacacgagggtctcattgatagagaaactatgttccggctcttgagcgcccagctcctgtccggcggcctgatcaattcaaattctggccagagaatgactgtagaagaggctgttagggagggagttattgacagggacaccgcaagctctattctgacctaccaggtccagaccggcgggatcattcaatctaacccagccaaaaggctaaccgttgacgaagctgtacagtgtgaccttatcacctctagcagtgccctcttggttctggaggctcagcgcggatatgtgggactgatttggccacacagcggcgaaattttccccacaagctcttccttgcagcaggagcttatcacgaacgagttagcttacaaaatcctcaatggaagacagaagatcgcagctttatacatccccgagagttcacaagttatcggactggacgcagctaaacaactgggcattatagacaataacacagccagcatcttaaaaaacattaccctccccgataaaatgccagacctcggcgacctggaggcatgcaaaaatgccagacggtggttaagcttttgtaagttccagccaagcactgtgcacgactatcgccaggaggaagatgtgtttgacggggaagagcctgtgaccacgcaaacatcagaagaaactaaaaagctattcctgtcttacctgatgatcaactcttacatggacgcaaataccggtcagcgccttttgctgtacgacggggatctggacgaggcagttggcatgctcctcgagggatgccacgcggaatttgacgggaataccgcaatcaaagagtgcctagatgttctaagcagcagcggggtgtttctgaataatgctagcggaagagagaaagacgagtgtacagccacaccatcttccttcaacaagtgccactgcggggaaccagaacacgaggagactcccgagaaccgaaagtgtgccatagatgaggagttcaacgagatgcgaaacaccgtgattaactcagagttttctcagtcgggtaaactggcgagtactattagcattgaccccaaagtgaactcaagcccttcggtttgtgtgccatccctgatttcgtatttgacgcaaactgagctagccgacatatccatgctgcgctcagatagtgaaaatattcttactaattacgaaaatcagtctcgcgtggagactaacgagcgggccaacgagtgctctcacagcaagaacatacaaaacttcccctccgatttgattgaaaaccccattatgaagagcaagatgtcgaagttttgcggcgtgaatgaaaccgaaaacgaagacaatactaaccgcgattcccctattttcgactattccccaaggctgtccgctctgctcagccacgacaagctcatgcatagccaggggagctttaacgacacccataccccagagtcaaatggcaacaagtgcgaagcccctgccttgtccttcagtgacaaaacaatgctgtccggtcagaggattggcgagaagttccaggatcaattccttggaatagctgccatcaatattagtctcccgggtgagcagtacggacagaagtccctgaacatgatctctagtaacccccaggtccagtaccacaatgataagtacatttcaaacacgtccggtgaagacgaaaagacccacccggggttccaacagatgccggaggataaggaggacgagtcggagatagaggaatactcctgcgcggtgacacctggcggcgacacagataatgcaattgtgtcgttgacctgtgcgacgcctttgctggacgagaccatcagcgccagcgactacgagacttccttattgaacgatcagcaaaacaacacagggacggatacagacagtgatgacgacttttacgacaccccattgttcgaagatgatgatcatgacagcctgctgctggacggcgacgaccgggactgtctacaccctgaagattatgacacactacaggaggagaacgacgagacagcaagtcccgccgacgtgttctatgatgtcagtaaagaaaacgagaattctatggtgccgcaaggtgcacccgttggctccctgtctgttaaaaacaaggcccactgtttacaggatttcctcatggacgttgagaaggatgagctcgactcaggagaaaagattcacctgaatcccgttggatctgacaaggtgaacggacagtcactcgaaaccggaagtgaacgggagtgtactaacatcctggagggggatgaatccgattcgttgacggattacgacatcgtaggaggaaaagaaagtttcacagccagtctgaagttcgacgactccggttcttggcggggcagaaaagaagagtatgtcacaggccaggagtttcacagtgacaccgaccacctagactccatgcagagcgaggagtcatatggggactacatctacgattctaatgatcaggatgacgatgatgacgacggtattgacgaggaaggcgggggtattcgggatgaaaatggcaagccccggtgtcaaaatgtggctgaggatatggatatccagctctgtgcatctattttgaacgagaattccgatgagaacgagaacatcaatacaatgattctcctggataaaatgcattcttgctcatcactcgagaagcagcaaagagtcaatgtggttcaactcgcaagtcccagcgaaaacaatttagtgactgaaaagagtaatctgccggaatataccaccgagatagccggcaaaagcaaagagaacctcttgaatcacgagatggtcttaaaagacgtgctgcccccgattatcaaagatacagaatccgagaagaccttcggcccggcctccatctcccatgataataataacatctcttcaacaagcgagctcgggactgacctagcgaacacgaaagttaagctcatccaggggtctgaactgcctgaattgacagattcagtgaagggcaaggatgagtacttcaagaacatgacccccaaggtagatagcagtctcgaccatatcatatgtacagagcccgacctgatagggaagcccgctgaagagagtcatctgtccctgattgctagtgttaccgataaagaccctcaggggaatggaagcgatctgattaagggtagagacggcaagtctgacatccttatcgaggatgaaacaagtatccaaaagatgtacctaggcgaaggggaggtgctggtagaggggcttgtcgaggaggagaacaggcatctgaagcttctgcctggtaagaacaccagagattcttttaagctcataaatagccagttccccttcccgcagataactaataatgaagaattgaaccaaaagggcagcctcaaaaaggcgactgtgaccttgaaggatgagcccaacaatctgcagataattgtgtccaagtcacccgtgcaatttgagaatctggaggaaatctttgataccagtgtcagcaaagagatctccgatgacatcacatcagacatcacatcctgggagggaaatacccacttcgaggagagcttcaccgacggcccggagaaggagctggacttattcacctatttaaagcactgcgccaagaacatcaaggcaaaggatgtggccaaaccaaatgaagacgtgcctagccacgtgttgatcactgccccgcctatgaaagaacatctgcagctcggagtcaacaataccaaggagaaatcaacctccacccagaaagattctccccttaatgatatgatccagtcaaacgatctgtgcagtaaggaatccatctccgggggtggtactgagatctcccagtttacccccgagagcattgaagcaaccctgtccatactatcacggaaacatgtggaagatgtgggtaagaatgatttcctgcagagtgaaagatgcgccaacggattgggcaacgacaattccagtaacactctcaataccgattatagctttctggagataaacaacaaaaaggagagaatcgagcagcagctgccgaaggaacaggctttgagccctcgatctcaggagaaagaagtccaaattccagaactctcccaggtttttgtggaagatgtaaaagacattctgaagtcacggctgaaggagggacatatgaatccccaggaagttgaagaaccgagcgcatgcgcagacaccaagattctgatccagaatctgataaaacgaataaccacaagccagctggttaacgaagcatctaccgtgccctctgactcccaaatgagcgacagtagtggggtgtcgcctatgactaacagttcagagttaaaacccgaatcccgcgacgaccctttttgtatcgggaacttgaagtctgagctgttactgaatatcttgaagcaagaccagcattcccagaaaatcacaggcgtgttcgaactgatgagggagctgacccacatggagtacgatcttgagaagaggggaataacatcaaaggtcctgccactccagctggaaaacattttctacaaactgctcgcagacgggtattccgaaaaaatcgagcacgttggtgacttcaatcagaaggcctgttccactagcgaaatgatggaggagaaacctcacatcctaggggatatcaagagtaaagagggcaattactactctccgaacttagagaccgttaaagaaatcggactcgagagtagtacggtgtgggccagcacacttcccagggacgaaaagctgaaagacctctgcaatgacttccccagtcacctagagtgtaccagcggttccaaagagatggcaagtggtgacagctccaccgagcagttcagttctgaattacagcagtgcctgcagcacacagagaaaatgcacgaatacctgacactgctgcaggacatgaagcccccgctggacaaccaggagtcactcgataacaacctcgaagccttaaagaaccagctgaggcagctagaaacctttgaattaggtctggccccaattgcagtgatcctgagaaaagacatgaaacttgctgaggaattcctgaaatccctgccgtccgactttcctcgcggacacgtcgaggagttgtcaatctcccaccagtcccttaagaccgcattcagcagcctctcaaacgtgtcatcagaaagaaccaaacagatcatgttagccatagatagtgagatgagtaagttggctgttagccacgaggaatttctgcacaagctcaaatcattcagcgactgggtctctgagaagagcaaatcagtgaaggacattgagatcgtaaatgtacaggactctgagtatgtgaagaaacgactggagttcctgaaagccaataacgtgctaaaggatctaggccatacaaagatgcagttggaaactaccgccttcgacgtgcagtttttcatcagtgagtacgcccaggatctgtcccccaaccaatccaagcaactgctacgcctcctcaacaccacccagaaatgcttcttagacgtgcaagagtcagtgacaacacaagttgaacggctcgagacacaactgcatctcgaacaggacttggacgaccagaaaattgtcgcagaacggcagcaggagtacaaggaaaaattacaggggatctgcgatctcctcacacagaccgagaaccggctgattggtcaccaagaggcatttatgattggagatggtaccgtcgaacttaagaagtaccaaagcaaacaggaagaactccagaaggacatgcagggaagtgcacaagccctggccgaggtggtgaaaaataccgagaatttcctcaaggagaatggagaaaagctctctcaggaggacaaggctctcatagaacagaaattaaatgaggccaaaattaaatgcgagcaactaaacttaaaagccgagcaatcaaaaaaagaactggataaggtcgtcacaacagcgattaaagaagagactgaaaaagtggccgctgtcaaacagctggaagagtctaaaacaaaaattgaaaatctgctcgactggctgagtaacgtagacaaggatagtgagagggcgggcaccaagcataagcaggttatagaacagaacgggacacactttcaggagggcgacgggaagtcagcgatcggggaagaagatgaagtgaatgggaacctgctcgagacggacgtcgatgggcaggttggtaccacccaagagaatctgaaccaacagtaccaaaaggtcaaagcccaacacgaaaagattattagccagcatcaggccgtcatcatcgctactcaatcagcccaggtcctgcttgaaaagcagggacaatatttgtcaccagaggagaaagaaaagctgcagaagaacatgaaagagctcaaggtgcactacgagactgctttggccgagagtgaaaaaaaaatgaagctgacacacagtttgcaggaggaacttgaaaagtttgacgctgattatactgagttcgaacactggctccaacagtccgagcaggaactggagaaccttgaggctggagccgatgacattaatgggctaatgaccaagctcaagaggcagaagagtttctctgaggatgtaataagtcataagggtgatctgcggtatattaccattagcgggaaccgcgttcttgaagccgcaaaaagctgttcgaagcgcgacggaggcaaggtagacacctcagccacccaccgagaggttcagagaaaactagaccatgctacggaccgctttcgatccctgtactctaaatgcaatgtgcttggaaacaacctgaaagatctcgtcgataaatatcagcactatgaagacgcttcttgcggccttctggctggactccaggcatgtgaggcaaccgcctccaagcacctcagcgagccaatcgcagtggatcccaagaacctgcagcgacagctggaggagacaaaagccctacagggccagattagctctcagcaggtggccgtggagaagctgaagaaaacagccgaagtgctgttagacgcaagaggatccctgttgcctgccaaaaacgatatacagaagacactggatgacatcgtgggcagatacgaagacctgtcaaaatctgtcaatgagcgtaatgagaagctacagattaccctcacacggagtctgtctgtccaggacggccttgatgaaatgctggactggatggggaacgtcgaatcatctctgaaagagcagggacaagtcccactcaattccaccgcgctgcaagacatcatcagtaagaatattatgcttgagcaggatatcgcaggtcgacaaagcagcatcaacgcgatgaacgagaaagtgaaaaaatttatggaaaccacagacccgagtacagcaagctctctccaagccaagatgaaggatctaagcgccaggttctccgaggctagccataaacataaggaaacactagctaaaatggaggaattaaagacaaaagttgaattgttcgagaatctcagtgaaaaactccagacatttctggagacaaaaacccaagcactgactgaagtcgacgtgcctggcaaagacgtgaccgagctgtcacaatacatgcaagagtccacatctgaattcctcgagcacaaaaagcatctggaggtgttacactccctcttgaaagagatcagtagtcacggcctcccgtctgataaagccttggtgctcgagaagacaaataacttgagtaagaaattcaaggaaatggaagacacaatcaaagaaaagaaggaagcggtcacatcctgtcaagaacagctagacgctttccaggtgcttgtgaagtctctgaagagctggattaaggaaactacgaaaaaagtcccgattgtccagccaagtttcggagctgaagatctgggaaagagcctagaagacactaagaaactccaggagaaatggagcctcaaaacccccgaaattcagaaagtgaacaatagtggcatttctttatgcaatcttattagtgccgtgaccactcccgcgaaggccatcgccgccgtcaagtccggtggtgctgtgctgaatggagagggtaccgctacaaacacagaggaattctgggctaataagggactgaccagtataaaaaaagatatgacggatatttctcacggctacgaggacttgggcctcttgctaaaggacaagattgctgaactgaacacgaagctttctaagctccaaaaggcccaggaggaaagctccgccatgatgcaatggctgcaaaagatgaataagactgccaccaaatggcagcagaccccagccccaacagatactgaggcagtgaagacacaggtcgaacagaataagagctttgaagccgaattaaagcagaatgtcaataaggtccaggaactgaaggacaaactcacagagctgttagaagagaatccagacacccccgaagctccccggtggaaacagatgttaaccgagattgattccaagtggcaggagttgaaccagctcacgattgatcgccaacagaagcttgaagagtcctccaataatctgacccagttccagacggtcgaggcccagctgaaacagtggctggttgagaaggaactcatggtgagtgttttgggccctctgagcatagatcctaatatgctcaacacccagcgtcaacaggtccagattttgctccaagaattcgccactcggaagccgcagtatgagcaattgaccgccgcaggccaaggaattctgtcacgcccaggcgaagacccttcactcaggggcatcgtcaaagaacagctagccgccgtcactcagaagtgggatagccttaccggtcagctgtctgacaggtgcgactggatcgatcaggcaatagtgaaaagcacacagtatcagagtctgttgaggagtctttcagacaagttgtcagacctggataacaagctgtcctctagcctcgctgtgtcgacgcatcccgacgcaatgaatcagcaactggagacagcgcagaaaatgaagcaggaaatccagcaggagaaaaaacagattaaggtggcccaagcgctttgcgaggacctgtccgctctcgtcaaagaggagtatttgaaagccgagctatctagacagttggaagggattctgaaaagctttaaagatgtggagcaaaaagcagaaaatcacgtccagcacttacagtccgcttgtgcttcaagtcaccaattccagcagatgtcccgggattttcaggcctggctggatacaaagaaggaagaacagaacaaatcacacccaatatcagcgaaactggacgtgctagagtctcttattaaagatcacaaggacttttccaaaactctgactgctcagagccatatgtacgagaagactattgcagagggagaaaacctgttactgaagacgcaggggagcgagaaggccgcccttcagctccagttaaataccataaaaaccaattgggacactttcaacaaacaagtgaaggagcgcgaaaacaagctgaaggaatctctcgagaaagccctcaaatacaaggagcaggtggagacattgtggccctggattgacaagtgccagaacaatctagaagaaattaaattctgcctggatccagctgaaggtgagaattcaattgcaaagctgaagtcactgcagaaagagatggaccagcatttcggcatggtggagctgctgaacaatacggccaactccctgcttagcgtttgcgagatagacaaagaggtggtgacggatgagaacaaatccctaatccagaaagttgatatggtgacagagcaattgcacagcaaaaaattctgtctggagaacatgactcagaaattcaaggagttccaggaggttagtaaggaatcaaaacgccagctgcagtgcgcaaaagaacagctggacatccacgattccttgggctctcaggcctactccaataaatatcttactatgctccagacacagcaaaaaagccttcaggctctcaagcatcaggtcgatcttgccaaaaggctggcccaagacctcgtagtcgaagcatcagacagtaagggaactagcgacgtactgctgcaggtagaaacaattgcccaagaacactcaacgctgtcccagcaggttgatgagaagtgcagcttcctcgagaccaaactgcagggcattggacattttcaaaacacaatcagggagatgttcagccagtttgccgaattcgacgatgagttagatagcatggcaccagtgggccgggatgctgagaccctgcagaaacagaaagagacgataaaggcctttctgaaaaagctggaagccctgatggcgtccaatgacaacgcgaataagacatgtaagatgatgctagccactgaagagacctcccccgatctggtaggcatcaagcgtgacctggaggcactctccaagcaatgcaacaagctcttggaccgcgcccaagcccgggaggagcaggttgaaggaacaattaaacgacttgaagagttctacagcaaactgaaggaattttcgatccttctgcagaaagccgaggaacatgaggagtcgcagggacctgtgggtatggaaactgagaccattaaccagcaactgaacatgtttaaggtgttccaaaaggaagaaatcgagccgcttcaggggaagcagcaggacgttaactggctcggtcagggcctgatccagtctgctgcaaaaagtaccagcacacagggactggaacacgacctggatgatgttaatgccagatggaaaaccctcaataaaaaggtagcccagagagccgctcaactgcaggaggctttgctgcactgcgggcgttttcaggatgctctggaaagcctcctctcttggatggttgatacagaggagttggtcgcaaaccagaagccaccgtctgcggaattcaaggttgtcaaagctcagattcaagagcaaaaactgcttcagcgtctgcttgatgaccgaaagagtacagtagaggtaatcaaaagggagggagaaaagattgcaaccaccgctgagccggccgacaaggtgaagatcctgaagcagctgagtttactcgacagcagatgggaggcactcttgaataaagctgagacccgcaaccgacaattggagggaatttctgtggtggctcagcagttccacgagacacttgaacctctcaacgagtggttaacaacaatagagaaaaggcttgtcaactgtgaacctatcggaactcaggcgagcaagctcgaggaacagatcgcacaacacaaggccctggaagacgacataattaatcataacaagcatctccatcaagcagtgagtatcggtcagtccctgaaggtgctgtccagcagagaggacaaggacatggtccagtccaagctcgatttcagtcaagtctggtacatagagattcaggaaaagtcgcacagtaggagtgagctcctgcagcaggcactgtgcaatgcaaagatttttggagaagatgaagtggagctgatgaattggcttaacgaggttcatgataaattatcgaagctgagtgttcaggactactccacggaggggttatggaagcagcagtccgagcttcgcgtccttcaggaggacatcttactgcggaaacagaacgtcgatcaggccttactcaacggccttgaactcctgaaacagactaccggagatgaggtacttattatccaagataagcttgaagccatcaaggctagatataaagatatcacgaagctgagcacggatgtggctaaaacgctggagcaagccctgcagctagctaggaggcttcatagtacacacgaggaactttgtacctggctcgacaaagttgaagtggagttgctctcgtacgagacacaggtcctaaaaggtgaggaagcctcacaggcacagatgcggccaaaagagctgaagaaagaggccaaaaacaataaagcactgctggatagcttaaatgaggtcagcagcgccttgctcgagttggttccctggagagcacgggaggggctggaaaagatggtggctgaagataatgagagatatagactcgtaagcgacacaattacgcagaaagtggaggagatcgacgcggcgatcctgcggtctcagcagttcgatcaggctgccgacgcagaactgagttggattacggagacagagaaaaagctgatgtcattaggagatatcaggttggaacaggatcagacctccgctcaactgcaagtccagaagacttttacaatggagatacttcggcacaaggacataatcgacgacctggttaagagcggccataagattatgacagcgtgctcagaagaagaaaagcagagcatgaagaaaaagctggataaagttttgaaaaactatgacacgatctgtcagataaactccgaaaggtatctccaacttgagagggcccagagcctcgtcaaccagttttgggagacctatgaggaactctggccatggctgaccgaaacgcagtccattatatcccagctgccagctcctgcgctcgagtatgagacgctgagacaacagcaggaagagcaccgacagcttagggaactgatagccgagcacaagccgcacattgacaaaatgaataaaaccggcccccaactccttgagctgtcacccggggaaggattttcaattcaggagaaatatgtggctgctgatacgctttacagccagatcaaagaggatgtgaagaagagggcagttgcccttgatgaagctatcagccaatccacccagttccacgacaagatcgaccaaatcctcgaatccctcgagaggattgttgaaagactccgccaaccccctagcatttccgcagaagttgaaaaaattaaagaacagatcagcgaaaataagaacgtcagcgttgatatggagaaactgcagccactgtatgagacacttaagcagcgtggtgaggaaatgattgcacgtagtggcggaacagataaagacatcagcgccaaggcagtgcaggacaaattggatcaaatggtcttcatttgggagaatatacatacattggtcgaggagcgcgaagccaagctcttggatgtaatggagctggctgagaagttctggtgcgaccatatgtcgctgatcgttacaatcaaggacacccaggacttcattagagatttggaagatcccgggatcgatccgtccgttgtgaagcaacaacaggaggcagcagaaacaattagggaggaaatcgatggtctgcaagaggagctagacattgtcattaatttaggctcagagttgatcgcagcgtgcggagagccggataaacccatcgtgaagaaatcaattgacgaactgaactccgcctgggacagcctcaataaagcctggaaggaccgaatcgacaaattggaggaagccatgcaggctgccgtgcagtaccaagatgggctgcaagccgtatttgactgggtcgacattgcaggaggcaagctggcatctatgagtcctatcggaacagatcttgaaacagttaaacagcagatcgaggaactaaaacagtttaaaagcgaggcttaccagcagcagatagaaatggaacgcctgaatcatcaagccgaactgctgctgaagaaagtgacggaggagtccgacaaacatactgttcaggaccctcttatggagctgaagctgatttgggactcactggaagaaagaattattaacaggcagcataagttggaaggagctctcttagccctgggccagttccagcatgcccttgacgagctactggcgtggctgactcacacagagggcttgctgtccgagcagaaacccgtaggaggcgacccaaaagcgatcgaaatagaattggctaagcaccacgtgctgcagaatgatgttcttgcccaccagtcgacagtggaagctgtgaataaagctggcaatgaccttattgaatcgagtgctggtgaggaagcatcaaatctgcagaataaactggaagtcctgaatcagcgctggcagaatgtgctggagaagaccgagcagaggaagcagcagctggacggagcactacgtcaagccaaaggctttcacggcgagatcgaagatttgcagcagtggctgaccgatactgagaggcacttattagctagtaaacccttgggcggcctgccggagactgccaaggagcagctaaacgtgcacatggaagtgtgcgcagccttcgaagcaaaagaggagacgtataaatcccttatgcaaaaaggtcagcagatgctcgctcgctgcccaaaaagcgccgagacaaatatcgaccaggatattaacaatcttaaggaaaagtgggaatccgttgagaccaaactgaatgagaggaagaccaagctggaggaggccctgaatctcgccatggaatttcataactctctgcaagatttcatcaactggctcacccaggccgagcaaacactcaatgtggctagcaggccgagcctaatcttagatacggtgctgttccaaatagacgaacacaaagtgtttgccaatgaggtgaacagtcacagagaacagatcatagagctcgacaagaccggcacacatctcaagtatttctctcaaaaacaggacgtggtcctgatcaagaacttacttatatctgtacagtcccgatgggaaaaagttgtccagagattggtcgaacgaggccgaagccttgatgacgcgaggaagagggcgaagcagtttcacgaggcttggtccaagctgatggagtggctcgaggagtccgaaaaaagcctcgactccgagctggagatagccaacgatccagataaaatcaagacacagctcgcacagcataaggaatttcagaaatcactgggcgcgaagcactccgtttacgacactacaaacagaacaggacgatctctgaaagaaaagacaagtctagcggatgataacctcaaattagatgatatgctaagtgagcttagagacaaatgggatacaatatgcggcaagagcgtcgaaagacagaataaactggaagaggccttactgttctcaggacagtttaccgatgcactgcaggcgttaatcgactggttataccgggtggagccccaacttgctgaagatcagcccgtccacggagacatcgacctcgtgatgaatttaatagacaaccataaggctttccagaaagaactgggtaagcgaacgagctccgtacaggccctcaaacgctccgctcgagagctaattgaaggctctagggatgattcgagttgggtgaaggtacagatgcaggagctgtcaactcggtgggaaaccgtctgcgctctgagtatcagtaaacagacccggctggaggccgctcttagacaggccgaagaatttcatagcgttgtccacgcactgctggaatggctggcagaggccgaacaaactctaagattccacggggtacttcccgatgatgaagacgcactgagaaccctgattgatcaacacaaagagttcatgaaaaagctggaagagaagcgcgccgagctgaacaaggctaccactatgggcgatacagtgcttgctatttgtcatccagattctatcacaactatcaagcactggattaccatcattcgggcccgttttgaggaggtgctggcgtgggcaaagcagcatcagcagcgtttagcgtcagcgttagccggtctgatcgctaaacaagagttgctggaggccctgctcgcgtggctccagtgggccgaaactacactgactgacaaagacaaagaagtgattcctcaggagatcgaggaagtgaaggcattgattgccgagcaccagacattcatggaggagatgacaaggaaacagccagatgtcgacaaagtcaccaaaacctataagagacgcgcggctgatccaagcagtctccagtcacatataccagtgttggacaaaggaagagcagggagaaagagattcccggcaagtagcctttacccttcgggcagccagacacaaattgaaacaaagaaccctagagtgaatctcctggtgtcaaaatggcagcaggtgtggctgctcgctttagagaggaggaggaagctcaacgacgctctggaccgcctggaagaactgagagagttcgcaaacttcgactttgacatatggcgcaagaagtatatgaggtggatgaaccacaaaaagtctcgtgtgatggactttttccgtcgcatcgataaggatcaggatggcaaaattactcgccaggagtttatcgacggcattctgagtagtaaattccccacatccaggcttgagatgtcagcggtcgcagacatcttcgacagggacggggacggctacattgactactatgagttcgtagcagctctccatcctaataaggacgcctataaacccattaccgacgccgacaagatagaagacgaggttactaggcaggtggccaaatgtaaatgcgctaaaaggtttcaagtggaacaaataggggacaacaagtatagagtcagtttccaatctaacttcggggattcccagcagcttcgacttgtgcggatcttgcggagcactgtaatggtacgggtggggggcggctggatggcgctggatgaatttttggtgaagaacgatccctgccgggttcatcaccacggatccaagatgctgcgctctgaatccaacagttccattacaacaactcagccaacaatcgctaagggtcgtaccaatatggaacttagggagaaattcatccttgcagacggcgcttcgcagggtatggccgcatttcgtccccgcggaaggagaagtaggccgagcagccgcggcgcgtcccctaatagatctacaagcgttagctcacaagcagcacaagccgcatccccccaggtcccagccactaccacccctaaaggcacccctattcagggcagcaagctgaggttgcctgggtacctcagcgggaaaggcttccactcaggggaagattccgggctcatcacaactgcagccgcaagagtccgaacgcagttcgccgactccaagaaaacaccctccagaccagggagtcgcgccgggtccaaggcgggatctcgagcatcctctaggcggggatctgacgcctcggacttcgacatatcagagattcaaagtgtgtgtagcgatgttgagaccgtgccacagacgcacagacctacacctcgcgcgggatcgcgccctagcactgccaaaccctccaagatccccacccctcagaggaaaagcccagcgtctaaattagacaagagctcaaaaaggtag

SEQ ID NO: 115322 - DNA, 768 bp, Artificial Sequence
  Description of Artificial Sequence: Synthetic coding sequence
atgaataaaactggcccacaactgctggagctgtcgccgggcgagggtttctctattcaggagaagtatgtcgccgctgacaccctgtattctcagattaaggaggatgttaagaagcgtgcggtggccttggatgaggctatttcccagtccacccagttccatgataaaattgatcagatcttggagtcactcgagagaatagtcgagagactgcgccaacccccaagcatctctgccgaggtcgagaagattaaagaacaaatatcagaaaataagaatgtgagcgtagacatggagaaactccagcccctttacgagactctaaaacagagaggtgaagagatgatagcccgatccggcggcactgacaaagacatatctgcgaaggcggtgcaggataagctggaccaaatggtgttcatctgggagaatattcacactctggtcgaggagcgcgaggcgaagctgctggacgtcatggaattggctgaaaagttctggtgcgaccacatgagcctgatcgtgactatcaaagacacacaggactttatcagggatcttgaggacccagggatagacccctcagtagtcaaacaacaacaggaggctgcggagactatccgagaggagattgacggcttgcaggaagagttagatatcgtcatcaaccttggaagcgaacttattgccgcgtgtggcgagccagataagccaattgtgaaaaaaagcatcgacgaattgaattccatgggatttagtaaatag

SEQ ID NO: 115323 - DNA, 1359 bp, Artificial Sequence
  Description of Artificial Sequence: Synthetic coding sequence
atgtttcccgaccagcccgagaagcctctgaacctggctcacatcgtgccaccaagacccgttaccagcatgaatgatactctgttttcccactctgttcccagttctggtagtccatttatcactcgccgattgcccgagggtattagtgcaagctcacccgtcgccgaggaacattcgttgatcaaactttatgttaaccagttggaccatggggcccggtcccctcccaaggacagcgaggttgaacagaacaagctgctggcgagagcggctccagctttcctaaaaggcaaggggatccagtatagtctgaacgtcgccgaccgccttgccgatgagcacgtgctgataggcctttacgtcaatatgctcagaaacaacccaagctgcatgctcgagtcctccaatcgactggacgaggagcaccgcctgatcgcccgctatgctgcacgtctagcagccgagtcgagcagcagccagcctccccagcagcgatccgcaccagatataagcttcaccattgatgccaataaacaacagcgacaacttattgccgagcttgagaacaagaacagagaaatcctgcaagagatacagaggctgaggcttgagcacgaacaagccagccaacccacccctgagaaggcacagcagaaccctacactcctcgccgagttacgtctgctccgacaacgcaaagacgagctagaacaaaggatgagcgccctccaagaatccaggcgggaattaatggtgcagctggagggcctcatgaaactgctaaagacccagggggccggtagtccccggtctagtcccagtcacactatttcccggccaatccccatgccaatccggtctgcatctgcatgtagtactcctacgcacactccccaagattctctaaccggggtgggcggcgatgttcaggaagcctttgcacaatcctcacgccggaatctccgtaatgatttgctggtggctgccgactccataacaaacacaatgtccagcctcgttaaggaactgaattctgaagtgggctctgagaccgagtctaacgtggactcagaatttgcaaggacccaatttgaggaccttgtcccgagccccacttccgagaaggcattcctggcacagatccatgcacgcaagccaggttacatccatagtggagctactacatctaccatgaggggggatatggtcacagaagacgccgatccgtacgtgcaacccgaagatgaaaattacgaaaatgacagcgtcaggcagcttgaaaatgaactgcagatggaggagtatctgaagcagaagctccaggacgaggcatatcaggtgagtctgcaggggtag

SEQ ID NO: 115324 - DNA, 1116 bp, Artificial Sequence
  Description of Artificial Sequence: Synthetic coding sequence
atgatcgaggatagcggaaaaagagggaacacaatggcagagcggaggcagctgttcgctgaaatgagggcccaggacctggatcggattcgacttagcacctatcggaccgcgtgcaagctcaggtttgttcagaagaaatgtaacctacacctggtagacatttggaacgtgatcgaagctctgcgtgagaacgctctaaacaacctggaccccaacaccgagctcaacgtaagcaggctcgaggctgttctttccaccattttctatcagctgaataagcgaatgcccactactcatcagatccatgtcgagcagtcaatctcactgctgctgaatttcctgctggccgcattcgacccggagggacacggtaaaattagcgtctttgccgtcaaaatggctctcgccactctgtgcggcggtaaaattatggataagctcaggtatatcttctctatgatcagcgatagcagcggcgttatggtctacggacggtacgaccagttcctccgggaggtgctcaagctacctaccgcggtcttcgagggccccagttttggctacaccgagcagagcgccagatcatgcttcagccagcagaaaaaagtcaccttaaacgggtttttggacaccttgatgtcagacccccctccccagtgcctggtgtggctgccactgcttcataggctagctaatgtggaaaacgtatttcaccccgtggagtgctcatactgtcacagcgagtccatgatgggattccgataccgatgtcagcagtgtcacaactatcagctctgccaagattgtttctggcgggggcacgccggtggaagccattccaatcagcaccagatgaaggaatacacctcttggaaatctcctgcaaagaaactaacaaacgcactcagcaagtcgcttagctgcgccagctcgagagaacctctccatcctatgtttcctgatcagcctgagaagccccttaacctggctcacatagtcccccccaggccggttacttctatgaatgatacactgttttctcactcggtgccgagttccgggtcaccatttatcactcggagttccgatggtgcatttggcggatgtgtgtag

SEQ ID NO: 115325 - DNA, 1188 bp, Artificial Sequence
  Description of Artificial Sequence: Synthetic coding sequence
atgttcccagaccagccagagaagccacttaatctggcacacatcgtaccaccaagacccgtaacatctatgaatgacaccctgttctcccactctgtcccctccagcgggtccccattcattactcgtaggctgcccgagggcatcagtgcttcctctcctgtcgcagaggaacattccctgataaaactgtacgtcaaccagcttgaccacggtgcacgtatgctggagtcttctaacagactagatgaagaacatcgcctcatcgcaaggtacgctgcacgccttgctgctgaatcatcctcctcacagcccccgcagcaaagatccgcccccgatatttcattcacaattgacgcaaataagcagcagcgccaactgattgcagaactggagaataaaaatcgagagatcctccaagagatccagcggttgcgattagagcatgaacaagccagccagccaactcccgaaaaagcacaacaaaatcccaccctgcttgccgagctccggttgctgcggcagcgaaaagatgaactcgagcaacgcatgtccgccctccaggaatctcgcagagagctgatggtgcagctggaagggttgatgaagctcctcaaaacacaaggcgcggggagcccaaggtcttctcctagccacaccatttccagaccaattcctatgcctatcagatctgcctctgcttgctctactccaactcatactccccaagactcattgacgggggtgggtggggatgtgcaggaggccttcgcacagtcatcacgtcggaatttgcgcaacgacctgcttgtggctgcggactccataactaatactatgagcagccttgtgaaggagctgaactccgaggtgggcagcgaaacagaatccaacgttgattcggagttcgccaggacccaatttgaggatctcgtaccttctccaacatctgaaaaggcttttctggcccagatacacgctagaaagccaggatacatccattctggcgccactacctctaccatgcgaggggatatggtgaccgaagatgccgatccctatgtgcaacccgaagatgagaactacgaaaacgacagcgtacgtcagctggagaatgagttgcaaatggaagagtaccttaagcagaagctacaggacgaggcttaccaggtgtcattgcaaggttag

SEQ ID NO: 115326 - DNA, 2175 bp, Artificial Sequence
  Description of Artificial Sequence: Synthetic coding sequence
atgatcgaagactcaggaaagcgaggtaataccatggccgaaaggcggcagctgttcgccgaaatgagagcccaggacttagaccgtatccgtctgtccacatatcggacagcctgcaaactgcgctttgtgcagaaaaaatgtaatctgcatctggtagacatatggaacgttattgaagccctgcgggaaaatgcccttaacaatctggaccctaatacagagctgaacgtgtctagactcgaagccgttttaagtaccatcttctatcaactgaataagcggatgcctactacccaccagattcatgttgaacaaagcatctcactgctcctgaatttcctgcttgccgcattcgacccggaaggccatgggaagatctccgtctttgccgtcaagatggctttggctactctatgcggagggaagataatggacaagttacggtatatcttctccatgatctctgactccagcggcgtgatggtatacggccgatacgaccaattcctgagagaggtgctcaaactacccaccgccgtgttcgaaggaccttcctttggctacaccgagcagtctgcacgttcctgcttctcacaacagaaaaaggtcacactcaacggctttctggataccctgatgagtgatcctcccccccagtgcctagtctggttacctctgctgcacagactggccaacgttgaaaatgtatttcacccagtggagtgttcgtattgtcattccgagagtatgatggggttccgatatcgttgccagcaatgccacaattaccagctttgccaagactgcttttggaggggccacgctggaggctcacactcaaaccagcaccagatgaaagaatacacatcctggaagtcccccgcaaaaaagcttacgaatgcactcagtaagtcattgtcttgtgcatcttcacgcgagcccctccatcctatgttccccgaccagcccgagaagcccttgaaccttgcccacattgtcccacccagacctgtaaccagcatgaatgataccctattctctcactcagtacccagctccggttccccttttattacacggtctatgctggaatcatcaaatcgattggatgaggagcaccgcctcatcgccaggtacgccgcccgtctcgcagccgagagttcatcttcccagccaccgcagcaaagaagtgccccagatatttcctttaccattgatgccaataaacagcagcgccagctgatcgccgagctggaaaataagaatagagagatcctgcaagagatccaaagacttaggcttgagcacgaacaggcgagccagcctactccagaaaaggcacagcagaatcctacgcttctggctgagctgaggctgctgcgccagcgcaaggatgaattagagcaacggatgagtgctctccaggagagccgaagggagctcatggtgcagcttgaaggtttgatgaaattgctgaaaacacaaggggccggctctcctaggtcctccccttcacataccatcagcaggccaatccccatgcccatcaggagtgcatcggcatgtagcacgccaacacacacccctcaggacagtctaactggggtgggaggcgatgtccaggaggctttcgcacagagcagccggcggaatctgagaaacgatcttctggtggccgccgacagcatcaccaatactatgtcctctctcgtcaaggaactcaactccgaagtgggcagcgaaacagagtccaacgtcgacagtgaatttgctcgaacccagtttgaggacctcgtgccctcaccaacatccgaaaaagcctttttggcccagatacacgcaagaaaaccaggatatatccattctggcgcaaccacgagtactatgagaggtgacatggtgaccgaggatgcagacccttatgtgcagcctgaagatgaaaactatgagaacgactcagtcagacaacttgagaacgagctgcagatggaggagtacctcaagcagaagctacaggacgaggcttatcaactccacgtcagtactgagactcgacttgaacacccatgtcccgtgtccgaaactaaatggcgtgtgctcttctggggtttcgtcttctttggtgggttcctctcccttgcactccaaatttatttttggggcctgttctag

SEQ ID NO: 115327 - DNA, 912 bp, Artificial Sequence
  Description of Artificial Sequence: Synthetic coding sequence
atgctggagacattgagagagcgtctcctgagtgttcagcaggactttacaagtgggctaaaaacgctgagcgacaaaagtcgcgaggccaaggtcaagagtaagcccagaaccgtgccattcttacccaagtactccgcaggactggagttattgtcccgctatgaagacacgtgggccgcactccacaggagggctaaagactgtgcaagcgccggggagctagtcgacagcgaggtggtcatgctgtcagctcactgggaaaaaaagaaaacaagcctggtcgaactccaagagcagctgcaacagctgcctgccctcatcgccgacttggaatctatgactgccaacctgactcacctggaggcgtcctttgaggaggtagaaaacaatcttctccaccttgaagacttgtgtggtcagtgcgagctggaaagatgcaagcacatgcagagtcagcagctggaaaactataagaagaataagcggaaggaactggagacatttaaggctgagctggatgcagagcatgcccagaaggtcttagaaatggagcacacccagcagatgaagctaaaagagaggcagaagttctttgaagaagccttccaacaggatatggaacagtacttaagcaccgggtacctgcagatcgcagagcgccgggaaccaattggttctatgtccagtatggaggtaaacgtcgacatgctggagcagatggatttaatggacatttcagatcaggaggccctcgatgtgttcctcaatagcggcggcgaagagaataccgtcctatccccagcactaggtcgagtagataaattggccctcgctgaaccagggcaatatcggtgtcatagtccacccaaagtgagacgagagaatcacctccccgtcacatacgcgtag

SEQ ID NO: 115328 - DNA, 1056 bp, Artificial Sequence
  Description of Artificial Sequence: Synthetic coding sequence
atgttggaaacactgcgggagcgactcttgagcgtgcaacaggactttaccagtgggctgaaaacactgtcagacaagtctagggaggcaaaagtgaagagtaagcccagaactgtccctttcttacccaagtatagcgctgggctggaactgctgagccgctatgaagacacctgggccgctctgcatcgacgggctaaagactgcgctagtgcaggcgagcttgtggacagcgaggtggtgatgctgagtgcgcactgggagaagaagaagacctcacttgtagagctgcaggaacagctgcagcagctgcctgcgttgatagccgacttggagagcatgaccgctaatctgacacacctcgaagcctccttcgaggaggtggagaacaatcttctgcacttggaagatctgtgcgggcaatgtgagctggagcggtgtaagcacatgcagtcccaacaattggagaattataaaaaaaacaagcgaaaggagctggagacctttaaggcggaactggacgccgagcacgcccaaaaagtgctggagatggaacatacacaacagatgaagctgaaagagaggcaaaaattttttgaggaggctttccaacaagacatggagcaatacttatccaccgggtaccttcagatagcagagcggcgagagcccattggctcaatgagctcaatggaagtcaacgtcgacatgctggaacagatggacctgatggatatctccgaccaagaggccttagacgtgttcctaaacagcgggggtgaggaaaacaccgtcttgtctcccgcgctcggccccgagagctcaacctgtcagaacgagatcacattacaggtccctaatccatccgagttgcgggctaagcccccctcttcctcctccacatgtaccgactcagctaccagggacatctctgaagggggagaatcgccagtggtgcagtctgacgaggaggaggttcaggtcgacacagcgctggctacttcccataccgacagggaagctacacctgacggaggcgaggacagcgactcttag

SEQ ID NO: 115329 - DNA, 1059 bp, Artificial Sequence
  Description of Artificial Sequence: Synthetic coding sequence
atgttggaaaccctgcgggaacgccttctgagcgttcagcaggactttacctctggactgaagacattgtctgataagagcagagaggccaaagttaaatccaaaccccgtactgtgccctttctcccgaaatacagtgccggccttgaactactgagtcgctacgaagacacttgggctgccctgcaccgaagggccaaggattgcgcctccgcaggggagctggtcgatagtgaggttgtgatgctcagcgctcactgggagaaaaagaaaacttctctggtggagctgcaggagcagctgcagcagctccctgccctgattgcggacctggagagcatgacagcaaaccttactcatttggaagcatcatttgaagaagtggaaaataatctcctgcatttagaggacctttgcggccagtgcgagttggagcgctgcaagcatatgcagtcacagcagctggaaaactataagaagaataagagaaaggagctcgaggtcacgtttcgctccgagctagatgccgagcacgcgcagaaggtgttggagatggagcatacccaacagatgaaacttaaggaaaggcaaaagttttttgaagaggcttttcagcaggatatggaacaatatctcagtacaggctatctgcagatcgcagagcggagggagcctatcggtagcatgtcgagtatggaagtcaatgttgacatgctcgaacagatggacctgatggacatctccgatcaagaggcactggatgttttcctgaacagcggaggggaggaaaacaccgtgctgtccccagcactggggcccgaatcatcaacgtgtcagaacgagatcacacttcaggtccccaatccaagcgaattgagagccaagccgccaagcagtagtagtacctgtacggattcggctacgcgggacattagcgagggcggcgagagtccagtggtccagtctgacgaagaagaagtgcaggtggacacagccctcgccacaagtcacaccgaccgcgaggcgactcctgacggaggtgaagactccgactcctag

SEQ ID NO: 115330 - DNA, 813 bp, Artificial Sequence
  Description of Artificial Sequence: Synthetic coding sequence
atgctatccgcacattgggagaagaaaaaaacatcactggtcgaactgcaggaacagttgcagcagcttccggcgcttatagcggacctcgagtccatgaccgccaatctgacccatctagaagccagcttcgaagaggtggagaataatctgttgcacctggaggatctgtgtggccagtgcgaactggagcggtgcaaacacatgcagagccagcagttggagaactacaagaaaaacaaaagacggagactcaggacatttaagaccgagcttgatgccgaacacgcccagaaagttttggaaatggagcacactcagcagatgaaactgaaggagcgccaaaagttctttgaagaagcctttcagcaagatatggagcagtatttatcaaccggttatttgcagattgcggagcgcagagaacccattggatccatgagctccatggaggtgaatgtggatatgctggaacagatggacctgatggatattagtgaccaagaggctctggacgtgtttctcaattctggaggcgaggaaaatacggttttgagccctgcacttgggcccgagagctccacgtgtcagaatgaaatcacactccaggtgcccaacccaagtgagctacgagccaagccgccctcctcttccagcacttgtactgactccgccacgagagatatctcagaggggggcgaatcccccgtggttcaaagcgacgaagaagaggtgcaggtcgacacggccctggcgaccagccacacagatcgcgaggccactcctgatggtggcgaagactctgattcctag

SEQ ID NO: 115331 - DNA, 912 bp, Artificial Sequence
  Description of Artificial Sequence: Synthetic coding sequence
atgctagaaacccttcgcgaacggctcctgagtgtgcagcaggattttacgtcaggccttaaaacgctgagcgataagtcccgagaagctaaagtgaagtcgaaacccagaaccgtgcctttcctgcctaagtattccgcagggctcgaactgcttagccgatatgaagatacatgggccgcgctccaccgtcgggctaaggattgtgcctccgccggtgaactggtggacagtgaggttgtaatgctatcggcccattgggagaaaaaaaaaacatctctagtcgagctgcaggagcaactccagcagctgcctgccctcattgccgacctagagagcatgacagccaacctcacccatctcgaagcctccttcgaagaggtggaaaataacctcctccatctggaggatctctgtgggcagtgcgaacttgagcggtgtaaacacatgcaaagccagcagctggaaaactataagaagaacaagagcaaggagcttggcactggaaaggcagagctggacgcggagcacgcacagaaggtactggaaatggagcatacccagcagatgaagctgaaagagcgtcagaaattctttgaggaagcgtttcagcaggatatggagcagtatttgagcacggggtatttgcagatcgcagaaagacgggagcctattggttcgatgagctctatggaagttaacgtcgatatgttagagcagatggaccttatggacatctcagaccaagaagcacttgacgtgttcctgaactctggcggggaagagaacacagttctttcaccagccctcggaagggttgacaagctagcgctggcagagcctggccagtaccgttgccattccccccctaaggttagacgggaaaaccaccttccagtgacctacgcttag

SEQ ID NO: 115332 - DNA, 135 bp, Artificial Sequence
  Description of Artificial Sequence: Synthetic coding sequence
atgctcgagactcttcgggagagattgttatcagtgcagcaggatttcaccagcggcctcaagaccctgtcggataagtcgagggaagcaaaagttaaatccaaacccagctggctgaatcaagaacagttctag

SEQ ID NO: 115333 - DNA, 627 bp, Artificial Sequence
  Description of Artificial Sequence: Synthetic coding sequence
atgctggaaactctgcgagagaggctgctgagtgtacagcaagatttcacctccggcttaaaaacccttagcgataaatctagagaggcgaaagtcaaatccaaacctcgctatgaggatacatgggccgcactgcaccgaagagcaaaggattgcgcctccgctggagaacttgtcgactccgaggttgtcatgctatccgcacactgggaaaaaaagaagacaagcctggtggaacttcaggaacagctgcagcagctgcctgctctgatcgcggaccttgaatctatgaccgccaatttgacacacctggaagcctctttcgaagaagtggagaataatctgctccatttagaggatctttgtggccagtgcgagcttgagagatgcaagcacatgcaatcgcagcagcttgagaactataaaaagaacaagaggaaggagcttgaaacattcaaagctgagctggacgccgagcacgcgcaaaaagtcttggagatggagcatacacagcagatgaaactgaaagagcggcagaagttcttcgaagaagctttccagcaggatatggagcagtatctgtcgaccggttacttgcaaattgcagagcggaggggagatccatag

SEQ ID NO: 115334 - DNA, 2235 bp, Artificial Sequence
  Description of Artificial Sequence: Synthetic coding sequence
atgattgaagattcaggaaagaggggcaacactatggcggagaggcgtcagctgtttgctgaaatgagggcacaagatctcgatcgcataaggctgagcacttaccggacagcttgcaagttgcgtttcgtgcagaagaaatgtaatctgcacttggtcgatatctggaacgtgattgaagcgctgcgcgaaaacgctttaaacaacctagacccaaatacagaactgaacgttagccgcctggaggccgtgttgtccaccatcttctaccaacttaataagagaatgcctaccacccatcagattcacgtggagcagtccatcagcctgctgctcaatttcctgctggccgcattcgaccccgagggccatgggaaaatttcggtctttgcagtaaaaatggccctagctactctgtgtggaggcaagataatggataaattacgttacatcttctccatgatctcagactcttctggcgtgatggtgtacggaaggtatgatcagtttctacgtgaagtcctgaaactgccaaccgccgtgttcgaagggccttccttcggctatacagaacagagtgcaagatcatgttttagtcagcagaagaaagtgaccctgaatgggtttctcgacaccctaatgagtgaccctccccctcagtgcctagtttggctgccgctactgcatcgcctagccaatgtggagaacgtgttccaccccgttgaatgtagctattgtcactctgagtctatgatgggcttcagatatagatgccagcagtgtcataactaccagctgtgtcaggactgtttctggagaggacacgccggtgggagtcactctaatcaacaccagatgaaagagtacacctcatggaagtcacccgccaagaagcttacaaacgcactgagcaagtcactctcctgtgcctcttccagagaacccctacatccgatgtttccagaccagcccgaaaaacctctgaatctggcacacatcgtgctcgacaatatgcctccccgccccgttacttccatgaacgataccttgttctcgcattcagtcccatcctctggatcccctttcatcacccgctcaagccctccaaaggactcagaagttgagcagaacaaactgctggctcgcgccgcacctgcatttctaaagggtaaaggaattcagtactccctgaacgttgccgaccgcctggcggatgagcacgtactgatcgggttgtatgttaacatgttacgcaataaccctagctgtatgttggaatcttctaatcgcctggatgaagaacatcggttaattgccagatatgcggcccgcttggcggcggagtcaagcagttcccaaccccctcaacagcgttctgccccagatatcagcttcactatcgatgccaacaagcaacagagacagctgattgcggaactggaaaacaagaaccgggagatcctgcaagagatccagaggctgcgcctggaacacgagcaggccagccagcctactcctgagaaggctcagcaaaatccgacactgctggccgaactcaggcttctgcgccaacgcaaagatgagctggagcaacgcatgagcgctctgcaggaatcccggcgagagctcatggtgcagctagaaggcctcatgaagctccttaagacccaaggtgccggctctccccggtctagccccagtcacaccattagtcgacccatccccatgcccatccgctctgccagcgcatgttctaccccaacacatacaccgcaggattccttaacaggggtggggggggatgtccaggaagctttcgctcaaagctcgcggagaaatcttagaaacgaccttctggtcgctgcagatagcatcaccaacaccatgtcctctctcgtcaaggagctcaactctgaggtgggctccgagaccgaaagcaacgttgacagtgagttcgctcgcactcaattcgaagaccttgtaccaagcccgactagcgaaaaagctttcctagcccaaattcatgcccgtaagcccggctatatccatagcggggctaccactagcacaatgagaggggacatggtgactgaggatgctgatccctatgtgcagccggaggacgagaactacgagaatgattcagttaggcaactcgagaatgaactccaaatggaagagtacctcaaacaaaaactgcaggatgaggcttaccaggtttccctgcagggatag

SEQ ID NO: 115335 - DNA, 1713 bp, Artificial Sequence
  Description of Artificial Sequence: Synthetic coding sequence
atgatagaagactctggaaagcgaggcaataccatggctgaacggcgccagctgttcgctgagatgcgcgcccaggatttggaccggattcggctgtctacttaccggactgcctgcaagctgagattcgtgcagaaaaagtgcaatttgcatctggtcgacatctggaatgtaattgaggcactacgcgagaacgctctcaacaatctggatcctaatacagaactcaacgtgtctagactcgaagcagtgctttcaacaatcttttaccagttgaacaagaggatgcctacaacgcaccaaatccacgtggaacagagcataagcctcctactaaacttccttctggcagcgtttgacccagaaggacacggaaagatctcagtgttcgctgtgaagatggccttggcgactctgtgcggcggtaaaatcatggataaattaagatacattttctctatgataagtgactctagtggtgtaatggtctacggacgttacgaccaattcctcagggaagtgctgaagctgcctaccgccgttttcgaagggccttcattcggatatactgaacaaagcgccagatcatgcttttcacaacagaagaaggttaccctgaatggtttcctcgacactctgatgtccgatcctcctccacaatgcctggtgtggctcccactgctacataggctggcaaatgtcgaaaacgtctttcaccccgtggagtgcagctattgccactcagagtcaatgatggggttcagataccggtgccaacaatgtcataactaccagctttgtcaggactgtttctggcgcgggcacgctgggggatcccattccaatcagcaccagatgaaagagtacacaagctggaaatctccagcaaaaaagcttaccaatgccctgagcaagtctttgtcttgtgctagtagtagggagcctctgcaccccatgttccccgaccaacccgaaaagcctctgaacctcgcccacattgtcgacacatggccaccacgcccggtgacaagcatgaacgacactctattttcgcattctgtgccgtcatccggtagtccattcatcacacgatccagccctccaaaggatagtgaggtcgagcagaataagctccttgcccgagcggctcctgcctttttgaagggcaagggtattcagtactcactcaacgtcgctgacaggcttgccgatgagcatgtactaattggtttgtatgtgaatatgctgaggaataacccctcctgcatgctggaatcttcaaatagactcgatgaggagcacaggctgatagctcgctacgcagcccgcctcgccgcggagagcagtagcagccagccaccccagcagagaagcgctcctgatatctccttcaccattgacgcaaacaagcagcagcggcaactgatagctgaactggaaaataagaatcgagagatccttcaggaaattcagcgactccggctggagcacgagcaggcatcccaacctacccccgagaaagcacaacagaatcctactttgttggctgagctcaggttgttgcgccagagaaaagacgagctggagcaaaggatgagtgcgctgcaggaatcgcgcagagaactgatggtgcaactggaggggcttatgaagctgctgaaggaggaagaactaaaacaaggcgtgtcttacgtgccgtattgtcgaagttag

SEQ ID NO: 115336 - DNA, 2061 bp, Artificial Sequence
  Description of Artificial Sequence: Synthetic coding sequence
atgattgaagactccggcaaacgcggcaacaccatggccgagcgtcggcaactctttgccgaaatgagagcacaagacctggaccggatcagactttccacctaccggaccgcgtgtaaattgagattcgtacagaagaagtgcaacttacatcttgttgacatctggaacgtgattgaagccttgagagaaaacgctctgaataacctggaccccaacacagagcttaacgtgagccgactcgaagcagttctctcaaccatcttttaccagctgaacaaacggatgcccaccactcatcagatccacgtcgaacagtctatcagcctgcttctcaattttcttctcgctgcctttgatccagaaggtcatgggaaaatatcagttttcgctgtgaagatggccctggctactctgtgtggcggtaagatcatggacaagctccgctatatcttttcaatgatctctgatagctccggagtgatggtgtacggaagatatgaccagtttctccgcgaagtcctgaaactacccacagcagtgtttgagggtcccagctttgggtacaccgaacagtcagccaggtcttgcttcagccaacagaagaaggtgaccttgaacgggtttttggacacccttatgtctgacccacccccccagtgtctcgtgtggctacccctgctgcatagactggccaacgtagagaacgttttccatcctgttgaatgctcatactgccactccgagagcatgatggggtttagataccgctgccaacagtgccataactatcagctgtgccaggattgcttctggcggggacacgccgggggctctcactccaatcagcaccaaatgaaagaatatacttcatggaagtcacctgccaaaaagctcactaatgcactgtcgaaaagcttaagctgcgcgtcgtctagagaaccattacatcctatgtttccagaccagcctgagaagcccctgaacctggcccatatagtcgatacatggccccctagacccgttacatcaatgaacgacactttgttttctcatagtgtgccaagcagcggcagcccttttattactcgatcgatgctcgagagctctaacaggctcgatgaggagcatcgcctcatcgcacgttacgctgctagattggccgcggaatcatcctctagtcagcccccacagcaacgctctgcccccgatatctcctttactatcgatgccaataaacaacaacggcagctgattgccgagctagagaacaaaaatcgtgagatcctccaggaaatccagcgtctgcgcctagagcacgagcaggcttcacagccaacgcctgagaaggcccagcagaatcccactcttcttgcggaattacggttactgcgacagcgcaaggacgagctagaacagagaatgtctgctcttcaggaaagcagaagggagctgatggttcagcttgagggcttaatgaaattactcaagactcagggagcggggtccccccgtagcagccctagccatactatatcaagaccaatcccaatgccaattagatcagcgagcgcttgtagtactccgactcataccccacaagactccctcacaggtgttggcggggatgtgcaggaggcatttgctcaaagcagcagaagaaatttgcggaacgatctcctggtagcggccgatagcatcactaataccatgagcagcctcgtcaaagagctgaatagtgaagtgggaagtgagactgagagtaacgtagacagtgagttcgcccggacacagttcgaggacctcgttcctagtcctacttcagagaaggcctttctggcgcaaatacatgccagaaagccaggttatatccatagcggcgctactacctccaccatgcgcggagacatggtgacggaggatgccgatccatatgtgcagcccgaggatgagaattacgagaacgactcagtgcggcagctggagaatgaacttcaaatggaggagtacctgaaacaaaaattgcaggatgaagcttaccaggttagcctccaggggtag

SEQ ID NO: 115337 - DNA, 1125 bp, Artificial Sequence
  Description of Artificial Sequence: Synthetic coding sequence
atgattgaggattctggtaagcggggtaatacaatggcagaacgaagacagttgtttgcagaaatgcgtgctcaagatcttgacaggattcggctgagtacctataggactgcgtgtaaattgcgatttgtgcagaaaaaatgcaacctgcacctggtggacatttggaacgtgatcgaagcccttcgggaaaatgctcttaataacctggacccaaatactgagctcaatgtgagcagactggaggccgtgcttagcacgatattttaccagcttaataaacgcatgccaactacacatcagatccatgtcgaacagtctatatcactcctcctcaactttctgttagctgcattcgaccccgaaggccacggcaagatatcagtgttcgccgttaaaatggctctagcgaccctatgcggggggaaaataatggataagcttaggtatatattctcaatgatcagcgattcttcaggggtgatggtgtacgggcgctacgaccagtttctcagagaagtccttaagcttcccacagccgtatttgaagggcccagcttcggctatactgagcagagcgcacggagctgtttctcacagcaaaagaaggtgactctgaatggcttcctcgataccctgatgtcggatccccctccccagtgcctcgtatggctgccactgcttcacagacttgccaatgtggagaacgtgtttcacccggtcgaatgctcatactgtcacagcgagtccatgatgggattccgatatcgctgccagcagtgccacaactaccagctttgccaggactgcttctggcgcggacacgcgggggggagtcatagcaaccagcaccagatgaaagaatatacttcatggaagtcacctgctaagaagctcaccaacgcgctctccaaatctcttagttgcgccagtagccgggaacctctgcaccccatgttccccgaccagcctgaaaagccacttaatctcgcgcatatcgtagatacctggcccccgcggcctgtgacatctatgaatgacaccttattttctcatagtgtccccagcagcgggtccccctttatcacccgctcgtccgatggcgctttcggcgggtgtgtgtag

SEQ ID NO: 115338 - DNA, 1704 bp, Artificial Sequence
  Description of Artificial Sequence: Synthetic coding sequence
atgattgaggatagcgggaagcggggcaataccatggcagaacgaaggcagctttttgcagagatgcgcgctcaagacttggaccggatcagactgtcgacctaccgcacagcatgcaagctgagatttgttcagaagaaatgtaacctccatttagttgacatttggaatgtgattgaagccctgcgggaaaacgccctgaataacttggatccaaatacagagctgaacgtaagccgcctggaggccgtgctttccaccatcttctaccagctgaacaaacggatgccaaccacccatcaaattcatgtggagcagtccatctcgctgttactaaatttcctccttgcggcgttcgatcccgagggacacgggaagatctctgtgttcgccgtaaagatggctttagctacattgtgcggcggcaagattatggacaagctccgctatatcttttccatgatctcagatagctcaggagtgatggtgtatgggcgctacgaccagtttctccgcgaggttctcaagctgccaacagccgttttcgagggtccatcatttggatacaccgagcagagtgccaggagctgtttttcgcagcagaagaaggtgactctgaacggatttttggataccctcatgagcgatccacctccacagtgccttgtgtggttacccctgcttcacaggctggctaacgttgaaaatgtgtttcatccagtggagtgttcatactgtcattcggagtcgatgatgggctttaggtatagatgccagcagtgccataattaccagctctgccaagactgtttttggcgcggacacgctgggggatcccactctaaccagcaccagatgaaggagtatacatcatggaagtcacccgcgaagaaactcacaaacgccctgtctaaatctctgtcctgtgcatcttctagagaaccactgcacccaatgttccccgaccagcctgagaaaccacttaacctggcccacatcgttccaccccggccagtgacaagcatgaatgacaccttgttctcgcactcagtcccaagcagcggctctccttttataaccaggtccagtcctccaaaagactccgaagtcgagcagaacaagctgctcgctagggccgcaccggctttccttaaggggaagggcatccagtatagtctgaacgtggccgaccggctcgccgacgagcatgtgctcatagggctgtatgtcaatatgctgagaaataatcctagctgcatgctggaatcatccaatcgcctcgacgaggaacaccggctgatcgcgagatacgccgcccgactggccgcggagtcctcaagtagccaaccaccccaacaaaggtccgcaccagatattagttttaccattgacgccaacaaacagcagcgccagctgattgcagagttggaaaataagaacagagaaatcttgcaagaaatccaacggctccgtttagagcacgagcaggccagccagcccacgccggaaaaagcacagcagaatcccaccctattggctgagctgcggctgctgcggcagcggaaagacgaactcgagcagcggatgtcggcgctccaagagagtaggagggaacttatggtccaactggagggattgatgaagcttctgaaggaagaggaacttaaacaaggtgtctcatacgtcccatattgccgatcttag

SEQ ID NO: 115339 - DNA, 1176 bp, Artificial Sequence
  Description of Artificial Sequence: Synthetic coding sequence
atgttccccgaccagcctgagaagcccctaaatcttgcacatatcgtgccccctagaccggttacgagtatgaacgacactttattcagccacagcgtgccctccagtggatctcccttcatcacaagatccagcccgcctaaggactcagaagtggagcagaataagttattggctcgcgccgcaccagccttcctgaagggtaaggggatgctggaaagtagtaatagacttgatgaggagcatcgtttgatagccaggtatgcggcacgcctggcagctgaatcatcctcctctcagcccccacagcagaggtccgcaccagacatcagttttacgattgatgccaataagcaacagcgccaactgattgctgagctcgagaataagaatagggaaatactgcaggaaatccaacgcctcaggctggagcacgagcaggcatctcaaccgactcccgagaaagctcagcagaacccaaccctactggctgagttacgcctgctacgccagagaaaagatgagctcgagcagcgaatgtcggccctgcaggagtccagacgtgaactcatggtgcagctcgagggattgatgaaactgttgaagacccaaggagccggttcaccccgctcaagtccctcccataccatctccaggccaatcccaatgcctattaggtccgcctcggcctgcagtactcctacccatactccccaggactccctgacaggagtgggaggcgacgttcaggaggcgtttgcccagtcctctcgacggaacctgaggaatgacttgctggtcgccgcagactcaatcacaaatacaatgagtagtctagttaaggaacttaactcagaggtagggagtgaaactgagtccaatgtggactcagaattcgcccgcacccagttcgaggatttagttccatccccaacctccgaaaaggcctttctggcgcaaatccacgctaggaagcctggttacatccactcgggagcaaccacatccacaatgcgcggtgatatggttacagaagatgcagatccttatgttcagcccgaggacgagaattatgaaaatgattccgtgagacagctagaaaacgagttacagatggaagagtatctcaagcagaagctgcaggacgaggcatatcaggttagtctgcagggctag

SEQ ID NO: 115340 - DNA, 2232 bp, Artificial Sequence
  Description of Artificial Sequence: Synthetic coding sequence
atgatcgaggacagtggaaaaaggggtaatacaatggcagagcgtcggcagcttttcgccgagatgcgtgctcaagacttagatcggatccgcctgtcaacgtacagaacggcgtgcaagttacgattcgtgcagaagaagtgtaatctacacctagtcgatatttggaatgtcattgaagccctgcgcgagaatgctctgaacaacctggatccaaatacagaactcaacgtgagtagactcgaagccgtcctctccactatcttctaccagctgaataagagaatgccaaccacccaccagatccatgtggaacagtccatctctttattgttgaacttcctccttgctgcatttgatcctgaaggccacgggaaaatatccgtatttgccgtgaagatggcattggccaccctctgcggaggaaaaattatggacaaactgcgctacattttttcaatgatcagcgattcctctggagtcatggtttatggaagatatgaccagttcctgagagaagtgctgaaacttcccactgccgtgtttgaaggacccagttttggatacaccgaacaaagcgcaaggtcgtgtttttcacagcagaaaaaggttacactgaatggttttttggatactttgatgtctgacccgcctccgcaatgtctcgtctggttgcccctgttgcacaggctggctaacgtggagaacgtgtttcatccagtggagtgctcatattgccattcagaatccatgatgggcttcagatatcggtgccagcagtgccacaactaccaattgtgtcaagactgtttctggagaggccacgcaggggggtcccattcgaatcagcatcagatgaaagagtacactagttggaaaagcccggccaagaaactaacaaatgcactgtccaagtcacttagctgtgcgagctcccgagaacctctgcatcctatgttccctgatcagccagagaagcctctgaatctagcccatatcgtcgacacctggcccccaagacccgttacttcaatgaacgacaccctgttttcccactctgtccccagttctggttccccttttattactagaagctcccctcctaaagacagcgaagttgaacaaaataagttactggcccgcgctgcaccggcgttcctcaaaggcaaaggtattcagtattctctcaatgttgcagataggctggcggatgaacatgtgctgatcggcctatacgtgaatatgctgagaaataatccttcctgtatgctcgagagctctaacagactggacgaggagcatcgattgatagcacgttacgctgcaaggttggccgccgaaagctctagcagccagccacctcagcagagaagtgctcctgacattagttttaccatcgacgcaaataaacagcagcgccaacttatcgccgagttggaaaataagaatcgggagatattgcaggaaattcagcgcctccggctggagcatgaacaggctagtcagccgaccccggagaaagcccagcagaaccccactctcctcgcagagctgagacttctccgccagcggaaggacgaactggaacagagaatgtccgccctccaggaatctcgaagagagctgatggtgcagctggagggactgatgaagctacttaaaacgcagggcgccggatccccccgttcttcccccagtcacactatatccagacctatccctatgccaatcaggtccgccagcgcctgctctactcccacacacactccgcaggatagtttaacgggtgtgggaggtgacgtgcaagaggccttcgcccagagctcccggcgcaacctgcgtaatgacctcttagtggctgctgactccattacaaatacgatgagtagcctggtgaaagagttgaactccgaggtaggatccgaaaccgaatctaacgttgatagcgagttcgccagaacccagtttgaggacctggtaccttcaccaacatctgaaaaggctttcctggcccaaattcatgcaagaaaacctgggtatattcatagtggggccaccacgtctacgatgagaggcgatatggtgaccgaagacgcagacccctatgtgcagcccgaagacgagaattatgaaaacgatagtgtgaggcaactggagaacgagctgcagatggaagaatacctgaagcagaaactccaggatgaggcctaccaagtgtcccttcagggatag

SEQ ID NO: 115341 - DNA, 2073 bp, Artificial Sequence
  Description of Artificial Sequence: Synthetic coding sequence
atgattgaagactcgggtaagcggggtaatacaatggcagagcgacggcagttattcgctgagatgagagcccaggatctcgaccgaatacggctgtctacatataggacggcatgcaaattgcgatttgtgcagaaaaagtgtaaccttcacttggtcgacatttggaacgtcattgaagccctgcgagagaacgcactcaataacctggaccccaacacggagctcaatgtgtccaggctcgaagctgtactgtcaactatcttttaccagttaaacaagcgcatgccgaccacccaccaaatccacgtggaacaaagcataagcttacttctaaacttcctgctggccgcctttgatcccgagggccacgggaagatatctgtttttgccgtaaagatggcactcgcaacactttgtgggggcaaaataatggacaaattacggtatatcttcagcatgatttcagatagttccggggttatggtctatggccgctacgaccagttcctgagggaggtcctgaagctccccactgccgtgtttgagggtcccagttttggctacacagaacaaagcgctaggagctgctttagccaacaaaagaaggtgacactcaacggattcctggataccctgatgtctgatcctcccccacagtgcttagtgtggttgcctttactccacaggttagccaacgtagagaatgttttccacccagtggaatgctcgtactgccattctgaatccatgatgggatttcgatacagatgccagcagtgtcacaattatcagctttgccaggactgtttttggagagggcacgccggcggttcacatagcaatcagcaccagatgaaagaatatacctcctggaagtcaccagccaaaaagcttacaaacgccctgagtaaatctctgtcttgcgcctcctctagggaacccttacatcccatgttcccagaccaaccagagaaacccttgaatcttgctcatattgtgcctccgaggcccgtgacgtccatgaatgatacactcttcagccactccgtgccttcttcaggctcccctttcatcactcgctccatgctggaaagttccaaccggttagatgaagagcaccgcttgatcgccaggtacgcggctcggctggccgccgaatcaagctccagccagcccccacagcaacgaagcgcccctgacattagcttcacgattgacgcaaacaaacaacagcgccaactgattgccgaactggaaaacaagaatcgagagatcctgcaggaaattcagcgtcttaggttagagcacgagcaggcatcacagccgacaccagaaaaagcccaacaaaatccaacactgctcgcggagctgcggttgttacgccagcgcaaggacgaactggagcaaagaatgtcagcacttcaggagagccggcgcgagctgatggtgcagttagagggactaatgaaacttttgaaggaggaagagttaaagcagggcacccagggggccggcagcccacgaagcagtccttcacacaccatatctcgtcctataccgatgccaatacgctctgcatctgcatgctctacaccgacacacactccacaggattccctgactggagtgggcggagacgtgcaagaagcatttgcgcagtcatcaaggcgcaatctcaggaatgacctgctggtggctgctgactctatcaccaacaccatgagcagtcttgtgaaagagctgaacagcgaggtcggcagcgagaccgaatctaatgtcgatagtgagtttgccaggactcagttcgaggacctggttccttcacctacctcagagaaagcttttttagcccagatccatgcacgtaaaccaggatacattcatagtggcgcgaccacatccacaatgcggggagatatggtgaccgaggacgccgatccttatgtacaacccgaagacgaaaattacgagaatgactctgtacggcaactcgaaaatgagttgcaaatggaagaatatctgaagcagaaactgcaagacgaggcctaccaggtgagcttgcagggatag

SEQ ID NO: 115342 - DNA, 2061 bp, Artificial Sequence
  Description of Artificial Sequence: Synthetic coding sequence
atgatcgaggattctggcaagcgcggaaacacgatggccgagcgaagacagctgttcgctgaaatgcgcgcgcaggaccttgaccgcattaggctgtccacatacaggacagcttgtaaactgagattcgtgcagaaaaaatgtaacctacacttggtcgatatctggaatgtcatagaggcactgagagagaatgcccttaacaacctggatcccaatacagaactgaatgtgtcgcggctggaggctgttctaagcactatcttttaccagcttaacaaaagaatgcccactacccaccagatccacgtagaacagtctattagcttactcctgaacttcctactcgctgcgtttgatcctgaggggcacggcaaaataagcgttttcgccgtcaagatggcattagctacactctgcggaggtaagatcatggataagctgcgatacatcttcagtatgatcagtgattcctcaggcgtaatggtctacgggcggtacgatcagtttttgcgcgaagtgttgaaactgcctactgctgtcttcgaaggaccatctttcggctacactgaacagtccgcccggtcttgcttttctcagcagaaaaaagtgactctcaatgggttcctcgacacattgatgagcgacccacccccccaatgcctggtgtggctgcctcttctccataggttagccaatgtggaaaacgtcttccaccccgtggaatgctcttactgccattccgagtcaatgatgggttttagatatcggtgccagcagtgtcataactaccagttatgccaggactgcttctggcggggtcacgccggaggaagccactcgaatcaacaccagatgaaggagtacacttcctggaagtcccctgccaaaaagctgacgaatgccctcagtaagagcctatcttgtgcatcttcaagggaacccctccaccctatgttccccgaccagcctgaaaaaccactaaacctcgcacatatcgtttgctttcgcccaccgagaccagtgacctctatgaatgacaccctgttcagccacagtgtgcctagctcggggtcccctttcatcacacggagtatgctggaatccagcaatcggctcgatgaagagcaccgcctcatcgcacgatacgcagcgagactggcagcagagagcagtagcagtcagcctcctcaacaaagaagcgctcctgatatcagttttactatcgacgctaacaaacagcagcgccagttgattgcggaactcgagaacaaaaatagggagatcctgcaggagatccaaagactgaggttggagcatgaacaggcctctcagcctactccagagaaagcgcagcagaaccctactcttttagcagaactgaggctacttcgacagcgaaaggacgagctagagcagcggatgagcgctctccaggagtcacggcgcgaactaatggtgcagttggagggattaatgaaactgctgaaaacacagggcgccggaagccctagaagttctccttcccatacgatttcccggcctatcccaatgcccattcgttccgccagcgcctgctctacacccactcatactccccaagacagcctcactggtgttggaggagatgtgcaggaggcctttgcccagtccagtcgccggaatctgcgtaatgatctgctggttgccgcggactccatcacaaacacaatgagtagcctggtgaaagaactgaactcagaggtgggaagcgaaaccgaatccaacgttgattcagaattcgcacggacccaattcgaagaccttgtaccaagccctacctcggaaaaggctttccttgctcagatccatgcacgaaagccaggatatatacattcaggggcaaccacctccacaatgcgaggagacatggttaccgaagacgcagacccatatgtccagcccgaagacgaaaactacgagaacgattccgtccggcagctggagaacgagctgcagatggaggaatacctgaagcagaaacttcaagacgaagcataccaggtgagcctgcaaggatag

SEQ ID NO: 115343 - DNA, 2232 bp, Artificial Sequence
  Description of Artificial Sequence: Synthetic coding sequence
atgattgaggactcaggcaagcggggcaacacaatggctgaaagaaggcagctgtttgccgaaatgcgcgctcaagaccttgaccgcatcagactcagcacttacagaacagcttgtaagttacgcttcgtgcagaagaagtgtaacctccaccttgtcgacatctggaacgttatagaggcccttagggagaacgcactcaataacctcgaccccaatactgaactcaacgtatctaggcttgaggccgtgttaagtacaattttttaccaactcaataagcggatgccaaccacgcatcaaattcacgtggaacagtcaatcagccttctcctgaactttttgcttgcggcttttgaccccgaagggcacgggaagatcagcgtattcgcggtgaagatggcactggcgacactctgtggcggaaaaataatggataaacttcggtatatcttctccatgatctctgattcatctggggttatggtatacggcaggtacgatcagtttctgcgggaggtgcttaagcttccaacggctgtattcgaagggcctagttttggatacactgagcagtccgcccgctcctgcttttcccagcagaagaaggttactcttaacggatttctggataccttgatgagcgaccctcccccgcagtgtctagtatggttgccccttctccaccgactcgctaacgtggaaaatgtgtttcaccctgtcgaatgctcttattgtcatagcgagagtatgatggggttcaggtacagatgccagcaatgtcacaattaccagttgtgccaggattgcttttggcgtggacacgccggcggatcccactctaatcagcatcaaatgaaagagtatacgagctggaaaagccccgcaaaaaagctaaccaatgctctgagcaagagcttatcctgtgcttcttctcgagaacctttacatcctatgttccccgaccagcccgagaaaccgttaaacttagctcacatcgtgtgcttcagacctcctagacctgtcacttctatgaatgacacactgttcagtcatagtgttccatcctctggttctccctttataacaaggagctcaccccctaaagactctgaggtggagcagaacaaacttctcgccagggcagcaccagccttcctgaagggtaagggtattcagtacagcctgaatgtggccgaccgtttagctgacgaacacgtgcttataggcctgtacgtcaacatgctgcgaaataatccctcttgtatgctggaaagtagtaataggttggacgaagaacacaggctaattgccaggtatgccgccagactggcggccgaaagttcctcttcccagcctccccagcagaggagtgcaccggatataagtttcaccattgacgccaacaagcagcagaggcaactcatcgcagagctggagaataaaaacagggaaatccttcaggagattcagaggctgcggctggaacatgagcaggcctcacagcccacccctgagaaagcacaacaaaatccaaccctgctggcggagttaagactgctgaggcagagaaaagacgaactcgaacagaggatgtcagccctgcaggagagcaggagggaactgatggtgcagctcgagggactaatgaagttgctgaaaactcagggggccggtagcccacgatcgagtccatcacacaccatctcccggccaatccccatgcctatcagaagcgcctccgcttgcagtacccccacgcacacgccgcaggattccctgacgggagtcggaggcgatgtgcaagaggcgttcgctcagagctcaagacgaaatctgcgtaacgacttgctcgttgctgccgactctatcaccaataccatgagttcgcttgtgaaggagctaaactcagaagtgggctcagaaactgagagcaacgtagacagcgagtttgctaggacacagttcgaagaccttgtgccgagcccaacctctgagaaggcttttctcgcacaaatccatgcccgcaagcctgggtacatccattctggagccactaccagcactatgcgcggtgacatggtcacagaggacgcggatccctatgtgcagcctgaggacgagaactatgaaaacgacagcgtgcgccagttggagaacgaactgcagatggaggagtatctgaaacaaaagctgcaggacgaggcctaccaggtttcacttcagggttag

SEQ ID NO: 115344 - DNA, 2232 bp, Artificial Sequence
  Description of Artificial Sequence: Synthetic coding sequence
atgattgaggattctgggaagcgggggaacaccatggcggagcggagacaattgttcgccgagatgcgtgcccaggacttggacaggattagattgagtacatatcgtaccgcctgcaaacttagattcgtccagaagaaatgcaacctacatcttgtcgatatctggaatgttatcgaggcactgcgcgagaacgcccttaacaatcttgacccgaacactgagttaaatgtgagtagattggaagcagtcctgtcaactattttctaccagctgaacaaacgcatgccaaccactcatcagatccacgtcgaacaatccatttccttgcttctaaacttcctgctggctgcgttcgaccccgaggggcacgggaagattagtgtctttgccgttaagatggccctggccaccctgtgtggggggaagattatggacaaattgagatatatttttagtatgatctccgactcttcaggagtgatggtgtacggccggtacgaccaatttctgagggaggttctgaagctgccaacagccgtgttcgagggcccaagcttcggatacaccgaacagtctgcaagatcttgtttcagccagcagaaaaaggttactctcaacggctttttggacacccttatgtccgaccctcccccacagtgccttgtctggctccccttattacaccggctcgcaaatgtggaaaatgtctttcacccagtggagtgttcatattgccacagtgagtcaatgatgggctttaggtatcgatgtcagcagtgtcataattatcagctttgccaggactgcttctggaggggacacgctggaggcagtcacagcaatcaacatcagatgaaagagtacacctcctggaagagcccagctaagaaactgaccaacgcactgtcaaagtcccttagctgcgcctcaagtcgcgagcctctccacccaatgttccccgaccaacctgagaagcctctcaaccttgcccatattgttgatacatggccccctaggcctgtgacatctatgaacgacacattgttctcgcactctgtcccgtctagcggcagtccctttatcactcggtcctctcctccaaaagatagcgaagtagaacaaaacaagctgttggctagggcagctccggcctttctgaagggtaagggcattcaatacagtttgaacgtcgcagatagacttgcagacgagcacgtcctcattggactctacgtaaatatgctcagaaataatcccagctgcatgctggaatccagcaaccgactcgacgaggagcaccgactaattgctaggtacgcggccagacttgctgccgaatctagtagctctcagcccccacaacagaggagcgccccagatatttcgtttacaatcgacgctaataaacagcagcggcaattaatagctgagctagagaacaagaatcgcgaaatcctgcaggaaattcagcgcctgcgcctggaacacgaacaggccagccagcccaccccagaaaaggcccagcaaaatccaacactcctcgccgaactaaggctgctgaggcagcgcaaggacgagctcgagcagaggatgagtgccctccaggagagccgccgggagctgatggtgcaactggaaggtcttatgaagctgcttaagacacagggtgcgggctcgccccggagcagcccgtcgcatacaatatctagacccatcccaatgcctattcgcagtgccagtgcatgctcgactccaacacacacaccccaggacagcttgactggggtcggcggtgatgtgcaggaagcatttgctcagagctcgcgcaggaatctgcgcaacgacctgctcgtcgcagctgactcaattacaaacactatgtcatcgctggtgaaggagcttaactctgaggttggatctgagactgaatctaacgtcgatagcgaatttgcccggacacagttcgaggacctagtaccttcccccacttccgaaaaggcatttttagcccaaattcatgcgcgaaagcctgggtacatacattcaggggctacgacttctacgatgaggggcgatatggtgaccgaggatgctgatccttatgtgcaaccagaggacgaaaactatgaaaacgattccgtgaggcaactggagaacgagctgcaaatggaggaatatttgaagcagaaactgcaggacgaagcatatcaggttagcctgcaggggtag

SEQ ID NO: 115345 - DNA, 1176 bp, Artificial Sequence
  Description of Artificial Sequence: Synthetic coding sequence
atgttcccagaccagcctgaaaagcctcttaacttggcacacatcgttccaccacgtccagtgacctctatgaacgacacattatttagccacagcgtcccttccagcggctcacctttcatcacgagaagctcgccacctaaagatagcgaggtggaacagaacaaactcttagctcgggccgccccggccttcttgaaaggcaagggaatgcttgaatccagtaacagactggacgaggaacacaggctgattgcccgatacgctgctaggttggctgccgagagttcatccagtcagccaccacagcagcgctccgcccccgatatctcattcacgattgatgccaacaaacagcagaggcagctcattgctgagctggagaacaagaatagggagatactccaagaaatccagaggctgcgactcgagcacgagcaggcctcccagccaacccctgagaaagctcaacagaatcctacactgctcgctgagctccgtctgcttcgacagcgcaaagacgaactcgagcagaggatgtccgcgctccaggagtctaggcgggagctgatggtacagctggaggggcttatgaagcttctaaaaacacagggggctggcagccccaggagctctccgtcccataccatttccagaccaattccgatgccaatccgctccgcttcggcatgttctacccccacccataccccacaggactccctgactggagtgggcggcgatgttcaggaggctttcgcccagagctcacgacgaaacttgaggaatgatttgctggtggctgcagactccattacaaacactatgtcgagtctggtgaaggaactgaacagcgaagtagggagcgagaccgagagtaatgttgattcagagttcgccagaacccaatttgaggatctagtgcctagtccaaccagtgagaaggccttccttgctcagatccatgccagaaagcctggctatatccactctggtgccacaacctctacaatgcggggtgatatggtgaccgaggatgcggacccatacgtgcagcctgaagacgagaactatgaaaatgatagtgttcgccagcttgagaacgagctgcaaatggaggagtatctcaagcagaagctccaggatgaagcatatcaggtctctttgcaggggtag

SEQ ID NO: 115346 - DNA, 1116 bp, Artificial Sequence
  Description of Artificial Sequence: Synthetic coding sequence
atgatcgaagacagtggcaagcgaggcaacactatggcagaacgccgtcagctgttcgctgagatgcgagctcaagatcttgatagaatccggctcagtacttatcgtactgcttgtaaactgcgcttcgtgcagaagaaatgcaacttacacctggtggacatctggaatgtgattgaagctctgcgggaaaacgcattgaacaacctcgacccgaacaccgagctcaatgtatcgaggctggaggctgtgctgtctacaatcttttaccagctcaataagcgtatgccaacgacacaccagatccacgtggaacagagtattagtctgctccttaacttcctcctggcagcttttgaccctgagggccatgggaagatatccgtattcgccgttaagatggcgctggccacactctgtgggggaaaaatcatggataagttaagatatatcttctcgatgatttcagactcctcaggagtgatggtttacggtcggtacgatcagtttctccgtgaggtgttaaaactgccgactgctgtattcgaaggccccagctttggttatactgaacagagcgctagatcttgcttttcccagcaaaagaaggtcacccttaacggcttcctggatacattaatgtccgatcctcctcctcagtgtctggtgtggctgccgctcctgcatcgtctagctaatgtggaaaatgttttccatccggtcgaatgcagctattgtcattcagagagcatgatgggattcaggtaccggtgccaacagtgccataattaccagctatgccaggattgcttctggcgtggccacgcagggggctcacactccaaccaacatcagatgaaggagtacaccagttggaaatctccagcaaagaaactcacaaatgccctgtctaaaagcctctcatgcgcatcttcaagggagcctctgcatcccatgttcccggatcaaccagagaaaccgttaaatctggcccacattgtgccaccgcggccagttacttctatgaacgacactctcttctcccattccgtccccagctcaggctctccattcataacaagaagttctgatggagccttcggagggtgcgtttag

SEQ ID NO: 115347 - DNA, 1794 bp, Artificial Sequence
  Description of Artificial Sequence: Synthetic coding sequence
atgattgaggagtcagggaataagcgcaaaaccatggccgagaagaggcagctgtttattgagatgcgagctcagaattttgacgtgattcggctaagcacatatagaacagcttgcaaactgcgcttcgtccagaagcgctgcaatctgcacctggtggatatctggaacatgattgaagcgttcagggataacggactgaacacactcgaccataccacggagatcagcgtgtcacgattggagaccgtgatctcttccatatattaccagcttaataagaggctcccctccacacatcaaatttccgttgaacaatcaatttcccttctcttgaacttcatgatagcggcatacgattctgaagggagagggaaattgacagtgttctctgttaaggctatgctggctaccatgtgcgggggaaagatgttggacaagctacggtacgtgttctctcaaatgtctgactcaaatgggctgatgatctttagcaaatttgaccagtttctgaaggaggtgctgaagttgccaaccgcagtctttgaaggaccctcgtttggctacacggagcattccgtcagaacctgctttcctcaacaaagaaagatcatgctgaatatgtttctcgatactatgatggctgaccctccgccccagtgtttggtgtggttaccactgatgcatcggctggcacacgttgagaacgttttccatccagtcgagtgcagctactgccgctgcgaatccatgatgggtttccgctaccggtgtcagcagtgtcataactatcagctgtgccagaattgtttctggaggggacatgccggtggaccgcactctaatcagcatcagatgaaggaacactcgtcttggaagagccccgctaaaaagctctctcacgcgatctccaagtcacttggatgcgtcccaacacgagagcctccccatcccgtgttccccgaacagcctgaaaagcctttggacttggcccatattgtgccaccccgtcctctgaccaatatgaacgatacaatggtgtcccatatgtcaagcggtgtgcctacccccaccaagcgccttcaatactctcaggacatcccaagtcatttggctgacgagcacgcactgatcgcctcttacgtggcacggctgcagcactgcgccagggtcctggatagcccgagccgtctagacgaagagcacagactgatcgcaaggtacgcggccaggctagcggcagaggccggtaatgtgaccagacccccaactgatctgagttttaacttcgacgccaataagcagcagaggcaactcatcgcagagctagaaaataaaaaccgggagattctgcaagagatccaacgacttcgcttggaacacgagcaagccagccagcccactccagagaaagcccagcagaaccccaccctgctggccgaattaagactcttacggcagcgcaaggatgagttggagcagcggatgtccgctcttcaggagtctcgtcgtgagcttatggtccaactggaggaacttatgaagctgctgaaagaggcagaggcaagagagtcagctcaggctaccggctctccacatacctcacctacccacgggggaggacggcccatgcccatgcccgtgaggtctacctcggccggtagcacgcctacccactgcccacaggacagtctttccggggtgggcggggatgtccaagaggcatttgcacaagctgaggaaggtgcggaagaggaggaggagaagatgcagaacggcaaggacagaggttag

SEQ ID NO: 115348 - DNA, 567 bp, Artificial Sequence
  Description of Artificial Sequence: Synthetic coding sequence
atgatagaggagtctgggaataaaagaaaaacaatggccgagaaacgccaactcttcattgaaatgcgggcacaaaacttcgacgtgatcaggctgtctacctacaggacggcatgcaagctgaggttcgttcagaaaaggtgtaacctgcatttggtcgacatctggaacatgatcgaggcattcagggataatgggttaaacactctcgaccacacaaccgagatttccgttagccgactggagaccgtcatttcctcgatctattaccagctgaacaaacgccttccctctacccatcagatttccgtggagcagtcgatctcactgttgctgaacttcatgattgccgcctacgacagcgaggggcggggcaagctgacggttttcagtgtgaaagctatgctagctaccatgtgcggagggaagatgttagacaaactacgttacgtcttttctcagatgtctgattccaatgggcttatgatattctcaaaattcgatcagttcctgaaggaagtcctaaagttacccaccgccgtgttcgaagggccttccttcgggtag

SEQ ID NO: 115349 - DNA, 399 bp, Artificial Sequence
  Description of Artificial Sequence: Synthetic coding sequence
atgattgaagaaagcgggaacaagcggaagacgatggcagaaaaacggcagctgttcatagagatgagggcacagaactttgatgtaattcgcctgtcgacttaccgaacagcatgcaaacttcggttcgttcagaagcgctgtaacttgcatctggtcgatatatggaatatgattgaagcctttcgtgacaacgggctgaacaccctcgaccataccactgagatctctgtttctagactagagactgtgatctcctccatttactaccagctgaataagcgtctcccaagtactcaccagatctctgttgagcagagtattagcctacttttgaattttatgattgctgcgtacgattctgaaggtagggggaaattgacagtcttctccgtatag

SEQ ID NO: 115350 - DNA, 450 bp, Artificial Sequence
  Description of Artificial Sequence: Synthetic coding sequence
atgatagaagagtccggcaacaagaggaagacaatggccgagaagagacagctgttcatagaaatgcgtgcccagaactttgacgtgatccgattgagtacctatcgaaccgcctgcaagcttcgcttcgtccagaagagatgcaacctccacctggtggacatctggaatatgattgaagcatttagggataacggtctgaacacgctagaccacactacagagatttcggtgtctaggctcgagacagtaatttcttccatctactatcagctgaataaaagactgccaagcacacatcagatatcagttgaacagtcaattagtttgcttctaaacttcatgattgccgcctacgactccgaggggcgagggaagctcacagttttttccgttaaagcaatgctagctactatgtgtggaggcaaaatgctagataaactgcgctag

SEQ ID NO: 115351 - DNA, 1794 bp, Artificial Sequence
  Description of Artificial Sequence: Synthetic coding sequence
atgatcgaagagtccgggaataaacgaaaaaccatggcagaaaaaagacagctttttattgagatgcgagcccagaattttgatgtgatcagactgtcgacctaccgtaccgcttgcaaactgcgcttcgttcagaagaggtgcaacttgcatcttgtggatatctggaacatgattgaggcctttcgggataacgggttgaacaccctggaccacaccacagagataagcgttagccgattggaaaccgttatctcctctatctactaccaactgaataaacgtctcccttccacccaccagatttcagttgaacagagtatttccctactgctaaactttatgattgcagcctatgattctgagggaagggggaaactcacagtcttcagcgtgaaagcgatgttggctactatgtgcggcggcaagatgctggataagcttcggtacgtcttttctcagatgtccgactcaaatggacttatgatattcagcaagttcgaccagttcttgaaagaggttctgaagctaccaaccgccgtattcgaggggccaagctttggctatactgagcattcagtacgcacttgttttcctcagcaaagaaaaatcatgctgaacatgttcctggacaccatgatggccgacccacctccccaatgcctggtgtggctgcccctgatgcaccgcctggcccatgtggaaaacgtgtttcaccccgtggagtgcagctactgcagatgcgagtccatgatgggcttccggtatcgctgtcaacagtgtcataattaccagctgtgccagaattgcttctggcgcggccatgcaggcggaccacatagcaatcaacatcagatgaaagagcacagttcatggaagtccccagccaaaaaactcagccacgcaatctccaagtccttagggtgcgtaccaacaagagaacctccccatcctgtgttcccagagcaaccagaaaaacctctggatctggcgcacatcgtccctccacgcccccttacgaacatgaacgatactatggtgtcacatatgtcgtcaggggtcccgacccctacaaagaggctgcaatattcacaggatatcccatcccacctggctgatgagcatgctctgattgcgtcctatgtggcccgcttgcagcattgtgcaagagtgctagatagccctagtagattggacgaggagcaccgcctgattgcgaggtatgctgcacgcttggctgcagaggctggaaacgtgacacggcctcctacagacctatcctttaatttcgacgctaacaaacaacaacgccaattgatcgcggagctggagaataaaaaccgagagatactccaggaaatccaacggctgagactggaacacgaacaggcgagtcagcctaccccagagaaagcccagcagaaccctacacttctggccgagctgcgtctcctgcgtcagaggaaagacgagctggagcaacgcatgagcgcactgcaggagtcacggcgcgaactgatggtacaactcgaggaactcatgaaattacttaaggaagaagagcagaagcaggctgcacaggccacagggagtcctcatacgagtccgacacacgggggggggcggccaatgccaatgcctgtgcgcagcacttccgccggaagcacaccaactcactgcccacaagactcattgtccggggttggcggagatgtgcaggaagccttcgcccaggcggaggaaggtgccgaggaggaggaggagaagatgcagaatggcaaggatcgcggctag

SEQ ID NO: 115352 - DNA, 1683 bp, Artificial Sequence
  Description of Artificial Sequence: Synthetic coding sequence
atgattgaggagtcaggcaacaaacgcaagacaatggcggagaagcgacagcttttcattgaaatgagagcccagaatttcgacgtaattcggttatccacttataggactgcctgcaaactacggtttgtacaaaagcggtgcaatctccatctagtggatatttggaacatgatcgaggccttccgtgacaatggattgaatacactcgatcacactacagagataagtgtctcacgcctggaaacagtgatttcctccatctattaccaacttaacaagagacttccctctactcatcagatctctgtggagcaatctatctccctattgctgaatttcatgatcgccgcctatgattctgagggaagagggaagctgacggtgtttagtgttaaggccatgttggcaaccatgtgcgggggtaaaatgttggacaagctcagatatgtgttttctcaaatgagcgatagtaatggactgatgatcttcagtaaattcgatcagtttctgaaagaggtgctgaagctgcccaccgccgtgttcgaaggcccctcatttggttatactgaacatagcgttcggacctgttttccccagcagcgaaaaataatgttgaatatgtttctggataccatgatggcggacccaccccctcaatgcctagtttggttaccactcatgcacagactggcgcacgtcgagaacgtttttcaccccgttgagtgcagttattgccgctgcgaatcaatgatgggtttccgctatcgctgtcagcaatgtcataattatcagttatgtcaaaattgcttttggcggggccatgccggagggcctcacagtaaccagcatcagatgaaagagcacagcagctggaagagtccagcaaagaaactgagccatgcgatctccaagtctctgggctgcgtgccaacccgggagcccccacatcccgtctttccagagcaacccgagaaaccactggacctggcacacatcgtgcccccgaggcctctcaccaatatgaatgacaccatggtttcccatatgtctagtggggtccctacccccacgaaaagtgtgcttgactcaccatcccggttggacgaagagcatcgcctgattgcgaggtatgctgccaggttggccgccgaggctggcaatgttacgcgcccgcccacagacctgagctttaatttcgacgctaacaaacagcagcgtcagttaattgcggaacttgagaacaagaatcgtgagatcttgcaggagattcagagacttcggctcgagcacgagcaggccagccagccgacaccagagaaagctcagcagaatcctacactcttggcagagctccgactgctccgtcagcgcaaagatgagctagaacaaagaatgagtgctctccaggaatcacgtcgagaactgatggtgcagctggaggaactcatgaagctgctgaaggcccaagccacaggatcccctcatacgagcccgactcatggggggggccgccccatgcctatgcctgtgaggagcacatctgctgggtccacacctacccattgccctcaggattctctatccggcgtggggggagatgttcaggaggcatttgctcaggctgaagaaggtgccgaagaagaggaggaaaagatgcaaaacggaaaagaccgggggtag

SEQ ID NO: 115353 - DNA, 1884 bp, Artificial Sequence
  Description of Artificial Sequence: Synthetic coding sequence
atgatagaagagtccggaaacaagcgtaaaaccatggcggaaaagcgtcagctctttatcgagatgagggcccagaactttgacgttatacgcctgagcacttaccggactgcttgtaaattgagatttgtccagaagcgctgtaacctgcacctcgtcgacatctggaacatgattgaggcattccgtgacaatggccttaacactctggatcataccacagagatttccgtcagcaggctggaaacggtcattagttccatttattatcagctgaataagcgcctcccttctacccaccaaatctccgtggagcagtccatcagccttctcctgaactttatgattgccgcctatgactccgagggccgtgggaaattaactgtgttctctgttaaggccatgctggccactatgtgcggcggtaaaatgttagacaagctcagatatgttttctcacagatgagtgactccaatggactgatgattttctcaaagttcgaccagtttctgaaagaggttttgaagctccctacagctgtgtttgaaggtccctccttcgggtatacggagcattctgtaagaacatgtttcccgcagcagaggaagatcatgctgaatatgtttctggacacgatgatggccgaccccccgccacagtgcctcgtctggttgccgctgatgcacaggctggcacatgtagagaacgttttccaccccgttgagtgctcttactgccggtgtgagagtatgatggggttcaggtatagatgccaacaatgtcacaattaccagctgtgtcaaaactgtttctggcgaggacacgccgggggaccacacagcaatcagcaccagatgaaggagcatagttcttggaaatcccctgcaaaaaagctgtcccatgcaatctctaagagtctcggctgtgtgccaactcgggaaccccctcaccctgtgtttccagagcagcccgagaaaccactggacttagcccatattgtaccacctcgaccattaactaatatgaatgacactatggtcagccacatgtccagtggagtccctacacccactaaaaggctgcaatacagccaagatatcccttcgcatctcgcggacgaacatgcgctgatagcctcttacgtggcccgcctgcaacattgtgcacgcgtgctggacagcccctcccgcctggatgaggagcaccgccttatcgccagatatgcggcgaggctcgcggccgaagccggtaatgtgacgcgaccgcctaccgatctctcgtttaacttcgacgcgaataagcagcagcgacagctcattgccgagctcgagaataaaaatcgcgagatcctgcaagaaattcaaaggctgcgccttgaacacgaacaggctagccagcctacacccgagaaggcccagcaaaatcctaccctcctggccgagttgagactgctgaggcagcggaaagacgagctggagcaacggatgtccgcactccaggagagtcgcagggagcttatggtgcagctggaggagttaatgaagttgttaaaagaggaggaacaaaaacaggctgcacaggccactggtagccctcacacctcgcctacacacggaggtggccggccaatgcctatgccggtcaggtctacaagtgcggggagcaccccaacacactgccctcaggactctttgtccggggttggcggagatgtccaggaggccttcgctcaagggacacgccggaatcttagaaacgacttattagtcgctgcggactctattacaaatacgatgagcagtttggttaaagaactccacagcgccgaagaaggcgccgaggaggaggaagagaagatgcagaacggcaaagaccgcgggtag

SEQ ID NO: 115354 - DNA, 1704 bp, Artificial Sequence
  Description of Artificial Sequence: Synthetic coding sequence
atgattgaggagtctggaaataagcgcaagaccatggcagagaagagacaacttttcatcgagatgagggcccagaatttcgatgtcatcagactgagcacataccgcacggcctgcaaattacgctttgtgcagaagcggtgcaatctacacctggtagacatctggaacatgatcgaggcgtttagggacaatggcctaaatacccttgatcacacgaccgaaatttccgtctctaggctggagaccgtcatcagctctatctactatcagctgaacaaacgcctcccatcaacccatcagataagcgtagaacaatctattagcctcctgctcaacttcatgattgctgcctacgattcggagggcagaggtaagctcacagttttcagtgttaaggcaatgcttgccacaatgtgcgggggaaaaatgctcgataagcttaggtatgtgttttctcaaatgagcgatagtaatggtctcatgattttcagtaaattcgaccagtttctgaaggaggtacttaagctgcccacagccgtctttgagggcccgtcattcgggtacaccgaacatagtgtgcgcacctgcttcccacagcaacggaagattatgctgaatatgttcctggacaccatgatggcagatcctccaccccagtgccttgtctggctgccacttatgcatcgcttggcccatgtagaaaatgttttccacccggtggaatgctcctattgcaggtgtgaatcgatgatgggcttccgttatagatgtcagcagtgccataactatcagttgtgtcaaaattgcttttggagggggcacgctggtggaccacactcaaaccaacaccagatgaaagagcactcaagctggaagagtcctgccaaaaaattgagccacgcaattagcaaatcactggggtgcgtgcctactcgggagcctccccatcccgtttttccagaacaaccagagaaaccgctggacttagcacacatagtgcccccaaggcctttaactaatatgaatgacacgatggtatctcacatgtcgagcggagtgccgactcccacgaaaagcgtgctggattccccttcccgtctcgacgaggaacaccggctcatcgcacgttacgctgcccgactggcggctgaggcggggaacgttactagaccgcctaccgatctgtcctttaattttgatgccaataagcaacagaggcaacttattgcagagttagagaacaaaaatcgcgagattctccaggaaatccagaggttgaggctagaacatgagcaggcctcacagcccacaccggagaaggctcaacagaatcctacgcttttggcagaacttagattattacgccaaagaaaagacgaactagagcagagaatgagtgcattacaggagtcccgccgtgagcttatggttcagctcgaggagctgatgaagctacttaaagaagaggagcagaaacaggcggcccaggctactgggtcgccccatacaagccccacccatggcggaggacgcccgatgccaatgcccgtaagaagtacttccgctgggtccactcctacccattgcccccaggattctctcagtggcgtcgggggcgacgtacaggaagcctttgcacaggcggaggaaggggcggaagaagaggaggaaaagatgcagaatgggaaggataggggttag

SEQ ID NO: 115355 - DNA, 1773 bp, Artificial Sequence
  Description of Artificial Sequence: Synthetic coding sequence
atgattgaagagtctgggaacaaacgaaaaacaatggctgagaaaagacagttatttattgagatgcgggcccagaacttcgacgtgatccgcctgagcacttaccgcaccgcctgcaagctgagattcgtgcaaaaacggtgcaatctacatctggtggatatctggaatatgattgaagctttccgggacaacggtctaaatacccttgatcacacaaccgagatcagcgtgagccgactcgagacagtaatctcttccatctattaccaactgaataagcgtttgccatcaactcaccagatttcagtggaacagtctatctctctgctcctgaatttcatgatcgccgcttatgattccgaaggaagagggaaattgactgtgttcagtgttaaagctatgctggcaaccatgtgtggaggcaagatgctggacaagttgaggtacgtgttttcccagatgtcagattccaacggcctgatgatcttttcaaagtttgatcagttcctcaaggaggtgctgaagttgccaactgctgttttcgaaggtccgtcctttggatacactgagcacagcgtacgcacttgtttcccacagcagcggaaaataatgctgaatatgtttttggataccatgatggcagacccccctccccaatgcctcgtatggctgccgcttatgcaccgtttggcccatgtggagaatgtcttccaccccgttgagtgtagctactgtcgatgtgagagcatgatgggattccgctaccgttgtcagcagtgccacaattaccagttatgccagaactgtttctggagggggcacgcaggcgggcctcactcgaaccagcaccagatgaaggaacatagctcatggaagtctcctgcaaaaaagctgagtcacgcgatatccaaaagcctcgggtgcgtgcctaccagagaaccccctcaccccgtgttcccagagcagccagagaagcctcttgacctggcacacattgtgcccccgcgaccgctaacaaacatgaacgacacaatggtctcacatatgagttccggagtcccaacaccaacaaagagcgtcctcgactccccatcacgcctcgacgaagaacatcggctgattgctcgatacgcagcaagactcgccgctgaagctggcaatgttacacgccccccgactgacttgtccttcaactttgatgctaataaacagcagagacagttgatcgctgagcttgagaacaagaatcgcgagatcctgcaggaaattcaacgtttgcggctggagcacgaacaggccagtcagcctactcctgaaaaggcacagcagaacccaaccttactcgcagaactacgcctgttacggcagaggaaagatgaattagaacagcggatgtccgcactgcaggagtccaggcgggaactgatggtgcagctcgaagagctgatgaagctgctgaaagcccaggctaccggatctcctcatacaagccctactcacgggggaggacgccctatgccgatgccagtaagaagcacttctgctggtagtacacccacccactgtccccaggactctctgtcaggagttggaggtgatgttcaggaggcctttgcgcaaggcacccgccgcaacctcagaaatgatctgcttgtagctgcagacagtattactaatactatgtcctccctggtaaaggagctgcactcagcagaagagggggctgaggaggaggaagagaaaatgcaaaacggcaaggataggggttag

SEQ ID NO: 115356 - DNA, 1830 bp, Artificial Sequence
  Description of Artificial Sequence: Synthetic coding sequence
atgatagaggagagtggcaataagcgtaaaaccatggcagaaaagcggcaactgttcattgaaatgagagcgcagaacttcgatgttattaggctgtcgacttatcgcactgcgtgtaagctccgtttcgttcaaaagaggtgcaacttgcatctggtggacatctggaatatgatcgaagcattcagagacaatggattgaacaccctcgaccacacgacagagatctccgtgagcagactcgaaacagtgattagctcaatttattaccagctgaacaaacggctgcctagcactcatcaaataagtgtcgaacagtcaatcagcttgctgttgaattttatgatcgctgcttacgatagcgaaggacgcggtaaactgacagtgttttcagttaaggccatgttggccacaatgtgtggtggaaaaatgttggacaagctaagatatgtgttctctcagatgtctgactccaacggactcatgattttctccaaattcgaccagttccttaaagaagtactaaagcttccgactgcagtctttgaaggaccctcatttgggtacacagagcatagcgttcgcacttgctttcctcagcagaggaaaattatgctgaatatgttcctggatacgatgatggcagatcccccaccacagtgtttggtctggttacccctcatgcatcgccttgcacacgttgagaatgtgttccaccccgttgaatgcagttactgccgttgtgagagtatgatggggttcaggtaccggtgccagcagtgtcacaattatcaactctgtcaaaactgcttctggcgggggcacgctggaggcccgcactccaaccagcaccaaatgaaggagcattcttcttggaaaagcccagccaagaaactaagccatgccatcagtaaatcactcggttgtgtgccgactcgagagccacctcaccctgtgttccctgagcagcctgaaaaacccttggacctggctcatatcgtgcctcctagacctctgactaacatgaatgatacgatggtgtcccatatgagcagcggagtgcccacccctaccaaacgtctccaatactctcaggatatccccagccacctcgctgatgaacacgccttgatcgcaagctacgtcgcgcgattgcagcactgcgcacgtgtgctcgatagtccctcgcggctagacgaggaacaccgattgattgcacggtacgccgcgaggttggcagcagaggctggaaatgtcacgagacctcccacggacctgtctttcaactttgacgcgaacaagcagcagcggcagttgatcgctgagctggaaaataaaaacagagagatactgcaggaaatccagaggctacgtctagagcatgagcaggctagccagcctactcctgagaaagctcaacagaaccctaccctccttgcagaattgcgcctgctcagacaacggaaggacgaactcgagcagcgcatgagtgccctacaagaaagtcgtagggagctgatggtgcagctggaagaactaatgaagttgttgaaagaggaagagcaaaagcaggctgcacaggccaccggatctcctcatactagccccacccacggcggtggacggccaatgccaatgccagtccggtccacctcagccggttccacaccaacccactgtccacaggactccctcagcggcgttggcggcgacgtccaggaagccttcgctcaggggacccggcgcaacctgaggaacgacttgcttgtggcggccgactctataacaaatacaatgagctcgcttgtcaaggaattgcattccgggtag

SEQ ID NO: 115357 - DNA, 1638 bp, Artificial Sequence
  Description of Artificial Sequence: Synthetic coding sequence
atgatcgaggccttccgggacaacggacttaatactctagaccacacaaccgagatttctgtgagtagactggaaaccgtgatctcatccatctactaccagctaaacaagagactgcccagtactcatcagatttccgtggaacagtctataagtctgttgctcaattttatgatcgccgcttatgactccgagggcagggggaagttgacagtcttttctgtcaaagccatgttggccactatgtgtgggggcaagatgctggacaagctacgatatgtgttttctcagatgagcgatagtaacggcctaatgattttttcaaagtttgaccagttcctcaaggaagtcctgaaacttcccacagccgtgttcgagggccctagcttcggctacaccgaacattcagtacggacttgcttcccacaacaaagaaagatcatgttgaatatgttcttggacactatgatggctgacccaccccctcaatgcctggtctggctcccactgatgcacagactggctcacgtagaaaacgtcttccaccccgtggagtgcagctattgcagatgcgagtcaatgatgggcttccgatatagatgccagcagtgccataactatcagctgtgtcagaactgtttctggcggggccacgccggcggacctcactccaatcagcatcagatgaaggagcattcttcctggaaaagccccgccaagaaattgagccacgcaatcagcaaaagcctgggctgcgtgccaacgagagagcctccacatcctgtatttccagagcagccagaaaagcctctggacctggcccacattgtgccaccgcgccccctgacaaatatgaatgacacaatggtgagccatatgagcagtggagtgcctactccaaccaaacgcttgcagtactcgcaggacatcccctcccacctcgcggacgagcatgccctcatagcatcctacgtagccagattgcagcattgtgcccgcgtgctggactctccatcccgcctggacgaagagcataggctgattgcacgatatgcagcccggcttgccgccgaagctgggaacgttaccagaccgccaacagatttgagctttaactttgatgcaaacaaacagcaacgtcagttaatcgccgagctggagaacaaaaaccgtgaaatacttcaggaaatacagaggctcaggctggaacacgaacaggctagccagcccaccccagaaaaagctcagcagaatcctaccctgcttgcagaactgcggttattacggcagcggaaggatgaactcgaacaacggatgtcagccctgcaggagagtcggagggaactgatggttcaactcgaagaactcatgaagctcttaaaagcccaggctactgggtctccccacacatcacccactcatgggggcgggcggcctatgcccatgcctgtgcggtcgacaagcgccggatcgaccccaacccactgcccacaggactccctcagcggagtgggtggggatgtccaagaggccttcgcacagggcacacgaagaaacttacgaaatgacctgctggttgcagccgattccattaccaatacaatgtcttctttggtcaaggagctgcatagtggatag

SEQ ID NO: 115358 - DNA, 960 bp, Artificial Sequence
  Description of Artificial Sequence: Synthetic coding sequence
atgacagacgtcttcagtcagatgtccgattctaatggtctgatgatcttctcaaagtttgatcagtttcttaaagaggttcttaaactccccacagctgtctttgaagggccctccttcgggtacaccgagcacagtgtgcgaacatgctttccacaacagaggaagatcatgcttaacatgtttctcgacaccatgatggcagacccaccgcctcagtgtttggtgtggcttcccttaatgcatcggcttgcgcacgtcgaaaatgtctttcatcccgttgaatgttcttactgtcgctgtgaaagtatgatgggattccgataccgttgtcaacagtgccataattaccagctctgccaaaactgtttttggcgcggtcacgccggagggccacactccaaccaacatcaaatgaaagagcactctagctggaagagtcctgcaaagaagctttcccacgcgatcagcaaaagtttagggtgtgtccccacccgagagcctccgcaccccgtgtttccagaacagcctgaaaaacccttagatcttgctcatattgtgccccccaggcctctgacaaatatgaatgatacaatggtgtctcatatgtccagcggcgtaccaactccaaccaagcgcctgcagtactcccaggacatacctagccacctggctgatgagcatgccttgatagcaagttatgtggccaggctccaacactgcgctagggtgctggatagcccatcaagactcgacgaagaacaccggctaattgccagatatgctgcccgcctggcagcagaagccgggaatgttacacggccaccaactgatttgtcttttaacttcgacgctaacaagcagcagcgtcagctgatagccgagcttgaaaacaagaatcgggagattctccaagagatccagaggctgcggctggaacacgagcaagcctcacagtag

SEQ ID NO: 115359 - DNA, 1251 bp, Artificial Sequence
  Description of Artificial Sequence: Synthetic coding sequence
atgttaaacatgtttcttgatactatgatggcagacccaccccctcagtgcctggtctggttaccactcatgcacaggctggcccatgtcgaaaacgtatttcacccagtcgagtgctcctactgccgatgcgaatcaatgatgggttttagataccgatgccagcagtgtcacaattaccagctgtgccagaattgcttctggagggggcacgccggaggaccccattctaaccagcaccagatgaaggagcattcatcttggaaaagccccgccaagaagctgagccacgctatttcaaaatcattggggtgcgtccctacgagagagccaccccaccctgtcttccctgagcaaccagagaagcctctggatctcgctcacattgtgccacccaggcctctgactaacatgaatgatactatggtgagccatatgagttctggagttccgacccctaccaaacgtctacagtacagtcaggacataccaagccacttagctgatgagcatgcactgatagcctcctatgtggctcggctgcagcattgcgcacgggttttagacagtcctagtaggctggacgaggaacacagactcattgcacgctatgcagcacgactcgcagctgaggcagggaatgtgacgcggcctcccacagacctgagttttaactttgacgccaataaacagcagcgtcaattgatagccgagctggagaacaaaaatcgggagatcctgcaggaaatccaacggctcagactggagcacgaacaggcctcacagccaacacctgagaaagcccaacagaatccgaccctgctggcagagcttaggctgctaaggcagcggaaggacgaattggaacagagaatgagcgcccttcaggaatcaaggagagagctgatggttcagctcgaagagctgatgaagctgttgaaggcacaggccactggttcaccccatacctcccctacacatggcgggggcagacccatgccaatgcccgtccgatcgacaagcgccggtagtactcccacgcactgcccacaagactctctctccggggtcggtggagatgttcaagaagcatttgcccaaggtacccgccgtaacctccggaacgacctgctagtcgctgcggactccattaccaacactatgagctctcttgttaaggaactgcactccgccgaagaaggtgccgaggaagaggaggaaaaaatgcaaaacgggaaagaccgcggatag

SEQ ID NO: 115360 - DNA, 2688 bp, Artificial Sequence
  Description of Artificial Sequence: Synthetic coding sequence
atgcgtatgtcagtgggcctgtccttattgcttcccctgtcaggaagaacttttctgctgctgctctctgttgttatggcacagagccattggccgtccgagccctctgaggcagtacgggactgggagaatcagctggaagcttccatgcactccgtgttatcagatctgcacgaagccgttccgaccgtggttggcattcccgatgggacagctgtggtcgggcggtcgttccgcgtaactataccaactgacctcatagcctctagcggcgatatcataaaggtctccgcagctgggaaagaggcactgccaagttggttgcattgggactcacagagccacaccctcgaaggcctgcctctcgatacagacaagggtgtacactacatctccgtgtccgcgacacggctcggagccaatggatcccacatcccacagaccagctctgtttttagtatagaagtgtaccccgaggatcacagcgaattgcagagcgttaggacagcctctcccgacccaggcgaggtcgtcagtagcgcgtgtgcagcagatgagcccgtgaccgtcctcaccgttatcttggatgccgaccttacaaagatgaccccaaaacagaggattgaccttttgcatagaatgcggtccttctcagaggttgaactgcataatatgaagctggttccagtggtaaacaatcggttgtttgacatgtctgctttcatggccggacccggcaatgcaaaaaaggttgtcgagaatggcgcgttgctgtcctggaagctgggatgctcgttgaatcaaaattccgttccagatattcacggagtagaagcccctgcacgagagggggccatgtccgcacaactcggctatcccgtagttggttggcacatcgcaaacaaaaaaccccccttgccgaagagggtgcggcgtcagatccacgctaccccaacacctgtgaccgctattggaccccccactaccgccattcaggaaccgcccagtagaatcgtacccacacccacctcaccagcaatagcacctcctacggaaacaatggcaccgcccgtcagagatcccgtacctggcaagcccacagtcaccattcggacccggggggcaatcatccagacgcctaccctgggacccattcagcctacaagggtgtccgaggccggtactactgtccccgggcagatccgtccgacaatgaccattccaggctacgtggagcccacagctgtcgccactccccccaccaccacgacaaaaaagccaagagtttccactcccaagcccgcaacacccagcactgacagtacgactacaaccacgcgaaggcctacaaaaaagccacgcacaccaagaccagtgccgcgtgtcactaccaaggtgtctatcactaggcttgagacggctagcccacctactaggatcaggacgactacctctggggtgccacggggtggggagcctaatcagcgcccagaactgaagaatcatatcgatagagtcgatgcttgggttggaacatactttgaggtgaaaatcccatctgacacattctacgatcatgaggatacgacaaccgacaagctaaagctgacgctcaagttgagagaacagcagctagtgggcgagaaatcttgggtgcagttcaactctaattcacagcttatgtacggcctgcctgattcttcacatgtcggtaaacacgagtacttcatgcacgcaaccgacaaaggagggctgagcgcagtagacgcctttgagattcacgtacatcgcaggcctcaaggggatcgggcgcctgcgaggttcaaggctaagtttgtgggggaccctgcattggttctgaatgatatccacaagaaaattgctcttgttaaaaagctggccttcgcgttcggtgacaggaattgttcaacgataacactccagaatatcaccagggggagcattgtcgttgagtggacgaacaatacccttcccctggagccctgtcccaaggagcagatcgccggtctcagtcgccggatcgctgaggatgacgggaagccacggcccgccttcagcaatgccctggagcctgatttcaaggctactagcattactgtcactggctcagggtcctgcagacacttacagtttattccagtagtgcccccgcggcgagttcccagcgaggccccgccaaccgaggtgcctgatcgagacccagagaagagcagcgaagacgatgtgtatctccacacagttattcctgccgtagttgtcgccgcgattttactaattgccgggattattgctatgatctgttatcgcaagaaacggaaaggtaaactcactcttgaagaccaggccacgtttatcaaaaagggggtgcctatcatttttgccgatgagcttgatgacagcaaacctccgccgagcagttcaatgccactgatcctccaggaagaaaaggcccctctgccacctcccgaatacccaaaccaatccgtgcccgaaacaacccctctcaatcaggatacaatgggcgaatatacccccctcagggatgaagaccccaacgcacctccctaccagccaccaccaccctttacagcacctatggagggtaagggttctcggcccaagaatatgaccccctatcggtcacctcccccttacgtgcccccctag

SEQ ID NO: 115361 - DNA, 432 bp, Artificial Sequence
  Description of Artificial Sequence: Synthetic coding sequence
atgacacctaagcagagaatcgatctgctccaccgcatgcgcagcttctctgaagtggagctccataacatgaagctcgtcccagtcgtgaacaaccggttatttgatatgagcgcgtttatggcgggccctggcaatgccaaaaaagtggtggaaaacggtgctcttctgtcatggaaacttggctgctctcttaatcagaactccgttcccgatatccacggtgtcgaagcaccagcgagagagggagctatgtctgctcagctgggctaccctgtggtgggatggcacattgcaaacaaaaagccccctgctctttcaggcccgcctaagcctcagagctcctggcgcgacttcggggattttttcatcttcatcttttgcctgactgcatttggactcttcatcgagaattcttcactgcatttttag

SEQ ID NO: 115362 - DNA, 267 bp, Artificial Sequence
  Description of Artificial Sequence: Synthetic coding sequence
atgaggatgagcgttggattgagcctgctcctgccactcagtggtcggacatttcttctgcttctgtctgtggttatggctcaatcacattggccaagcgagccctctgaggcagtgcgagattgggagaaccagctggaggccagcatgcactccgtgcttagcgacctgcatgaggctgttcctaccgtggttggcattccagacggaaccgctgtcgtaggtagatcattccgcgttacaatcccaaccgatctgattgcctag

SEQ ID NO: 115363 - DNA, 48 bp, Artificial Sequence
  Description of Artificial Sequence: Synthetic coding sequence
atgcgcatgtcagttggcctaagcctccttctgcccctgagcggatag

SEQ ID NO: 115364 - DNA, 321 bp, Artificial Sequence
  Description of Artificial Sequence: Synthetic coding sequence
atgaggatgtccgtggggttgtccttgctgctccctctcagtggtcggacgttcctgctgttgttaagtgtggtgatggcccagtcgcactggccttccgagccttctgaagctgtgagggactgggagaatcagctggaggcctctatgcactccgtactctcagacctgcatgaggccgtgcccacggttgtgggtatcccagacgggactgctgttgtgggtcgctccttccgggtcacaattccgacagacctgatcgccagcagcggagacattattaaagtgagcgctgcaggcaaagaggcgctaccaagctag

SEQ ID NO: 115365 - DNA, 291 bp, Artificial Sequence
  Description of Artificial Sequence: Synthetic coding sequence
atgagaatgagcgtaggacttagtctactcctgccactgtcagggaggacctttttgctgcttctttccgttgtaatggcacaatcacactggcctagcgaaccatcggaggccgtgagggattgggaaaaccagctggaggcaagcatgcactccgtgcttagcgacctgcatgaagcagtccctactgtggtcgggattccggacggaactgcagtcgtggggagaagctttcgagtgactattcccacagacctcatcgcctcatcaggcgacataattaaggtttag

SEQ ID NO: 115366 - DNA, 30 bp, Artificial Sequence
  Description of Artificial Sequence: Synthetic coding sequence
atgcggatgtcagtggggctgtctctctag

SEQ ID NO: 115367 - DNA, 354 bp, Artificial Sequence
  Description of Artificial Sequence: Synthetic coding sequence
atgaggatgtctgtgggactgagcctgctgttacccctgtcagggaggacatttttattactcctctctgtcgttatggcccagtctcattggccaagtgaaccaagtgaagctgtacgtgattgggagaatcaactcgaggcaagcatgcactctgtgctaagcgacctgcacgaggctgtcccgacagttgtgggtatccctgatgggacagctgtggtaggaagatcctttagagtcacaatcccaacagatttgatcgcatcaagtggagatattattaaggtgtctgcggccggaaaagaggctttgcctagctggttgcattgggactcacagagccacaccctgtag

SEQ ID NO: 115368 - DNA, 159 bp, Artificial Sequence
  Description of Artificial Sequence: Synthetic coding sequence
atgcgtatgtccgtgggcctgtcacttctactccctttgagtggaaggaccttccttctcctcttatcagtcgtgatggcccagagtcactggccatcggaacctagcgaggccgttagagactgggagaaccagctggaggcctctatgcatagctag

SEQ ID NO: 115369 - DNA, 261 bp, Artificial Sequence
  Description of Artificial Sequence: Synthetic coding sequence
atgcgcatgagtgttggactatcccttttgttacctctgtctgggcgcacattcctgctgctgctgtctgtcgtgatggctcagagtcattggccatcagaacccagcgaagctgttcgagattgggagaaccagctggaagcttcaatgcatagtgtgctctctgacctgcacgaggcagtgcccaccgtagtaggcattcccgacggcactgctgttgtggggagaagcttcagagttaccatccctactgatttgtag

SEQ ID NO: 115370 - DNA, 126 bp, Artificial Sequence
  Description of Artificial Sequence: Synthetic coding sequence
atgagaatgagcgttggcctgagtctcctcctgccattgagcggaagaacctttctgctgctgcttagtgttgtcatggcgcaaagccattggccctcggagccatcagaggccgtgagggattag

SEQ ID NO: 115371 - DNA, 2688 bp, Artificial Sequence
  Description of Artificial Sequence: Synthetic coding sequence
atgaggatgtctgttggactaagtttgttactaccactgtctggtcgcacatttttactgctcctgtcagtcgtgatggctcagtctcactggccctccgaaccttctgaggccgtgagagattgggagaatcagctggaggccagtatgcacagtgtgttgtctgatctgcacgaggcagtacccactgttgtgggcatccctgatggaacagctgttgtggggcgctcctttagggtcaccattcctacagatctgatcgcatctagtggggatattatcaaggtgtccgccgctggaaaagaggccttgccatcttggcttcattgggactcacagtcccacaccctggagggactgcccttagacacagacaagggggtccactacattagcgtaagtgccactaggctgggcgccaatgggagtcacattccccagacgtcttccgtctttagtatcgaggtgtaccccgaggaccactcagaactgcagagcgtgcgcacagcatctcctgaccctggtgaggttgtttcatccgcgtgtgcggcagacgagcctgtgaccgtacttactgtgatcctcgatgctgatttaaccaaaatgactccaaagcagcggattgacctcctgcacagaatgcgaagcttttccgaggtggaactccacaatatgaagcttgtacccgttgtcaacaatagactgtttgacatgtccgcttttatggccggacccggcaatgccaaaaaagtggtcgaaaacggagcgctactgagctggaagcttggatgtagcctgaatcagaattctgtccctgatatccacggagttgaggctcctgcacgggaaggcgcgatgtccgctcagctgggataccccgtggttggctggcatattgcaaacaaaaaacccccactcccaaagagagtcagaagacagatacacgctacacccacccccgtcactgctatcggccccccaaccactgcaatccaagaaccaccctctcggatagtgcctacgcccacctccccagcaatagcgccaccgacagagacgatggcccctcctgtacgcgatcctgtacctggcaaaccaaccgtgacaattcggaccagaggcgctataatccagaccccaacgctagggcccatccaacctaccagggtgtccgaagcagggactaccgtgcctggccagatccgcccaaccatgacaatacccgggtatgtggagccgaccgccgtggcgacccctccaacaaccacaaccaagaaaccacgcgtctcgacccccaagcccgccacaccctctaccgattccacaacaacaaccactcgccgccccacgaagaagccacgaacgccacgtccagtgccgagggtgacaactaaggtgtccataacgcgactggaaaccgcttcaccaccaaccagaattcgtaccaccaccagcggtgtgccaagagggggagaacctaaccagagaccagagctgaagaaccacatagatagagtcgacgcatgggttggaacttattttgaggtaaaaattccttctgataccttttacgaccatgaagatactactacggacaagctgaaactcaccctcaaactgcgggagcagcaattggtcggcgaaaaatcatgggtgcagttcaatagtaactcccaactgatgtatggccttcccgacagtagccatgtaggcaagcacgaatattttatgcacgctactgacaaaggcgggctgtcagctgtggacgctttcgagatccatgtgcatcgcagaccccagggagaccgcgccccagcccgattcaaggcaaagtttgttggtgaccccgcgctggtgttgaacgacatccacaaaaaaattgccctggtaaagaaactggcgtttgctttcggagacagaaattgttcaaccattaccctccagaatattactaggggcagcatcgtggtcgagtggacaaacaacactcttcctctcgaaccctgccctaaagaacaaatcgccggcctcagtcgcaggatcgctgaggacgacggtaaaccaaggccggccttttctaacgcactggaaccagattttaaagcaacctctataacggtcactggaagcggttcttgccggcatcttcaattcatcccggtcgttccaccacgccgagtgccgtccgaggcccccccaaccgaagtgcctgacagagatccagagaagagttcagaagatgatgtatatcttcatacagtgattcctgcggtcgtcgttgccgccattctcctcatcgctggcataattgcaatgatctgttatcggaaaaagcgaaaagggaagctgaccctggaagatcaggccacgttcattaaaaagggcgtgcctattattttcgccgatgagctggacgacagtaagcctcctccatcctccagcatgccccttatcttgcaggaggagaaagcccctctcccccctcctgagtaccccaaccagagtgtgccagagaccactcccttgaatcaggataccatgggtgagtacactccccttcgagatgaagatcccaatgccccaccttaccaaccaccccccccctttaccgcccccatggagggcaagggctctagacctaaaaacatgaccccttatcgaagtcccccaccgtatgtgcccccttag

SEQ ID NO: 115372 - DNA, 2688 bp, Artificial Sequence
  Description of Artificial Sequence: Synthetic coding sequence
atgagaatgagcgtgggactgtcgctcctcctgcctctgtccggaaggacattcctgctgctgctgtcagtggtcatggcccagtcgcattggcccagtgagccctctgaagctgtgagggactgggaaaatcagctcgaagcatccatgcacagtgtgctgagcgatcttcacgaagcagttccgaccgtggttggcattcccgacggtacggctgttgtgggccggagcttccgagtcacaatccctaccgacttgattgcctcatctggcgatattatcaaagtgagcgctgccggcaaagaagctctgccctcttggctccactgggactcccagtctcatacactggaaggactccctctggatacggataaaggcgtccattatatctccgtctcagccaccaggctcggggcgaatgggtcgcatattcctcagacttctagcgtattcagcatagaggtgtatccagaagatcactccgaacttcagtccgtgaggaccgcatctccagatccaggcgaggtcgttagctctgcctgcgcggcggacgagcccgtaactgtacttacggttattctagatgcagacctgaccaaaatgacgccaaagcagagaatcgatctgttgcaccggatgcgctcattttccgaagttgaacttcacaacatgaagctcgtccccgtggtgaacaaccggttgtttgatatgtctgcattcatggccggccctggcaatgcgaaaaaggttgtcgagaacggggcccttctgagctggaaactggggtgctctttgaatcaaaactccgtcccggatatccacggcgtagaagctccagcccgcgaaggcgctatgtcagcgcaactggggtatccagtggtgggttggcacatagctaataaaaagccccctctccccaagagggtcaggcgccaaattcacgccacccctacaccagttactgcgataggcccaccgaccaccgcaatccaagagcctccctctaggattgtccctacaccaacgtccccggcaatagcccccccaacagagacaatggcccctcccgtcagagatcctgtgccaggcaaacctacggttacaatccgtaccaggggcgctatcattcagacacccaccttgggtccaatccaacccaccagagtgtctgaagctggtacaaccgttcccggccagattaggcctaccatgaccatacccggttacgtggagccaaccgccgtggctactcctcctaccaccaccacaaagaagccgagagtgagcacacccaaaccggctaccccatctacagattctacaacaactactacccgccggcctacaaaaaagccgcgcacaccccggcccgtgccaagagtcactacaaaggtcagtattaccagactggagacagccagccctccgacacggattcgaaccactacatccggggtgcctagaggcggagaaccaaatcagcgcccagagctcaaaaaccacatcgaccgcgtggatgcctgggtgggcacttatttcgaggtgaaaattccaagcgatacattttacgatcacgaggataccaccactgacaaactgaaactcacccttaagctacgggaacagcagctggtgggtgagaagagttgggtgcaatttaactcaaattcccaactaatgtacggtctgccagatagtagccacgtgggcaagcatgagtactttatgcacgccactgacaaaggaggactgagtgcagtggatgcatttgaaatccacgttcatcggcgcccacagggggaccgggctccagcaaggttcaaagcgaagtttgtcggagatccagcattagtgctgaatgacattcataaaaaaattgccctggtgaagaagctggcattcgcatttggcgatcgtaactgtagcaccattaccttgcagaacatcacacgcggtagtatcgtagtggagtggacaaacaacaccctgccgctcgaaccgtgccccaaggaacaaatcgctggtctcagccggcggatcgcagaagatgacggaaaaccaaggcctgctttctctaacgcactggaaccagatttcaaggccacctccatcaccgtgactggctccggatcgtgcaggcatcttcaatttattcctgtggttcctcctagaagagtcccatctgaagcccccccaacggaagtgcccgaccgcgatccagagaagtctagtgaggacgacgtatacctgcacactgtcattcccgccgtggtggttgcagcaatactgctcatcgcgggcatcatcgcaatgatctgctataggaagaagaggaagggcaagctaaccctagaagaccaggccactttcatcaaaaaaggcgtgcctattatctttgctgatgagctggacgatagcaaaccacctccaagcagctcaatgccactgatactccaggaggagaaagcacccctgcctccccctgaataccctaaccagtccgtgcctgaaacaaccccactaaatcaggacactatgggagaatacactcccctcagggacgaggacccaaacgctccaccttatcagccccccccccccttcactgctcctatggaaggcaagggcagccgtcctaaaaatatgactccctacaggtcgccacctccctatgtccccccctag

SEQ ID NO: 115373 - DNA, 2688 bp, Artificial Sequence
  Description of Artificial Sequence: Synthetic coding sequence
atgcgaatgtccgttggcttgagcctgctgttgccactgtccggtaggacatttttgcttcttctctcagtggtcatggctcagtcacactggccatccgaacctagcgaggccgtcagagactgggaaaatcagctagaagcgtcaatgcacagcgttctatccgacttacacgaggccgtgcccacagtagtgggcatccctgacgggacagccgtggtgggccggagtttcagggtgacaatccctacagatttaatcgcgagctccggcgatattatcaaagtgagcgccgcgggtaaagaggctctccccagttggctccattgggacagccagagtcacacactagaaggcctacccctggatactgataaaggggtccactatattagcgtgtcagccactagattgggcgctaatggctctcacattcctcagaccagctccgtctttagcattgaggtgtaccccgaggaccatagtgagttgcagagcgtgcggactgccagccctgaccccggggaagtcgtgtcttccgcgtgcgctgctgacgaacctgtcacagttttgaccgtgattttggacgctgacctgactaaaatgacaccaaaacagcgcattgatctgctgcaccgcatgcggtccttttcggaggtggagctgcacaatatgaaattggtgcctgtcgtaaataaccgtcttttcgatatgtctgcgttcatggcgggccccggcaacgccaagaaggtcgtcgagaacggcgctttgttatcttggaaattgggctgctcgctgaatcagaactctgtgcctgatattcacggggtggaagctcctgccagggagggggcaatgagtgcccagctgggctatcctgtggtcggctggcacatcgcaaacaaaaagcctccgcttccaaagcgggttcgcagacagattcacgctacgcctacaccagtgacggcaattgggcctcccaccaccgcaatacaggaaccacccagccgcatcgtaccgacaccaacaagcccggctattgccccaccaacagaaactatggccccaccagtccgggatcccgtgccgggtaaacctacggtaacaatccggaccaggggtgctattatccagacccctactctcggcccaattcagcctacaagggtgagtgaggctgggactaccgtcccaggccagataaggcccactatgacaatacctgggtacgtcgaaccgacggctgtggctactcctcctaccacgacaactaaaaaaccgcgcgtgtctactcctaaaccggccaccccaagcaccgattctaccaccacgacaacacgacgccctacaaagaagccgagaacaccgcgccccgttcccagagtgaccactaaagtgtcgataacccggctcgagactgcatctccgccaacacgcattcgcacgaccacaagcggtgtgccccggggtggagagcccaatcagcgcccagagctaaaaaatcacattgatcgcgttgatgcgtgggtgggtacctacttcgaagtgaaaatcccaagtgatactttttacgaccacgaggacacaactaccgacaagctgaagcttacactgaagttaagggagcagcagctagtaggggaaaagagctgggtccagttcaactccaactcccagcttatgtatgggcttccagattcgtcacatgtgggcaaacacgagtattttatgcatgcgactgataaaggggggctgtcggccgtggatgctttcgaaatccacgtacacagacgcccacagggcgatcgagcaccagctaggttcaaggctaagttcgtgggggacccagctttggtgctgaatgacatccataagaagatagccctggtgaaaaagctcgcattcgctttcggtgatcgaaactgctccaccatcacacttcagaacatcacacggggctccattgtggtcgagtggaccaataacacacttccactggaaccgtgtcccaaagaacagatcgctggtctgagcagacgaattgctgaggatgacggcaagccgagaccagcattctcaaacgctctggaacccgacttcaaagctaccagcatcactgtgacgggtagcggatcctgtcgccaccttcagtttattcctgtggtgcctcctaggcgcgtgccatccgaagcacccccaacggaggtgccagatcgggatccagaaaagagttccgaggacgacgtctaccttcatacagtgatcccagctgtcgtggtggctgccatccttttgatcgctggcatcatagccatgatctgctatagaaaaaagcgcaagggtaagctgactctggaggatcaggccacctttataaagaagggtgtcccaatcatctttgccgatgaactagacgactccaagcccccgccatcctcttcaatgccacttatcttgcaggaagagaaggctccactgcccccaccggagtacccaaaccagtcggtcccggagacgacccctctcaatcaggatacgatgggagagtatacccctctccgggatgaggatccaaacgcacctccgtaccaaccccctcctcctttcacagcacctatggaaggtaagggttctagacccaaaaacatgaccccctatcgaagccctcccccatacgtgcctccctag

SEQ ID NO: 115374 - DNA, 2688 bp, Artificial Sequence
  Description of Artificial Sequence: Synthetic coding sequence
atgcgtatgagcgttggactcagcctgcttctcccactttctggccgcaccttcctgctgctattgtcagttgtgatggcacagagccattggccatccgaaccatcagaggctgtccgggactgggagaatcagctggaggctagtatgcattcggtgctatccgacttacacgaagctgtccccacggtcgtcgggatcccagatggaactgccgtggtgggacgatcattccgcgtaactatccccaccgatctgatagcatcctcaggcgatatcatcaaagtgtcagctgctgggaaggaggccctgccctcctggctccattgggatagccagagccataccctggagggactgcccttggatacagataaaggtgtgcactacatctcggtttccgctacaagactgggcgccaacggcagccacatcccgcaaactagctccgttttctcgatcgaggtgtacccagaagatcactctgagctgcagtcagtaaggactgccagccctgaccccggcgaagttgtatcctccgcctgtgccgccgacgagccggtgacagtgttgacagtcattcttgatgccgatctcactaagatgactcctaagcagcgcatcgatctgctgcatagaatgaggtcattttccgaggtggaactacataacatgaaacttgttcctgttgtgaataatcgccttttcgatatgtctgctttcatggccggtccaggcaatgcgaagaaagtagtggaaaatggagctctcttgagctggaaacttgggtgttctctcaatcaaaacagcgtaccggatatccatggggtggaagctcctgcccgggagggcgcaatgagcgctcaattgggctaccccgtggtggggtggcacatagcaaacaaaaaacccccgcttccaaaacgggtgagacggcagatccacgctactcctacccctgtcacggctattggtcccccaacaaccgccatccaggagcccccttcccggatcgtgcccacaccgacatcacctgcaattgccccccctaccgagacgatggctccccctgtacgggaccccgtccctggcaaacctaccgtgacgattcgcacgcggggagccattatccaaacccccacattgggacccattcagcccactagagtttctgaagcgggcacaaccgttccaggacagatcaggcccaccatgaccatcccaggttatgtggaaccgacagcggttgctacacctcctactacaacaactaaaaagcctcgggtatctactccaaaaccagctactccctcaacagacagcacgaccactacaactcgacgccctaccaaaaaacccaggacgcccaggcccgtacccagagttactactaaagtctctatcacaagactggaaacagcatcgccaccaacaaggatccgaacgactacaagtggggtaccccgcgggggagagcccaaccaaagacccgaactcaaaaaccacatagatcgggttgacgcttgggtcggtacctattttgaggtgaagatcccttctgatacgttctacgaccacgaggatacgaccactgataagcttaaattgactctgaaactcagagagcagcagctggtcggtgaaaaaagttgggtacagttcaacagcaacagtcaactcatgtacgggctgcccgacagttctcatgtcgggaaacatgaatacttcatgcacgccaccgataagggtgggctttctgcagttgatgcattcgaaattcacgtccacaggcgcccgcaaggagacagagcccccgctaggttcaaggctaagtttgtcggagaccccgccctcgtgcttaacgacattcataagaaaattgccttggtaaaaaagctggcttttgcatttggtgacaggaactgctcaacaatcactctgcagaacataacccgcggtagtattgtggtcgagtggactaacaacactctccccctggagccctgcccaaaagagcagatcgcaggcctgtcacggaggattgccgaggacgatggaaaaccaagacctgcatttagcaacgctctagagcccgatttcaaagctacatctataaccgttaccggtagtggttcatgtcgacatctccagttcatcccagtggtgccacctagaagagtgccaagcgaggcacctcctaccgaagtccctgatcgtgatccagaaaaaagctctgaggacgacgtgtacttgcatacagttatcccagctgtcgttgtggcagcaatcttactgatcgctggaatcatcgcgatgatctgctacaggaagaagaggaagggaaaactcactctggaagaccaagctacctttataaagaaaggggtgcctatcatcttcgctgatgaactcgacgatagtaagcctcccccttcctcctcaatgccactgattctgcaggaggaaaaggcacctctcccccctccagaatacccaaaccagtctgtgccagaaaccactccattaaaccaggacacaatgggcgagtacactccgctccgcgacgaagaccctaacgccccaccctatcagccgcctccacccttcacggcacctatggagggcaaagggtccaggcctaagaacatgacaccgtatcggtcccccccaccttatgttccaccctag

SEQ ID NO: 115375 - DNA, 2688 bp, Artificial Sequence
  Description of Artificial Sequence: Synthetic coding sequence
atgcgcatgagcgtgggacttagcttgctcctcccactcagtggtcggaccttccttctgctcctttctgtggttatggcacagagtcattggccttccgaaccctctgaggcagtgagagactgggagaatcaactggaagctagtatgcacagcgtactgtccgacttgcatgaggccgttcctacggttgtggggatccccgacgggaccgcggtggtgggtagatcctttcgagtaaccataccaaccgacttgatcgccagtagcggagacattatcaaggtgagtgccgcaggaaaagaagccctgcccagctggctgcactgggactctcagagccacacattggaagggctccctcttgataccgacaaaggcgtccattacatatccgttagcgcaacgcgcctcggggctaatggaagccacatacctcagacttccagcgtattttctatagaggtttatcctgaagaccattctgagcttcagagcgtccgcaccgcttcccccgaccccggagaggtggtaagttcagcttgtgctgccgacgaacccgttacagtgctgacggtaatcctggacgcggacctgaccaaaatgactccaaaacagcgcatcgatctcttacacaggatgaggagtttttccgaggttgagcttcacaacatgaaactggtgcccgtggtaaataatcgcttgtttgacatgtcagcttttatggccgggccaggcaacgctaagaaagtagtagaaaatggcgccctgcttagctggaaacttggctgctctctaaatcaaaactccgtgcctgatatccatggtgtggaagcgcccgccagggagggagctatgagtgcccagttaggctacccagtcgttggctggcacatagcaaataagaagcccccacttccaaagcgagttcgaagacagatacacgcaacaccaacacctgtcacagctatcggtcccccaactaccgccatccaggagcctccgagcagaattgtacccacccctacctcccccgccatagctccgcctactgaaacgatggcaccacccgtgcgagatccagtacctggcaagcccaccgtgactattcgaacccggggggccattatccagacccctacgctgggacccatacagcccacacgcgtgagcgaagcaggcacaacggtccccgggcagattagacctactatgactatccctggatatgtggagccaaccgccgtagcgacacctccgacaacaacaacaaagaaaccccgcgtgagcaccccaaaacctgcaactcctagtactgacagtacaacaacaactactcgcaggccaacaaaaaaacctagaacacctcggcccgtccctcgagtgaccacaaaggtttctattacccggttggagaccgctagccctccaactaggatcaggactacaaccagcggcgtgcctcggggcggtgagccaaaccaacggcccgaactgaagaatcacatcgatagagtcgatgcttgggtgggcacatattttgaggtgaagattccgtcagatactttttacgaccatgaggacaccacaactgacaaactgaagttgacactcaagctgagagagcagcagctggtaggtgagaaatcttgggttcagttcaatagtaactcacagttgatgtacggcctgccagatagttcgcatgttggcaaacacgagtacttcatgcatgcaaccgataaaggaggtctgtctgccgtcgacgcctttgaaatccacgtgcatagaaggcctcaaggtgatagagcccccgcaaggttcaaggctaagttcgttggcgatccagcccttgtgttaaatgatatccacaaaaagattgcccttgtgaaaaagctggcttttgctttcggggacagaaattgctcaaccataacactccaaaacataaccagaggctctatagtggtagagtggaccaataatactctccccttggagccatgcccaaaggaacaaattgcgggtctgtctcggagaatagctgaggacgacggcaaacccaggccagccttctctaacgctctcgaaccagatttcaaagctacaagtatcactgtgacagggagcggctcatgcaggcacctgcagtttatacctgtggtgccaccacgcagagtaccctcagaggctcctcccaccgaggtaccagacagggaccctgaaaagtcctctgaggatgatgtttacctccatacagtgattcctgccgtggtcgttgcggccatccttttgattgccggaatcatagccatgatctgctatcgaaagaagaggaagggaaaactgacacttgaagatcaagctacgtttattaagaaaggcgttcccataattttcgccgatgagctagatgattcaaaacctccaccaagctctagcatgcccctgatcctgcaggaggagaaggctccgctcccccccccagagtacccaaatcagtccgtgcccgagacaacgcctctgaatcaagacacaatgggggaatatactcctcttcgggatgaagaccctaacgctcctccatatcagccaccaccacccttcaccgccccgatggaaggcaaaggatccagacctaaaaatatgaccccatacaggtctcccccaccatatgttcctccctag

SEQ ID NO: 115376 - DNA, 2025 bp, Artificial Sequence
  Description of Artificial Sequence: Synthetic coding sequence
atggctgccggcggagctgaaggaggaagcggccctggcgctgccatgggagattgcgcggaaattaagagccagttccgaacgcgggagggattctacaagctcctgcccggggacggcgccgctcgacgaagcgggcccgcatctgcccagactccagtgccaccgcagcctccccagcctccaccagggccggcttctgcatctggcccaggagccgccggtccggccagtagccctcctcccgcaggacctggtccgggacctgcccttccagccgtgaggctgtccctcgtgaggcttggagaacctgactctgctggtgccggcgaaccacccgcaactcccgctggcctggggtcgggaggggatagagtgtgctttaatctaggccgtgaactgtacttctatcctgggtgctgcagacgcggttctcagaggagcatcgatcttaataaacccatcgacaagcgcatctacaaaggtacccagccaacttgccacgactttaatcagttcaccgctgccactgagacgatatcgctcttagtgggctttagtgcaggccaggttcagtatttagacttgattaagaaggacacatcgaagttgtttaatgaggaaagattaattgataaaacaaaagtgacgtatctcaagtggcttcccgagagcgaaagtttgtttctggccagtcacgctagcgggcacttgtacctgtacaatgttagccacccgtgcgcctcagcaccaccgcagtattccctgctgaagcaaggcgaagggttttctgtctacgctgctaagagcaaagctcccaggaatccccttgccaaatgggccgtgggcgaaggcccccttaatgagtttgctttctcccccgacggtcgccaccttgcctgcgtctcccaggacggctgcctgcgggtgtttcatttcgactccatgctgttgcgaggcctcatgaaaagctattttggaggattactttgtgtttgctggagccccgatgggcgatacgtcgtgacaggcggagaggatgacctggtaacagtgtggagctttaccgaagggagggttgtggcaagggggcatggccacaagtcctgggtaaacgcagtcgcgtttgacccttacaccacccgagcagaggaggccgccaccgcagccggagctgacggcgaacggtcaggggaagaggaagaagaagaacctgaagccgccggaaccggcagcgcaggaggagcccctctgtctccactccccaaggctggcagcataacctatagattcggttctgccggtcaagacacccagttctgtctgtgggacttaactgaggatgtattgtacccacacccgcctttagcccgaaccaggactctcccaggtacgcctgggacaaccccacctgccgcatctagcagtcggggcggagagcccggcccgggacccctaccgcgctctctctctcgctctaattcacttccacatcctgcgggaggtggtaaggcgggaggccctggggtggccgcagaaccaggaacacccttctcaattgggaggttcgctactctgaccctgcaggagaggcgcgaccgcggagctgagaaagagcacaagagatatcactcgttgggaaacatctcccggggtggatcaggtgggagtggttccgggggcgagaaaccatctggacctgtgcctaggagtcggctggacccagcgaaggtgctgggcacggcactctgtccccggatccacgaggtgcctctattggaacccttggtgtgcaagaagatagctcaggagaggctgaccgttttactgttcctcgaggattgcatcattacggcttgccaagaaggtctcatttgtacctgggcccggcctggaaaggctttcacagatgaagagaccgaggcacagactggcgagggcagctggccgcgaagtcctagcaagagcgtagtggaaggtataagcagtcagccaggcaacagcccctccggaacagtggtatag

SEQ ID NO: 115377 - DNA, 1890 bp, Artificial Sequence
  Description of Artificial Sequence: Synthetic coding sequence
atgtcggccgaagtgcgactgagaagactgcagcaactcgtccttgaccctggctttctggggctggagcctcttctggacttactgctgggagtgcatcaggagttgggcgcatcagagctagcacaagacaagtatgttgctgatttccttcagtgggcggagccaatcgttgtcagactcaaggaagtgaggctgcagagagacgacttcgaaattctaaaggttatcggaagaggggcattctcagaggttgcagttgtgaagatgaagcagacgggacaggtttatgctatgaaaattatgaacaagtgggacatgctaaagagaggagaggtgagttgttttagggaagagagggacgtgttagtgaacggcgaccgcaggtggataactcaactgcactttgcattccaggatgagaattatctctatctcgtgatggaatattacgtgggcggggatctcctcacccttttgtcgaaattcggagagcgcatacctgcggaaatggcgcggttctatttggccgagatagttatggccatagacagtgtgcatagactgggatatgtgcacagggacatcaaaccagataacatcttactcgatcggtgcggtcatattcgactggcagatttcgggtcatgtctgaaactacgtgccgacgggaccgtgcgatcgctggtggccgtgggcacgcccgactacctgagccccgaaatcctccaggcagtcggcggaggcccgggaaccggaagctatgggcccgagtgtgactggtgggcactcggcgtattcgcctatgagatgttctatgggcagacccccttttatgcggactccacagccgagacctatgggaagatcgtgcattacaaggaacacctgtccctgcccctcgtagacgagggagtgcctgaggaagcccgcgactttattcagcgactgctttgcccacccgagacgaggctgggcagggggggagcaggggattttcgtactcatcctttcttcttcggactggattgggacggacttagagactccgtccccccattcactccagattttgagggggcaaccgacacctgcaactttgacctggtggaggatgggctgaccgcaatggtgagcggcggaggtgaaacactgagcgatattagggagggagcaccgctgggcgttcaccttccctttgtcgggtattcttatagttgcatggcattgagagacagcgaagtccccggaccaactccaatggagcttgaagccgaacagctgctcgagccccatgtgcaagccccttctctcgagccatctgtatctcctcaggacgaaacggcagaggtggcagtcccggctgcagtgcctgcggcagaagcagaggcagaggtaacgctcagagaattgcaggaagcccttgaagaagaagtcttgacgcggcagagcctttcaagagaaatggaggctatacgcacagacaaccagaactttgctagtcagctgcgcgaggccgaggcgcggaatcgcgatctggaggcccacgttagacaattacaagaaaggatggagttactccaagctgagggtgcaacagcagtgactggggtaccgagcccccgagcaactgatcctcccagtcatttagatggccctcctgccgtcgccgtcgggcaatgtcccctagttggaccagggccaatgcataggcgccacctgttgctacctgccagagtcccacggcctggactgtctgaagctttatctctgctgctgttcgccgtggtgctttcacgggcggccgcactgggctgcattggcttggtggctcatgccggacagcttacagcagtttggcggaggccaggcgccgcccgagcgccctag

SEQ ID NO: 115378 - DNA, 1968 bp, Artificial Sequence
  Description of Artificial Sequence: Synthetic coding sequence
atggtgctgcccgtgcaacacgtaagcaggggagccgccgaggctgccccagcagctggagttgggccaggcctgcctggagccggcgcaccggctaggcccagtcctggccggccgccaggggccggccgcctacggacaggaccaggccaggtacgaggtcggctcctcgcggtaggacccaagagccgtgtcttccaatctgttgtgcaggaacccccggccagcgagtcaagggctgagcccatagtggtacgcttgaaggaagtgaggttgcagcgcgacgacttcgagattctgaaggtgatcggtcgcggggccttttccgaggttgccgtcgtcaaaatgaagcaaacagggcaggtttatgccatgaaaattatgaacaaatgggacatgttaaagaggggggaggtgtcctgctttcgcgaagagcgggacgttctcgtcaatggagaccgtaggtggataacccagctccacttcgcattccaggacgagaactatctctacctggttatggaatattacgtggggggcgatctcctcaccctgcttagcaagttcggggaacggatcccagcagaaatggcacggttttacctggcagagatcgtgatggctatcgactcggtgcaccgactggggtacgttcatcgggatattaaacccgataatatccttttagataggtgcgggcatataaggctggcggatttcggtagttgcctcaagctgcgggcggacggcacggtgcgctctctagttgccgtgggcacacccgactatctaagccccgaaatcctacaagctgtgggagggggtcctggcaccggaagctacggccccgaatgcgactggtgggcccttggtgtatttgcctacgaaatgttctacggccagacacccttctatgccgatagcactgctgagacctatggaaagattgtgcactataaggagcatctcagccttccattggtagacgagggtgtcccagaggaggccagggacttcattcagcggttgttgtgcccaccagaaacgcgccttgggcgcggcggcgccggtgacttcaggacacaccctttctttttcggtcttgattgggatggactgcgtgacagtgtaccacctttcacaccagattttgagggtgctacagatacatgcaactttgatctggttgaggatgggctgacagctatggtcagtggcgggggcgagaccctgagtgacatcagagaaggagccccccttggggtgcatttaccctttgtaggctactcatatagctgtatggctctgcgggattctgaagtgccggggccaacacctatggagttggaggctgagcaactgctggagcctcacgtgcaagccccctctctggaaccctccgtgtccccacaggatgaaacagcggaggttgcagtaccagccgcagtgccggctgcggaggcagaggccgaggttaccttgagggagctgcaggaagcgttggaagaggaagtgcttactagacagtctctgtctcgagagatggaggccattagaaccgacaaccagaattttgcaagtcagttacgagaagctgaggcccgaaaccgagacctggaagcgcatgttagacagctgcaagagcggatggaactactgcaggccgaaggcgcaactgccgtaaccggtgtgccatccccgcgggctacagatcctccatcacatctcgacgggcctcccgcagtagcagtgggccagtgcccacttgttggacccgggccaatgcaccggagacatcttttgttgcccgcacgagttccaaggcccggtctcagcgaagcattgagcctgttgctgttcgcggttgtgctgtcccgggcggccgcgctgggctgcattgggctcgtcgcacacgccgggcagctcactgccgtatggcgtcgtccaggtgccgcccgcgccccttag

SEQ ID NO: 115379 - DNA, 1920 bp, Artificial Sequence
  Description of Artificial Sequence: Synthetic coding sequence
atgggaggccacttttggccgcctgaaccttacaccgtgtttatgtggggctcaccctgggaggcggactcaccaagggtgaaacttcgaggtagggagaaaggccgccagactgagggcggggccttcccactggttagttcggcgctcagtggcgaccctagattcttcagtcccacaactccaccagccgagcctatcgtggtcagattgaaggaagtccggctgcaaagggacgacttcgaaattctcaaggtgatcggacggggggcattctccgaggttgcagttgtgaagatgaaacagaccggtcaggtttacgctatgaaaatcatgaacaaatgggacatgctcaaacggggtgaagtgagctgtttcagagaggaaagggacgtgttagtcaacggggatcggcgctggataacccagctgcacttcgccttccaggatgagaattatttgtacctggtcatggagtattatgtgggaggtgatctgctgactctcttaagcaagtttggagaacgcatccccgccgagatggcgaggttctatttagccgagattgtgatggcaatcgattccgtgcataggctggggtatgtacaccgcgacataaagccggacaacattctactcgaccggtgcgggcacatcagactcgccgacttcggtagctgtttgaaattacgagcggatggaaccgttcgcagcttggttgccgtggggactcccgactatctcagtcctgagatccttcaggccgtggggggagggcctggcactggcagctatggacccgaatgtgactggtgggcccttggcgttttcgcttatgagatgttctatggacagacgcccttttacgcagattccactgcagaaacctacgggaaaatagttcactataaagagcatctctcactccccctggtggacgaaggcgtcccagaggaagctcgagattttattcaaagattactatgtcctccagaaacccggcttggtcgggggggggccggagactttaggacacacccgtttttcttcggcttggattgggacggtcttcgcgacagcgtcccgcctttcacccctgacttcgagggcgctaccgacacatgtaactttgaccttgttgaggatggtctgactgccatggtgagcggaggaggtgagacactgagtgatattagagaaggggccccactcggcgtgcacttacccttcgtaggctattcttattcgtgcatggcactgagggactcggaggttcctggtcctacacccatggagctggaggccgaacagctgcttgagcctcacgttcaggcaccctccctcgagccatctgttagcccgcaggatgaaacagcggaggtggctgtgccagccgcagtgcccgccgccgaagcagaagcggaggtgactctgagagagttgcaagaggctctagaagaagaagtgttgacccggcagagtttgagtcgagaaatggaggccatcaggaccgataaccagaattttgcctctcaactgagggaggctgaggctcgcaaccgagacctggaggcccacgtgcgtcagctccaggagagaatggagcttctgcaggcagaaggggctacagccgtgaccggcgtcccctctccacgggcgacagaccctcctagccacttggacgggccacctgctgtggccgtgggtcagtgccctttggtgggccctggcccaatgcaccggcgacacctactgttaccggcaagggtgccacgaccagggctgtccgaggcattgtccctgttactttttgctgttgtgttgagtcgggccgctgctctcggctgcattgggctggtggctcacgctggtcaattgaccgccgtgtggcgtcgacccggtgcggcgcgtgcgccgtag

SEQ ID NO: 115380 - DNA, 1830 bp, Artificial Sequence
  Description of Artificial Sequence: Synthetic coding sequence
atgggaggccacttttggccccccgagccatatactgtttttatgtggggatctccctgggaggctgattcccctagggtaaagctgagggggagggaaaagggccggcagaccgagggcggcgctttcccactcgtgtcttctgccctgagtggcgatcctaggtttttttcacccacaacgcccccggcagaacctatcgtagtgcggctgaaagaagtacgccttcaacgagatgactttgagatcctgaaagtgattggccggggggccttcagcgaagtcgccgtggtgaaaatgaaacagaccggacaggtgtacgccatgaagattatgaataaatgggacatgctgaagcggggcgaagtaagttgtttccgcgaagaacgagacgtcctggtcaacggagaccgacggtggataacccagctgcattttgcatttcaggatgaaaactacctatatttggtaatggaatactatgttggaggtgatctgctcactttactgtccaaatttggggagagaatccctgcagaaatggcgcgcttctaccttgctgagattgtgatggctatcgatagcgtgcaccggctcggttatgtgcatagggatattaagccagataacatcctgctggacagatgcgggcatattcgtctagctgattttggtagttgtctgaaattgagagccgacgggactgtgcgcagcttggttgctgtcggcacgcccgactatctgagcccggagatcctccaagccgtaggcggcgggccgggcactggaagctatggccctgaatgtgactggtgggcactgggcgtgttcgcttacgagatgttttatggacagaccccgttttatgccgactctacggcagaaacctacggaaaaattgtccattataaagagcacctgtcgcttcctttggttgacgaaggcgtacctgaggaggctcgcgactttatccaaaggctgctttgtccaccggagacgagactgggcaggggcggcgcaggggattttagaacacaccctttctttttcggcctggattgggacggattaagagattcagtgcccccattcacccctgattttgaaggggcaacagatacttgcaatttcgatcttgttgaagacgggctgaccgccatggtgagtggtggcggggagacccttagcgatattagggagggggcccccctcggcgttcatctgccatttgttggctattcatattcgtgcatggcgctgcgggacagcgaggtccctgggcccacacccatggaactagaggcggaacagctgcttgaacctcacgtgcaagcccctagcctcgagccttccgtctccccacaagatgaaaccgccgaggtggcagtgccggcagccgttccggccgcagaggcggaggccgaagtgactttgcgcgaactgcaggaggctctggaagaagaggtgctgacccgtcaatcgctctcacgggagatggaggccattaggacggataatcaaaactttgcgagtcagctgagagaggcagaggcacgcaatagagatttagaagctcacgtcagacagctgcaggagcgaatggagcttctccaggcagagggagccaccgctgtcaccggggtgcctagtccgagagctacagatcctccgtcccacgtgcccaggccaggcttgtcagaagccctatccctgctgctcttcgcagtggtcttgtccagagccgccgccctggggtgtatcgggcttgtcgcacatgcaggacagctgacggccgtctggagacggcccggagccgcaagagcaccatag

SEQ ID NO: 115381 - DNA, 1593 bp, Artificial Sequence
  Description of Artificial Sequence: Synthetic coding sequence
atgagtgcagaagtgaggttaaggagacttcagcagctcgttcttgaccccgggttcctgggcctggaacctttgttggacctgctgctgggagtacatcaggagcttggggctagtgagttggcacaggacaagtatgtagccgattttttacaatgggctgaacctattgtggtgaggttgaaagaggtacgccttcaacgcgatgacttcgagatattgaaggtgatcggcaggggggcgttcagcgaggtggccgtcgtgaagatgaagcagacgggccaggtatatgccatgaagatcatgaacaagtgggatatgctgaaaaggggagaggtgtcctgctttcgggaagaacgcgacgtcctggtgaacggcgacaggagatggattacccagctgcattttgcgttccaggacgaaaattacttgtatttggttatggaatattatgtgggaggggacctactcacactgctgtcaaaattcggcgagcggattcccgcggagatggcaaggttctacctagccgagatagtgatggctatcgattccgtccacagactgggctacgtgcatcgcgacataaaaccagataatatattgctggatcggtgcgggcacatcagattggcggacttcggctcttgtctgaagctgcgcgccgacggcacagtgcgcagtctcgttgccgtgggcacgcccgactacctatcaccggagattctgcaggccgtaggggggggccctggtaccggtagctacgggcccgagtgcgactggtgggccctcggggtgttcgcatacgaaatgttttatgggcagactcccttctatgctgactctacagccgagacatatggcaaaatcgtacactacaaggagcacttgagcctgccccttgtcgacgaaggagtgccagaggaagctcgagactttatacagagattgctttgcccacctgagacacgccttgggcggggcggggccggtgactttagaacccacccgttcttcttcggccttgactgggacggcctgcgcgattccgtgcccccgtttaccccagattttgaaggagcgacagatacctgtaacttcgatttggtagaggatggtctcacggccatggaaactctgtcggacataagagaaggcgcccccctgggcgtacaccttccattcgtgggctatagctatagctgcatggctctgcgggactcagaggtacctggacctacacccatggaactcgaggccgaacagcttttggaaccccatgtgcaggcaccaagcctagaaccatctgtgtcaccacaggatgagacagccgaggtcgcggtccccgccgctgttcctgctgcggaggctgaagctgaggtgactcttcgcgaactccaggaggcgcttgaagaggaagtcctcacccggcagtctttatctcgggagatggaggcaatcaggacggataatcaaaattttgcttcccagctccgggaggcagaagctcgcaaccgcgatcttgaggcacacgtgaggcaacttcaagaacgtatggaactactgcaggcggagggagccaccggtccttag

SEQ ID NO: 115382 - DNA, 1866 bp, Artificial Sequence
  Description of Artificial Sequence: Synthetic coding sequence
atgagcgcggaggttcgtctccgccggctccagcagctcgtgctcgaccctggatttctcggcctggagccactccttgacttactgttaggcgtccaccaggaactcggtgcatccgagctagcgcaggacaaatatgttgccgactttcttcagtgggccgaacccattgtggttcggttgaaagaggtaagacttcagagggatgatttcgagattctgaaggtaattggacgcggcgctttcagtgaggttgccgtggtgaagatgaagcaaaccggccaggtctatgccatgaagatcatgaataaatgggatatgttaaagaggggcgaggtgtcatgtttcagggaggaacgtgatgttctcgtgaatggcgatcgtcggtggatcacacagctgcacttcgcatttcaggacgagaattacctgtatctggtgatggaatattatgtgggaggtgacctgctcacactcctcagcaagttcggggagcggatccccgcagaaatggctcgattctatctagcagagattgtgatggctattgactctgtgcaccgcttgggctacgtgcaccgcgatattaagccggacaatatactgctggaccgctgtggacacattcgcctggctgattttggctcttgtttgaagctgagagctgatggcacagtaaggagcctggtggctgtggggacccccgactatctatctcccgaaatcctgcaggccgtgggaggcggaccaggaacaggatcttacggacctgagtgcgactggtgggcacttggggtattcgcatacgagatgttttacggtcagacacctttttatgcggatagcactgccgagacctacggaaagattgtccactacaaagagcatctgagtcttcccctggtcgacgaaggggtccccgaggaggcgagagatttcattcagcggctcctgtgccccccagagacacgattgggccgggggggggctggggattttcgcactcacccattctttttcggacttgattgggacggacttcgggacagcgtcccacctttcactccagatttcgaaggcgccactgatacctgtaattttgacctcgttgaggatgggctcaccgctatggaaacattgtctgacatccgggaaggggcccccctgggtgtccacctcccttttgtggggtactcatacagctgtatggctctgagggacagtgaggtgccaggccccacccccatggaactggaagccgagcaactcctcgagccccacgttcaggccccttcacttgaaccgagcgtgtccccgcaggacgagacggcggaagtggcagtgcccgccgcggtccccgcggcggaagcggaggccgaagtcacgctgagagaacttcaagaagctcttgaggaggaagtgctcacaaggcagagcttgtctagggaaatggaggctataaggaccgataatcagaacttcgctagccagctcagagaagcggaggctcgaaacagggacctagaggcccacgtgaggcagctgcaggagcgcatggaactgctgcaagctgagggggcaacagctgtgactggtgtgcccagcccacgcgccacagatccaccttcccacctggacggccctccttggttatgggccagcgctcggtggtggggccagatgcaccggcgtcacctgttgctgcccgccagagtgccgagacctgggctatcggaggcgctttctctgctgctcttcgctgtcgttttatcccgcgccgctgccctggggtgtataggactggtcgcccatgcgggtcagctgacagccgtgtggagaagaccaggcgcagcacgagccccctag

SEQ ID NO: 115383 - DNA, 1875 bp, Artificial Sequence
  Description of Artificial Sequence: Synthetic coding sequence
atgtcagctgaagtccgtctgcgcagactgcagcagttggtgttggatccaggctttctggggttagaaccactgctggacctgctgcttggcgttcaccaggagttgggagcttccgagctcgctcaggataagtatgtcgcagatttcttgcagtgggcggagcccattgtggtgcgactaaaggaggttcgccttcagcgagacgacttcgagattctgaaagtcattggcaggggagccttctctgaagtcgccgttgtcaaaatgaagcagactgggcaggtttacgccatgaaaatcatgaacaaatgggacatgttgaagagaggcgaagtgagttgctttagagaggagcgagacgtgctcgtgaatggggaccgccggtggattactcagcttcatttcgctttccaagacgagaactacctttacctcgtaatggagtactacgtcggcggcgacttgttgacacttctctctaaatttggagagcggattcccgcagaaatggcgaggttctatctcgcagagatcgttatggctatcgattctgtgcatcggctaggttatgtccatagagacattaagccggacaatatacttctagaccggtgtggccatattagacttgctgattttggcagttgtcttaaacttagagctgatggaaccgttagatccctcgtcgctgtgggaacccccgattacctgtcacccgaaatcttgcaggcagtgggaggagggcctggaaccggctcttatggacctgaatgtgactggtgggccttgggggtattcgcttacgagatgttttatggccagacccctttctacgccgactccaccgccgaaacatatggtaagatcgtccactataaagagcaccttagtctgcctctggtggatgagggcgtgcccgaggaggcaagagacttcatacagcgtctgttgtgccctcccgagacaaggttgggtcggggcggagccggagatttccgaacccatccatttttctttggtctcgattgggacgggctgcgggatagcgtgccgcctttcaccccagattttgagggcgctaccgatacctgcaatttcgaccttgtcgaggatggactgactgctatggaaacactctcggatattagagaaggggccccactgggtgtccacttgccgttcgtaggctattcttacagttgtatggccctgcgcgatagtgaagtacccggcccaacacctatggaattagaggcggaacaactcttggagcctcatgtacaggcccccagcttagagccgagcgtcagcccacaggacgaaactgccgaggtcgctgttcctgccgcggtgcctgccgccgaggctgaagcggaggtgaccctgagggaactccaggaggccctagaggaagaagttctgacccgacaatctctctcccgcgaaatggaagctatacggaccgacaatcagaacttcgcttcacaacttcgggaagccgaggcacgcaatcgagacctggaagcgcatgtgcggcagttgcaggagagaatggaactgctgcaggccgagggtgccacagccgtcactggcgtgccgtctccccgggccaccgacccgccatctcatctcgacggtcccccagcggttgcggtaggacagtgtccgttagtcgggcccggtcccatgcaccgccgccatctgctattacccgcacgggtccccagaccagggctgtctgaggcgctcagtctgctgctgtttgcggtggtcctatcccgtgcagctgccctggggtgtattggtctggtggcccacgccgggcaactcaccgccgtctggagaagaccaggcgctgcgcgtgccccctag

SEQ ID NO: 115384 - DNA, 1878 bp, Artificial Sequence
  Description of Artificial Sequence: Synthetic coding sequence
atgtccgccgaagtgagactccggaggcttcagcagttggtgctggacccgggtttcctgggtctcgaaccgctgttggatcttctgcttggcgttcaccaggagctgggggcctctgagctggctcaggataagtacgtcgcggactttctccagtgggcagaaccaatcgtggtgcgactcaaagaggtccgccttcaacgagacgatttcgagatactcaaggtgattggaagaggcgccttttccgaggtcgccgtcgtcaaaatgaagcaaaccggccaagtttacgcaatgaagattatgaataagtgggacatgctcaagcggggcgaagttagctgctttcgtgaagaacgtgacgtattggtgaacggagaccgcaggtggattacccagcttcacttcgcttttcaggatgagaattacctctacctagtcatggaatactatgttggcggagacttgctgaccctcctatccaaattcggggaacgaatccccgccgaaatggcaaggttttatctggctgaaatcgtaatggccattgactccgtgcacagattaggctacgtgcatagggacatcaagccagataatatccttctggataggtgtgggcatatccgcctggccgacttcggcagctgtctgaagctacgggccgatggaacagtccgcagtctcgtggctgtgggcacgcccgactacttgtctccggaaattttacaagctgttggcggtggacctgggaccggatcttacggacctgaatgcgactggtgggccctgggggtgtttgcatacgagatgttttatggtcagacccctttttacgccgatagcaccgccgagacttatggaaagatcgtccactataaagaacatctgagtctccccctagtggatgaaggtgtaccagaagaggcaagggacttcatccagagattactgtgccccccagagacaaggctggggcggggcggtgcaggagacttccgcacgcaccccttcttttttggcctggattgggacggactgagggattccgttcctccctttactccagacttcgagggagcgactgatacctgcaacttcgacctggtagaggacggcctgacggccatggagaccctttccgacatccgcgagggggcgccgcttggagtgcacctgccatttgtgggctattcttatagctgcatggctcttagggactctgaggtgccaggccccaccccaatggaacttgaggcggagcagttactagaaccccacgtgcaggcccctagcctggagccatctgtctctccccaggacgagacagccgaagtggccgtgcccgccgccgtccctgcagccgaggcagaggccgaggttactttaagagaattgcaggaggctcttgaggaagaggtgctgactaggcagagtctcagtcgggagatggaagctattcgaacagacaatcagaactttgcctcccagttacgggaggctgaagctagaaatcgcgaccttgaagctcacgtgcggcagctgcaagaaagaatggagctactacaagccgagggggccacggccgtgaccggggttccatctcctcgggctacagatcctccctcacacatggctcctcgaccatggctctgggccagtgccaggtggtggggccaggctccatgtactgcagcaacttgttgtagcctgcctggatctctaggcctggcttacagaagaagatttccttgctcctgcagcccactgttctgtttggtgccccccccctgggctgctctaggttggtggccaactcctgccaacagtccccagtcaggtgcggcacaggagccccccgcactgcctgagccgtag

SEQ ID NO: 115385 - DNA, 129 bp, Artificial Sequence
  Description of Artificial Sequence: Synthetic coding sequence
atggaactgcttcaggcggaaggtgccacggctagatggccgccaggccgaggctgcgggcctgtccctgcagggggcgcccgtcctcatgcccctcctcccccagccgccccctgccagggcccatag

SEQ ID NO: 115386 - DNA, 3402 bp, Artificial Sequence
  Description of Artificial Sequence: Synthetic coding sequence
atgccatcttctctgatgcttgaagtgcccgcactggctgatttcaaccgggcttggaccgaactcacagattggctgagtctcctcgaccaagtaataaagtcacagcgcgtgatggtaggagacctggaggatatcaatgagatgatcattaaacagaaagcaaccatgcaggaccttgaacagagaagacctcagttggaggaactgattactgctgcccaaaacctaaagaataagactagcaaccaggaggccaggaccattataactgatcggatagagaggatccagaaccagtgggacgaggtgcaagaacatctacagaatagacgtcaacagctgaatgaaatgttgaaagatagtactcagtggctggaggccaaggaggaggctgaacaggtcctggggcaagcacgggcaaaactggaatcttggaaagaaggtccctacaccgtggacgcgatccaaaaaaagatcaccgaaaccaaacaattagccaaggacctacggcagtggcagacgaatgtagatgtagccaacgacctcgccctgaaattgcttcgagattactccgctgacgacacaagaaaggtgcacatgatcacagaaaacataaatgcaagctggagaagtatccacaagagagtctctgaaagagaggcagcattggaagaaacacaccggctactacaacaattcccccttgacctcgagaagtttctcgcgtggctgaccgaagcggagacaacagctaatgttttacaagacgccactaggaaagagcgtctgctggaggacagtaagggcgttaaggaactcatgaagcagtggcaggatctccagggagaaattgaggcccacaccgacgtgtatcacaatctggatgagaattctcaaaagatcctgcggagcttagaggggtccgacgatgccgtgttgctgcaaaggaggctggacaatatgaatttcaagtggtctgagctccggaaaaagtccctcaacatcagatctcacctggaggcatctagtgatcagtggaagaggctgcacctatccttgcaggaactcctcgtgtggctccaactgaaagacgacgagctgtctcgtcaggcccccatagggggagacttccccgcggtgcaaaaacagaacgatgtgcatcgagccttcaagcgtgagttgaagacgaaggaaccggtgatcatgtccactttggagaccgttcggatttttctgactgagcagcccctggaaggcctggaaaaactgtaccaagagcccagggaactgccaccagaagagagagctcagaatgttactcgactgctgcggaaacaggcggaggaagtcaacaccgaatgggaaaagctcaatctgcactccgcggattggcagagaaagatcgatgaaactcttgagcgccttagggagctccaggaagcgacagatgaattagacttgaaactgaggcaagccgaagtcatcaaggggagttggcagccagtgggcgaccttcttattgattcattgcaggaccacctagagaaggtaaaagccctgcgcggagagattgccccacttaaggagaatgtgtcacacgtgaacgacctagcaaggcagctgacgaccttaggtatccaacttagcccgtataatttgtctacgctcgaggatctgaatacgcggtggaagctcctccaggtcgccgtggaagaccgcgtaagacagctgcacgaggcacaccgggacttcggaccagccagccagcacttcctttctacatccgtgcagggaccctgggaaagagcaataagcccaaacaaggtgccttattacatcaatcacgagactcagaccacttgctgggatcaccctaaaatgaccgagctttaccagagtctggccgatctgaacaatgttagattcagcgcttataggactgccatgaagctgaggcgcctccagaaggcactctgcttagacttgctgtcattatcagctgcctgcgatgcgctggatcagcataatctgaagcaaaacgatcagccgatggatatcctccagatcattaattgtttgaccactatttacgacaggttggagcaagaacacaataatttggttaacgtgcctctgtgcgtcgatatgtgcctgaactggctgctcaacgtgtacgacacgggaagaactggtcgcatccgagtgctttcatttaaaacaggcattattagtctatgtaaggcccacctggaagataagtataggtatctatttaagcaagtcgcctcttccacaggcttttgtgatcagcggagactgggtcttcttcttcatgattcaatacagattccacgccagctcggggaggtcgccagctttggaggctctaatatcgagcctagcgtacggagctgcttccagtttgcaaacaataagcccgagattgaagccgcgcttttcctagattggatgagactagagcctcaatctatggtgtggctgccagttctgcacagagtcgccgctgcagagactgccaaacatcaggccaaatgtaacatctgtaaagaatgtccaatcatagggtttcgctacaggtctctcaaacactttaattatgatatatgtcagagctgcttctttagcggcagagtggccaaaggtcataagatgcactatccaatggtcgagtactgcacccccaccacgagcggggaagatgtacgggacttcgccaaagtcctgaaaaacaagtttcggaccaagcgctacttcgctaaacatcccagaatgggctatcttcccgtgcagacagttctagagggagacaatatggagaccaatctgcaggccgagtatgaccggctgaaacaacagcatgagcacaagggtctgtcccccttaccttctccaccagaaatgatgccgacaagcccccagtctcctcgggatgccgaactgatcgctgaggcgaagttgctgcgacagcacaaagggaggctggaggcccgtatgcaaatcttagaggatcacaataagcagctagaaagccagctgcatcgtctaagacagcttctggagcaaccgcaagcagaggcgaaggtgaatggcactactgtaagttcgccctcaacatcccttcagcggtccgactcgtctcaaccgatgctccttcgagtggtcggcagtcagacttccgacagcatgggcgaggaagatcttttgagccccccccaagacactagtaccgggctggaggaagtaatggagcagttgaataattcctttccttctagcaggggacacaatgtgggttctctttttcacatggcagatgacttaggaagggctatggaatccctcgtgtccgtaatgacggatgaggaaggagccgagtag

SEQ ID NO: 115387 - DNA, 11058 bp, Artificial Sequence
  Description of Artificial Sequence: Synthetic coding sequence
atgctgtggtgggaggaggtggaggactgttatgaaagggaggatgtgcagaagaaaacatttaccaagtgggtcaacgcccagttttccaaatttggaaaacagcacatcgagaatctgttctctgatctgcaggacgggcgccgtctgctggatctcctggaggggctgaccggccagaaactgccgaaggagaaaggcagcacccgagttcacgcactaaataacgtgaataaagcactgcgggtgctgcagaataataatgtcgacctggtaaacattggatccacggatatcgttgacggtaaccacaagctcactcttgggctcatctggaatatcatcctacattggcaggttaagaacgtgatgaagaacatcatggccgggctccagcagaccaactctgagaagattctgctgagctgggtgcgccagtccactcgtaactacccccaagtaaatgtgattaacttcacaacctcctggtctgatggactggctctaaacgctctgattcattcccaccggccagatctgttcgactggaattcggtcgtgtgccagcagagtgctacccagagactcgaacacgctttcaacattgcccgttatcagttaggcattgagaagttgctcgatccagaggacgtagataccacctatcccgacaaaaagtcaattttaatgtacatcacctccttattccaagtactgccacaacaggtttccatcgaagccatccaggaggtggagatgctacctcgaccgccaaaggttaccaaagaagagcatttccagctccaccaccagatgcattactcccagcaaatcacggtctcattagcacaaggctatgaaaggacgagttccccaaagcctcgattcaaatcctacgcatacacacaagctgcatacgttaccaccagtgatcctacaaggtccccattcccctcgcaacatcttgaggcgcctgaagacaaatcttttggctcttcacttatggagagcgaggtgaacttggatagatatcagaccgccctggaggaggtcctttcgtggctgctgagcgccgaagacacgctccaggcacagggcgagatcagcaacgatgtggaagttgtgaaagaccaattccacacacacgaagggtacatgatggatctcacggcccaccagggtcgtgtggggaacatcctccagctcggatctaagttaattggaacagggaagttgtcagaggatgaggagacggaagtgcaagaacagatgaatctcctcaacagccgctgggaatgcctcagagtggcctcaatggagaaacagagcaatctgcatagggtgctgatggacctgcagaaccaaaagcttaaagagttgaatgactggcttaccaaaacagaggagagaacaagaaagatggaggaggagccgctggggcctgacctggaagatcttaagagacaggtgcagcagcacaaggtgctgcaggaggatctggaacaggagcaggtgcgagtaaattccctgacccatatggtggttgtcgtcgacgagtcgagcggagaccacgcaacagcggctctggaagagcaactaaaggtgctgggagaccgctgggccaatatttgccggtggaccgaggatcgatgggtcctactgcaggacatcctccttaagtggcagaggctgacagaggagcagtgcctgtttagcgcctggctgtcagagaaagaggatgccgtaaacaagatccataccacgggatttaaggaccagaatgagatgctgagcagcttacagaaactggctgtgcttaaggccgacctggagaaaaagaaacaaagtatgggaaagctgtatagcctgaaacaggatctcctgtcaacattaaagaataagagcgtcacacagaagaccgaggcctggctggacaattttgctaggtgctgggacaatctggtgcagaagcttgagaagtctacagcccagatttcccaagccgtgaccacaactcagccttcactcacgcaaaccacagttatggagaccgtcaccaccgtaactacccgcgagcaaatcctggtgaagcacgcacaggaggaacttccgcccccgccaccccaaaaaaagcgccagatcaccgtagattcggagatccgaaagcggcttgacgtcgatattactgagttgcactcttggatcactcgcagtgaagccgtactgcagtcaccggagtttgcaatcttcagaaaggagggtaatttctctgatcttaaggagaaggtgaatgcgatcgaacgcgagaaggcagagaaattccggaagctccaggatgctagccgcagtgcacaggcgctggtcgagcagatggtaaatgagggagtgaatgccgactccatcaagcaggccagcgaacaactcaattccagatggatagaattttgccaactgctaagtgaaaggcttaactggctggaataccagaacaacattatcgctttttacaatcaactccagcaactggaacaaatgacaaccacagcagagaattggctgaagatccagcccacgactccctcagaacccactgccatcaagtcccagctaaagatctgcaaagacgaggtcaatagactgagcgatcttcagccacagatcgaaaggctcaaaatccaaagcattgcactcaaggaaaaagggcagggacctatgtttctggacgccgacttcgtcgccttcaccaatcacttcaagcaggtcttttccgacgtgcaagccagggaaaaggagctgcagacaatcttcgatactctcccaccgatgcgttaccaggagactatgagtgctattcggacttgggtccaacagtccgagactaagctgtctatcccacaattgtccgttacagactacgaaatcatggaacagcgcctgggcgaactgcaagccctccagtcttctctacaagagcagcagtccgggctatactacctctcgacaacagtgaaggaaatgtcgaagaaagccccaagcgagattagcagaaaataccagagcgagtttgaggagatcgaaggaaggtggaaaaagttgtcatctcagctggttgagcactgtcaaaaattagaagaacagatgaacaagctgagaaaaattcaaaatcatattcagacgttaaagaaatggatggctgaagtcgacgtctttttgaaggaggagtggcctgccctcggcgactctgagatccttaagaaacaattgaagcagtgcagactgttggtgagtgacatccaaaccatacagccttcattaaactcagtgaacgagggcggtcagaagataaagaacgaagccgagcccgagttcgcctcacgactggaaacagagttgaaagagttaaatacccagtgggatcacatgtgccagcaagtctatgcacgcaaagaagccctgaaaggcggcctggagaagacggtgagcctgcagaaggacctgtctgagatgcatgaatggatgacacaggcggaggaggagtatctggagcgcgacttcgagtataagacgcccgacgagcttcagaaggcagtagaggagatgaaacgagctaaggaagaagcccaacagaaagaggccaaggtcaaacttttgactgaatcggtgaacagtgtgattgcacaggctccaccagtggcacaagaggcccttaagaaggagttagaaactctgacaacaaattatcagtggctttgcacaaggttgaacggcaaatgcaagactctggaggaagtgtgggcctgttggcatgagctgctctcttacctggaaaaagctaacaagtggcttaatgaggtagagtttaaactcaagactacagaaaatattcccgggggagctgaagaaatttccgaggtcctggatagcctggaaaatctaatgcgccatagcgaggacaatccaaaccagattcgcattctcgcccagactctgaccgacggaggggtgatggacgagttaattaacgaggagttggagacctttaattcaaggtggagggagctccatgaagaagccgttaggaggcagaaacttctggagcaaagcatccagtcagcccaggagactgaaaaatcattacatctcattcaggagtctctgaccttcatagataaacagctcgcagcttatatcgcagataaggtcgatgctgcacagatgccacaagaggctcagaagattcagtccgaccttacctctcacgaaattagtctcgaggaaatgaaaaaacacaatcagggtaaggaagcagctcagcgggtcctgagccaaatcgacgtggcgcagaaaaagttgcaggacgtgagcatgaagttccgtctgtttcagaagccggccaacttcgagcaaaggctccaagagagcaaaatgattctggatgaggtgaagatgcatctgcctgcgctggaaactaagtcggtggagcaggaggtggtccagagccagctcaaccactgtgttaatctttataaatcactttcagaggtcaaaagcgaagtggaaatggtgatcaagactggccggcagatcgttcagaagaaacaaacagagaatcctaaagaactggacgagcgggtgactgcgctgaaattacattataacgaactgggggctaaggtaaccgagagaaaacagcagctcgagaagtgccttaagctgtcacgtaagatgcggaaggagatgaatgtgctgacagagtggctggccgctactgacatggagctcaccaaacgatcagcggtagagggaatgccttctaacttagacagcgaagtggcatggggcaaagcgacccaaaaggagatcgaaaagcagaaggtacacctcaagagcataaccgaagtgggcgaagctttgaaaacagttctggggaaaaaggaaacactggtagaagataaactctctctcctgaactcaaactggatcgctgtgactagtcgcgccgaggagtggctgaatcttttactggaatatcagaagcatatggagaccttcgaccagaatgtggatcacataacgaagtggatcatacaggccgacacactgctggatgaatcagagaagaaaaaaccgcagcagaaggaagacgtgcttaagcggctgaaggccgagctgaatgatatcagaccaaaggtggacagtacccgcgaccaggctgcgaacctcatggccaataggggagatcactgccgtaagctggttgaaccccagatcagtgagttgaatcatcgctttgcagctatttctcaccggattaaaaccgggaaggcctctatccccctcaaagaactggaacagttcaattccgacatccagaagttgttggagcccttggaggccgaaattcagcagggagtaaacctcaaagaggaagactttaataaggatatgaacgaggacaatgagggcactgttaaggaattattgcagagaggagataatttgcaacagcgtattactgatgagcgaaaacgggaggaaatcaaaataaagcagcagttgctccagacgaagcacaacgccctgaaggatcttcggagtcaaaggaggaagaaagcccttgaaatttcccaccagtggtatcagtataagagacaagcagacgacctgctgaagtgcctggatgacattgagaaaaaactggccagtctgcccgaaccgcgggacgagcggaaaatcaaggaaatcgatagagaactgcaaaagaagaaagaagagctgaatgccgtacgccggcaagcagaagggctgagcgaagacggcgctgccatggcagtcgaaccaacgcagattcagctaagcaagaggtggcgcgaaattgagtccaaatttgcacagtttaggagacttaatttcgctcagatccacaccgtccgggaagaaactatgatggtgatgacagaagacatgccactcgagatatcatacgtcccgtccacttatctcacggagatcacccacgtctcgcaagcactgttggaagtcgagcaactgctcaatgcgccggacctctgtgccaaggactttgaggacctgttcaaacaggaggagtcactgaagaacataaaagactcactccaacagagctcaggtaggatagatatcatccacagtaagaaaaccgccgccctgcagtcagccacacctgtggaacgggtcaaactgcaagaggccctgagtcagcttgatttccagtgggagaaagtgaacaaaatgtacaaggacagacagggacgcttcgatagatctgtggaaaagtggaggcgattccactatgatatcaagatctttaaccagtggctcacagaggcggaacaattcttacgaaagacccagattccggagaattgggaacacgctaaatacaagtggtatctaaaagagctgcaggatggcatcggacagaggcaaaccgtcgtgcgcacattgaacgcaactggagaggaaattatccagcagtcatcaaagactgacgcaagtatactccaggagaagctcgggtccctgaacttgcgctggcaagaagtgtgtaagcagctgagtgaccggaaaaagcggctggaagaacagaagaatattttgtcggagttccaacgagacctgaacgaattcgttctgtggctggaggaagccgacaatatcgcctccatcccacttgagcccggcaaagaacagcagcttaaagaaaagctggagcaggtgaaactgttggtggaagagctaccactcagacaaggaatcctgaaacagctgaatgagaccggaggaccggtgctggtgtccgcacccatcagcccagaggagcaagacaagctggaaaacaagctgaaacagacgaacctgcaatggatcaaggtgagccgagcattgcctgagaagcagggcgaaattgaggcccagatcaaggacctgggtcaattggagaagaaactggaggacttggaagagcagctgaatcatctgctgttgtggctgtcccccatcaggaatcagctggagatctacaaccagcccaatcaagagggcccattcgacgtcaaagaaactgagattgctgtccaggccaagcaacccgatgttgaggagatcctttctaaaggacaacacctgtacaaggagaaaccggctacacaacctgtgaaacggaagctcgaagacttatcctcggaatggaaagcagtaaaccgactgttacaggaacttcgcgccaaacagcccgatctggcccccgggctcactacaattggggcatctcctacacagactgtgacactcgtcacccagccagtggtcacaaaagagacagccattagtaaactggagatgccctctagtttaatgctggaagtccccgcgctggcagacttcaatcgagcttggaccgaattgacagactggttaagcctgttagaccaggtgatcaagagccagcgcgttatggtcggggatctagaggacatcaatgagatgatcatcaaacaaaaggcaacaatgcaggacttagagcagcgtaggcctcagttggaggagctcatcacggccgcacagaatctgaagaacaagacctccaaccaggaagccaggaccatcatcacagataggatagagaggatacagaaccagtgggatgaagtgcaggagcacctgcagaatcggcgccaacagctgaacgaaatgctgaaagacagtacccaatggctcgaggccaaggaggaagccgagcaggtgctcggccaagccagggcaaagctggagtcatggaaagagggcccatacactgtcgacgccatacagaaaaagatcaccgaaaccaaacagctggccaaggacctccggcagtggcagactaacgtcgacgtggcaaacgatttagccctgaagctacttcgcgattactccgctgatgatacccgtaaagtgcatatgattacggagaacataaatgcatcctggcgcagcattcataagcgtgtgtctgagagggaggccgccctcgaagaaacacacaggctgcttcaacaattccccctcgatctcgagaagtttctcgcctggctgacggaggctgagactaccgctaacgttctgcaagacgcgacccggaaagagcgactgctggaagattctaaaggagtgaaggagctgatgaaacagtggcaggatctgcagggagagatcgaggcacacaccgatgtatatcataatcttgacgagaatagccaaaaaatcctgaggagcttggagggatccgatgatgccgtcctattgcagagaagactcgacaacatgaatttcaaatggagcgagctgcgaaaaaagagcctcaacattcgctctcacttggaggcatcttctgaccagtggaagcggttacacctgagcttgcaggaactcttagtctggctgcagcttaaagacgatgagctcagccgccaggctcccatcggaggcgatttccccgccgtgcagaagcaaaacgatgtgcacagagcattcaagcgggagctcaagaccaaggagcccgtgatcatgagtaccctggaaactgtgcgaatttttcttaccgaacagcctctcgaagggcttgaaaaactctaccaggagccccgtgagctgccccccgaggaaagggcccagaatgtgacaagactgctgcgaaaacaggcggaggaagtcaacactgaatgggaaaaattgaatcttcactcagctgactggcagagaaagattgacgagacgctggagcggctgcgggaattgcaagaggctaccgatgagctggacctcaaactgaggcaggcggaggttatcaagggttcgtggcagcctgtgggagatctcctgattgactccctccaagaccacctagaaaaggtgaaagccctgcgcggggagattgccccattaaaggaaaatgtgtctcatgtgaacgatctcgcccgacagttgaccactctgggcatccaactctctccatataacctaagcactcttgaagaccttaacactcgatggaagctcctgcaggtggccgtggaggatcgagtgagacaactgcacgaagcgcatagggacttcgggcccgcaagccagcactttctgagcacctctgttcagggcccctgggaacgcgccatcagtcctaataaggttccctattatattaaccatgagacccaaaccacatgctgggatcaccccaagatgacagagctctaccagtctctcgccgatctgaacaacgtgcgcttttccgcctaccggacagcgatgaagctgagaaggctccagaaggctctttgcttggatttgctaagtttgtctgcagcctgtgatgcgcttgaccagcacaatctgaagcagaatgaccaacccatggacattctgcagataataaattgtttgacgactatctatgaccggctagagcaggagcacaataatttggtgaatgtgcctctgtgcgtggatatgtgcttaaactggctgcttaacgtgtatgacaccggacggaccggacgcatccgcgtgctttcattcaagactggcatcattagtttgtgcaaagcccatctggaggacaagtatagatatctgttcaaacaggtggcatcttccactgggttttgtgatcagcggcgactcggtcttctcttacatgactcgatccaaatcccccgacagcttggcgaggtggcctcattcggcggcagtaacatcgaaccatcagtgcgatcctgttttcagtttgctaacaacaaaccagagatagaagctgccttgttccttgattggatgcgcttagagcctcagagcatggtttggctgcccgtcctgcatcgtgttgcggccgccgagaccgcaaagcatcaggccaagtgtaacatctgtaaggaatgccctataattgggttccgttaccggtcactcaagcacttcaattacgacatctgccagtcttgcttcttttctggacgcgtggccaaaggacacaaaatgcactaccccatggtagagtattgtacacccacaacaagcggggaagatgtccgggattttgctaaggtattgaagaataaattcaggactaaaaggtacttcgccaaacacccgcggatgggctatctaccggttcagacggttcttgaaggcgacaacatggagacgcccgtaacattaatcaatttctggccagtggactctgctcccgcgtcatcaccccagttgtctcacgacgatacacactcacggatcgagcactacgccagcagactcgcggagatggagaacagcaacgggtcgtatctcaatgatagcatatccccaaacgaatcaattgatgatgaacacttgctgattcagcattattgccagagcctcaatcaagattctcctctaagtcagccgaggagcccagcgcagatccttatttcgttggagtctgaggagcgtggagaactcgagcggatactggccgacctggaagaggagaacagaaacctgcaagcagagtacgaccgcttgaaacagcagcacgagcacaagggtttaagtcccctgcctagcccacccgagatgatgccgacaagcccccaaagcccccgagacgcggaacttattgcagaagccaagctccttcgacaacataaagggcggctggaggcgcggatgcagatcttagaagatcacaacaagcaactcgagagccagttacacagactgcggcagttattagagcagcctcaagctgaggctaaggttaacgggactacagttagtagcccatcaacttctctgcaaagatccgatagttctcaacccatgcttttgagagtggtgggctctcaaacatccgattctatgggggaggaagatctgttgagtccccctcaggacacatccacagggctggaagaggttatggaacagctcaataactccttccctagttcaaggggaaggaatacacctggaaagcctatgagggaggacactatgtag

SEQ ID NO: 115388 - DNA, 3693 bp, Artificial Sequence
  Description of Artificial Sequence: Synthetic coding sequence
atgccaagttccctgatgctcgaggtccccgctttggccgatttcaatagagcctggacagagctgacggactggttgtcactcctggaccaggtgattaaatctcagcgggtgatggttggagaccttgaagacattaatgaaatgattataaaacaaaaagccaccatgcaagacttggaacagcggcggccgcagcttgaagaattaattacagcggctcagaatcttaaaaataagacttcaaatcaggaggccagaacaatcatcacagataggatcgagagaattcagaaccagtgggatgaggtgcaggaacatcttcagaataggcggcagcagctcaacgagatgctaaaggattccacccagtggctagaggctaaagaggaagccgaacaggtactgggacaggctcgagctaaactcgaatcatggaaggagggaccctacactgtcgatgccatacagaagaagatcacagagactaagcagctggcgaaggatttacggcagtggcagacaaatgtggatgtcgccaacgacttagctctgaaactactcagggattattctgctgacgatacacgtaaggtccatatgatcacagagaatatcaatgcctcttggcgatctatccataagcgggtgagcgaacgagaagcagccctggaagagacacatcgcctgctgcagcagttcccccttgatttggagaaattcctggcatggctgacagaggcggaaacgactgctaatgtcctgcaagacgccaccagaaaagaacggctgttagaagatagcaaaggagtcaaagaactcatgaagcaatggcaggatctgcaaggcgagattgaggctcatactgatgtctaccataacctcgatgagaactcccagaagattctccgcagtctggaaggatccgacgatgcggttctgctgcagcgccgcctggacaatatgaacttcaagtggtccgagttgcggaaaaagagcctgaacattcgctcacatctcgaagctagttctgaccagtggaagcgcctgcacctgtcactgcaggagctgctcgtgtggctgcaactgaaagatgatgaactctcacggcaggctccaattggcggggatttccccgccgtgcaaaaacagaatgacgtccacagagcgttcaagcgcgagctcaagaccaaagagcctgtgattatgagtaccctggaaacagttcggatttttctcactgaacagccattggagggccttgagaaactctaccaagagccacgggagctgccaccagaagagcgggcccagaatgttactcgcttactccgcaaacaggcagaagaagtgaatacagaatgggagaaactgaatctccactccgccgactggcagaggaagatagacgaaacactcgagaggttacgggaactgcaggaagctaccgatgagctggacctgaagcttaggcaggctgaggttataaaaggatcttggcagcctgtcggcgacctcctgatagacagtctgcaagaccacttagagaaggttaaggccctgcgtggggagattgccccgttgaaagagaatgtgtcacatgttaacgatctggcccgtcagctaacaacacttggcatccaactgagtccatacaacctctcgacactcgaggatctcaacaccagatggaagctactgcaggtggctgtcgaggatcgcgtgcgccaactgcacgaggctcacagagatttcggcccagcttcccaacactttctgagtactagtgttcaaggcccctgggagagagccatttcccctaataaggtcccttattacattaaccacgaaacgcaaacaacatgctgggatcaccccaagatgaccgagttgtaccagagtcttgctgacctgaacaacgtgcgttttagcgcctatcgtaccgccatgaagctaagacgattacagaaagccctctgcttagacctgctgtccctttcagcagcctgtgacgcactggaccaacataacctcaagcagaacgaccagccaatggacattctgcaaattattaattgcctaaccactatctacgaccggctggagcaggagcataacaacctggtgaacgttcccctgtgtgtcgatatgtgccttaattggctgctgaacgtgtatgatacaggccgcactggcagaatccgtgttctctcctttaagacagggatcatttccttgtgcaaagcccatctcgaggacaagtataggtacttatttaaacaggtggcttcttcgactggcttttgtgaccaacgcagactgggattactcctgcacgactccatccaaattccgagacaactgggggaggtggccagctttggcggctctaatatagaaccttcagtgcgatcttgcttccaattcgccaataacaagcccgaaatagaggccgcgctgttccttgattggatgcgtttggagccgcagagtatggtgtggctgcctgtcctccaccgagtcgctgctgccgagaccgcgaagcatcaggccaagtgtaacatttgtaaagagtgccccatcatcgggtttcgataccgcagcctgaaacactttaactatgacatttgccagagttgctttttctcaggtcgcgttgctaaggggcacaaaatgcattatcccatggttgaatactgcacccccacgacgagcggtgaggacgtccgtgactttgccaaagtcttgaagaacaagttccgcaccaagagatattttgcaaaacatcctagaatgggttatctgcccgttcagacagtgctagagggagataacatggaaacacctgccagcagtcctcaactgagccatgacgacacacactcccgcattgaacattacgcaagtcgcctagcggagatggagaactccaacggtagctacctgaacgattcaatcagccctaacgagagcattgacgatgaacacctgttgatacagcactattgccaaagcttgaaccaggactcccctctgtcacaacccagatctccagcccagatattgataagccttgaatccgaggagaggggcgaattggaaagaattctcgctgacttggaggaggaaaatcgaaacctccaggccgagtacgaccgtttaaagcagcagcacgagcataaaggactctcacccctgccgagccctccagagatgatgcctacatccccccagtccccaagggacgcagagcttattgctgaagcaaagctacttcggcagcataagggtcgcctggaggcccgaatgcagattcttgaggatcacaacaaacagctggaaagtcagctccataggttgagacagctacttgagcaaccccaggcggaggccaaggtcaatggcaccacagtatctagcccatctactagtctgcaacggtctgacagcagtcagcccatgttgctccgcgtggtcggaagccagactagtgactcaatgggggaggaggatctgttgtcaccaccccaggatacctctaccgggctcgaagaggttatggagcaactgaacaactccttcccctcctctagggggcacaacgtgggctccctgtttcacatggctgacgatctgggccgcgccatggaatctcttgtcagtgtgatgacagatgaggagggcgctgaatag

SEQ ID NO: 115389 - DNA, 1869 bp, Artificial Sequence
  Description of Artificial Sequence: Synthetic coding sequence
atgcgggagcagctgaagggtcacgagactcaaacaacgtgttgggatcacccaaagatgactgagttgtaccagagtcttgcggatctcaacaacgtgcgattttcagcctataggactgctatgaaactgagacgcttacagaaagccctgtgcctggacctcttatctttgagcgctgcttgtgacgctctcgaccaacacaatctaaaacaaaacgaccagcccatggatattctgcagatcatcaactgtctgacaaccatatatgaccggttggagcaggagcataacaacctggtcaatgttccgctgtgcgtcgacatgtgtttgaattggctcttgaatgtgtacgacaccggtcggacaggacgcattcgggttctctcttttaagacaggcattatctctttgtgcaaggcgcacttggaggacaaataccggtacctctttaaacaggtggcttcttctactggcttctgcgatcagcggaggttgggcctgctgctgcatgacagtattcagatccctcgacagctaggggaagtagcatcattcgggggcagtaacatcgagccttctgtgaggagctgcttccagttcgccaataacaagcccgagattgaggccgctctgttcctggactggatgcggcttgagccccagtcaatggtttggctcccagttctccatcgcgttgccgccgcagagacggctaagcaccaagcaaagtgcaatatctgtaaagaatgcccaatcatcggatttagatacagatcgctcaagcacttcaattacgatatctgtcaatcctgcttcttttcaggtagggttgccaaaggccataagatgcactaccctatggtagaatattgcacccccaccacgtctggagaagacgtgagggacttcgccaaagttctgaaaaacaaatttcgaaccaagcgttattttgccaagcacccccgtatgggctaccttcccgtccagaccgtgctggaaggtgataatatggagaccccagcatcatcaccccagctttcccacgacgacactcatagccgaatagagcactacgcctctaggttggccgagatggaaaactccaacggatcttatcttaacgactccatttcgccaaacgagagcatcgatgacgaacatttgctgattcagcactactgccaatccttgaatcaggactccccactctcgcagcccagatcgcctgcccaaattctgatctcattggaatctgaggaacgtggcgagttggaacgaattttggcagacttagaggaagagaacaggaatctgcaggccgagtatgatcggctaaagcagcagcatgagcataagggcctaagtcccttacctagcccccccgagatgatgccgacttccccccagtctccacgggatgccgaattgatcgccgaggctaaactacttagacagcataaggggcggctggaggcccggatgcagatccttgaggaccacaacaagcagctggaaagccagttgcatagactcagacaactcctcgagcaaccacaagctgaggctaaggtgaatggtactacagtgtctagcccatctaccagcctacagaggagcgacagtagccagccgatgctcctgcgcgttgtgggctcccaaacttccgattccatgggtgaggaagatctgctctcaccacctcaggatacctccacggggctggaggaagtgatggaacagctgaataattccttccctagcagtcgtgggcacaacgtgggaagtcttttccacatggctgatgatctgggacgagctatggaatctttggtgtctgtgatgaccgacgaggagggggccgagtag

SEQ ID NO: 115390 - DNA, 11046 bp, Artificial Sequence
  Description of Artificial Sequence: Synthetic coding sequence
atgagtgaagtaagctctgacgagcgggaggacgtccagaaaaagactttcacaaagtgggtaaatgcccagtttagcaaatttggaaaacagcacattgaaaatctgtttagtgatcttcaggacggccggagactcttagacctcctggaaggacttaccgggcaaaaactgccgaaggagaagggctccacgagagtccacgccctgaacaatgtgaacaaggcactgcgggtcctgcagaataataatgtggatcttgtgaacatcggcagcacagacattgtcgatggcaaccacaaattaacactcggactgatttggaatatcatcctgcattggcaggttaagaatgtaatgaaaaatataatggcaggcctccagcagacaaatagcgaaaaaattctgctgagctgggttcggcaaagcacacggaattacccgcaagtaaatgtcataaattttactacctcttggagtgacggcctcgctctgaacgccctgattcacagccatcggccagacttgttcgactggaactccgtggtatgtcagcagagtgcgactcagcgactggagcatgccttcaacattgcaagataccagctgggcatcgagaaattgttggatcccgaggacgtagacacaacatacccagacaagaaatcgatactcatgtacataactagcctgttccaagtgctgcctcaacaggtgagcattgaggccattcaggaggtggaaatgctacctcgtcccccaaaggtgaccaaagaggagcatttccagttgcatcatcagatgcattactctcagcagattacagtttcactggcccagggctacgaacggacgtcttctcccaagccacgcttcaagagctacgcatacactcaggccgcttacgtgacaacttctgaccccacgcggtctccctttcccagccagcatctagaggctccagaagataagagctttgggagcagtctgatggagtccgaagttaacctggatagataccagaccgccttagaagaagtactctcttggttactgtcggccgaagacactctgcaagctcaaggagagatctctaacgacgtcgaagtcgttaaggatcagttccacactcacgaagggtacatgatggacttaacagctcaccaaggccgggtgggtaatatcctacagttggggtcgaaactcatagggacagggaaactaagtgaggatgaagaaaccgaagtgcaggagcaaatgaacttattgaactctcgttgggagtgtttgagagttgcgagcatggagaaacaatcgaacctccatcgggtactgatggatttacaaaaccaaaaactgaaagaactgaatgattggttgactaagacggaggaaagaactaggaaaatggaagaagaacctttggggcccgacctagaggacctaaagcggcaggtacagcaacataaggtgctgcaggaggatctagagcaagagcaagttagggtaaacagtctcacacacatggtggtggtcgtagatgaaagcagtggcgaccatgctaccgccgccttggaggagcaactgaaagtgttgggggataggtgggcaaatatctgtcggtggactgaggaccgctgggtgttgttacaggatatcctgctaaagtggcagaggctcacagaagagcagtgcctgtttagtgcttggctgagtgaaaaagaagatgcagtgaacaagatccacaccaccggatttaaggaccagaacgaaatgctgtcgtctcttcagaaactcgccgtccttaaggcagatcttgaaaagaagaaacaatccatggggaagctgtacagcctgaaacaagacttgctatcgacactaaagaataaatccgtcactcagaagacagaagcctggctcgataattttgccagatgttgggataacctcgtccagaaactggaaaaatccacggcccagatttctcaagccgtgaccacaactcagcctagccttactcaaaccaccgtgatggagaccgtgaccactgttacaactagagaacagatactggtgaagcacgctcaggaggagttgcccccaccacctccgcaaaagaaacggcagattacagtagacagcgagattaggaagcgcctggacgtggatatcactgaactgcattcttggattacaaggtccgaagccgtcctgcaatcgccagagttcgctatcttccgaaaagagggcaatttctctgacctgaaagaaaaagtgaatgccattgagagagagaaagctgagaagtttaggaaacttcaggacgcatcaagatccgcccaagccctcgtagaacagatggttaacgagggggtaaatgccgactctattaaacaggcatccgaacagctgaactcccggtggattgagttttgtcagctgctgagcgagcgccttaactggcttgagtatcaaaataacatcatcgcattttacaaccagctacagcagctcgagcagatgaccacgactgcggagaattggctgaaaattcaacccacgacacccagtgagcctacagccataaagtctcagctcaaaatttgtaaggatgaggttaaccgcctgtcagatcttcagccccaaattgagcgcctgaagatccagtctatcgcgctcaaagaaaaaggacaggggcccatgttcctggacgccgactttgttgcatttacaaatcacttcaagcaggtgtttagcgatgtgcaggcccgggaaaaggagttacagaccatatttgatacactgccccccatgcgttatcaggaaactatgtctgctatccgtacctgggtgcagcagtcagaaaccaaattatcaattcctcagctcagcgtaactgattatgagataatggagcagagactcggcgaactgcaggccctgcaatcaagcctgcaggaacagcagtccggactatattacctgtcaaccacggtgaaggaaatgtctaagaaggccccatccgaaatctcacggaagtatcagagtgagtttgaagagatcgagggaaggtggaagaagctctcttcccagttggttgagcattgtcagaagcttgaggaacaaatgaacaagctgcggaagattcagaaccacatccaaaccttgaagaaatggatggccgaggttgacgtcttccttaaagaagaatggccagccctgggcgattctgagattctaaaaaagcagctgaagcagtgtagactgctggtgtctgatattcaaactatccagccgagcctgaattctgtgaacgaaggaggccagaagatcaaaaacgaagcagaacccgaattcgccagcaggctcgagaccgagctcaaggagctaaacacccagtgggaccacatgtgtcaacaggtctacgcccgcaaagaggccctgaaaggcggactggaaaaaacagtgagcttgcagaaagatctgagcgagatgcatgagtggatgactcaggccgaggaggagtatttagagcgggactttgaatataaaactccggatgaactccagaaggctgttgaggagatgaaacgagctaaagaggaggctcaacagaaggaggcgaaggttaagcttctgactgagagtgtgaactctgtgatcgctcaggctccacccgtggcacaggaggcgctgaaaaaagagctggaaacactgactaccaactatcagtggctctgtacacgcttgaacggcaagtgtaaaaccctggaagaagtttgggcgtgttggcatgagctcctaagttacctagaaaaagctaataagtggttgaatgaggtggagttcaagctcaaaactaccgagaatatcccaggcggcgccgaagagatttccgaggtgttggattcactcgagaacctgatgcggcacagcgaggacaatcccaatcagattcgtattctggcacagacattgacagatggaggcgtcatggatgagcttatcaatgaggaattagagacttttaacagccggtggcgtgaactccatgaagaagctgtgagaagacagaaactgctcgagcagtccatccaatcggcccaagaaacagagaaaagcttacatctgattcaggaatccctaaccttcatcgacaaacaattggctgcctatatcgccgacaaggtcgatgctgctcaaatgccccaggaggcacagaaaatccaaagcgatctcacatctcatgagatctcgctcgaagagatgaaaaaacacaatcagggcaaggaggctgcccagagagttctgtcgcagatcgacgtcgctcagaagaaattgcaggatgttagcatgaagtttcgactgttccagaagccagctaacttcgagcaaagattgcaggaatcaaagatgattctggatgaagtaaaaatgcatctgcccgccctggagacaaagtccgtggagcaggaggtcgtacagtctcaattgaaccactgcgtcaatctgtataagtctttatccgaggtaaaaagcgaggtcgagatggtgattaagacgggcagacagatcgtacagaaaaaacagaccgagaatccaaaagaactcgacgaaagagtcacggccttgaagctacattataatgagctgggggccaaggtgaccgaacgtaaacagcagttagaaaagtgtcttaagcttagtaggaaaatgcgaaaggaaatgaatgtgcttaccgaatggctcgccgccaccgatatggagctgacgaaacgaagcgctgtcgaaggcatgccttctaatctggactcagaggtggcctgggggaaagcaacacaaaaggagattgagaaacaaaaagtccacctgaagagcatcacagaggtgggcgaagctctgaaaaccgtactggggaagaaggagacactggttgaagataaactgtctctgctgaacagcaattggattgccgtgacctccagagcagaggagtggttaaatcttttactcgaataccagaagcacatggagacctttgatcagaatgtggaccacattaccaagtggattattcaggccgataccttactggacgagtccgaaaaaaagaagccccaacagaaagaagacgttttaaagcgcctcaaggccgaactgaatgacattaggccaaaagttgattccaccagagaccaggccgctaatctgatggccaatcggggggatcattgcaggaagttggtggaaccccagatcagcgagctgaaccatcggtttgctgccatcagtcaccgcattaaaacagggaaggcctccatccctctgaaagaactggagcaattcaactccgacattcagaaattgctggaaccgctggaagccgaaatccagcagggtgtgaacttgaaggaggaagattttaacaaggatatgaacgaggataacgagggaacagtgaaagagttactgcaaagaggggataatctgcagcagaggatcacagacgagcggaaacgcgaagagatcaagatcaaacagcagctgttacaaaccaagcacaacgccctaaaagatctgcgctcccagcgccggaaaaaggcactggagatctctcatcagtggtaccagtacaagcgccaggctgatgatctcctcaagtgtctggatgatatcgaaaaaaagctcgcttcacttcctgaacctcgtgatgagcggaaaattaaggagatcgaccgggaactccagaagaaaaaagaggagcttaatgccgtcagacgtcaagcggaaggcctaagcgaggatggggccgccatggccgtggagcctacacaaattcagctctcgaagcggtggagggaaatcgagtctaaatttgcacaattcaggaggctgaatttcgcccagatccacactgtccgcgaggagacgatgatggtgatgactgaagatatgccactggaaatatcgtacgtgccctccacttatttgacagaaatcacacatgtgtcccaggcactcctggaggtggaacaactcttaaatgcgcctgacctgtgcgctaaggattttgaggatttattcaaacaggaggaatccttaaagaacattaaggactccctacagcagagcagtgggaggatagatataatccacagcaaaaaaactgccgcgcttcagtccgccactcccgtcgagcgggtgaagcttcaggaagccctgagccagttggactttcaatgggaaaaggtcaacaagatgtataaggaccgtcaggggcgctttgataggagtgtggagaaatggcggcgattccactacgatatcaagatttttaatcaatggctcaccgaggccgaacaatttctgcgcaaaactcagattcccgagaactgggaacatgcgaaatataagtggtatctgaaggagctgcaggatggaattggtcaacggcagactgtggtgcgtaccttgaatgccaccggggaggagatcatccaacagtcatctaaaactgatgccagcatccttcaagagaagcttggctctctgaatctgaggtggcaagaggtctgtaagcagctcagcgaccggaagaagcgccttgaagagcagaagaacattctgtctgaattccagagggatttgaatgaatttgtgttatggctcgaggaggcagacaacatcgcctcaatcccccttgagccaggtaaggagcagcagctcaaggaaaaactggaacaggttaagttactggtcgaagagttacctctaaggcagggtatcctcaaacagctaaatgagacaggcgggcctgtgttggttagcgcccccatctcgccagaagaacaggacaagctcgaaaacaagctcaagcagacgaatctgcagtggataaaagtgtctcgggccctgcctgagaagcaaggcgaaatcgaagcccagataaaggacttagggcaactcgagaaaaagttggaggatctggaggagcagctaaaccatctcctgctgtggctgagccctataagaaatcaattggaaatttataaccagccgaaccaggaagggcctttcgatgtgaaggaaacagagatagccgtccaggcaaaacagccggatgtggaggaaatcctgtcaaagggccagcatctgtacaaggagaaaccggccactcaacccgtaaagcgcaaactggaggacttgagctctgagtggaaagcagtcaataggcttctgcaagagctgcgcgctaaacaacccgacctggcgccaggattgactacaataggcgcaagcccaactcagaccgtgaccttggtaacccagccggtggtcactaaggagacagctattagcaagctagaaatgccttcaagccttatgctagaggtaccggccttggctgattttaatcgcgcatggactgagctaacagactggctctccctcctggaccaagtcattaagtctcagcgcgtgatggtgggagatctcgaggatataaatgaaatgatcatcaagcagaaagccactatgcaagatctagagcagcggcgaccacagctggaggagctcattaccgcagcccagaacttaaaaaacaaaaccagcaaccaggaggctagaacgatcattactgaccgcattgagcggatccagaaccagtgggacgaggtgcaggaacatctgcaaaaccgcaggcagcagctaaatgagatgctgaaggactctacccaatggttagaggccaaggaggaggccgagcaggtgctcggtcaggctcgcgcgaagcttgaaagctggaaagagggaccttatacagttgacgcgatacagaaaaagatcacagagaccaagcagttggccaaggaccttagacagtggcagaccaacgttgacgtggctaatgacctggcacttaagctgttgcgcgactactccgctgacgatacgaggaaagtgcacatgatcactgagaatattaatgctagttggaggtcgattcataagagggtgagtgagagggaagccgccttagaggaaacccaccgcctcctccagcaattccccttagacttagaaaagttcctggcatggctcactgaagccgagacaacagctaacgtgctgcaagacgcgacgcgtaaagagcgtctgttagaggattccaaaggtgtgaaagaactcatgaaacagtggcaagaccttcaaggcgagatcgaggctcatacggatgtataccacaatctcgatgaaaatagccagaaaatactgaggtccctcgaggggagcgacgacgctgtgctgctccagcggcgcttagataacatgaactttaaatggtcagagcttagaaagaagtctctgaacattagatcacatctcgaggccagtagcgaccaatggaagcgcctgcatctctcactgcaggaacttctcgtgtggctgcagctgaaagacgacgagctgtctaggcaagctcctataggaggagatttcccagccgtacagaagcagaacgacgtgcatcgcgccttcaaaagagagcttaagactaaagagcccgtgataatgagtaccttggaaaccgtgaggatctttctcacagagcagccgcttgagggcctcgaaaaattgtaccaggaaccccgcgagttaccccctgaggagagagctcagaacgtaacaagactcctgaggaagcaggctgaagaggtcaatactgaatgggagaagctgaatcttcattcggccgattggcagaggaagattgacgagacattagagagacttagggaactgcaggaggccacagacgagttggacctgaaactgcggcaggcagaagtaattaaggggtcctggcagccagttggggatctgctcatagactccctccaggaccacctggaaaaagtcaaagccctgcgtggcgaaatcgcccccctgaaagagaatgtcagccacgtgaatgacctcgcaaggcaactcacaacgctagggattcaactgtcaccatataacctgtccactcttgaagatctgaatactcggtggaaactcttgcaggtcgccgttgaagatagagtgcggcagcttcacgaggcgcaccgggacttcgggcctgcaagccagcattttctatccacatccgtccaagggccgtgggagagagctatctcccctaacaaagtcccatactacattaaccatgaaacccaaacaacctgttgggaccatccaaagatgacggagctgtatcagagcctcgcggacctgaacaacgtcaggttttccgcctaccggaccgcgatgaaactgcgcagactgcagaaagcactgtgcttggacctcttatcacttagcgcagcttgcgatgccctcgaccagcataaccttaaacagaacgaccagcctatggatatcctgcaaatcatcaattgcttaactacaatttatgaccggctggaacaggagcataacaacttggtgaacgtgcccttatgtgtagatatgtgtttgaactggttgctcaacgtctatgacacaggacgaactggacggataagagttctttcgttcaagaccggaatcatcagcttgtgcaaggctcatctcgaggacaagtataggtaccttttcaaacaggttgcctcttcaacggggttctgcgaccagaggcgcttaggcctgctgctccacgattctatccaaattccccggcagttgggtgaagtcgcctctttcggcggaagcaatatcgagcccagtgtaaggtcatgttttcagttcgccaacaacaaaccagaaatcgaagcggccctgttcttggattggatgcgtttggagccgcagtctatggtgtggctaccagtcctccatcgggtggcagctgctgaaaccgcaaaacaccaagctaagtgcaacatctgcaaagagtgcccaatcattggattccgttatcggtcacttaagcattttaactacgacatttgccagagctgcttcttttcaggccgagttgccaagggccacaagatgcactatcctatggtagagtactgtacaccaacaacctccggagaggacgtaagggactttgcgaaggtgcttaagaacaaattccgcaccaaacggtacttcgccaaacacccccgtatggggtacttgccagtgcaaacagtgctggagggtgacaacatggaaaccccagtgactctgatcaacttctggccagtcgacagtgcgcccgcatccagtcctcagctgtcccatgacgacacgcactcccgcatcgagcactacgcatcaagacttgccgaaatggagaattctaacggttcctaccttaatgattccatcagtcctaacgaatccattgacgacgaacacctgctgatccaacactattgccagtccttgaaccaggatagtccattaagccagccacgttcccctgctcaaatcttgataagtctagaatctgaagagcgcggagagctggaacgcatccttgctgatctggaagaagaaaatcgcaatttacaggctgaatatgatcgacttaagcaacagcacgaacataagggtctcagtcctttgccttcacctcccgaaatgatgcctactagcccacagtcaccacgcgacgccgagttgattgccgaagccaaacttctgcgtcagcataaaggtcgtttagaagcccggatgcagatacttgaggatcataacaagcagctcgagtctcaactgcaccgactgaggcaactcctggagcagccgcaggccgaagccaaagtaaatggtaccacggtcagcagccctagcacaagtctgcaacggtccgactcatctcagccaatgctgctccgcgtggtcggaagtcagacttcagattccatgggggaggaggatctcttgagtccgcctcaggatacgagtacagggctcgaagaggtgatggagcagctgaataactcttttccatctagcaggggccgaaatactcccgggaagcctatgcgcgaagataccatgtag

SEQ ID NO: 115391 - DNA, 7035 bp, Artificial Sequence
  Description of Artificial Sequence: Synthetic coding sequence
atgacggagatgatactgctgattttcttcccggcgtacttcttgaacgcagtgcggcgccagaagctgctcgaacagagtatccagagtgcacaggaaacagagaaatcgctgcatctgattcaggagagtctcaccttcattgacaaacagttggctgcctacatcgccgacaaagttgacgctgctcagatgccacaggaggcccagaagattcaaagtgatttaacttcccacgagatctccctcgaggaaatgaagaagcacaatcagggcaaggaggccgcacagagagtgctgtcccagattgacgtcgcccaaaagaaactgcaggatgtcagtatgaagttccgtctgtttcagaaacccgccaatttcgaacagagattacaggagtcaaagatgatcttagatgaggtaaagatgcacctgccagccctggaaaccaagtccgtggagcaggaagtggtgcaatcccagctcaatcattgcgtgaatctctacaagagtctgtctgaggtgaaaagcgaagtagagatggtcatcaagacggggagacaaattgtccaaaaaaagcaaaccgagaacccaaaagagctggacgaaagagtaacagcgctcaaactacactacaatgaacttggcgccaaggtaactgagaggaaacagcagctggagaagtgcctgaagctgagccgaaagatgagaaaggagatgaacgtactgacagagtggctggcagcaactgacatggaacttaccaagcgaagcgccgttgaaggtatgccgtctaatctggatagcgaggtcgcttggggcaaggctacacagaaggagatcgaaaaacagaaagtgcatctcaaatccatcaccgaggtcggtgaggccctcaagacagtgttgggaaaaaaagagactctggtggaggataagttatccctgctgaattccaattggatcgccgttacttccagggctgaagagtggttaaacctcttgttggaataccagaagcacatggaaacatttgaccagaatgtggaccatatcaccaagtggatcattcaggctgacaccttgctcgatgagtctgagaagaagaagccgcagcagaaggaggacgtgctcaaaagactcaaggcagagctgaacgacatcagacctaaggtagacagtacgagggaccaagcagccaacctgatggctaaccgaggggaccattgtcggaagctggtggaaccacagattagtgaattgaatcatcggttcgctgcgatttctcatcgcattaaaactggcaaggctagcattccgctgaaggaactggagcagtttaatagcgatatccagaagcttttagagccactggaggcggaaatccagcagggagtaaacttgaaggaggaagatttcaataaggatatgaacgaggacaatgagggaactgtaaaggaactgctgcaacgtggcgataacttacagcaaagaataacagacgaaaggaagagggaggagataaaaatcaaacaacaactactacagaccaagcacaacgctctgaaggaccttaggtcacagcgtcggaagaaggccctagagatttcgcatcagtggtatcagtataaaagacaggctgacgatcttttgaagtgcctggacgatatagagaagaagctcgcaagcttgccagaaccccgcgatgaaagaaaaatcaaggaaattgatagggaactgcagaaaaagaaggaggagctgaacgccgtacggcggcaagctgagggcctctctgaagatggcgcagctatggccgttgagcctacgcagattcaattaagcaagcgctggcgcgagatcgagagcaaattcgcacaatttcgccgccttaatttcgcccaaatccatacagtgagggaagagacaatgatggttatgaccgaggatatgcccttggaaattagctacgttccgtccacttacctcaccgaaattacacacgtgtctcaggccctccttgaagttgagcagctattgaacgccccagatctctgtgcaaaggactttgaggacttgtttaaacaggaggaatcactgaaaaacatcaaggattctctgcagcagtcctcgggaaggatcgacatcattcactcgaagaagaccgcagcattgcagtcagcgacaccagtggagagggtcaagctccaagaggcactgagccagctcgatttccagtgggagaaggtgaacaaaatgtataaagatcggcaaggtcgatttgatcggtccgtggaaaagtggaggcgtttccactatgatataaaaatctttaaccagtggctgaccgaagccgagcagtttttacgcaagacgcagatccctgaaaactgggagcacgctaaatataagtggtatctgaaggaactacaggacggcatcggccagcgtcagacggttgtgcgcactttgaatgccacaggcgaggaaatcattcagcagtcttctaagacagatgcatccatcctgcaggagaaactggggtcccttaatctgcgctggcaggaggtttgcaagcagctgagtgatcggaaaaaaaggttagaagagcaaaagaacatcctttcagaatttcagagagacctgaacgaattcgtcttgtggctagaggaagccgacaacatcgcctccattccactggagccaggcaaagagcagcaacttaaggagaagcttgaacaggtgaagctcctggtggaggagctgcccctcagacaagggattcttaagcagctcaatgagacgggaggtcctgttttagtatctgcccctattagtccagaggagcaggataagttggagaataagttgaagcagaccaatctgcagtggatcaaagtgtcacgtgccttgcctgagaaacaaggcgagattgaggcacagataaaggacctgggccagttggaaaagaagctcgaggacctggaggaacaacttaatcatctgctgctgtggctgtcaccaatccgaaaccagcttgagatttacaatcagcctaaccaagaggggccctttgacgtgaaggaaactgagatcgccgtgcaggccaaacaaccagacgtggaagagatcctgtccaagggtcagcacctttacaaagaaaaacctgccacccagccagtgaaacgaaaacttgaggatttgagcagcgagtggaaggcagtaaaccgactcctgcaggaactccgcgccaaacagccagatctggccccaggtcttacaacaattggagcgagcccaactcaaaccgtgacgcttgtgactcagccagttgttaccaaagagaccgccatatcgaaactagagatgccgtcaagcttgatgctggaagtgccagcacttgcagactttaatcgcgcctggactgagctgacagactggctgtcactgctagaccaggtgattaagtcccagcgcgttatggttggcgacctggaagatataaatgagatgattattaaacaaaaagccactatgcaggacctggaacagagacgccctcagctcgaggaacttataactgctgcgcagaatttaaagaacaagacgtcaaatcaggaggcccgtacgatcatcactgaccgaatagagcgtatccagaatcagtgggatgaggtgcaggagcatcttcagaatagacgccagcagttgaacgagatgcttaaggattcaacgcagtggctggaagcaaaggaggaggcggaacaggtgctgggccaggctagagccaagctcgagtcatggaaagagggcccttatacggtcgacgcaatccagaaaaagattaccgaaaccaagcagctggcaaaggatttgcggcagtggcagacgaatgtggatgttgctaacgatttggccctgaagctcctgagggattacagcgccgacgatacacgtaaagtgcacatgatcacggagaatatcaacgcctcttggagatctatccacaagagggtatccgaacgcgaagctgccttggaggagacccaccggctccttcagcagttccctttggatttggagaagttcttagcctggctcaccgaggcagagacaacagccaacgttttgcaggatgcgactaggaaggagcggcttcttgaggactctaaaggagtaaaggagctgatgaagcagtggcaagaccttcagggggagattgaggcccatacagatgtctatcacaatcttgacgagaattcccagaaaattttgcgctctctggagggctcagacgatgcggtgctacttcagagaaggctcgacaatatgaatttcaaatggagcgaactacgaaaaaagtcactgaacattcgctctcacttagaagcaagttccgaccagtggaagcgactccacctcagcttgcaggaactgctggtgtggttgcagttgaaagacgatgaactgtcacgccaggcaccaattggaggtgacttccccgcagtccaaaagcagaacgacgtccatagggcttttaagagggagctgaagactaaagaacctgtgatcatgagtactctggaaactgtgcgaatattcttgacagagcagcccctggagggcctagagaagttgtatcaggagcctagagagttgccaccagaggagagagcccagaacgtcacacgccttctgcggaagcaggctgaggaagtgaacactgaatgggagaaactgaaccttcacagtgccgattggcagcgaaaaattgacgagaccctcgagagactccgcgagctgcaagaggcaacggacgaattagatctgaagctgcgccaggccgaagtgatcaagggaagctggcagccagtcggtgatctgcttattgattccctccaagaccaccttgagaaagtgaaggccttgcgaggggaaatcgcaccgctgaaagaaaatgtgagccatgtgaatgacctggcaagacagctgacaacactggggatccagctgtcaccatataacctatctacacttgaagatctgaacacccgctggaagctgctgcaggtggctgtggaggatcgcgtccggcagcttcacgaagcacatagagactttggccccgcaagtcagcactttttatctacctcagtccaagggccgtgggagcgcgctattagccccaacaaggtgccatattatattaatcatgaaacccagacaacgtgctgggaccacccgaagatgactgagctctatcagtcactggccgacctaaacaacgtgcgattctcagcttatagaaccgccatgaagctaaggaggcttcagaaagccctgtgcttagatctcctgtcccttagtgctgcatgcgacgcgctggaccagcacaacttgaaacagaacgatcaacctatggacatcctccagattatcaactgccttaccaccatatacgatagactggagcaggaacacaacaaccttgtgaatgtgcctttgtgcgtggatatgtgtctcaactggctgctcaacgtttacgatacaggtagaacaggacgcatccgggtgctgtccttcaagaccggtatcatatctctgtgtaaggctcatctggaagacaaataccgctatctattcaaacaagttgctagctccacagggttttgtgatcagagaagactggggctcctgttgcatgacagtattcagatacccaggcagctgggtgaggtggcttctttcggcgggtccaacatcgagccttcagtgaggtcctgctttcagtttgcgaacaacaagcctgagatagaggcagccctgtttcttgactggatgcggctggagcctcaaagcatggtttggctccccgtgctgcatcgcgtggccgccgccgaaaccgccaaacatcaggccaagtgtaatatatgtaaggagtgcccaattattggctttcgctatcgttcactcaagcatttcaattatgacatctgtcagtcctgcttcttcagcggccgcgttgccaaaggtcacaaaatgcactatcccatggtcgaatactgcacacccaccactagcggcgaggatgtgcgcgactttgctaaggtcttgaaaaacaaatttcggaccaaacggtatttcgccaagcacccacgaatgggctacctgccagtacagacagtgctcgaaggcgataatatggagacacctgtgacactgatcaatttctggccagtggatagtgcccctgcctcatcaccacagctgagccacgacgatacacactccagaatagaacattatgccagtaggctcgctgagatggagaactcaaacggctcttacttaaatgattccatatcacctaacgaaagcatcgacgacgagcacttactgatacagcattactgccagtccctcaatcaagacagtcccctatcacagccgcgtagccctgcccagatcctgatatcactagagtccgaggagaggggggagttggagcggatcctggcagacttggaggaggagaacagaaacctacaagccgagtacgacagactcaaacagcaacacgagcacaagggcctatcgcccttgccgagtccccctgaaatgatgccaacatctcctcagagcccacgggatgccgagctgatcgcagaggctaaacttctgcggcagcataagggtagactggaagcccgtatgcagatcctagaggatcacaacaaacagctggagagccagctgcatagactgcgtcagctactggaacaaccgcaggcagaggctaaagtcaatggtacaaccgtgtcaagcccctccacgtcactgcaacgcagtgattcctctcaacccatgctgctgcgtgtcgttggttcacagacgagcgactcgatgggggaagaggatctgctcagccctccccaggacacttctaccggactggaagaggtgatggagcagctcaacaacagctttccctccagcaggggccgaaacaccccagggaaaccaatgcgcgaagacaccccttag

SEQ ID NO: 115392 - DNA, 7026 bp, Artificial Sequence
  Description of Artificial Sequence: Synthetic coding sequence
atgtccgcgagaaaactgcggaatctgagctacaagaaggccgtgaggagacagaaattactggagcagtccatccagagcgcccaggaaaccgagaagtctttgcatctgatccaggaaagcttaaccttcatagacaaacagctcgctgcttacattgctgacaaggtcgacgcagcgcaaatgccacaggaggcccagaaaatccaatcagatctgacatcccacgagatcagcctggaggagatgaaaaaacataaccagggcaaagaagctgcacagcgtgtcctgtcccagatcgacgtggcgcagaagaagctacaagatgtgtctatgaagttcagactgttccagaaacctgccaacttcgaacaacgcctgcaggaaagtaaaatgatactcgacgaggttaaaatgcatctaccggcacttgaaacaaagtccgttgagcaggaggttgtgcagtcccagctcaaccactgtgttaacctgtacaaaagcctatcggaggtaaaatctgaggtcgaaatggtgatcaagactggtaggcagattgtccaaaagaaacagacagagaacccaaaggagcttgacgaacgggtgactgcattgaagctgcattataatgagctcggcgcaaaggtcacagagcgcaagcagcagctggagaagtgcctgaaattgagccgaaagatgagaaaagaaatgaacgtactgactgagtggctggccgccaccgacatggaactgactaagcgttccgcagtggaggggatgccctcaaacctggacagtgaggtcgcatggggcaaggcaacacaaaaagagatagaaaagcagaaagtgcacctaaagtccattaccgaggtcggtgaagcccttaagactgtgttaggaaaaaaggagaccctggttgaggacaaactctccttgttaaatagcaattggattgcagtgacctcccgagctgaggagtggctcaacctgctccttgaataccagaaacacatggagacttttgaccagaacgttgatcacattaccaaatggattatccaggcagacaccctgctcgacgagtcggaaaaaaagaaacctcagcagaaggaagacgtcctcaagcgactcaaggcagaattaaatgatatcaggccaaaggttgattccacgcgggaccaggctgcaaacctcatggcaaaccgcggagatcattgccgcaaactcgtggagccccagatatctgagctgaaccatcgcttcgctgctatctctcaccggataaaaacgggtaaagcaagcatccctttgaaggagttagagcaattcaactctgatattcaaaaacttttagaacccttggaggctgagatccagcagggcgtcaatctgaaagaagaagatttcaacaaagatatgaacgaggacaatgagggcactgtaaaggagttgctacaacggggcgataacctccagcaacggatcactgacgagcggaaacgcgaggagattaagattaagcaacagctgctgcagacgaagcacaatgccctgaaagacttgcgatcccagcgacgaaagaaagcacttgagatatcacaccaatggtatcaatacaaaaggcaagcggatgacctgctgaagtgtctggacgacatcgagaagaaactggcttctctcccggagcccagggatgagcggaaaattaaagagatcgaccgagagctccaaaagaagaaggaagagctcaacgctgtgcggcgccaggctgaaggcctgagtgaggatggcgcagccatggcagtcgagcccacccagatccagctgtcgaagcggtggcgggaaatcgagtctaagttcgcacagtttaggagactaaatttcgcccagatccacaccgtgcgagaggagaccatgatggttatgactgaggacatgcctttagagatttcctacgtccctagcacctatctcacagaaattacccacgtaagccaggccctcctcgaggttgagcagctcctcaacgcgccggatctctgcgctaaagacttcgaggatctgttcaaacaagaggagagcctcaaaaatatcaaagacagtctgcagcagtcgtctggtcgaattgatatcatccactccaagaagaccgccgcattgcaatctgcaaccccagtagagcgcgtgaaactgcaggaggctctatcgcagctggatttccagtgggaaaaggtaaataaaatgtataaagatcgacagggacggtttgatcgttcggtagagaagtggagacgcttccactacgacataaagatattcaatcaatggctgaccgaagcggaacagtttcttagaaagactcaaatccccgaaaactgggagcacgcgaagtataaatggtatctaaaggagctacaggacgggattggccagaggcagaccgtggtccgcacattaaatgcaaccggagaggagattattcaacagtcttccaagactgatgcctcaatcttacaggagaagctgggtagtctgaatcttcgatggcaggaggtgtgcaagcagctgtctgaccgtaaaaagcgcctcgaagagcagaaaaatattttaagcgagtttcagagggatctaaacgagttcgtgctgtggctggaagaagcagataacattgcttctataccactggagccaggcaaggagcagcagctgaaggaaaagcttgagcaggttaaattgctggtagaggagcttcccctcaggcagggcatccttaaacagttgaatgagaccggcggcccagtgctcgtctctgcccccattagcccagaagagcaagacaagctcgagaataaattgaagcagactaatctacaatggatcaaagtaagcagagctctaccagaaaagcagggggaaatcgaggcccaaataaaggacttgggccaactggagaaaaaattggaagatcttgaggagcagttaaaccatcttctgctgtggctgagccctatccggaaccaactggagatctacaatcagccaaatcaggaagggccgtttgacgtgaaggaaacagaaattgctgtgcaggccaagcaaccagatgttgaagaaatcttgtcaaagggacagcatttgtacaaggagaaaccagcaacacagccagtgaaacgcaaacttgaagacctttcctccgaatggaaagctgtaaatcgccttcttcaggaattgcgagccaaacaacccgatctcgctcccggcctcactactataggtgctagccccactcagacagtgacgctggtgacacagcctgtggtgactaaggaaactgctattagtaagctagagatgcctagtagccttatgcttgaggtcccagcactggctgattttaaccgggcatggactgagctaacagattggctgagtcttcttgatcaagtgattaagtcccagcgcgttatggtgggagatctagaggacataaatgagatgataataaaacagaaggccacgatgcaagatcttgagcagcggaggccacagctggaagaattaataactgcggctcaaaacttgaaaaataagacctctaatcaagaggcccgaacgattattacggatcgtatagaacggatacagaatcagtgggatgaggtgcaagaacacctccagaacaggaggcagcagctgaatgaaatgctgaaggatagtacccaatggctggaagcaaaagaagaagcggaacaggtgttaggacaggccagagctaagcttgaaagctggaaggaggggccatatactgtggatgccattcaaaagaagattacggagaccaagcagctggcaaaagaccttcgacagtggcaaacaaacgtggacgtggcaaatgacctcgccctgaaacttctgagagactacagcgcagatgacactcgcaaggttcatatgatcaccgagaacattaatgcctcttggcggagtattcacaaaagggtttctgagcgggaggctgcccttgaggagactcaccggcttctgcaacaattcccattggacttggaaaaattcttggcctggctgaccgaggcagaaacaactgctaacgtgttgcaggatgcaactcgcaaagaaagacttctggaagactctaagggcgttaaagaactgatgaagcagtggcaggacctgcagggtgagattgaggctcacacggacgtgtaccacaatctggatgaaaactcacagaagatcctgcgtagtctcgagggctcagatgatgccgttcttctgcagagacgcctcgataacatgaacttcaaatggtctgagctgcggaaaaagtctctcaatattagatcccatctggaggcatctagtgaccagtggaaacgcctgcacctgtctctccaagaactgctggtctggctccaactcaaggatgatgaactatctagacaggccccgattggtggtgacttccctgctgtgcagaaacaaaacgatgtgcaccgggccttcaagagagagctaaagactaaggaaccagtaataatgagcaccctagagactgttcgaattttcctcactgaacagccactcgaagggctggaaaaactttaccaggagcccagggagctgcctccggaggagagagcgcagaatgtaactcggttgctgaggaagcaggccgaggaagtgaataccgagtgggagaagctgaacctccatagcgcagactggcagagaaaaattgatgagacattagagcgcctgcgagaactccaggaggccactgacgagctcgatctcaagctgagacaggccgaagtgattaagggctcctggcagcctgtgggcgacctgctgatagatagcctgcaagatcatctcgagaaggtgaaggctctcaggggcgaaattgctccactgaaagaaaacgttagccatgtaaatgatctcgcccgacaactcacaaccctgggaatccagctgagcccctataacctttcaactttagaggatctgaacacacgttggaagctgctccaggtggctgtggaagatcgcgtgcggcagcttcacgaggctcacagagactttggaccagcctcacagcattttctcagcacatccgtgcagggcccttgggagcgcgccattagccctaacaaagtgccatactatattaaccatgaaactcagaccacctgttgggaccaccctaagatgactgagctttatcagagcctggctgacctcaataacgttcggttctctgcttatcgaactgcgatgaagctgaggagattacagaaagcgctgtgcctggatcttctgtcactttcagcagcttgcgacgccctggaccagcacaatctcaagcagaatgaccaacccatggatattctgcagattattaattgcctgaccacaatatatgaccggttagagcaggagcataataaccttgtgaacgttcccctatgtgtcgatatgtgtctgaactggctgttgaacgtgtacgataccggacgaacgggccggattcgggtgcttagcttcaagaccggcatcatatcactatgcaaggcccacttggaggacaagtaccgctatctctttaaacaggttgcttcatctactggcttctgtgatcaaagaaggctcgggctgctcctacacgattccatccaaatcccccgacagcttggggaagtagccagtttcggggggtctaacattgagcccagtgttcgctcttgcttccaattcgccaacaacaagcccgagatcgaagccgctctgttccttgattggatgcgcctagagccacagagcatggtgtggctccctgtgctccatcgcgtcgccgccgcagagacagcaaaacaccaggctaagtgtaacatctgtaaggagtgccccataatcggatttcgttaccgctcactgaagcattttaattacgacatctgccaaagttgcttttttagtggacgtgtggcgaagggtcacaagatgcattatccaatggttgagtactgtacccccaccacctcaggcgaagacgttagagatttcgcgaaggtgcttaagaacaagttcaggaccaagagatactttgctaagcacccacgtatggggtatctgcccgttcagaccgtgctggaaggtgataatatggagactcccgttacccttataaacttctggccagtggacagcgcacccgcttcatcaccacaattgtcacacgacgacacccattcccggatcgagcattacgcttccagactcgcagagatggaaaatagcaatgggagttacttaaacgacagcatcagtccaaacgaatcgatagacgacgagcacctgcttattcagcattactgccagtcgctgaaccaggatagtccattgtcacagcctcgctcacccgcacaaatcctgattagcctggaaagcgaggagaggggcgaactcgagcgaatcctcgctgatctggaagaggagaacaggaatctgcaagctgagtatgatagacttaagcagcaacacgagcacaagggactcagtccactgccctcaccgccagagatgatgcccacatcgcctcaaagccctagggatgccgaacttatagcggaagccaagctcttgcggcagcataaaggtcgactggaagcccgcatgcagattctcgaggatcataataagcagctggagagtcagctgcatcgactcagacagctgctggagcagccacaggcagaggccaaagttaatggtacaaccgtttcttctccatctacttccctccaaaggagcgactccagccagcctatgctgttgcgcgtcgttgggagccaaacctctgacagcatgggtgaggaagacctgctgagccctcctcaggacacttctacaggtctagaagaagtcatggaacagttgaacaacagctttccctcaagtcgtggccgaaataccccagggaagccaatgagagaagacacaccctag

SEQ ID NO: 115393 - DNA, 1854 bp, Artificial Sequence
  Description of Artificial Sequence: Synthetic coding sequence
atgcgtgaacagcttaagggccacgagacacagaccacatgctgggatcaccctaagatgacagagttgtatcagtccctggcagacctgaacaacgtcaggttctccgcttaccgaacagccatgaagcttcggagactgcagaaagcattatgcctcgacttgttgagcctttccgctgcctgtgatgctctagatcagcataatctgaaacagaacgaccagccgatggacatcctccaaatcataaactgcttaaccaccatctacgacaggctggaacaagagcacaataatttagtcaatgttccactgtgcgtggacatgtgcctgaattggctcttgaatgtgtatgatactggaaggaccggaaggattcgcgtactgtcatttaaaacgggaatcatctcactgtgtaaagcacacctcgaagacaagtaccggtatttattcaaacaagtggcttctagcacaggcttctgcgaccagcgaaggttaggattactgctccatgattcaattcaaatcccgcggcagctcggcgaagttgcgagcttcggcggtagtaacatcgaaccatccgtgagatcttgtttccagtttgctaataataaacccgagatcgaggccgccctcttccttgattggatgcgcttagagcctcaatcgatggtgtggctgcccgtgctccatagagtggctgctgccgaaacagctaagcaccaggcgaagtgcaatatctgcaaagagtgtccaataattggatttcggtatcgctccctaaaacattttaactacgatatttgtcaatcttgtttcttctctggaagggtcgctaagggtcacaaaatgcactacccgatggtggagtactgtacgcccaccaccagcggagaggacgtacgggatttcgcaaaagtgctgaagaataaattccgcacaaaaagatacttcgccaaacaccctagaatgggctacctgcctgtgcagaccgtgttggagggcgacaatatggagacaccagtcactctcatcaatttttggcccgttgacagcgcgccagcttcttccccacaactatctcatgatgacacccatagtagaatcgaacactacgcttcaagactcgcggagatggagaacagcaacggcagctacctcaatgatagcatttcgcctaacgagagtattgacgatgagcaccttcttatccagcattattgtcagtcattaaatcaggattcccccctgtcccagccacgatctccggcccagatcctcatcagcttggaaagcgaagagcgcggagagctcgagagaatcttggccgaccttgaagaagaaaaccgcaacctgcaggcggagtacgaccgattaaaacaacagcacgaacacaaaggcctgtcacccctgccctcccctcctgaaatgatgcccacctccccgcagagcccgagggacgctgagttgatcgctgaggctaaactgcttcgtcaacataaaggtcgcctcgaggcccgtatgcagattctggaggaccacaataagcagctggagtctcagctacatcgcctgaggcagcttctggagcagccacaggccgaagccaaggtgaatggcacaaccgtgtctagcccttccacaagtctacagcgctctgattcctctcaacccatgctgctaagggtggtgggcagtcagacatccgattcaatgggcgaggaagatcttttgagccccccacaggatacctctacgggcctggaagaggtgatggagcagctgaataactcatttccgagttcccgaggacgcaacacccctgggaagcctatgcgagaggatacgatgtag

SEQ ID NO: 115394 - DNA, 3678 bp, Artificial Sequence
  Description of Artificial Sequence: Synthetic coding sequence
atgccctcttccctaatgctggaggttcccgccctggccgacttcaaccgcgcctggactgaacttaccgattggttaagtctattggaccaagtcatcaagtctcagagagtgatggtgggagatctggaggatatcaacgagatgataattaagcagaaagcaacaatgcaggacttggaacaacgcagaccacaattggaggagttaatcaccgcagctcagaacctgaaaaataaaaccagcaatcaggaggcgcgcaccataattactgaccgtattgaacgcatacagaaccagtgggatgaggtgcaagaacacctccagaaccggaggcagcaattaaacgaaatgctgaaagattctacgcagtggctggaggcgaaagaagaagctgagcaggtgctgggtcaggcaagagcaaagttggagtcctggaaagaaggaccttatactgtagacgccatccagaagaaaattactgaaactaagcagctcgctaaggacttgaggcagtggcagactaatgtggatgtggcaaatgacctggctctcaagcttctcagggattattccgccgatgacacacggaaggttcacatgataaccgagaacatcaatgcgtcctggagatcgatccacaagagggtttccgaacgggaggctgcgctggaagaaacccatcgactcctgcaacagttcccacttgacctggagaaattcctcgcttggctgactgaggcagaaactactgcgaacgtcctccaggatgccactcggaaggagcggctcttggaagacagtaagggcgttaaagaactaatgaaacaatggcaagacctgcagggcgagatcgaggcccacacagacgtgtatcacaatcttgatgagaactcacagaagatccttcgttcactggagggcagcgacgatgccgtactgctccagaggcgcttagataacatgaacttcaagtggagcgaactgagaaagaagtcactcaatatccgcagccacctcgaagcatcctccgaccagtggaagagattgcacttatcactccaagaattgcttgtctggttacagcttaaggatgacgagttgagccggcaagcacctatcggaggcgattttcctgccgtacagaagcagaatgacgtccacagggcctttaagagagagctgaagaccaaagagccagtcattatgtcaacactagagacggtgcggatcttcctcactgaacaaccactggagggtctggagaagctgtaccaggagcctcgggagctccctccagaggagcgtgcccaaaacgtcactaggttactgaggaagcaggctgaggaggtgaacaccgaatgggaaaagttgaatctccactccgccgactggcagcgtaagatcgatgaaacgctcgaacgccttcgggagctgcaggaggccaccgatgagttagacttaaagctgcgtcaggctgaagtgataaaggggagctggcagcccgttggggacttattaattgatagcctgcaggaccatctggaaaaagtgaaagctctgaggggggaaatcgctcctctcaaggaaaacgtgagccacgtaaatgacttggcgaggcagctcacgaccctcgggatacagctgtccccttacaacctctcaactctggaagatcttaatacgcgctggaagctgctccaagttgcagtggaggaccgtgtgaggcagctccatgaggctcacagagatttcggccccgcttcacaacactttctgtccacctctgttcaggggccctgggaacgcgcaatcagccccaataaggtgccatattacattaatcacgaaactcagacaacctgttgggaccacccaaaaatgacagagctttatcagagcctggcggacctcaacaacgtgaggttcagcgcttacagaaccgccatgaaattaaggaggttacagaaagcactctgtctggatctcctgtcactaagtgccgcctgtgacgctcttgaccagcacaacctgaagcagaacgaccaacccatggatatcctccaaatcatcaattgcttaacgaccatatatgaccgcctggaacaggagcacaacaacctggtgaatgtccccctgtgcgtcgacatgtgcctcaactggctcctgaacgtttacgacaccggccgcacggggcgcatcagggtattgtctttcaagacgggaatcatctccctgtgcaaggcacatctggaggacaagtatcgttacctctttaagcaggtcgcctcctctaccggtttttgtgaccagcgccggctggggttgcttctgcacgatagcatccaaatcccccgccagctgggcgaagtggcgtcattcggtggcagcaacattgagccgtccgtgagatcctgctttcagttcgcaaataataagccagagattgaggccgctcttttcctcgactggatgcggctggagccccaaagcatggtgtggctgcccgttttgcaccgcgtggctgcggcagagacagctaaacaccaagcaaagtgtaatatctgcaaggaatgccctattattggatttcgctaccgatccctaaaacattttaattatgacatctgccagtcctgttttttcagcggaagagtggcaaagggccacaagatgcactatcctatggtggaatattgcaccccaacaaccagtggtgaggatgtacgggatttcgcgaaagtgctgaagaacaaattcagaacgaagcgctatttcgcaaaacatcccaggatgggttacctgcccgtacagactgtgctcgaaggagacaatatggagacacctgtgactctgatcaacttttggccggtggactcagcccccgcgtcatcaccacagcttagtcatgacgacacacacagccgcattgaacactatgctagccggctggcagaaatggagaactcaaacggctcttaccttaatgactccattagtcccaacgaatctatcgacgacgaacatctgctgatccagcactactgccagtcactcaaccaggattctccactgagccagccaagaagtccggctcagatcctgatctctttagaatcagaagagagaggtgagctcgagcgcatcctagccgacttagaagaggaaaacagaaacctgcaggctgaatacgaccgcctaaagcagcaacatgagcataaaggactgtcaccgttgccgtcacctccagagatgatgcctacttctcctcagtctccccgggacgccgagctcattgccgaagccaagctccttcgccaacataaaggacgcctggaagccagaatgcagatccttgaggatcataacaagcagcttgagtctcagctgcaccgacttagacagctgctagagcagcctcaagctgaggcgaaggtgaacggtacgacagttagttccccatccacctcactgcagcgctctgactcctcccagcctatgttgttgagagtcgtggggtcacagacttcggacagcatgggggaagaggacctgctctcacccccacaggacactagcacaggcctcgaagaggtcatggaacaacttaacaatagtttcccttcgtctaggggccgaaataccccgggaaagcctatgagggaagacactatgtag

SEQ ID NO: 115395 - DNA, 1908 bp, Artificial Sequence
  Description of Artificial Sequence: Synthetic coding sequence
atgcgcgaacagcttaaaggccatgagactcagacaacatgctgggaccaccctaaaatgaccgaattgtatcaaagcctcgccgatctcaataacgtgaggttttccgcctaccgcactgccatgaaactgcggcgcctgcagaaagctctttgtcttgacctgctgtcattgagcgccgcatgtgacgcactggaccaacataatctgaagcagaacgatcaaccaatggacatattacagatcattaattgtctcactactatctacgacaggctggagcaggagcacaacaatctagtgaacgtcccgctgtgcgtcgacatgtgcctcaactggttgctgaacgtgtatgacactggtcggacgggcagaattcgggtgttgagcttcaagaccggcatcatttcactctgcaaggctcacctggaggacaagtatcgttatctgttcaagcaggttgcatccagtaccgggttctgtgatcagcggagattgggtctgcttctccatgatagcatacaaattccccggcagcttggggaggtagcctcattcgggggctcaaatatcgaaccttcagtgagatcttgttttcaatttgcaaataataaaccagaaatcgaggcagctttattcctggactggatgcggcttgagccacagagtatggtgtggctgcccgtgctgcaccgggtggcagccgcggagacggccaaacatcaagccaagtgcaacatctgtaaggaatgccccataataggtttccgctaccgttccctgaaacacttcaactacgacatttgccagtcatgtttctttagcggcagggtggctaagggacataagatgcactatcctatggtggaatattgcactccgaccacatccggtgaggacgttcgagactttgccaaagtgttgaagaataaatttaggaccaaaagatactttgccaaacatcctcggatggggtacctgcccgtccagactgtgctcgagggcgacaacatggagacccccgtgaccctcatcaatttttggccagtggactcggctccagcgagtagtccccagctgagccatgacgatacgcacagccgcatagaacattacgcttctcggctggctgagatggagaactccaatggtagctaccttaacgactccatctccccaaacgagtccatcgatgatgagcacctgctgatacaacactattgtcaatctttgaatcaggactctccactgtcccagccccgaagccccgcccagatactaatatccttggaatcggaagagcggggggagttggagcgaattcttgccgatttagaggaagagaatcggaacctgcaggctgagtacgatagattgaagcagcagcacgagcataaggggctgtctccccttccatcccctccagaaatgatgcccacatctccgcagagccctagggacgctgaattgatcgctgaggcgaagctgctcaggcaacacaaaggacggctcgaagcgagaatgcaaatactcgaggaccataacaaacaattagagtctcaattacacaggcttcgccaactgctggaacaaccgcaggcagaggcaaaagttaacggcactactgtcagcagtccatcgacttcactccagcggagtgacagctcacagcccatgctgctaagggtggtaggtagccagacttctgacagcatgggagaagaggacctactgtctccacctcaggacacgtcaacagggcttgaagaagtgatggagcaactgaacaattcatttcctagcagtcgcggacataacgtgggttcactgttccatatggctgatgatcttggccgcgctatggagtcacttgtgtcggtgatgacagatgaagagggcgccgagtag

SEQ ID NO: 115396 - DNA, 3732 bp, Artificial Sequence
  Description of Artificial Sequence: Synthetic coding sequence
atgccttcaagcctgatgctagaggtccccgctcttgccgacttcaaccgggcatggactgagcttacagactggcttagcctgctggaccaggtgatcaagtctcagagggtgatggtaggagacttggaggacattaatgagatgatcatcaagcaaaaggcaaccatgcaggatttagagcagaggcgaccccagctggaagaactgatcaccgcagcacaaaacctcaaaaataagacttccaaccaagaggcaagaacgattatcaccgaccgtatcgagagaattcaaaatcagtgggacgaggttcaggagcatttgcagaatcggaggcagcagctgaacgagatgctgaaggacagtacacagtggcttgaagccaaggaagaggctgagcaggtgcttggtcaggcgcgtgctaagctggaaagttggaaggagggtccttataccgtcgacgcgatacaaaagaagattaccgagaccaagcagttggctaaggatctgcggcagtggcagacaaacgtggacgtggcaaacgacttggctttaaaactattgcgtgactatagtgccgatgacacccgcaaggtacacatgatcaccgagaatatcaatgcttcgtggaggagcatacacaaaagggtgtccgaacgcgaggctgctttggaagagacccatcgcctgcttcagcaatttcccctggatctagagaagttcctggcttggctcactgaagcggagactacagccaacgtgcttcaggatgctacccggaaggagcgactgctcgaggattccaaaggagtcaaggagttgatgaagcagtggcaggatttacaaggcgagatagaggcacacactgacgtttaccacaaccttgatgagaatagccagaagattctgaggtctctggagggctctgatgatgccgtactgctgcaaaggaggttagacaacatgaacttcaagtggtcagaactaaggaagaaaagtcttaacatacggtcacatctggaagcaagctctgaccaatggaaaagattgcacctgagcctgcaggagctgttagtgtggcttcaactgaaggatgatgaattgagccggcaagcccccattggcggagacttccccgcggtgcagaaacagaacgacgtgcatcgggcttttaagcgggagctcaagaccaaggagccagttatcatgtccaccctcgaaacagtgcgtatctttctgaccgagcagcccctcgaggggcttgagaagttatatcaagaaccccgggaactcccccccgaagaaagagcccagaatgtgacccggctattgagaaaacaggctgaagaggtaaatacagagtgggagaaactgaatctgcattcagctgactggcagaggaaaatcgacgagaccctggaacgcttaagggagttgcaggaggccaccgacgaactcgatctgaagctaaggcaagcggaagttatcaagggctcttggcagcccgtgggagatcttctgatcgactcacttcaagatcacctggagaaggtaaaggcgctccgtggcgaaatcgctccgctcaaggagaatgtgtcacatgtgaacgacctagctcgccagctgactacgctgggcatacaactgtccccatacaatttgtccaccttagaggatttgaataccaggtggaaactccttcaggtggccgtagaagatagagtacgacaactccacgaggcccacagagacttcggtcctgctagtcaacacttcctgtccactagcgtgcagggaccatgggagcgagcaattagccctaataaagtgccttattacattaaccacgagacccaaacgacttgttgggatcatcctaagatgaccgagctgtaccaaagtctagccgatctgaataatgttcggttcagcgcatacaggaccgccatgaaactgcgcaggcttcagaaagctctgtgtctggatttgctgtcattgagtgctgcatgcgatgccctggatcagcataatctgaagcaaaacgatcaaccaatggacatcctgcaaatcataaactgtctgactactatttatgaccgcctggagcaagagcacaacaacctcgttaacgtgccactctgcgtcgacatgtgcctcaactggttgctgaacgtgtacgacacaggcagaacgggtaggatccgcgtactgtcgtttaaaacgggcatcattagtctttgcaaagcccatctagaggataagtatcgctatctgtttaagcaggttgcatcaagcacaggtttctgtgaccagcggaggctcgggcttctcctccatgactctatccagatccccaggcagttaggggaggtagccagcttcgggggaagcaacatcgaaccttctgtgcgcagctgtttccagttcgctaataacaaacccgagatcgaagctgctctgtttttagattggatgagacttgaaccacagagcatggtttggctgcccgtccttcaccgagtagcagcagcagaaaccgccaaacatcaggctaaatgcaacatttgcaaggagtgccctattatcggctttaggtaccgctccctgaagcactttaattacgatatttgccagagctgtttcttttctggtcgagttgccaagggtcacaaaatgcactatccaatggttgagtactgtactcccaccacgtcaggggaggatgtgagagactttgcaaaagtccttaagaacaagttccggaccaagcgctactttgccaagcacccacggatgggatatctgcccgtgcagacagttcttgaaggggacaatatggagactccagttaccctcatcaatttctggcccgtggactctgcacctgcctctagcccacagctctcccacgacgacacgcattctcgaatcgagcactacgcatccagactcgcggagatggagaatagcaatggaagttatttaaatgatagtatttcccccaacgagtccatcgatgatgagcatctgctgatccaacattactgccagagcctcaaccaggatagcccattatcccagccccgctctccggcccagatactcatcagtctggagtccgaagaacgaggggagttggaacggattctggccgacttggaagaggagaatcgaaaccttcaggctgagtatgatcgattgaagcaacagcacgagcataaaggcctctcgccactgccttcacccccagagatgatgcctacaagtccccagtcgccgcgagacgccgaactgattgcggaggctaagctcttgcgacaacacaaaggacggttggaggccaggatgcaaatattggaggaccacaataagcagctcgagagccaacttcatcggctgcgacagctgctggagcagcctcaggctgaggctaaggtcaatgggactaccgtgagctctccaagcactagcctgcagaggtccgatagctcgcagccaatgctcctgcgcgtggtcggatctcagacctcggactctatgggcgaggaagatctgctttcaccaccccaggatacctccacgggacttgaagaggtaatggagcagctgaataattcttttccttcgtccagaggacacaatgtcgggtcactcttccacatggcagacgatctgggtcgggcaatggaaagtttagtgtctgtgatgacagatgaggaaggagccgaatag

SEQ ID NO: 115397 - DNA, 11034 bp, Artificial Sequence
  Description of Artificial Sequence: Synthetic coding sequence
atactggacgaacgcgaggacgtccaaaaaaaaacttttaccaagtgggtcaatgcgcaatttagcaagtttggaaagcaacacatagaaaacctgtttagcgacctgcaggatggtcgcagactgttggatctgcttgaaggtttgacgggacagaagttacctaaagaaaaagggtccacccgcgtccacgcactgaataacgttaataaggctctcagagtcttgcagaacaacaatgtcgacttagtcaacatcggaagcaccgatattgtcgatggcaaccataagctaactctgggattgatctggaacatcattctgcattggcaggtcaaaaatgtcatgaaaaacatcatggcgggcctccagcagacgaacagcgaaaagatactgttgagctgggttagacaatcgactagaaactatccacaggtcaacgtaatcaactttaccacctcgtggtcagacggcctggccctgaatgctcttatccactcccaccggcccgaccttttcgactggaattccgtcgtgtgccagcagagtgcaacacagcggctggagcacgcctttaacattgctcgctaccaactcggcattgagaagctgctagatcccgaggatgtagataccacgtaccccgataagaagagcatactcatgtacatcaccagcttattccaggttctaccacagcaggttagtattgaagccattcaggaagttgagatgcttccccgtccacccaaggtcactaaggaagaacactttcagctccaccatcagatgcactattctcagcagataacagtcagcctagctcaagggtacgagaggaccagctccccaaaacctcggttcaagagctatgcctacacacaggcagcttatgtgacaacaagtgacccaacccgtagcccctttccatcccagcatctagaagctcctgaagacaagtcgtttggaagttctctcatggaatcagaggtcaatttggaccgataccagaccgcactcgaggaggtattgtcatggttattgtccgccgaagataccctgcaggcccagggagaaattagcaatgacgtggaggtggtgaaagatcagtttcatacgcacgaggggtacatgatggatctgacagctcatcagggccgcgtgggtaacatcctccaattaggatccaaactaatcggcacaggaaaactgtccgaggatgaagagactgaggtccaagaacagatgaatttactgaactcgcggtgggagtgcctgagggtggcgagtatggagaagcaaagcaacttgcaccgagtgttgatggatctgcaaaaccagaagctcaaagagctgaatgattggttaaccaaaactgaggaacggacacgaaaaatggaggaggaacctttaggccccgacctggaagaccttaagagacaggtgcagcaacataaggttttgcaggaagacctggagcaggagcaagtccgtgtgaatagtctgacacatatggtggtggtcgtagatgagagctctggggatcatgccactgccgcacttgaggaacaactgaaagttctcggcgaccgctgggcgaatatctgcaggtggacggaagatcgctgggtcttgcttcaggatattctactcaagtggcagcggctgaccgaggaacagtgtctgttctctgcctggttatcagaaaaagaagatgctgtcaacaaaatccacaccacaggtttcaaggatcaaaacgagatgttgtcgtccctgcagaagttggctgtgctgaaagctgatctagaaaaaaaaaaacagagtatgggaaaactgtactctctgaaacaggatttgctgtctacattgaaaaataagagtgtgacccaaaaaactgaagcctggctcgacaactttgcgcggtgttgggataacctggtgcagaagctggagaaaagtactgcgcagatctcacaggccgtgacaaccactcagcccagtctgacccaaaccacagtgatggagacagttacgactgtgaccacccgggagcagattctggtcaaacacgcgcaggaagagctcccacctccccctcctcagaagaagaggcagattaccgtggacagtgagatccggaagcgtctggatgtggatatcaccgagcttcacagttggattacacggagtgaagcagtgcttcagagtcccgagttcgctattttccgtaaagagggcaatttttccgatctgaaagaaaaggttaatgctattgaacgcgagaaagcagaaaaatttaggaaactccaagatgcttctcgaagcgctcaagccctcgtcgaacaaatggtgaatgaaggggtcaatgcagactcgatcaagcaggcctccgagcagctgaacagtagatggatcgagttctgccagttgctgagtgagagactcaattggttggagtaccagaataacattatagctttctataaccagttacagcagttggagcaaatgacaaccactgccgagaactggttaaagatccagcctacgaccccttccgaacccaccgcaattaagtctcagttaaaaatctgtaaagacgaggtgaatcgtttgagcgacctgcagccccagatcgagcggctgaaaattcagagcattgcactgaaggagaagggtcaagggcccatgtttctggacgctgattttgtagccttcacaaaccatttcaaacaggttttcagcgatgtccaggccagagaaaaagaactccagaccatcttcgatactcttcccccaatgagatatcaagagaccatgagtgccattaggacatgggtgcagcagtctgagacaaagctctccataccacaattgagtgtgaccgactatgagataatggaacaacgcttgggcgagttgcaagcgctgcagtctagcctgcaggagcagcaaagcggactgtactacctcagtacaacagtgaaggagatgagcaagaaagccccatctgaaattagccgaaaatatcagagcgagttcgaggagatcgagggtcggtggaagaaactgagcagtcagctcgtggagcattgtcaaaagctcgaggaacagatgaataagctacgcaagatccaaaatcatatacaaacccttaagaagtggatggcagaagtagatgtcttcttgaaggaagagtggcccgccctgggggattctgaaatactgaaaaagcagctcaaacagtgtcggctccttgtgtctgatattcagactattcagcctagccttaattctgtgaacgaaggcggtcagaagatcaagaacgaagccgagcctgagtttgccagtcggcttgaaacggagttgaaagaactgaacactcaatgggaccacatgtgccagcaggtttacgcacggaaagaggctctgaagggcgggcttgaaaagacggtgagcttgcaaaaagatctgtctgagatgcacgagtggatgacacaggcagaagaagaataccttgagcgcgactttgagtacaaaacccctgatgaactccagaaagcagtggaggaaatgaaaagggcaaaagaagaggcccaacaaaaagaagccaaggtgaagcttctcactgagagcgtgaatagcgtcatcgcccaagcccccccggtggcccaggaagcgctgaagaaagagttggaaacattaacaaccaattatcaatggctctgcactcggcttaatggcaaatgtaagacattggaagaggtctgggcctgctggcatgagctgctcagctatctggaaaaagccaacaaatggcttaatgaagtggagtttaaactgaagactacagagaatatccccgggggcgccgaggaaatctcggaagtcttggactctttggaaaatctgatgcggcactccgaagacaatcctaatcagatcaggattctggcacagacattgacagatggaggcgttatggacgagcttattaatgaagagctggagaccttcaactcccggtggagagaacttcatgaggaggctgtaaggcgccagaaacttttggagcagagcattcaatcagcacaagaaacagaaaaatccctccacttgatacaggagtcattgactttcattgacaagcagctagccgcctatatagccgacaaagtggatgctgcacagatgccccaggaggcccagaagattcagtcagatctaaccagtcatgagatctcactggaagagatgaagaaacacaaccaaggcaaagaagcagctcagagggtgctgagccaaattgatgtcgcccagaagaagctgcaagacgttagcatgaagttccgcttgtttcagaaacctgcgaactttgagcaacggctccaagagtcaaagatgatactagatgaggtgaaaatgcacctcccagccctggagacgaagagtgtggagcaagaagtggtccagagccagttgaaccactgtgtgaacttgtacaagtccctgtccgaggttaagagcgaagtggagatggtaataaagacaggcaggcagattgtccagaaaaagcagaccgaaaacccgaaggaattggacgaacgcgtgactgccctgaagctgcattacaacgagctgggtgcaaaagtgacagaacgcaagcagcagctagagaaatgcctgaagctgtcccggaagatgaggaaagagatgaatgttctcacagaatggctagccgcaaccgacatggagctgaccaaacgatccgccgtagaaggtatgccaagtaatcttgactctgaagttgcctggggcaaggctacgcagaaagagatagagaagcagaaggtccatctgaagtctatcacagaggtgggggaagctctgaaaacagtgcttgggaagaaggaaaccctcgtcgaagataagctgtcgcttttgaactcgaattggattgccgtgacctcaagggcagaagagtggctgaacctgttactggagtatcagaagcatatggaaactttcgatcaaaacgtggatcatatcacaaaatggattattcaggccgatacccttttggacgaatccgaaaagaagaagccccaacagaaggaagacgtcctcaagcgcctgaaggcagaacttaatgatattcgacctaaggttgactcaacacgggatcaagctgcaaatttgatggcaaacagaggcgatcattgtagaaaattggttgagccacagatctccgaactgaaccatcgcttcgccgcaatcagtcatcgcataaaaacgggtaaagcgagcatcccactgaaggagctggagcaattcaattccgacattcaaaaactgttggagcctctcgaagccgagatccaacaaggggtcaatcttaaagaagaggacttcaacaaggacatgaacgaggacaacgaaggtactgtcaaggagctgctccaacgcggggataacctgcaacagcgtattaccgacgagcggaaaagagaagaaatcaagatcaagcagcagttgctccaaaccaagcacaacgccctcaaggacctgaggagccagaggaggaaaaaggcgttagaaatctctcatcagtggtaccagtacaagagacaggctgacgacctgctaaagtgtttggatgacatcgaaaagaaattggccagtctgccagaaccgcgtgatgagcggaagatcaaggaaattgatcgggagctgcagaaaaaaaaggaggagctgaatgcagtgcgaaggcaggcagagggcctctccgaggatggcgcggccatggctgttgaacccacccagatccagctctccaagcggtggcgcgagattgaaagcaaatttgcccagttccgcagattaaattttgcacaaattcacaccgtgagggaagaaactatgatggttatgactgaggacatgcccttggagatctcctatgtcccttccacctatcttactgagattacgcacgtaagccaggcattactggaagttgagcaactgctgaatgccccagatctgtgcgccaaagattttgaagacctatttaagcaagaagagtccctaaagaatattaaggactctcttcagcagagcagcgggaggatcgatattatccacagcaagaaaactgccgccctgcagtcagcaaccccggtcgagcgcgtgaagctgcaggaggcgttgtctcagctcgacttccagtgggaaaaagtcaacaagatgtacaaggaccgccaagggcggttcgaccgttcagtggaaaagtggcgaagattccactacgacattaaaatctttaaccagtggctgaccgaagcggagcagtttcttcgtaaaacacagatccctgaaaactgggagcacgccaaatataaatggtacctgaaagagttacaggacgggattggacagcgacaaaccgtagtgaggactttaaacgctacaggggaggaaattattcagcaatcatccaaaaccgatgcttctattctacaagagaaattgggatcacttaacctgaggtggcaagaggtgtgcaaacagcttagtgatcgcaaaaagcgactggaggagcaaaagaatatcctgtccgaatttcagagggatctgaacgaattcgtcctttggcttgaagaagctgataacatagcctctattccacttgaaccaggtaaggaacagcagctcaaagaaaagctggagcaggtcaagctgctggtggaagagctaccactgaggcaaggaatcttgaagcagttgaatgagactggcggccctgtgctcgtctccgcaccgattagcccggaggaacaggacaagctcgaaaataagcttaaacagaccaatctccagtggattaaagtgagccgggcgctgcctgaaaaacagggcgagatcgaggcccagataaaagacctcgggcaactggagaagaaacttgaggatctcgaggagcagctgaatcatctgctgctttggctttcgcccattcggaatcagctggagatctataaccagcctaaccaggaaggcccttttgacgtgaaagaaactgagattgccgtccaggcaaaacaacccgatgtggaagaaatcctgtcaaaaggtcagcacctatataaggaaaaaccagctacacagcccgtgaagcgtaagttagaggatctctcatctgagtggaaggccgtcaacagactcctgcaggaactgagggctaagcagccagatctcgcaccagggcttacaacgatcggagctagtccaactcagaccgtcacactggtgacacaacctgtcgtgacaaaagaaaccgccatctctaagcttgagatgcccagctccctcatgctggaggtcccagctttggcggattttaaccgagcatggactgaactgactgattggctcagtctgctcgaccaggtcatcaagtcccagcgggtcatggttggagatttggaggatattaacgagatgatcattaagcagaaggccaccatgcaagatctggagcagcgacggccccagctcgaagaactgatcactgcagcccagaatctaaagaataaaactagtaaccaggaagctcgcactattatcacagatcgcatcgagaggatccagaatcagtgggacgaagtgcaggagcacctgcagaaccgtcggcagcagctgaatgagatgctgaaagactctacacaatggttggaggctaaagaagaagctgagcaggtcctgggccaggctcgggctaagctcgagtcttggaaggagggaccctacacggtcgacgccatccagaagaaaatcactgagactaaacagctcgccaaagatttaaggcaatggcaaaccaatgtagacgtggctaatgatttggctctcaagctcctgagggactacagcgctgacgatactcggaaagtccacatgataacagaaaatataaacgcgtcatggagatctatccataagagagtgagtgagcgggaggctgcccttgaggaaacacaccgcctactgcagcagtttcccttggacctagagaagtttctggcctggctgacagaagcagaaaccaccgctaatgtccttcaggatgccacccgcaaagagagactgctggaggactccaaaggcgtgaaggagctcatgaaacaatggcaagacctgcagggcgaaatagaggctcacactgacgtataccataacctcgatgagaatagtcagaagatcctacggtccctggaggggtcagatgacgctgtgctattgcagcgacgcttggataatatgaatttcaagtggagcgagctcaggaaaaaaagtttgaacatcagaagtcaccttgaagcatctagtgatcagtggaaaaggctgcacctgtcactgcaggagctgctcgtgtggcttcaactgaaggatgacgagttgagtagacaggccccaattggcggggatttccccgccgtccagaaacaaaacgacgtgcacagggcctttaaaagggagctgaaaaccaaggaaccagttattatgtctacattggaaaccgtcaggatcttcctcacggagcaaccactagagggcctggaaaagctgtaccaggagcccagggaactgcccccggaggaacgcgctcaaaatgtcactcgcctattacgcaagcaggcagaggaagtcaatactgaatgggagaaattgaacttgcacagcgccgattggcaaaggaagattgatgaaactttggaaagactgcgcgaactgcaagaagccaccgatgaactggacttgaagctgagacaggctgaggttattaaagggagctggcaacccgtgggggatctgctgattgatagcctacaagaccatctggagaaggtaaaagcactcagaggcgagattgcccctttgaaggagaatgtgtctcatgtaaacgacctggctcgccagttaactacactggggatccaactatcaccatataatctcagtacccttgaagacctgaacacccgatggaagttgctgcaagtggccgtggaggaccgcgtcaggcagcttcacgaggcgcaccgtgatttcggcccggcctcccagcatttcttgagcacgagcgttcaggggccgtgggagcgggcaatctctccaaacaaggtgccctattacattaaccacgagacacagactacttgctgggaccatcccaagatgacagaactctaccaatctctggctgacctgaataatgtccggttttctgcctaccggactgccatgaagctgcgccgcttgcagaaagccctatgtctcgacctcttgtctttatcagctgcatgcgacgcactggaccagcacaatctgaaacagaatgaccaacccatggatatcctccaaatcataaattgtctgaccaccatctacgatcggctggagcaggagcacaacaatctggtgaacgtgccactttgcgtggatatgtgcctcaattggctgctgaatgtctatgatactgggcgcactggtcgaatccgtgttctgtctttcaagacaggaataatcagcctatgtaaagctcatctggaggacaaatacagatacctgttcaagcaggttgcctcttccacaggattttgcgatcagagaagactcggcctcctgcttcacgactctatacagattcctcgacaactcggcgaggttgcctcatttggaggatctaatatcgaaccctccgttcggagttgtttccagtttgctaataacaaacccgagattgaggccgctctcttcttagactggatgagacttgaaccacaatcaatggtctggctgccagtcctacatcgcgtagcagctgccgaaaccgccaagcaccaggccaaatgcaatatttgtaaagagtgcccaattattggctttcggtataggtcattgaaacatttcaactatgacatatgccaatcatgctttttctctggtcgggtcgcgaaagggcacaaaatgcactatcctatggtcgagtattgcacccctaccacgtcaggcgaggacgtgagggattttgccaaagttctgaaaaataagtttcggaccaagcgctatttcgcaaagcaccctcgcatgggatatctccccgtacagaccgttttggaaggtgataacatggaaacacctgtaacattaattaacttttggcctgtggacagcgcgcccgcttccagcccacagctgtctcacgacgatactcactctaggatcgagcattatgcatcaagattagcagaaatggaaaattccaatggctcctatttgaacgactctatttcccctaacgagtccatcgacgatgagcatctcctcatccagcattattgccagtccttgaaccaggattcacctctgtcgcagccgcgctctcctgcacaaatattgatcagcctcgagtctgaggaaaggggggagttagaacgcatcctggcggacctggaggaagaaaatagaaatctgcaggccgagtatgacagactcaaacagcagcacgaacataaaggtctgagtcctctgcccagcccacccgagatgatgcccactagcccacaaagcccaagagacgccgaattaatagcagaagccaagctgctgcggcaacataaaggcagattagaggcccggatgcaaatactggaggaccacaataagcagctagaaagtcaactgcaccgccttagacagctcctagagcagccacaggctgaagctaaggtaaatgggacaacggtgtccagcccgtctacttccttgcagaggtcagattcctctcagcccatgctgttacgcgtggtcggaagccagacaagtgatagcatgggcgaagaggatctgctgtccccccctcaggacacatccacaggactcgaggaggtaatggagcaacttaataatagcttcccttcaagtagagggcggaataccccaggaaaaccaatgcgcgaggatactccgtag

SEQ ID NO: 115398 - DNA, 10689 bp, Artificial Sequence
  Description of Artificial Sequence: Synthetic coding sequence
atgaagaacattatggccggcctgcaacagacaaattctgagaaaattttgctgtcctgggtgcggcagtctaccagaaattatccccaagtaaacgtgatcaatttcaccaccagctggtcagacggcttggctctaaatgccctgattcattcacatcggccggatttgttcgactggaattcagtggtgtgccagcagtcagcaacccagagactcgagcacgctttcaatatcgctcgataccagctgggaatcgaaaaacttctggatccggaagatgtcgatactacatatcctgataagaagtccattcttatgtatatcacctccctgttccaagtgctgccccaacaggtgtctatagaggcaatccaggaggtcgaaatgcttcctcgaccaccaaaggtgacaaaggaagagcatttccaactgcatcaccagatgcactatagtcagcagataaccgtgagtctcgctcaaggatacgagaggacttcatccccaaagccccggttcaaaagctatgcttatacccaggccgcatatgtgactacaagtgaccccactcggtcgcctttccccagccagcatctagaggcccccgaagacaagagcttcggctcgagccttatggaaagtgaagtgaacctggaccggtatcagaccgcactggaggaggtgctgtcatggctgctgagcgccgaggataccctgcaggcccagggagaaatctctaacgatgtggaagttgtgaaggatcagtttcatacgcacgaaggttacatgatggatctgaccgcgcaccaaggacgcgttggtaatattctgcagcttgggtcaaagctcattggtacggggaaattgtcagaggatgaagaaacagaggtccaggagcagatgaatctgttgaactcgaggtgggagtgtttgagagttgcatccatggaaaaacaatctaacttacatcgggtgctgatggacttgcaaaaccagaaacttaaagaattgaatgactggctcaccaaaacagaagaaaggacacggaagatggaggaggagccattgggccctgatttagaagacctcaagaggcaagttcaacagcataaggtgctccaggaggacctggagcaggagcaggtgcgtgttaacagtctgacacatatggttgtagttgttgatgaaagcagcggggatcatgcgacagcagccctggaggaacaactgaaggttctcggcgatagatgggcgaatatttgtaggtggaccgaggatagatgggtcctgctgcaggatatcttgctaaaatggcagagattgaccgaagaacagtgccttttctcagcctggttgagcgaaaaagaagatgcggtgaacaagattcacaccacaggcttcaaagatcagaatgagatgctctccagcctgcagaagctggccgtgctgaaggccgaccttgaaaaaaaaaagcagagcatgggcaagctttactccctgaaacaagacttgctgagcaccctgaagaacaaatccgtcacacagaaaaccgaagcgtggctggataactttgctcgatgctgggataatttagtgcagaaactagagaagtcaactgcccagatatcacaggccgttacaacgacgcagccttctcttacgcaaactaccgttatggaaaccgtgaccaccgtcacaacacgggaacagatcctggtgaagcacgcgcaggaggaactcccaccgccaccgccacagaagaagaggcagatcaccgtagatagtgagatcaggaagcgcctggatgtggatataacagagcttcattcgtggattaccagatctgaggccgtgctgcagagcccggaattcgcgatcttccgcaaggaggggaacttctcggacctcaaggagaaagtcaatgcgatcgagcgcgaaaaagctgagaaatttcgtaagttgcaggacgcctctcggagtgcacaggcgttggttgagcaaatggtgaatgaaggcgtaaacgcagacagcatcaagcaggcatctgagcagctgaattctaggtggatcgagttctgtcagctgctgtcagagaggctgaattggttagagtaccagaacaatatcatcgccttctacaatcagcttcagcaattagaacagatgaccactacagccgagaactggttgaagattcagccgaccaccccgtcagagcctacggccatcaagagccagctgaagatctgcaaggatgaagttaacaggcttagtgatttacagccacagatcgaacgccttaaaattcagtcaattgctttaaaggagaaaggtcaaggcccaatgttcctcgacgcagatttcgtggcctttaccaatcacttcaaacaggtgtttagcgacgtgcaggcccgggaaaaagagttacagacgatttttgataccttgcctcctatgcggtatcaggagaccatgtccgcaattaggacctgggttcaacagtccgagactaagctcagtatcccacagctgagtgtcactgactatgaaattatggagcagcgactgggcgaattgcaggcattgcagtcgtccctgcaggagcagcagtctggtttgtattacctgagcacaactgtgaaggagatgtctaaaaaagcgccgtcagagattagtagaaagtaccagtctgaattcgaagaaatagagggcaggtggaagaaactgagctcacagctcgtggaacactgtcagaagcttgaagagcagatgaataagctcagaaaaatccagaatcatatacagaccctgaagaaatggatggccgaagtggacgtatttctgaaagaggagtggccagcactgggtgatagtgaaatcttgaagaaacagctgaaacaatgccggcttctggtgagcgacatccagaccattcagccttccctgaactccgtgaatgaaggaggccaaaaaattaagaacgaagctgagcctgagtttgcgagtcggttggagactgaactgaaggaactcaacacacaatgggatcatatgtgtcagcaggtgtacgcgcgcaaagaagcattgaaggggggactcgaaaaaacagtctcactacagaaagacttatcggagatgcatgaatggatgacgcaggctgaagaggagtacctcgagcgggacttcgagtataaaacacccgatgagttacagaaagctgtagaagagatgaaaagagcgaaggaagaggcacaacaaaaagaagctaaggttaagctcctgaccgagtccgtaaattccgtcattgcccaggccccaccagtggctcaggaagccctgaagaaggagctggaaaccctaacaacaaactaccagtggctgtgtacgcggctgaatggcaagtgtaagaccttggaagaagtgtgggcttgttggcacgaactgttatcttacctcgaaaaggccaataaatggcttaatgaagtggaattcaaactcaaaacaaccgagaatattccaggtggtgctgaagagatcagtgaggttctggattcgctggagaatctgatgagacatagcgaagacaatcccaatcagatacgtattctggcgcagacccttactgatgggggtgttatggatgaattgataaatgaagaattggaaactttcaacagtagatggcgggaactgcatgaggaggcggtccgccgccagaagttgctcgaacagtctattcagtcagcgcaggaaacggaaaaatctctgcacctgatccaggagtcgcttacctttatcgacaaacagctcgcagcctatattgctgacaaagtcgatgctgcccagatgcctcaggaagcgcagaagatccagagtgatctgacttcacacgagatctccctggaggaaatgaagaaacataatcagggaaaagaggctgcgcaaagggtgttatcccagattgatgttgcgcagaagaagttgcaagatgtatcaatgaagttcaggctgttccagaaacccgcaaactttgagcagcgcctccaggaaagcaaaatgatcctggatgaagttaagatgcacctgccagcactagagacgaaatccgttgagcaggaagttgttcaatctcagcttaaccattgtgtgaacctctacaaaagtttgagcgaggtcaaatccgaggtagaaatggtgatcaagaccggcagacaaatcgtacaaaaaaaacagaccgagaatcccaaggaacttgacgagcgagtcaccgcgctgaagcttcattacaacgaactgggcgcaaaggttaccgagagaaaacagcaactggagaaatgcttgaagctgtcacggaaaatgcgcaaagaaatgaatgtgttaaccgaatggctggccgctactgacatggaattaactaagagatccgccgtcgaagggatgccatccaacctggactcggaagtcgcatggggaaaagccacacaaaaggagatcgaaaagcagaaggtccacctgaagtccattacagaagtcggagaagcattgaagacggtgctgggtaagaaggagaccctcgtagaagacaagctgtccctactgaactccaactggatcgccgtgacatccagagcagaagagtggctgaatctactgctggagtaccaaaagcacatggagacatttgaccagaacgtggaccatattactaaatggatcatccaggcagatacactgctggatgagtctgaaaaaaagaaaccgcagcagaaagaagacgtgctgaagcggctgaaagcagaactgaacgatattcgtccgaaagtcgattcaacccgcgatcaagctgccaatctgatggcgaatcggggcgatcactgtcgcaagctcgtagaaccacagatctcagaactgaaccataggtttgcagccatctcccaccggattaagactggaaaggcttcaatccccctcaaggagctcgaacaattcaactccgacatacagaagcttctcgagccccttgaggcagagattcaacagggagtgaacctgaaggaagaagacttcaataaagatatgaatgaagataatgagggaaccgtgaaggagctgctacagcgtggcgacaacttgcagcagagaattacagatgagcgcaagagagaggaaattaagatcaagcaacagctgttacagacgaaacacaacgcactgaaagacctgcgtagtcagcgcaggaaaaaggcattagaaatctcccatcagtggtaccaatacaaacggcaggccgacgacctgctcaagtgcttggacgacattgagaagaagcttgcatcgctaccagagcccagagacgaacgcaaaataaaggaaatcgaccgcgaattgcaaaaaaaaaaagaagaactcaatgccgtgcgccgtcaagccgaagggctcagtgaagatggggcggccatggcagtcgagccgacccagatacaactctccaagcgatggcgggaaatagagtccaaatttgctcagtttaggcggctgaactttgcacaaatccatactgtgcgcgaagaaactatgatggtgatgactgaggacatgcccctggaaatttcatatgtaccttcaacctatctgacggagattacgcacgtgtctcaggcgctcctcgaggtcgaacagctgctgaatgcccctgacctgtgtgcaaaggactttgaggatctcttcaagcaagaagaaagtctgaagaatattaaggacagcctgcagcagagtagtgggaggatagatatcattcacagtaagaaaacagcagccctgcagtcagccacaccagtggagagggtaaagcttcaggaagccttatcgcaactggattttcagtgggagaaagttaacaaaatgtataaggataggcagggacgtttcgacagatcagtggagaaatggcggcggtttcactacgacattaaaatctttaaccagtggttgacagaggccgaacagttcctacgaaaaacccagattccagagaactgggagcatgccaaatacaagtggtatttgatcgctctgaaggatgggataggccagaggcagacagtcgtgagaaccctgaatgcaacgggggaagaaataatacagcagtcctcaaaaaccgacgcttcaattttacaagagaagctcggctctctcaacctgcggtggcaggaggtttgcaagcagctaagtgacaggaaaaagcggctggaagaacagaaaaatatattgtccgagttccaaagggaccttaatgagtttgtcctgtggctcgaggaggcggataacatcgcttcaatcccacttgagcctggcaaagagcagcagctgaaggagaaactggagcaggtgaaactcttggtggaggaactgcccctccggcagggcatactgaagcagctgaacgagaccgggggacccgttctggtgtcagctcccattagccccgaagagcaggataaactggagaataagctaaagcagactaacctacagtggatcaaggtgtcccgcgcattgcccgaaaaacaaggtgagattgaggcccagatcaaggacctgggacagctggaaaaaaagctagaggatctcgaagaacaattaaatcacctcctgttatggctgtcccctatccggaaccagttagagatctataaccaaccgaatcaggagggccctttcgatgtcaaagaaactgaaatcgccgtgcaggccaagcagccagacgtggaggaaatcctgtcaaaagggcaacatctgtacaaggagaaacccgcaacgcagccagttaagcgcaaattggaagacctcagttctgaatggaaggcagtgaacaggctccttcaagaactacgagcgaagcagccggacctggctcctggactaaccacaatcggagcctctcctacgcaaaccgtcactctggtaactcaaccagtggttacgaaagaaaccgccataagcaagttagagatgcctagcagcctcatgcttgaggtgcccgctctggctgacttcaaccgagcatggactgaacttacagactggctgtcactgctggaccaagtgattaagagccagagggtgatggtgggcgatcttgaggatatcaatgaaatgatcattaagcagaaagctaccatgcaagatttagagcagcgaaggccacaacttgaggagttaattaccgccgcccaaaacctgaagaataagacttctaatcaagaggcccgaacaatcattactgataggattgagcgcatccaaaatcagtgggatgaggtccaagaacaccttcaaaatcgtcgacaacagctgaatgaaatgcttaaagatagcacccagtggctcgaggccaaggaagaggccgaacaggtgctgggccaggcccgggcaaagttagaatcttggaaagaaggaccctatacagtggacgcaatccagaagaaaattaccgagacaaagcagcttgcaaaggatttacgccagtggcaaaccaatgtcgacgtcgcaaatgatctggccttaaagctcttgcgcgactacagcgccgatgacactagaaaagtgcacatgatcaccgaaaacattaatgccagctggaggtccatccacaaacgcgtttcagagcgcgaggctgccctggaagaaacccatcgtttactgcagcaattccccctggatctggaaaaattcctggcctggctgacagaagctgagacaacggccaacgtgcttcaggatgcgacaagaaaggagaggctcctggaggatagcaaaggtgtcaaagaactgatgaagcagtggcaggaccttcagggggaaatagaagcacacaccgacgtctaccacaatctggacgagaatagccagaagatcctgcgttcccttgaaggctcagacgatgccgtcttactccagcgccgccttgataacatgaacttcaagtggtcagaactgaggaagaagagcctcaacatccgctcgcatctggaggccagtagtgatcagtggaaacgattgcatctgagtctgcaagagctcctggtatggttacagctaaaggacgacgagctgagtcggcaggcaccgatcggcggggactttcctgctgtgcagaaacagaacgacgtccatagagccttcaagagggaactgaagacgaaggaaccagtcatcatgtccacactggaaacggtcaggatatttttaaccgaacagccactggagggcctcgagaaactataccaggaaccccgagagctcccacctgaagagcgtgcccagaacgtgacccggctcttgagaaaacaggcagaagaggtgaatacagagtgggagaaattgaacctacactccgcggactggcaacgcaagattgacgagacccttgagcgactcagagaacttcaggaggcgactgacgaactggacctcaaactgagacaagctgaggtgatcaagggtagctggcagcctgtgggcgatttgctgatagatagtctccaggaccacctagagaaggttaaggcgctaaggggggaaatcgcgcccctgaaagagaatgtaagccacgtgaacgacttagcccggcagctgaccacactcggcatacagctgtccccttacaatctgtcaactttggaggatctaaacacacggtggaaactcctccaagtggccgtggaggatagggttaggcagctgcacgaggcccacagggattttgggccggcgtctcagcacttcctctctacaagtgtccagggtccctgggagagggctatctcccctaataaggttccctactacattaatcacgaaactcagactacttgttgggaccaccctaagatgaccgagctgtaccaatcactagctgatttaaataatgtcagattctcggcctaccgcacagcgatgaaattgcgcaggctacagaaggctctgtgtctggacttactgagtctgagcgctgcctgtgacgctctcgaccagcacaatctgaagcagaacgaccagcccatggacatactgcaaatcataaattgtctgacaactatctatgaccgactcgagcaggagcacaacaacctggttaacgtgcccctgtgtgtggatatgtgtctgaattggctgttgaacgtgtatgacactggcaggaccgggcgaatcagagttttgtcgttcaagactgggattataagcctgtgtaaggcccacttggaggataagtatcgatacctttttaagcaggttgcatcatcaacaggcttctgtgaccaaaggagactggggttgctgttgcacgacagtatccagatcccacgacagttgggcgaagtggcttcttttggaggatctaatatcgagccctccgtgcggtcctgctttcaattcgccaacaataagcccgaaatcgaggccgccctgttcctcgactggatgcgactcgagccacagagcatggtctggctgccagtcttgcatagggtggctgccgctgaaaccgccaaacatcaggccaagtgcaacatttgtaaggagtgtccaattataggattccgctatcggtcattgaagcatttcaactacgatatttgccaatcatgttttttctccggccgggtggccaaaggccataagatgcactaccccatggtggagtattgcacgccaacgacctcaggcgaggacgtgcgggactttgcaaaggttctgaaaaataagtttcggacaaaacggtacttcgcgaaacacccacggatggggtatttacccgtgcagaccgtgttagagggagataacatggaaacccctgtgacacttataaacttctggcctgtagacagcgcccccgcaagcagccctcagctgtcacatgacgacacacactcccggattgagcactacgccagtaggttagccgagatggagaattcaaacggctcttacttgaatgacagtatttccccaaatgagtcaatcgacgatgaacacctgctaatacagcattactgccaaagcctgaatcaagactcacccttgagtcaacctcggtctccagcgcagatactcatttcccttgaaagtgaggaaagaggggagctggaaaggattctcgccgatcttgaggaagagaaccggaacctgcaagccgagtatgatcgtctgaaacagcaacacgaacacaaaggcctgtctccgctgccttcccctccagagatgatgccgactagcccccagagtcctcgcgatgcagagctcatagccgaagctaagcttctccgacaacacaaggggcggttagaggcccgaatgcaaatcttggaggatcacaacaaacaactggaatctcagctgcaccggctgcggcagctgctggagcaaccccaggctgaagccaaggtaaacggcaccactgtgtcctcacccagtacctccctgcagagatccgacagcagccaaccaatgttgttgagagtggtaggctctcagacgtcggatagtatgggagaggaagatcttctgtcccctcctcaggatacgtccaccggcctggaagaagtgatggaacaactcaataacagctttcctagttcccgcggaagaaacactcccggtaagcccatgcgcgaggacaccatgtag

SEQ ID NO: 115399 - DNA, 3348 bp, Artificial Sequence
  Description of Artificial Sequence: Synthetic coding sequence
atgcctagctccctgatgctggaggtgcccgccctcgcagacttcaatagggcctggacagagctcactgactggctgtcactgttggaccaagtcatcaaaagtcaaagagttatggtcggtgatttagaggatattaacgagatgattataaagcagaaggccactatgcaggatctggaacagcgccgcccccaactggaggagctgattacagcggcgcagaatctgaaaaataagaccagcaaccaggaagcccggaccattattacagatcgtatagaacgcatacagaaccagtgggacgaagtacaggaacatctccaaaaccggagacagcagctgaacgagatgctcaaggacagcactcaatggctcgaggccaaggaggaggctgagcaagtgctgggtcaggccagggcaaaactggaatcatggaaagaaggcccttacactgtagatgccatacagaagaaaatcaccgagaccaaacagctggcaaaagatcttcgacaatggcagacgaatgtcgacgtggctaacgatctcgctctcaagctgcttagagactactccgccgatgacacacgaaaagtccacatgataactgaaaacatcaatgctagctggagatcaattcacaagcgggtatcagaacgggaagccgcactggaggagacgcacaggttactgcagcagttccctttagatttggagaaatttctggcctggctgacagaggccgaaaccaccgctaatgttcttcaggacgccacaagaaaagagcgacttctcgaagatagtaaaggagtaaaagagctgatgaagcagtggcaggatttgcaaggagagatcgaagcccacactgatgtctaccacaatctggatgagaactcccagaagattctccgatccttagagggtagcgatgacgcagtgctgctccagcggaggctggacaacatgaacttcaaatggtccgaattaaggaaaaagtctctcaatattagaagccatctggaggccagcagtgatcagtggaaacgtttacacctctcgctgcaagagctactagtttggcttcagcttaaagacgatgaactttctcgccaggcaccgattgggggcgattttccagccgttcaaaaacaaaacgatgtgcatagggcctttaaacgtgaacttaagaccaaggaacccgtgatcatgagtacactggagactgtgaggatattcttgacagagcagcctctcgaagggcttgaaaagttatatcaggagcccagagaactaccccccgaagagcgtgcacaaaacgtgactagacttctaaggaagcaggccgaagaagtgaacacagaatgggaaaagctgaacctgcattccgccgattggcagcgcaagatcgatgagactctcgagaggttgcgggagctgcaggaggctaccgacgaactggacctcaagctgagacaggccgaagtgatcaaaggaagttggcagccagttggtgatctgctgattgacagccttcaagaccacttagagaaagttaaagctctgcgcggggagatagcacccctgaaagaaaatgtgtctcacgtgaacgacctagccagacagctcacaacacttgggatccagctgagcccttacaatctgagtactctggaagacctgaacactcggtggaagctgttgcaagtggcagtagaggacagagtccggcaactgcacgaagcacaccgcgattttggtccagcttcacagcactttctgagtaccagtgttcagggcccatgggaacgtgcaatctcaccaaataaagtgccatattacattaatcacgaaacccaaacgacctgttgggatcaccccaagatgacagaactatatcagagcctggctgacttaaataatgttcgattctctgcatatagaacagctatgaaactgcgccggctccaaaaggccctgtgtttagacctcttgtctctgagcgcagcttgtgacgccctagaccagcacaacttaaagcagaatgaccagcccatggacatcttgcaaatcatcaattgtctcactacgatttacgaccgtttggagcaagagcacaataatctggtgaatgttccactctgtgtggatatgtgtctgaactggcttttgaatgtgtacgataccggccgcaccggacggattcgcgttctctccttcaagacagggatcatatctttgtgtaaagcgcacctggaggataagtatcgttatctctttaaacaggttgcctcgtctacgggattttgtgaccagcgtagactcggattgctactccatgatagcatccagatcccacggcagctcggggaggtggcttcttttggcggaagcaacatcgagccctcggttaggagttgtttccaatttgctaacaacaagcccgagatcgaagcagcgcttttcctggattggatgcgccttgagcctcagagtatggtttggcttcccgtccttcatagggtagctgcagccgagaccgcaaaacatcaggccaagtgcaacatctgcaaagagtgtcctattattgggttccggtacaggtcactcaaacattttaactacgacatttgccagtcctgcttcttcagtggacgggttgcgaaggggcacaagatgcattacccaatggtagagtattgcacacctaccacgtcaggtgaggacgtaagggatttcgccaaggttcttaagaacaaatttcgcactaaacggtactttgcaaagcaccctcggatgggttatctgcctgtgcagaccgtgctggagggagacaacatggaaaccaatctacaggccgagtatgaccgcctgaaacagcaacacgaacacaaggggctgtcccctctcccttctccccccgagatgatgcccaccagcccacaatcgccccgcgacgcggaacttatcgctgaggcgaaattactgcgccagcacaagggtagactggaggcccggatgcaaatccttgaggaccacaataagcagttagagagccaactgcaccgtctgagacagctgctcgaacagccacaggccgaggcaaaggtgaatggaacgaccgtgtcgagtccgtccactagcctgcagaggtcagacagctcacagccaatgttgctcagagttgttgggtctcagaccagcgatagcatgggcgaggaggacctcttaagccccccccaggatacaagtacgggcctggaggaagtgatggaacagctgaacaattcttttccatcttcacgcggccgcaatacaccaggcaagccaatgcgagaggatacaatgtag

SEQ ID NO: 115400 - DNA, 11058 bp, Artificial Sequence
  Description of Artificial Sequence: Synthetic coding sequence
atgctgtggtgggaggaagttgaggactgttacgagagagaagatgtacagaaaaagacgttcaccaagtgggtgaatgcccagttttctaaatttgggaaacagcatatagagaacctatttagcgacctacaggatggacggagactactggatcttcttgaaggtcttacaggtcaaaagctcccaaaagaaaagggcagcacccgggtgcatgctcttaacaatgtaaacaaggcactccgcgtgctccagaacaataacgtggacctggtcaatatcggatcaaccgacatcgtggatggaaaccataaactgaccctcggacttatttggaacattatcctgcattggcaggtaaagaatgtcatgaagaatatcatggccggcctgcagcaaacgaatagtgagaagatactgctgagctgggtgcgacagagcactcgaaactaccctcaggttaacgtcatcaactttacaacgtcctggagtgacggactcgctctgaatgcactcatccattctcaccgacccgacttattcgattggaactccgttgtgtgccagcagagtgctactcagaggctcgagcacgcgtttaacatcgcccgataccagttaggaattgaaaagctccttgacccagaagatgtcgacacaacatatccagataaaaaaagcattctgatgtacatcacaagcctgttccaggtgctcccacaacaggtgagtatagaagctatccaggaagttgagatgctgcccaggcccccaaaagtgaccaaggaggaacacttccaattgcaccatcagatgcactactctcagcaaatcactgtaagtcttgctcaggggtatgaaaggacatcctcacctaaaccacgattcaagagctacgcctatacgcaggcggcctatgtcactacaagtgatccaacccgcagtccgttcccttctcagcatttggaagcccccgaagacaagtccttcgggtcatctctgatggagagcgaggtgaacctcgatcgctaccagactgcactcgaggaggtgctcagctggctattatctgctgaagataccctacaggcccagggggaaatctctaacgatgtcgaagtcgttaaagaccagttccatacccacgaaggctacatgatggatttaacagctcatcagggacgcgttggaaacattctgcagctgggctcaaagctgatcggtacaggaaaattgagtgaggacgaagagaccgaagtgcaggagcagatgaacctgctcaactcacgttgggagtgtctgcgggtcgcctcaatggagaaacagtccaacctccaccgggtgctcatggatctgcagaatcagaagctcaaggaactaaacgattggctgaccaagaccgaggagaggaccaggaagatggaagaggagccccttggtccagatctggaggaccttaaaagacaggtgcagcagcataaagtcttgcaggaggaccttgaacaagaacaagtgcgggtgaactcgctgacccacatggtcgtggtggtggatgagagtagtggggatcacgccacagccgccttagaggagcaactcaaagttctgggcgaccgctgggccaatatttgccggtggaccgaggaccggtgggtgttgttgcaagatatcctgctgaaatggcagagactgactgaagaacagtgtctgttctcagcctggcttagtgaaaaagaggatgccgtgaataaaatccataccaccggcttcaaggaccagaacgagatgcttagctccctacaaaagcttgcggtgctgaaagccgacctggagaaaaaaaagcaatctatggggaaactctattccctgaagcaggacctccttagtactttaaagaataagtcggtcacacaaaagacggaggcctggcttgataattttgcccgatgctgggataacttggtgcaaaagctggagaagagcacagcacagatctctcaggcggtcaccaccacacaaccaagccttactcagaccactgtgatggagacagtaacaacggtgactacgcgagagcaaatattggtgaagcacgctcaggaggagcttcccccaccaccaccgcagaagaagagacagatcaccgtcgacagcgagatccggaagcggcttgatgttgacatcaccgaactgcattcttggattactcgatctgaggctgtactgcagagccctgagttcgccatattccgcaaagaaggtaacttctcggatttgaaagaaaaagtgaacgctattgagcgggaaaaagctgaaaagttcagaaagttgcaggatgccagccgctccgcgcaagccctggtggagcagatggtgaatgaaggagtgaatgccgattccatcaaacaagcctctgagcagctgaactccagatggattgagttctgccaactcttatctgaacggctaaattggctggaataccagaataacatcatcgctttctataaccagctacaacaactggaacagatgacaacaacagctgaaaattggctgaagattcaacctaccacacccagcgagccgacggctattaagtctcagctgaaaatatgcaaggacgaggtcaaccgcctttctgatttgcagccccagatcgagcggttaaagattcagagcatcgcccttaaggaaaaaggacagggtccaatgttcctggacgccgacttcgtggcatttacgaaccacttcaagcaggtcttttcagacgtccaggccagagaaaaggaactccagactatttttgacacactgcctccaatgcgataccaggagaccatgagcgctatcaggacatgggtacaacagagcgagaccaagctttccatccctcagctctccgtgactgactacgaaattatggagcagagactcggagaattgcaggcactgcaaagcagtctccaggaacagcagagcggactgtattacctgtcaaccacagtcaaagaaatgtctaagaaggctccttccgaaatcagtaggaagtaccaatctgagttcgaggagattgaggggcgttggaagaaactcagctcacaattggttgagcattgccagaagctggaagagcaaatgaacaaactgcgcaaaatccaaaaccacatccaaacgctgaaaaagtggatggccgaggtcgacgtatttttgaaggaggaatggccagctctgggggatagcgagattctgaagaaacagctgaagcaatgccgccttctagtgtcagacatccaaaccatccagccctctctcaactctgtgaacgaaggagggcagaagattaagaacgaagccgaacccgaattcgcctcaaggctggagacagagctcaaggaattaaatacacagtgggatcacatgtgtcagcaggtgtacgctagaaaagaggctctgaaagggggtcttgagaagacggtgtcccttcaaaaggatttgtcagaaatgcacgaatggatgacccaggccgaagaggaatacctggagcgggacttcgagtataagactccagatgagctacagaaagcagtagaggagatgaagcgggctaaagaggaagcgcagcagaaagaggcaaaggtcaaactgttgacagagagtgtaaatagtgtaatcgcccaggcaccacctgtggcgcaggaggccctaaagaaagagctggagacacttacaaccaactaccagtggctttgcaccagactgaatggcaaatgcaagaccctcgaggaggtctgggcctgttggcatgaattactttcatatctggaaaaagccaacaaatggctgaatgaggtagagtttaaactgaaaactacagagaacatacccgggggcgcagaagagattagcgaggtgctggacagcctcgagaacttaatgagacattccgaagacaatcccaatcagatccgaatcctggcccagaccttaacagacgggggcgtgatggacgagcttattaacgaggagctcgaaaccttcaatagcaggtggcgcgagctgcacgaggaagccgtccggaggcaaaaattactggaacagtccatccagtcagctcaagagaccgagaaaagcctgcatcttatacaggaaagcctcacatttattgacaagcagctggctgcttatatagctgataaggtggatgccgctcagatgccacaggaggcccaaaagattcagtccgacttgacgtctcatgagattagtctggaggagatgaaaaaacacaaccagggcaaggaggcagcccagagagtcttgagtcaaattgatgtcgcccagaagaagttgcaagacgttagtatgaagttcaggctgttccaaaaacctgccaacttcgaacagcggctgcaggagtctaagatgatcctcgacgaagtgaaaatgcacttgcccgcactggaaactaagtcagtggagcaggaagtggtccaaagccagctgaaccattgcgtgaatctgtacaagagtctgtccgaagttaagagtgaggtcgagatggtaataaagacggggcggcaaatagtgcagaaaaagcagacagaaaaccctaaagagctggatgaaagagtcaccgctctgaagctccactataatgaactgggtgccaaggtgaccgagaggaagcagcagctggagaagtgcttaaagttgagtcgaaaaatgcggaaggagatgaatgtgttgaccgaatggctggccgcaactgacatggaactgactaagagaagcgccgtggaaggcatgccttcaaacctcgactcagaagtagcctggggtaaggctacgcagaaagagattgagaaacagaaagtgcatctaaaatctattactgaagtgggggaagcattaaaaactgtgttgggaaagaaggaaacactcgtggaagacaagttgagccttctgaatagcaactggatcgctgtgacatcccgggcggaggagtggttgaatctcctgctcgagtatcagaagcatatggaaacatttgaccaaaacgtcgatcatatcaccaagtggatcattcaggcagacaccctattggacgagtctgaaaaaaagaaaccacagcaaaaggaagatgtgctgaaacgcctgaaggcagagctcaatgatatacggccgaaggtggacagcaccagggatcaggcggctaacctaatggccaacaggggagatcactgtcgcaaacttgtagaaccgcagatcagtgaactaaaccatcgattcgcagccatttctcaccgcattaagacaggcaaggcatcgatcccacttaaggagctcgaacagttcaactcagacatccagaagctgctggaaccccttgaggccgaaatccagcagggcgtgaatttgaaggaggaagatttcaataaagatatgaatgaggataacgaaggcacggtgaaggagctgcttcagcgcggggataaccttcagcagagaataactgatgaaaggaaacgggaagaaataaagatcaagcagcaactgctgcagactaagcataacgctctgaaggatctccgcagccagcgacggaagaaagccctggaaatctcacaccagtggtatcaatataagcggcaggccgacgatcttctgaaatgcctcgacgatatcgagaaaaagctggcctccttacctgagcccagggacgagaggaagattaaagagatagatcgcgagctacagaaaaagaaagaggagcttaacgcagtacggcgccaggctgaaggcctctctgaggacggcgccgctatggcggtggaacctacacagattcagctgagtaagcggtggcgggagattgaatcaaagtttgctcaattccgtcgactaaattttgcccaaatccacacggtgcgtgaggagacaatgatggtgatgaccgaggatatgcccttggagatctcttatgtgccctcaacatatttaacagaaatcacccatgtgagccaggccctgctggaggtggagcagctgctcaacgcacccgatctgtgcgctaaagatttcgaagatcttttcaaacaggaagagagcctgaaaaacattaaggacagtctgcagcagagttccgggcggatcgacataatccattccaagaagaccgcagccctgcagtctgcaactcctgtcgaaagagtcaagcttcaggaagccctgagccagctggactttcagtgggagaaggttaacaagatgtacaaagatcggcagggccggtttgaccgaagtgttgagaagtggagacggtttcattacgacatcaagatcttcaatcagtggcttactgaagcagaacagtttttaagaaagacgcaaattcccgagaattgggagcatgctaaatacaagtggtatcttattgcgctgaaggatggaatcggtcagaggcagaccgtggtccgcaccttaaatgcaaccggagaggagattatccagcagtccagtaaaacagacgcgtcaatcctgcaagaaaaactggggtctttaaaccttagatggcaggaagtttgtaagcaactcagcgatcggaagaaacggttagaggagcagaaaaacattctttccgagttccagcgcgatttaaatgagtttgtgctttggctagaagaagctgataatatagcctctataccgctcgaaccaggtaaggaacaacagttgaaggaaaagttagagcaggtgaagctgttagtggaggaacttcctctgcggcagggcatactcaaacagttaaatgaaactggagggcctgtgctagtgtctgcacctattagcccagaggagcaagataaactcgagaacaaacttaagcagacaaacctccagtggatcaaagtgtcaagagcgctccccgagaaacagggggaaatcgaagcccagataaaggatctaggtcagttagaaaaaaaactcgaggaccttgaagaacagctgaaccaccttctactgtggctgtctcccattagaaaccagctagaaatttataatcagccaaatcaggaggggccctttgacgtcaaggaaactgaaattgcggtccaggctaagcagcccgatgtggaggagattctgtcaaaagggcagcacctgtataaggagaagccagctacccaacccgtgaaacgtaagttagaagatctgagcagtgaatggaaggctgtgaaccgcttgctccaggaactgcgagccaagcagcccgatctcgcccccgggctcaccaccattggggcctccccaacacagactgtaaccctcgtaacccaaccagtggtaaccaaggaaactgctattagcaaattggagatgccttcaagtctcatgctggaagtgccagccctcgcagacttcaatcgggcctggacagagctaacggattggctgtcgctactggatcaggtaatcaaatcccagagagtcatggtgggggacctggaggatataaatgaaatgatcatcaaacaaaaggctactatgcaggatctggagcagaggaggcctcaactggaagagttaatcacagctgcccagaatcttaagaataaaaccagtaatcaggaagctcggacgatcattaccgaccggatagaacggatccaaaatcagtgggacgaggtgcaggagcatcttcaaaatcggcgccaacaactaaatgagatgctgaaagactccacacaatggctggaggcaaaggaggaagctgaacaagttttggggcaggctcgggccaagctggaatcatggaaagaaggaccttacacggtcgacgctatccaaaagaagattaccgagacgaagcagctggccaaggacttgcgccagtggcagacaaatgtcgacgtagccaacgacctggccctgaagttgctgcgggattacagcgctgatgatacacggaaggtgcatatgatcactgagaacataaacgccagttggagatcaatccacaaaagggtgtcagaacgggaggctgccctcgaggagacccacagactgctgcaacagttccccctagaccttgaaaaattcctagcctggctgacagaagccgaaacaacagcaaatgtgctgcaggatgcaaccaggaaggaacgactgttagaggactcaaaaggggtcaaagagctaatgaagcagtggcaggatctacagggagaaatagaagcacatacggatgtttaccataacctggacgagaactcccagaagatactgcgatcccttgagggcagcgacgacgcagtgctcctgcaaagaaggctggacaacatgaactttaagtggtccgagctgcgcaagaagtcgctgaacatccgatcacaccttgaggcctcttcagatcagtggaagaggcttcacctcagcctacaagaactactggtatggctgcagttaaaagacgatgagctgtctcgtcaggcgccaattggaggggattttccggcagtgcagaagcagaatgacgttcacagggcctttaagagagaactgaaaactaaagaacccgtcataatgtccacgttagagaccgtgcgcatatttctgactgagcaacccctggagggtctggagaagttatatcaagaaccccgcgagctgccacccgaagagagagcgcagaatgtcacccgcttgttgcgaaagcaagctgaggaggtgaataccgaatgggagaaacttaatctccacagcgcggattggcagcgaaaaatagacgagactctggaaagacttcgggaactacaagaggccaccgacgagctggatctgaaattgcggcaggctgaagtaattaagggctcttggcaaccggtgggtgacctcttgattgacagcctgcaggatcaccttgaaaaagtgaaggccctgcgcggagaaatagcaccactgaaggagaacgtttcacacgtcaacgacctggctcggcagctgacgacattgggcatacagctctcaccgtacaatctgagcactttagaagaccttaatactagatggaagttgttgcaagtggccgtggaggaccgcgtcaggcagctgcatgaggcacatagagatttcgggcccgccagccagcactttctgtcaaccagtgttcagggcccatgggagcgcgccatctcaccgaataaggtcccttattacatcaaccacgaaacacagaccacatgttgggaccaccctaagatgacagagctttaccagtctctggctgacctgaacaacgtccgttttagcgcttatcgaactgcaatgaagcttaggcgactgcagaaagctctgtgtctggatctgctatcactgtctgctgcctgtgacgcactggaccagcacaatctgaagcagaacgaccagccaatggatattctgcaaatcatcaattgcctgaccacaatctacgatcgcctggagcaagagcataacaacctcgtaaacgtgcccctctgcgttgatatgtgtctgaactggttgctaaatgtttatgacactgggcgcacagggcggatcagggtcctcagctttaaaaccggcattatctcgctgtgtaaggcccacttggaggacaagtaccgctacttgttcaaacaagtggcaagctcaacgggcttctgcgatcagaggagactgggactgctcttgcacgattccatacaaattcctaggcaactgggggaggtggcgagctttgggggctccaacattgaaccttccgtgaggtcatgttttcagtttgccaacaataagcctgagattgaggctgctttgtttctggactggatgaggctagaaccacagtccatggtgtggctgccagtcctgcaccgggttgctgcagctgagacggccaagcaccaagcgaaatgcaatatatgtaaagagtgcccgatcatcggatttagatacaggagcctgaagcattttaattacgatatctgccagagctgttttttcagtggcagggtggcgaagggacataaaatgcattatccaatggtggagtactgtacgccaaccacaagtggggaggacgtccgcgattttgctaaggtcctgaaaaacaaattcagaacaaagcggtacttcgctaagcaccccagaatgggctatctcccggttcagacagtgttggaaggtgacaatatggagactcctgttacacttattaatttttggcccgtcgactctgcacctgcctcttcccctcagcttagtcatgacgatacgcattctaggatcgaacactacgcttcccggctcgcagagatggaaaactcaaatgggtcctacctaaatgactctatcagtcctaacgaatcaatcgacgacgaacatttgctgatccagcactactgccagagtctcaatcaggactccccgctgagccagcccaggtctccagctcagattctgattagcttggaatccgaagaacgcggagaattagagcggattctagccgatctggaagaagaaaaccgaaacctgcaggccgagtatgacaggcttaaacagcaacatgaacacaagggactgtcccctctccccagccctcccgagatgatgccaacttcaccccaaagcccccgcgacgcagagcttatcgctgaggctaaactgctgcggcaacataaaggtcggctggaggcccggatgcaaattttggaggatcataataagcagttagaatctcagctccataggctacgtcagctgctggaacaaccccaggctgaagccaaagttaacggcacaactgtctcatcaccatctacttcactgcagaggtccgatagctctcagcctatgttgttaagagtggtcggcagccagacatctgattctatgggagaggaggatttactatccccaccacaggataccagtaccggtctggaggaggtaatggagcagctgaacaatagctttccgtcaagccggggcaggaatacgcccgggaaacctatgagggaggatactatgtag

SEQ ID NO: 115401 - DNA, 2874 bp, Artificial Sequence
  Description of Artificial Sequence: Synthetic coding sequence
atgcagccaatggtcatgcaagggtgcccatacacactcccaagatgccacgattggcaggcggccgatcagtttcaccattctagttccctgcggtcaacgtgcccccatccgcaagttagagcggccgtgacctcaccagcaccaccccaagacggcgcaggagttccatgcctcagtctgaaacttctgaacggttcagtcggcgccagtgggccgctggagccccccgctatgaatctgtgttggaatgaaatcaagaaaaagtctcacaacctaagagctcggctggaagctttcagcgaccacagcgggaaactgcaactgcctctgcaagaaattattgattggctctctcaaaaggacgaggagctgtccgcccaactgccactgcagggcgatgtggctctggttcagcaggaaaaagagacccatgctgctttcatggaggaggttaaatcaaggggcccctatatctatagtgtgctggagtctgcccaagctttcctctctcagcacccctttgaggagttagaagaaccccactctgagtccaaggatacctctcccaagcagcgtatacagaatctctcgcgcttcgtgtggaagcaagccactgttgcctcagagttgtgggaaaaactcaccgcaaggtgtgtcgaccagcatagacacatagaaagaacactcgagcagctccttgaaatccagggggctatggaggagctttctactaccctgagtcaggcagaaggcgtccgcgccacctgggaacccattggcgacttgtttatagacagtcttcccgaacacatacaggccattaaactgttcaaggaggaattctcccccatgaaagacggggtaaaactcgtcaatgacctggcccatcagctcgcaataagcgacgttcatctcagtatggaaaattctcaagcactggagcagatcaacgtgcgctggaaacagttgcaagccagcgtttcagaaaggctcaagcagcttcaggacgcgcatagggatttcgggcctggatctcagcacttcctgtcttccagcgtccaagtgccatgggaacgagctattagtccgaataaagtgccctactacatcaatcaccaagcccaaaccacttgttgggaccacccgaagatgactgaactatatcagacactcgccgacttaaacaacatcaagttctccgcttacagaaccgcaatgaaactccgacgcgtgcagaaagccttgcggctcgaccttgtcacgctgaccaccgcgcttgagatttttaacgagcatgaccttcaagcgtctgaacatgtgatggacgtggtagaggttatccactgtctcactgctttatatgagcgcctggaggaagaacgagggatcctcgtgaatgtgcctctctgtgtggatatgagtctgaactggctactcaatgtgttcgactccggcaggagcgggaagatgcgggccctctccttcaagaccggcattgcttgcttatgtgggaccgaggtgaaggagaaactgcagtacctgttctctcaagttgctaactcgggttcacagtgcgatcagcgccacttgggggttttgttgcacgaggctatccaagtgcctcgacagctaggcgaggtcgcagccttcggaggaagcaatgttgagccaagtgttcgctcctgttttaggttcagcacaggcaaacccgtgattgaggcctcacaatttctcgaatgggtcaaccttgagccccagtccatggtctggcttgccgtgctgcacagagtcacaatcgctgaacaggtcaagcatcagacgaagtgctccatctgtagacagtgccctatcaagggatttcggtatcgtagcttaaaacagttcaatgtcgatatctgtcagacctgcttccttaccggtagagcttcaaagggcaataaattgcactatccaatcatggagtactacactccaaccactagtagtgagaacatgagagacttcgccaccactctgaagaacaaattccggtcaaaacactatttttctaagcatccccagcgcggatacttgcctgtacaaagtgtactcgaagccgactactcagagacccctgcatctagcccaatgtggccccatgccgacactcactctcgcatcgaacactttgcatcccggctcgcagagatggagtcccagaactgcagcttctttaatgactccctgtcccctgacgactccatcgatgaggatcaatacctgctgcgacattccagcccgataacagatcgggagccagctttcggccagcaggcaccttgtagtgtcgctactgaatcgaagggcgaacttcaaaagattcttgcccacctggaggacgagaacagaatcctgcagggcgagctgcgccgcctgaaatggcagcatgaagaagctgctgaagcccccagtctcgctgacggatcaactgaagcggccacagatcaccgaaacgaggagctgctcgctgaagcccgaatcttacgccaacacaaaagtcgacttgagacgcgcatgcagatattggaggatcataataagcagctggagtcccagctccagcggctgcgggagctactgctgcagccgccaactgagagtgatggttcaggctccgctggctcgagtcttgcatcgtcacctcaacagagtgaaggatcgcatcccagagaaaagggtcaaactacacctgatactgaggcagctgatgacgttggctctaagtcacaggatgttagcctgtgtctggaagacatcatggagaaattacggcacgccttcccctctgtgcgcagttcggatgtaacagctaacactcttttggcgtcatag

SEQ ID NO: 115402 - DNA, 2874 bp, Artificial Sequence
  Description of Artificial Sequence: Synthetic coding sequence
atgcagccaatggttatgcaggggtgtccgtacaccctcccgcggtgccacgactggcaggccgccgaccagttccatcacagttcctcccttaggtcgacctgcccccacccacaggtgcgggccgcagtgacatctcctgcaccaccccaggatggagcaggagttccatgcctttcacttaagctgttgaatgggtctgtcggggcatcaggaccactggagccccccgccatgaacctttgttggaatgaaataaaaaagaaaagccataaccttcgagcccgcctagaggctttcagcgatcatagcggaaagttacaattaccactccaggaaataattgactggctatcccagaaagatgaagagctgtccgctcagttgcccttacagggagatgtcgctctggtccagcaagagaaggagactcatgcggcattcatggaagaggtcaaaagccggggaccgtatatctattcggtcctggagtctgcccaggccttcctctcacagcatcctttcgaagagcttgaagagccccactccgaatccaaagatacatcacccaagcagaggatacagaacctctcccggtttgtctggaaacaggctacagtcgcatccgagctttgggagaagctgacagctaggtgtgtcgaccagcataggcatattgaacgtacactcgagcagctcctggaaatccaaggggcgatggaagagcttagtacaaccctgagtcaggcagaaggggtacgtgcgacgtgggagcccatcggcgatctctttatcgattcattgccggaacacatccaggcgatcaagctattcaaggaagaattcagccctatgaaagatggagtgaagctggtgaatgacctcgcgcaccagctagccatcagcgatgtgcatttgtctatggagaatagtcaggccctagagcagattaacgtaaggtggaagcagctgcaggcatctgtaagcgagagactaaaacagctacaagatgcacatagagattttggtcctgggtcgcagcacttcctgagttccagcgtgcaggtgccctgggaaagagcaattagcccgaacaaagtgccttactacatcaaccaccaggcgcagacaacatgttgggatcacccaaagatgactgagctgtaccagactctagccgacttgaataatatcaagttcagtgcctacagaaccgctatgaagcttcgccgcgtccagaaagcattaaggttagacctggtgactctgactaccgccctcgaaattttcaatgagcacgacctgcaggcgagtgagcacgtaatggatgtggtggaggtgatccattgtctcacggctctgtacgagagactggaagaagagcgcggaatcttggtgaatgtgcccctctgcgtggatatgtcacttaactggctgctgaatgtgttcgatagcgggaggtccggaaaaatgagagctttgtcattcaagactggtatcgcttgtttatgtgggacggaggttaaggagaaactgcagtacctgtttagccaggttgctaattccgggtctcagtgtgatcagcggcatttaggggttctcctgcacgaggcgattcaggtgccacgacaactcggtgaggtggcagccttcggggggtctaacgttgaacccagcgtcaggtcctgttttagatttagtaccggcaagcccgttatcgaggcttcacagtttttagagtgggtgaacctagaacctcaatccatggtctggctcgccgttctgcacagggttactatcgcggaacaagtcaagcaccagactaagtgttccatctgcaggcaatgtcctattaaggggttcaggtaccgcagcctgaagcagttcaatgtggacatatgtcagacgtgttttttaacaggacgggctagcaaagggaacaaactacattaccccatcatggaatactacaccccaaccacctccagtgagaatatgagggactttgcaaccacgctgaagaacaagtttcgctcgaagcattactttagcaaacaccctcagcgcggctacctgcccgtccagtcggtgcttgaagccgattactcagaaacgcctgcttcatcgccaatgtggccccatgccgacactcatagccggattgaacacttcgcaagcagactcgcggagatggagtctcagaattgtagcttcttcaacgacagcctgagccccgacgactctattgatgaagatcagtatttactgaggcattcctcccccattacagacagggagcccgcgtttgggcagcaggcaccatgctctgtggccactgaaagcaagggggagcttcagaaaatcttggcacaccttgaagatgaaaatcgcattctccagggggaactaagacgattgaagtggcaacacgaggaagccgcagaagctccgtcgctggcggatgggagcaccgaagccgctacagaccatcgtaatgaagagctgttggctgaggcacggattctcaggcagcataaatctcggttagagactcggatgcaaatcctggaggaccataacaagcaactcgaatcccagcttcagaggttgagagagctcctgctgcaaccaccaactgaaagtgatggaagcgggtccgcagggagtagcctggcaagcagccctcagcagtccgaaggcagccatccccgcgagaagggtcagaccactccggatacagaggctgcggacgatgtaggctcaaagagccaggacgtttctttatgtctcgaggatataatggagaaactgcggcacgcgttcccaagcgttaggagcagtgacgtgacagccaacacgctgcttgcctcttag

SEQ ID NO: 115403 - DNA, 2874 bp, Artificial Sequence
  Description of Artificial Sequence: Synthetic coding sequence
atgcagccaatggtcatgcagggatgtccatataccctgccacgttgccacgattggcaggccgccgatcagttccatcactccagcagcctccggagcacctgtccccaccctcaggtgagggctgcagtgacaagtcccgcaccaccccaggatggagcaggcgtaccctgcctttccctcaaactgctgaatggcagtgtcggagcgtctggcccactggagccccccgccatgaatttgtgctggaacgaaattaaaaaaaagagccataacctgcgcgcacgcctggaggcgttttccgatcatagcgggaaacttcagttgcccctgcaggagattattgactggctgtctcagaaggatgaggaactctctgcacagctgccacttcagggtgacgtggctttagtccagcaggagaaagagactcacgctgccttcatggaggaagtcaagagccggggtccctacatctacagcgtgctggagagtgcgcaagccttcctgtcgcagcatccattcgaagaacttgaggaacctcacagcgagtccaaggatacttcaccaaagcagcggattcagaacctcagtcgattcgtttggaagcaggctacggttgcatccgaactgtgggaaaagctaaccgctcgctgtgtagaccaacacaggcacattgaacggacattagagcagttacttgaaattcagggtgcgatggaagaactgtctactaccctatctcaggccgagggagtgcgcgcgacttgggaaccaataggggacctgttcattgacagtctcccggaacacatccaggccatcaagctcttcaaagaggagttcagccctatgaaggatggcgtgaaactcgtaaatgatctggctcaccagctggccatttctgacgtgcacctctctatggagaatagtcaggccctcgaacagattaacgtaagatggaaacaactccaggcaagtgtgagcgagcggctgaaacaattgcaggatgcacatcgcgacttcggccctgggtctcagcacttcctgagctcaagtgtccaggtaccttgggagcgcgcaattagcccaaacaaggtgccgtactacattaatcaccaggcccagacaacttgttgggatcatccaaaaatgaccgagttgtaccagacactggctgatctcaacaatattaagttcagcgcttatcggaccgccatgaagctccgtcgcgtccagaaggccttacgcctggacctggtcaccctcacgacagcccttgaaatcttcaacgagcacgatctccaggcatccgaacacgtgatggacgttgtcgaggtgattcactgcctgactgctctgtacgaaaggctggaagaagagcgcggtattctcgtcaatgttccgctgtgcgtcgacatgagccttaattggcttctgaatgtgttcgatagcggtagaagtgggaaaatgcgggcgctttctttcaaaaccggcatcgcctgcctgtgcgggaccgaggtgaaagaaaagctgcaatatttattctctcaggtggccaattccgggtctcagtgcgatcagaggcacctgggcgtactccttcacgaggccattcaggtccctcgccaactgggagaggtggccgcttttggcggaagtaacgtggagccatctgtgcggagctgctttaggttttctacagggaaaccagtcatcgaggctagccagttcctcgagtgggttaacctggagccgcagtctatggtgtggctggcagtgctgcatcgagtgacaattgcggaacaagttaaacaccaaacaaagtgttccatttgcaggcaatgccctattaaaggctttcgttacagaagcctgaagcaattcaatgtggatatttgtcagacctgctttttaacaggacgggcctcaaaggggaacaagctgcattatcctattatggagtattacaccccaactacttctagcgagaatatgagggattttgccaccacactcaagaacaagttccgttcaaaacattacttctctaagcacccacaaagaggatacctgcctgtgcagagcgtcttggaggccgactattcagagacccctgcttcctctccaatgtggccacacgctgacacacattccagaattgagcatttcgcgagcaggctcgcagaaatggagtcgcaaaactgcagcttcttcaatgatagtctgtctccagacgattccattgatgaagaccagtacctgctgagacactcatctcccatcaccgacagggaaccggccttcggacagcaggctccttgcagtgtcgcaaccgagagtaagggcgagctgcagaaaattctggcccatttagaggatgagaacagaatccttcaaggagagttacgccggctcaaatggcagcacgaggaggccgcagaggcgccttcattagctgacggatccactgaggccgcgactgaccaccggaacgaggaactgctcgcagaggcacgaatcctgcggcagcataagtcccgcctggagacgcgtatgcagattcttgaggaccacaacaagcagcttgagtctcagttacagaggctgcgcgaactgctcctgcagccccctaccgagtccgacggaagcggtagcgctggaagctccctcgcaagctcaccccaacagtctgaggggagccatccccgggaaaaagggcagactacccctgacaccgaagcggccgatgatgtggggagcaaatctcaggacgtttctctgtgcttagaggatataatggagaaactaaggcacgcttttccttccgtgcggtctagtgacgtgacggccaacacacttttggcctcctag

SEQ ID NO: 115404 - DNA, 2640 bp, Artificial Sequence
  Description of Artificial Sequence: Synthetic coding sequence
atgaacctctgttggaatgagatcaaaaaaaagagccacaatctgcgggcccggcttgaagcatttagtgatcacagcggaaaattacagcttcctcttcaagaaataattgattggttatcgcagaaggacgaggaattatcagcccagctgccgttacagggtgacgtcgcgcttgtccagcaggaaaaagagacccatgcagcctttatggaggaggttaaaagtcgaggaccgtacatctattccgttctcgagtccgcacaagccttcctcagtcaacatccattcgaagaactggaagaaccccactctgagtccaaggacacctctcccaagcagaggatccaaaacttaagtaggtttgtctggaagcaagccacagttgctagcgagctctgggaaaaattgaccgctagatgcgtagatcagcaccggcacatcgagcggacactagaacagctactggagatacagggtgctatggaggagttgagtaccaccctgagtcaggccgagggcgttcgggccacatgggagcctataggagaccttttcattgactcactgccagagcacattcaggcgataaagctttttaaagaggaattctcccccatgaaagacggcgttaagttggtgaatgacttagctcaccaactggccatctccgatgtacacctgagtatggagaactcccaagcccttgagcagataaatgtgcgctggaaacagttacaagcctctgtttccgaaagactaaaacagcttcaggatgcacacagagacttcgggcccggtagtcagcacttcctgtcatctagtgtacaggttccttgggagcgcgctatttcaccaaacaaggtgccttactatattaatcaccaggcccagacaacttgctgggaccacccaaagatgactgagctttatcagaccctcgcggatttgaacaatatcaagttcagcgcctatcgcaccgcgatgaagctcaggcgggtccagaaggccttgagactggatctggtcacgctcacaacagcccttgaaatatttaacgagcacgacctgcaagcctctgagcacgttatggatgttgtggaggtgattcactgcctgacagcgttatatgagaggttagaagaagaacgggggattcttgtgaacgtcccactgtgcgttgatatgagtctcaattggctactaaatgtattcgatagcgggcggtcaggtaagatgcgggccctctcatttaagacagggattgcttgcctgtgtggtaccgaagtgaaggagaaactgcagtatctgttttcacaggtagcaaattcgggttcacagtgtgatcagcggcatctcggggttctcctacacgaagctatccaggtcccgcggcagcttggagaagtagccgctttcggtggttctaacgtagagccgagcgtgcggtcatgcttcagattctccactggtaagcctgtgatcgaggcttctcagtttcttgaatgggtgaacctggaacctcagtcgatggtgtggctcgccgtactccaccgagtcaccattgcagaacaagtaaagcaccaaacgaagtgctccatttgtaggcagtgtcccattaaggggttccgctacaggagtctaaaacaattcaatgtggatatctgccaaacctgctttctgacagggagggcatctaagggcaataaactgcattacccaattatggagtactacaccccaacaacaagttcagaaaacatgagagacttcgctactaccctgaagaataagttccggtcaaaacattattttagcaagcaccctcagcgggggtacctgcctgtgcagtctgtcttagaggccgactacagcgaaacaccggcttcatcgccaatgtggccacacgcagatactcactcaaggattgaacacttcgcaagccggctggccgaaatggagagccagaattgttcatttttcaatgatagtctgagccccgatgactcaatcgacgaggatcagtatctcttgagacattcctccccaatcactgatcgtgaaccagcctttggtcaacaggcaccctgctctgtggcgaccgaatccaagggagagttacagaagatcctggctcacctggaggacgaaaaccgcatcctgcagggggagctgcggcggctcaaatggcagcacgaagaggctgcggaggctccaagtctggctgacggcagcactgaggccgcaacagaccataggaacgaggaactccttgcagaagcacgaattctgagacagcataaatccagactggagacaaggatgcagattctcgaagatcacaacaagcagctagaatctcagctccagcgcctgcgagagctactcctgcagcctcccaccgagtcagacggctctgggtctgccggctcatctctagcctcatccccccagcagagcgaggggtcgcacccccgggaaaagggccaaacgacccctgacactgaagcagccgatgacgttggttccaaaagtcaggatgttagcctctgcctggaggatattatggaaaagttgcgccatgcctttccttccgtgagaagttccgacgtaaccgccaataccctccttgctagctag

SEQ ID NO: 115405 - DNA, 9129 bp, Artificial Sequence
  Description of Artificial Sequence: Synthetic coding sequence
atgcaccacgggacgggcccccagaacgtgcagcaccaactgcagcgttctcgtgcctgccccggctctgagggtgaggagcaacctgcacacccaaatcccccacctagcccagctgcccccttcgcaccctccgcctctcctagcgccccacagtcccccagttatcaaatacagcagttaatgaatcgttcgcctgctaccggacagaacgtcaacattaccctccaatccgtgggcccagtcgtcggcggcaaccaacagattaccctcgcccccctccccctcccatctccaacgagccccggcttccaattttccgcacaaccgcggcgcttcgaacatggttctccatcctatattcaggttactagccctctttctcagcaggtgcagacccaatctcccactcaaccatctccaggacccggacaggctctgcagaacgtaagggcgggagctccagggccaggcttgggcctctgctcgagctcccccactggggggttcgttgacgcatccgtcctggtgagacagattagcctgtcaccctcctctggtggccatttcgtatttcaggacggctccgggcttacacagatcgcccaaggcgcgcaggtacagctacagcatccgggaactcccattaccgtgagagaacgacggcctagtcaaccccacacgcagagtgggggcactatccaccatttaggcccccagagtcccgcggccgcggggggagccggcttgcagccactggcttcgccctctcatattactacagctaatcttcccccccagatctccagcattatacagggacagctcgtccagcaacagcaggtgctccagggcccaccccttcctcggcctctgggattcgagcgcacgcctggagttcttttgccaggggctggcggcgcagccgggtttgggatgacttcccctcctcctcccacttcccctagcaggaccgcagtgccacccggactttcctcactgccactgacctctgtcggcaacactgggatgaagaaagtgcctaaaaaactcgaagaaattcctccagcctcccccgaaatggctcagatgcgtaagcagtgtctagattatcactatcaagagatgcaggcacttaaagaggtgtttaaggagtatctcattgagttgttctttttacagcacttccaggggaacatgatggattttctcgcattcaaaaaaaagcactacgccccattgcaggcatatctgcgtcaaaatgaccttgacatcgaggaagaggaagaggaggaagaggaagaggaagaaaaatccgaggtgatcaatgacgagcaacaggcccttgctggctcacttgttgcgggcgcggggtctacagtcgagacagatttgtttaagcggcagcaggctatgccctctacaggcatggcagagcagagcaagcgcccacggctggaagtgggccaccagggcgtcgtgttccagcacccgggcgccgacgctggcgtgccgctccagcagctcatgcctactgcacaggggggcatgccacctacgcctcaggccgcccagctcgccggacagaggcaatcacagcagcagtacgatccctcaaccgggccccccgtgcagaatgctgccagtctccatacccctcttccacaactacctgggcgcctccccccagccggcgtccctacagccgctctgtcttctgccctgcagttcgctcagcagccacaggtcgtagaggctcagacacaattacagatccccgtcaaaacccagcagccgaacgtgccgattccagcccctcctagttctcagctccctatccccccttcgcaacccgcacagctggcattacacgtccctacccccgggaaggtccaggtgcaggctagccagctttcctcccttcctcaaatggtggctagtacacggctgccagtggatcctgctcctccgtgtcctcgaccgctgcctacctcatccaccagctccctcgcccccgtgagcggctccgggcccggtccatcacccgcacgttcttcccctgtgaaccgcccgtcctccgcgacaaataaagccctgtccccggttaccagtcggactcctggagtcgtagcctcagctcccactaaacctcaatcccccgcacagaatgctacttccagccaagattcttcgcaggatactttgaccgaacaaataacacttgaaaatcaagtccaccaaaggattgcagagctaagaaaagctggactgtggagccagcgcaggctgcctaagttacaggaagccccaagacccaaatcgcactgggattacctgttagaggaaatgcagtggatggcgacagacttcgcccaagaacgccggtggaaagttgccgctgctaagaaactcgtcaggacagtagttagacatcatgaagagaagcaactgagagaagagaggggcaagaaggaggagcagtcgagattgcgccggattgccgcctcaactgctcgcgaaattgaatgcttttggtccaatatcgagcaggtggtggagatcaagctacgagttgaattggaggaaaaaagaaagaaggctctgaatttgcagaaagtcagtagacggggcaaagagctgcgccccaagggctttgatgcattacaagagtcctctctggattctgggatgtcaggtcggaaaaggaaggcctccataagcctgacagacgacgaagtggatgacgaggaagaaacaattgaggaagaagaggctaacgagggtgtagtcgaccaccaaaccgaactgtccaatttagcaaaggaagcagagctccctctgttggacttaatgaagctgtacgagggggcgtttctgcctagttctcagtggcctcgccccaagcctgatggggaggatacctcgggcgaagaggatgcggatgattgtccaggagacagagagtccagaaaggacctggtcctcatcgattccctgtttattatggaccaatttaaagcagcagagcgaatgaacatcggaaagccaaatgccaaggatatcgcagatgtgactgccgttgcagaggctatcctgcctaaagggtctgccagagtgacaacaagcgtgaaattcaacgccccctctctgttatacggagcgttgagggactaccagaaaatcgggttggattggttagccaaactataccggaagaatctcaacggcattttggctgacgaggccggactgggcaaaaccgtccagattattgccttcttcgcacacttggcctgtaatgagggcaactggggtccgcatttggtcgtggtacggtcttgcaacattttaaagtgggaacttgaactgaaacgttggtgcccaggattgaagattctcagttacatcgggtcacaccgagagctgaaggctaagcggcaggaatgggccgagccaaacagcttccatgtctgtattacctcctacacccagtttttccgcgggctcactgcgtttacccgggtgcgctggaagtgtctggttatagatgaaatgcaaagagtcaaaggaatgacagaacgacactgggaagcagtgttcactctgcagagccagcagcgactcctcttgattgactctcccctgcataacactttcctcgaactttggacaatggtgcacttcctagtccctggaatcagtcggccctacctgagctcacccctgagggctcccagtgaagaaagccaagattactaccataaggtggttattcgactgcatcgggtgacgcaaccatttatcttacggcgaaccaagcgggacgtcgagaaacaactgaccaagaaatatgagcacgtgttaaagtgccggctatccaacagacagaaggccctgtatgaagatgtgattctgcagccgggaactcaagaggcattgaagtcaggccactttgtgaatgtacttagtatcctggtgagactgcagaggatatgcaatcaccccggcctcgtcgaaccacgtcatccagggtccagctacgttgctggtcctcttgagtatccctccgcatcccttattctgaaagctttagagcgcgacttttggaaagaggccgacctgtcaatgttcgaccttatagggttggagaacaagataacacgccatgaggctgagcttctctccaaaaaaaagatccctcgaaaactgatggaagagattagtacatctgcagcccccgctgcacggccagcagcagccaagctgaaagcgagtcgattattccaacccgtccaatacggccagaagcccgaagggaggactgtcgcattcccctctacccatccgccgcgcaccgctgctccgaccactgcctccgcagcacctcaaggacctttgaggggacgaccgccgattgcgaccttctctgccaatccagaggctaagggaggcgaggtcgtgaaaattgcccagctcgcctctattacgggcccccagtctcgggttgcccaaccggagaccccagtgacattacagttccaaggttctaagttcaccctctcccactcgcagttgagacaactaacggcggggcagcctctgcagctccagggatcagtcctgcaaatcgtgtcagcccccggacaaccgtacttgcgcgcccctggccctgtggtgatgcagaccgtgtcacaggctggggccgtgcacggcgcattgggctccaaaccccccgcgggcggaccctcacctgcccccctcactcctcaggtcggggtgcccggccgcgtggccgtgaatgcactcgcagtgggggaaccagggaccgctagtaagccagcaagcccaataggcggacctacacaagaggagaagactcgcttacttaaagagagacttgaccagatttatctggtgaacgaaaggcggtgtagccaagcaccggtctacgggcgtgatctgcttcgcatttgcgccctgccatcgcatgggagagtgcagtggcggggctctctagacggcagaagaggaaaggaggcagggcccgcccactcttatacctcttccagtgagagcccgtccgagctgatgctaaccttgtgccgatgcggagaatcgctgcaggacgtaatcgatcgggtagcctttgtaattccacccgttgtggcagctcctccatcactgcgggtacctagacccccccctttgtacagccataggatgcggatcctaaggcagggcttaagagaacacgcagcaccctattttcagcaactgcggcagactacagcacccaggctactacagtttccagaactgaggctcgtgcagttcgatagcggaaagttggaagcactggcaattctcctgcagaagctaaaaagtgagggccggcgagtcctgatactatcccagatgattctgatgctcgacattctggagatgtttctcaactttcattatctgacatacgtacggatcgacgaaaacgcaagttcagagcagagacaagagctgatgcgcagttttaaccgcgataggagaatcttctgtgcgattctgtctacacactcccgcacaacgggcattaatctggtggaagctgacacagtagtgttctatgataatgacctgaatcccgtcatggacgcaaaggcgcaagagtggtgcgataggatcggcaggtgtaaagatattcacatatacagacttgtaagcggtaactcaatcgaagagaaactgctaaagaatggcacaaaggatctgataagagaagtggcagcccaggggaatgactacagtatggcatttctaacccagcgcacgatccaggagctgtttgaagtctattcccctatggacgatgccggattccccgtaaaagccgaggagttcgtcgtgttgagccaggagccctccgtcacggaaaccatcgcccctaagattgcccggccttttatcgaggcactcaaatctattgaatatctggaagaggacgcccagaagagcgctcaagaaggagttctgggcccccatactgacgccctgtctagtgattctgagaatatgccctgtgacgaggaaccatctcaactggaagaactagctgactttatggagcagctaacacctattgagaaatacgcattaaattatctggagctgttccacacgagtatagaacaggaaaaggaacgcaatagtgaggatgctgttatgaccgccgtgagagcctgggagttctggaacctgaaaactctccaggagagagaggcgcggctgcggctcgaacaggaagaagcagaactgctgacatacacaagggaagatgcttattctatggagtatgtctacgaggatgtggacggccagacggaagtcatgcctctttggaccccaccgacccccccgcaggacgatagcgacatctacctcgatagcgttatgtgcctgatgtacgaggcaacacccatccccgaggctaagctgcctccagtatacgttcgtaaggagcgaaaacgacacaagacagacccctccgctgccggtcgaaaaaagaagcagcggcatggggaggccgtagtcccccccagaagtctgtttgaccgtgcaactcccggcctgctaaagattcggagggaggggaaggagcagaaaaagaatattctgttaaagcaacaggtgccttttgccaaaccattgcctacctttgctaaacctacagccgagccaggccaagacaatccagagtggctgatcagtgaggattgggccctgctgcaagccgtgaagcagctcttagagctaccgctgaatcttaccattgtgtcccccgctcatacaccaaattgggatttagtatcagatgtggtgaattcatgtagcaggatttatagatctagcaaacagtgccggaaccggtatgagaacgttattattcctagagaagaagggaaatctaaaaataacagaccccttcgcaccagccaaatctacgcacaggatgaaaatgccacacacacccaactttacacttctcacttcgatttgatgaagatgacagcggggaagaggagcccgcctattaagcctctgctgggaatgaacccctttcagaagaatccgaagcacgcttcagttcttgctgagagtggcataaactatgataagcctttacctccaatacaagtggcttctttgagagccgagagaattgctaaagaaaaaaaggcactagccgatcagcaaaaggcccagcagcctgctgtggcacagcccccccctcctcagcctcaacctccaccacctcctcagcaaccacccccaccactgccacagcctcaggctgcagggagccagccacctgcgggtcctccagccgtacagccgcagcctcaacctcagccacagactcaacctcagcccgtgcaggcaccagcaaaggcacagccagctattacaacaggcggcagtgctgctgttctagcaggcacgatcaagacaagcgttactggtacatctatgccgactggggccgtgagcggcaatgtcatcgtgaatactattgctggcgtaccggcagccacgttccagagcataaacaaacgcctcgctagccccgtggctccgggcgcattgaccacgccagggggttccgctcctgcccaggtagttcacactcagcctccaccacgcgccgtgggttcccccgccactgcgacccccgacctggtctcaatggctaccacacagggagtgcgggccgtaacatccgtgaccgcatcagccgtggtgacaacaaatctcacccctgtgcaaacacctgcaagatcactcgtaccccaggtgtctcaggccaccggcgtgcagctgcccggaaaaactattacacctgcccacttccagctcctgcgacagcagcagcagcagcaacagcagcagcagcagcagcagcagcagcagcagcagcagcaacagcagcagcagcagcagcaacagcaaaccacgactacttcccaagttcaagtcccgcaaatccagggccaggcgcaatctcccgcccaaatcaaagcagtgggcaagttaacccctgagcatctgattaaaatgcagaagcagaaacttcagatgcccccacaacctcctccgccccaggctcagtccgcacccccacaacctaccgcacaagtacaggttcagacttctcagccacctcagcagcagtcacctcagttgaccacggtgaccgccccccgaccgggcgccctccttaccggcactaccgtggcgaacctgcaagtagctaggcttacacgcgttcccacctctcagctgcaagcgcaaggacagatgcagacccaagcgccccagcccgctcaggtggccctggctaaacctccggtggtttcagtacctgccgccgtcgtgtcaagtcctggtgtcactacactgcccatgaacgtcgccggcatttcagtcgcaatcgggcagccacagaaggctgccggtcagaccgtcgtcgcccagcccgtccacatgcagcagcttctgaaacttaagcagcaagccgtgcagcagcagaaggcaatccagccgcaggccgcccaaggacccgccgctgtgcaacagaaaatcaccgcacaacagataacaacccctggcgcgcagcagaaggtcgcgtacgcggcgcagcccgcccttaaaacccaattcctcactactcctattagccaagctcaaaagctcgccggtgcccagcaggttcagacccaaatccaggtggccaaactcccccaggtggtgcagcagcagacccccgtcgcttccattcagcaggtcgcgagcgcatctcagcaggcttcaccccagaccgtggcactcactcaggcgacagcagcggggcagcaggtgcagatgataccagcggtgacagccacagcccaggttgttcagcagaaactgatacagcagcaagtggtcacaaccgcaagcgcccctctccagacacctggagcccctaatccggcccaggtgccagcaagtagcgactctccctctcagcagcccaagctccaaatgcgagtgcctgccgtgcgtctgaagactcccaccaagcccccgtgccagtag

SEQ ID NO: 115406 - DNA, 9261 bp, Artificial Sequence
  Description of Artificial Sequence: Synthetic coding sequence
atgcaccatggtacaggcccccagaatgtgcagcaccaacttcagcggtcacgcgcctgtccaggatctgagggggaagaacagcccgcccatccaaacccacctcccagtcctgccgctccattcgcccctagcgcaagcccttcagcaccccagtctccatcataccaaattcaacagcttatgaacagatctcccgctactggtcagaacgtcaacattactctgcagagcgtggggcccgtcgttggcggcaatcagcagatcactctggcacccctgccactcccttcaccaacatctcctggatttcagtttagcgcgcagccaagaagatttgagcacggctccccgtcctacatccaggtaacctcacccttatctcagcaagtccagacccaatcaccgacacagccctcccccggccctggccaggccctccagaatgtacgggccggagctccagggcctggactcgggctgtgctcctcctcccctaccggcggttttgttgatgcgtccgtgcttgttcgccagatttctctgtcacccagtagtggcggacattttgtgtttcaggacggctcagggcttactcagatcgcccaaggcgcacaagtgcagcttcagcaccccggcactccaattacagtccgggagcggcgcccttcacagccgcatacacagtcaggaggtactatccaccatctgggaccccagtctccagcagcagctgggggggctggtttacagcctttagcctcgcccagccatatcacaaccgctaatctgccacctcagatctcgtctattatccaggggcagttggttcagcaacaacaggttttgcagggtccccccctgccacggcccttagggtttgaacggaccccaggagttctgttgccaggagccggtggcgcggcaggttttggcatgacatctccacctccgcccacatcaccgagccggacagccgtgcctccagggctgagctcccttccactgaccagcgtcggaaacaccggaatgaagaaggtgccaaaaaaattggaagaaattccacccgcgtcacccgagatggcacagatgcggaaacaatgtttggactaccactaccaagaaatgcaggcgctgaaggaggtcttcaaggaatatctgattgagttgtttttcctgcagcactttcaaggcaacatgatggatttcttggcgtttaaaaagaaacattatgccccccttcaggcttatttacgtcaaaatgacctcgacatcgaggaggaggaagaagaagaagaagaggaagaagagaagagtgaggtgattaacgatgagcaggcactcgcaggctctctggtggccggtgccggatctacagtggaaacagatctgtttaaacgccagcaggcgatgccttcgacaggcatggccggcggcatgccacccactcctcaggcagctcagctcgcgggtcagcgacaaagtcagcagcaatacgatccatccactggtccaccagtccagaacgctgcctcgcttcatactccccttccccaactgccaggaaggctgcctcctgccggcgtcccaacagcagccctatcctcagcactgcaattcgcgcagcagccgcaagtcgtcgaagctcagacgcaacttcagattcccgtcaagacacagcagccaaatgttcccatcccagcacccccatcatcgcagctgcccattccaccctctcagcctgctcaacttgcactccatgtaccaacacctggaaaggtacaagtgcaggcctcccagttatcctccttaccccagatggtcgcgagcaccagactgccagttgaccctgccccgccttgtccccgccccctgcccacatcctctacaagttcgttggctccagtgtccggctctggccccggtccgagtcctgccagaagctctccggtgaatagacccagttcggccactaataaggccctttcccctgtcacttccaggacccccggcgtcgtcgcctctgcccccacaaaaccacagtcacctgctcagaatgctacctcctctcaggactcctcacaagataccctgactgaacagataaccttggagaatcaggtgcatcagcggatcgctgagttgcgcaaagccggcctgtggtcccagagaaggctgccaaaactgcaggaagcgcccaggcccaagagccattgggactaccttctcgaggaaatgcagtggatggccaccgattttgcacaggaacgccgatggaaagtggcggccgccaaaaagctggtgaggaccgtagtgagacaccacgaagagaagcagttgcgagaggaaaggggcaagaaggaagagcagtctagactgcgtcgcatcgcggccagtaccgcaagggaaatagaatgtttctggtcaaacattgagcaggtcgtggaaatcaaactgcgcgtggagctggaggaaaaaagaaaaaaagccctcaatctgcagaaggtgtctcgacgaggcaaggaactgcgtccgaaaggtttcgacgctctgcaagagtcaagcctcgactccggtatgtccgggcggaaacggaaggcctcaattagtctgacagatgacgaggtggatgatgaggaagaaactattgaggaggaagaggccaacgagggcgtagtcgatcatcagacagagctatccaaccttgccaaggaggcagagctgcccctcctggatctaatgaagctatacgaaggcgcatttctgcctagcagccagtggccgagacctaaaccggatggagaggacacaagcggggaagaagacgccgacgactgtccaggggatcgcgaatcacggaaagacctcgtgcttatagactctctgtttatcatggatcagtttaaagcagcagagaggatgaatatcgggaaaccaaacgccaaggacatcgccgacgttactgccgtcgcagaggccatcctccctaaggggtcagcccgagtgacaacaagcgtcaagtttaatgcacccagcctcctatatggcgcactacgggattaccagaaaataggcttggattggttagccaaactgtaccgtaagaatctgaacggtattctggccgacgaggctgggctcggcaaaacagtgcagatcatcgccttctttgcccacctggcgtgtaacgaaggaaactggggaccgcaccttgtggtagtgaggtcctgcaacatattgaagtgggagctcgaactcaaacgttggtgtcccgggctgaagatcctctcttacattggatcgcaccgcgagcttaaagcaaagagacaggaatgggccgagccaaactcattccatgtctgcatcacctcttacacccagttctttcggggtctgactgcatttacacgggtacggtggaagtgcttggtgatagacgagatgcaacgcgttaagggtatgacagagagacactgggaagccgtttttaccctacagtctcagcagcgcctcctcctcatcgactctccacttcacaacacatttctggagttatggaccatggtccattttctggtgcccggcatctctcgcccctatctgtcttcgcccctgagagctccttctgaggagagtcaggactattatcacaaggtcgtaatcagactccatcgagttacccagccgttcattctcagacgcaccaaacgagatgtcgaaaagcaactcactaagaagtacgaacacgtgctgaagtgccgcctaagtaaccgacagaaggccctgtacgaggacgtaattctgcagcctggcacccaggaggctctcaagagcggacattttgtgaatgtgctctccattctggtgagattgcagcgaatttgcaatcatcctggcttggttgagccccggcatccagggagctcttacgtcgccggacccctggaataccccagcgcatccttgatcctgaaagctctcgagagagatttctggaaagaggccgatttgtcaatgttcgacctgataggcctggaaaacaagataactaggcatgaagctgaactactgagcaaaaagaagattccacgtaagctgatggaagagatctccaccagcgcagctcccgcagcaagaccagccgctgctaaactcaaagcatccaggctatttcagcccgtgcaatatgggcagaaacctgagggaaggaccgtcgccttcccttccactcatcctccaagaactgccgctccgacgactgcgtcagctgcgcctcaggggcccctcagaggccgtccgcccatcgccacattttccgccaacccagaggcaaaggcagccgctgctccatttcagacctctcaggcatccgcttctgccccaaggcaccagccggcctctgcctcctcaacagccgcatcgccagcccatccagctaagttgagagcccagaccactgcacaggcctcgacgcccggccaacctccaccccagcctcaagcgccaagtcacgccgccgggcagagcgcccttcctcaaagactagtgctgccttctcaggctcaagcgagacttcccagcggagaagtggttaaaattgcacaattagccagtatcaccggccctcagagccgagtcgctcagcctgagactcctgtaacccttcagtttcagggctctaagttcactttgagccacagtcagcttcgacagctcactgccggccaacccctgcagttacagggttcagtcttacaaattgtctctgccccaggacagccatacctgagggctcctggaccagtggtgatgcagaccgtgtcacaggcaggagccgtgcacggtgccctgggtagtaagcccccagctgggggcccttctccagcaccgttgacaccgcaggtgggtgtccctggccgagtggctgtgaatgcactggctgttggggaacctggaacagcctctaaacccgcttctcctatcgggggacccacccaggaagaaaagacaagactgctcaaagagcggctggatcagatatacctcgtaaacgagagacgttgttcacaggcaccagtgtacggcagggacctcttacgcatatgtgccctgccttctcacggccgggtgcagtggcgcggatcactggatggacggagaggtaaagaggcagggccggcccattcttataccagcagttcggaatcaccgtctgaactcatgctgactctctgtcgatgcggtgagtcgctgcaggacgttattgatcgtgtggcctttgtcattcccccagtggttgcagccccaccgtcactcagagtgccgcgccctccccctctgtactcacacagaatgcgcatcctgcggcagggcctacgggagcatgccgccccatactttcagcagctgcgccagacaaccgcaccaaggctcctgcagttcccagagttgcggttagtgcaatttgacagcggaaagttggaagcgctggccattctgctccaaaagctcaaatccgagggtagacgggtactcatcctgtcacagatgatactgatgcttgatatactcgaaatgttccttaactttcattacctgacctatgtccggatagacgaaaatgcttcaagtgaacagagacaggaactcatgcggtcgttcaatcgcgataggcggatcttttgcgctatcctctctacgcacagcaggactacagggattaacctggtcgaggcagatacagtggtgttctatgataacgatctgaatccagtaatggatgctaaggcacaggagtggtgtgatcgcattggtagatgtaaggacattcatatctacaggttagtctccggtaactccatcgaagagaaactcctcaaaaatggaaccaaggacttaataagggaggtggctgcccagggcaatgactatagtatggcattcctaacccagaggaccattcaggaactgttcgaggtgtacagtcctatggacgatgccggctttccagtgaaggctgaagaattcgtcgtgctgagccaagagccctctgtcacagagacaattgcccccaaaatcgcacggcccttcattgaggcgctgaagagtatcgaatacctggaagaagatgcgcaaaaaagtgcgcaggaaggcgtgttggggccccatacagatgccctgagcagcgattcagaaaacatgccttgcgatgaagagccatcacaattggaggaacttgccgacttcatggaacaactcaccccgatcgagaaatatgcactgaattatttagagctattccacacctccatcgagcaagaaaaagagcggaattccgaagacgcagtgatgacagctgtgcgagcatgggagttttggaatttaaaaacactgcaggaacgagaagcacgccttcggctggaacaggaggaagctgaactgctgacctataccagggaggacgcctactctatggaatacgtctatgaagatgtcgacggacagactgaagtgatgcccctgtggactccacccacacctccgcaggatgattcggatatctatctggacagcgttatgtgccttatgtatgaagccactccaatcccagaagcgaaactccccccggtttacgttaggaaagagagaaaacggcataaaacagatccaagtgccgccggccgtaagaaaaagcaacgccacggtgaagccgttgtccccccccgttctctattcgatagggcaacccctggtcttcttaaaatccgacgggagggaaaagagcagaagaaaaatatcctgcttaaacagcaagtcccattcgctaagccactccccactttcgccaagcccacagcagagcccgggcaggacaatcccgaatggttgattagtgaagattgggccttgctgcaggcagtgaaacagctacttgagctgcctctgaatttaacaatcgtttctccagcccatactccgaactgggacttggtcagcgacgtggtgaactcttgctccaggatctaccggtcgagcaagcagtgtcgtaatagatatgagaacgtgattatcccaagagaagaaggaaagagtaagaataaccgaccactgaggacaagtcagatttatgcacaagacgagaatgccacgcacacacagctttatacaagtcattttgacctcatgaagatgaccgccggaaagcgcagcccaccgattaagcccctgctcggcatgaatcccttccagaagaatccaaagcacgcaagtgtccttgccgagtcagggataaattacgacaagccactcccaccgatccaggtcgcgtctcttagagctgagcggatcgcaaaggagaagaaggccttggcagatcagcagaaggcacagcagcccgccgtagcacaaccaccacccccacaaccgcaacctcccccaccaccgcagcagcctccaccacccctgccccagccacaggccgccgggagtcaacccccagccggaccgccagcggtacagccacaaccccaaccgcaaccccagactcagccccagccagtccaagctcctgccaaagcgcaacctgctatcacgaccggtggcagcgctgcagtcctcgcagggaccattaaaacttcggttactggcactagcatgccgacaggcgccgtaagtgggaatgtcatcgtgaatacaattgccggcgtacccgccgcaacctttcaaagcattaataagagactcgctagtcctgtggctccaggtgcacttacaacgcctggtggctctgcacctgcccaggtggtgcacacccagccacctccccgcgctgtagggtcgcctgctacagcgaccccagaccttgtgagtatggctacaacacagggggtgcgcgctgtaaccagcgtcaccgccagcgctgtggtcacaaccaatttgacgcctgtgcaaaccccagctcgctcattggtcccgcaggtctcccaggctactggcgtgcagctgcccgggaagacgattacacctgcgcacttccaactcctgcgtcagcaacagcaacagcagcagcagcagcagcagcagcaacaacagcagcagcagcagcagcagcagcagcagcagcaacaacagcagacaactacgacttcccaggttcaggtgccgcagattcagggccaggcacaaagccctgctcagatcaaggctgtcggcaagctgacccccgagcaccttatcaagatgcagaagcagaagctccagatgccgcctcaacctcccccaccccaggcccaatcagcaccgccgcagccaacggcccaagtccaggttcagacttcccagccgccgcagcagcagtctcctcagctcaccacagtgaccgccccaagacctggcgccttgctgacagggaccacagtggcaaatctgcaggtggctagacttacacgggttccgacctcccagctacaagcacagggccaaatgcagacacaggctccacagccagctcaggtagccctggctaagccgccagttgtgtccgtgccggcagccgtggtgtcaagtcctggagtaacaaccctccctatgaatgtggccggaatatcggtagcaattgggcagccacagaaggctgccggacaaaccgtcgtggctcagcctgttcacatgcagcagctgctgaagctgaagcaacaggcagtgcagcaacagaaggccatccagccccaagccgctcaggggccagctgccgtgcaacaaaagattaccgctcaacagatcactactcccggcgcccagcagaaagtggcctatgctgcccagcccgcattaaagacacaattcctgactacacccatttcccaggcacaaaaattggctggcgctcagcaagtgcagactcagattcaagtggccaaattgccccaggtggtacagcagcaaacgcccgtcgcctctatccaacaggtagccagtgcctcacagcaggcttccccgcaaacggtcgctctgacccaagctacggcggccggtcaacaggtacagatgatccctgccgtgaccgcaaccgctcaggtcgtccagcaaaagttaattcagcagcaggtcgtgacgacagcatcagcgcccctgcagacacccggagcacccaatccggcacaggttcctgcaagcagcgacagcccatcccagcagcctaaactccagatgcgggtccccgctgtgcgcctgaaaacacccacgaaacccccatgtcagtag

SEQ ID NO: 115407 - DNA, 9480 bp, Artificial Sequence
  Description of Artificial Sequence: Synthetic coding sequence
atgcaccacggcaccgggccccaaaatgtgcagcatcagttacagcgatccagagcttgtcctgggagcgagggcgaggagcaaccggcccacccaaatccgcccccaagccccgccgcacccttcgcaccgagtgcatctccatcagcccctcaaagcccctcttatcagattcaacagttaatgaaccgatcgccagcgacaggtcagaatgtaaacattacattgcagtccgtgggccccgtcgtagggggaaatcagcaaataactctggcccctctgcccctgccgtcacctaccagcccaggatttcagttttccgctcagcctagaaggtttgagcacggctccccatcatatatacaggttacaagccctctcagccagcaagttcagactcaatctcccacccagccctcaccaggccccgggcaggccctgcaaaacgtgagggctggggctccaggtccagggcttggcctgtgtagcagtagcccaacgggtggatttgtggacgcatctgtgttagtgagacaaatcagtctctcacctagttccggcgggcactttgtgtttcaggacgggagcggcctcacacaaatcgctcagggcgctcaggtccagctgcagcacccaggcacacctatcactgtaagggagcgaagaccttctcagcctcacacacagagcggaggtaccatccatcacttaggacctcagtcccccgccgccgccggcggtgcaggtctccaacccctggcttctcccagccacatcactacagcaaatctccctcctcagatctcatccattatccaaggacaacttgttcagcagcaacaggtactccaagggcctccgcttcctcgtccactcggatttgaacgcacccctggagttcttttgcccggggctggcggggccgcaggatttggtatgacctcccctccacccccaaccagtccttcccggaccgcagtgcctcctggcctgagtagcttgccccttacatccgtcggtaacacagggatgaaaaaagtgcccaaaaagcttgaggagatccctcctgcctccccggagatggcacaaatgcgaaagcaatgcctcgactaccattaccaggaaatgcaggcactgaaagaagtatttaaggaatacctaatcgaacttttcttcctgcagcacttccagggcaacatgatggactttctggccttcaagaaaaagcactacgccccactgcaggcatacctgagacaaaacgatctcgacatagaagaagaagaagaagaggaagaggaggaagaggaaaaatctgaggtcataaacgacgaggttaaagtcgtcaccggtaaggatgggcagactggaacacccgtagctattgcgactcagctgccccccaaggtgtccgccgcattcagttcccagcagcagccttttcagcaggccctggccggctctttagtcgcaggggcaggaagtaccgtcgagaccgacctgttcaaaagacagcaggccatgccctctaccggcatggccgaacagtccaagcggcctcgcctggaagtggggcaccaaggagtggtgtttcagcacccgggagccgacgcaggtgttcctctccagcagctgatgccaaccgctcaaggtggaatgcctcctacaccgcaggccgctcagctcgctggccaaaggcaatcccagcagcaatatgacccttctaccgggccgccggtccaaaacgccgcctcattgcacacaccactgccacagttgcccggacgcctccctccggccggcgtgcccaccgctgcgctcagcagtgcgctgcagtttgcacagcagcctcaggttgtagaggcacagacccagctgcaaattcccgtaaaaacgcagcaacctaacgtgcccatccctgcccctccatccagccagttgcctatcccaccatcacaacccgctcagctagccttgcacgtcccaacccctggaaaagtgcaagtccaagctagccaactgtcatctctgccccagatggtcgccagcacaagactgcctgtcgacccagctccaccttgccctaggcctcttcctacctcatcaacctctagtctggctcctgtgtctggcagcggccctggccccagtcccgctcggtccagtcccgtgaaccgaccatccagcgctaccaacaaggccctgtcacctgtcacctccagaacgcccggcgtcgtagcttcagcccccactaaaccacaaagccctgcacagaatgctacatcatctcaggactcttcacaggatacgctcacggagcagattaccctggagaaccaggtacatcaaaggattgcagaactgagaaaagccgggctctggtcccaacgccggctcccaaaactccaggaagcgccccgacccaagtctcattgggactaccttctggaagaaatgcaatggatggctactgacttcgctcaagaacgcaggtggaaggtagctgcagccaagaagctcgtgcgaacagtcgtgcgccaccatgaagaaaagcagctccgtgaggaacggggcaaaaaggaagagcagtcaaggctccggcgaatcgccgcttcgactgcaagggagatcgaatgtttttggtctaatattgaacaggttgtggaaatcaaactgcgggtcgagttagaagagaagaggaaaaaagcactaaacctacagaaggtctccagaaggggaaaggaactacgaccaaagggctttgatgcattacaggaaagtagtctcgattcggggatgagcggacgcaaaagaaaggcatccatttctctgacagacgatgaagtggacgatgaggaggagactatcgaggaagaggaggcgaatgagggggtggtagaccaccagacagagcttagtaacctagccaaggaggctgagctgccacttctggatctcatgaagctgtacgagggggcgtttttaccctctagccaatggccaagacctaagccagatggagaagatacgagcggcgaggaggatgctgatgactgcccgggagaccgggaatcccgcaaggatctggtgctgatcgactcactgttcataatggaccaatttaaggccgcagagcggatgaatatcgggaagcccaatgctaaggatatcgccgacgtgaccgcagttgcagaggccattctgccgaaggggtctgcccgggttactacatctgtgaaattcaacgctcctagcttgttgtacggagcattgcgtgattaccaaaagatcgggctggactggcttgcaaaattatatcggaagaaccttaacggcattcttgccgacgaggcaggactgggcaagacagtgcagatcattgctttttttgcccatctggcctgcaatgaagggaattggggtcctcacctggtcgtggtcagatcttgtaatatactcaagtgggagctcgagctgaaacggtggtgtccgggactgaaaattctttcatatataggaagccatagggagctcaaagctaaacgccaggagtgggccgagccaaattctttccacgtatgcattacaagctacacccagttctttcggggcctgaccgctttcactcgagtacggtggaaatgcctggttattgacgagatgcaacgggtgaaaggcatgaccgaacggcactgggaagccgtcttcaccttacaaagccagcaacgcctgctcctgatagattccccattgcacaataccttcctagagctgtggactatggtgcatttccttgtccctggaatctcccgcccctatctgagctccccacttcgtgccccttcggaggagtcccaggactactatcacaaagtcgtgatccgtctgcacagagtgacccagccatttatcttgcgacgaaccaagagagatgtggagaagcagttaacgaaaaagtatgaacatgtactgaaatgtcggctcagcaaccgccaaaaggcgctgtatgaagacgtgattttgcaaccgggtacccaggaagctctaaagtctggccactttgtgaacgtcctctccattctggtccgtctgcaaaggatttgtaaccacccgggcctggttgagcctaggcaccctggttcttcatatgtggctgggcccctggagtacccttccgctagcctcatacttaaagctttggagcgcgatttttggaaagaggctgacctctccatgtttgaccttatcggcctcgaaaataaaataacccgccacgaagctgagcttctgtcaaagaaaaagattccacgcaaattaatggaggaaatctccactagcgccgcgcccgctgctaggcccgcggccgccaagctgaaagcctcgcgcctttttcagccagtccaatacggccagaagcccgaagggcggaccgttgctttccctagcacccatcccccgcgaactgccgcccccaccactgcatcagccgccccgcaaggccctctccgcggtcggccaccaatcgcgaccttcagtgccaatcctgaggccaaagccgccgcagcacctttccagacttcccaggcatctgcgtctgcccccaggcaccagccggcaagcgcctcatcaacagctgcttctccggcccaccccgcgaaattacgcgcgcagactaccgctcaggcctctactccaggccagccccccccccaaccgcaggccccgagccacgcggctggccagtcagctctccctcagcggctggtgctaccaagtcaggcacaggctcgcttgcctagcggagaggttgttaaaatcgctcagcttgcctctataacaggcccacagtccagggttgcccagcctgagactccagttacgctccagttccagggttccaaattcactctctctcatagccagctgcgccagctgaccgctggccagcccttgcaactccaaggctcagtcctgcagattgttagtgctcctgggcaaccatacctccgggcccctggacccgtggtaatgcagacagttagccaagcaggcgctgtgcatggcgcattggggtccaagcctccagctggcgggcctagtccagcaccactgaccccgcaagttggagtgccaggtcgcgtggctgtgaacgctttagcagtgggggaacccggcacagcctctaaacctgcaagtccaatcggcggacctacccaggaagaaaaaacccgactgcttaaggagcgtctggatcaaatatatctagtgaacgaaagacggtgttcacaggcaccagtctatgggcgcgacctgttgcgaatctgtgccctccctagtcacggtagagttcaatggaggggctccctggacggcagacggggaaaggaagctgggccagcacactcctatactagctccagcgaatccccctctgagctgatgctgaccctgtgccgttgtggagaaagcctgcaggacgtaatagaccgcgtcgctttcgtaattcctccggtggtcgctgcacccccttccctacgggtgccccgacccccacctctttatagccatcgcatgaggatcttgaggcagggcctccgcgagcacgcggctccttatttccagcagctgaggcagacaactgctccacggctgctgcagttcccagaactgcgactggttcagttcgacagcggcaagctcgaggcccttgcaatcttgctgcaaaagctaaaaagcgaaggtcgcagggtgctgatattgtcacagatgattctaatgctggatatcctggagatgttcctcaatttccattacctaacctacgttagaatcgacgaaaacgcaagctccgagcagcgtcaggaattgatgcggtcatttaatcgagaccgacggatcttttgcgctatactgtccacacacagtcggacaaccggtataaacctcgtggaagccgataccgtcgttttttacgacaatgacttgaaccccgtaatggatgccaaggctcaggagtggtgcgatcgcatcggtagatgcaaggacatccatatctaccggttggtgtctggcaactcaatcgaagagaagttgctcaaaaatggcacaaaagacttgatcagggaggtagccgcccaagggaacgattatagcatggcctttctcacccagcgaactatccaagagctgtttgaggtctactcacccatggatgatgcggggtttccagtgaaagcggaggagttcgtggtcctcagccaggagccttcagttactgaaactatcgctccgaaaatcgctagaccgtttatcgaggccctgaaatcaatagaatatctcgaggaggatgcgcagaagtctgcccaagagggagtactcgggccccacaccgacgctctaagctccgactccgagaacatgccttgcgatgaagagccctcgcagctcgaggaacttgctgactttatggagcagcttacccctattgagaaatacgctcttaactacctcgaacttttccatacatccattgagcaggagaaggaaaggaacagtgaagatgctgttatgacggcagtgagggcatgggagttttggaacctcaagacgctacaggagcgcgaggcccggctgcggctcgaacaagaggaagcagaacttctgacctacacaagggaagatgcatatagcatggaatatgtgtacgaagatgtggatggccagacagaagtcatgccactgtggacacctccaacccccccccaggatgacagtgacatctacttagactcggttatgtgcctgatgtacgaggcgacccccattccggaggcgaagctgccacccgtgtacgtacgaaaagagaggaagcggcataagaccgacccatctgccgcagggagaaaaaagaagcagagacatggggaggctgttgttccaccccggtccctgttcgacagggcaacacctggcctcctcaagatccggcgggagggaaaagagcagaagaaaaacatcttgctcaagcaacaagttccattcgccaagccgctgcctaccttcgcgaagccaactgcagaacccggccaggacaacccagaatggctgatctcagaggattgggctctgctgcaggcagtcaagcaactgcttgaactccccctgaacctgacaatcgtgtctcctgcccacacgccgaactgggacctggtgtcggacgtggtgaactcctgctcccgaatttacaggtcctcgaaacaatgtcggaatcggtatgaaaatgtgataattcccagagaggaaggaaaatctaaaaataatcgccccctgagaacatcccagatatatgcccaggacgagaatgccactcatacccagctctataccagccactttgatttaatgaaaatgactgcggggaaacggagcccgcccatcaaacctctcttgggaatgaacccttttcagaagaatccaaagcacgcctcggtactggcggaaagtggtattaattatgacaagccgctaccaccgatccaggtggcttcgcttagggcagagaggatcgcaaaagagaaaaaagccctggctgatcagcagaaagctcagcagcccgccgtagcgcaaccccccccaccacagccacagccgccaccccctccccagcagccgccaccccctttgcctcaaccgcaggcagccggatcccagccgcccgctggacctccggcagtgcaaccccaaccgcaaccgcagcctcaaacacaaccgcagccagtgcaggctcctgctaaggcacagccggctattaccaccggtggctcggccgcggtgttagctggcactatcaagacaagtgtcacaggcacgtccatgcctaccggggctgtgtcaggcaatgtgattgtgaacaccattgcaggcgttccagccgctacctttcaatccataaataaaaggctcgcatctccggtggctccgggagccctgacgacgcctggtggatccgcgccagctcaggtggttcacacacaaccccccccgagggccgtcgggtctcccgcaacggcaacccctgatctggtttcaatggccaccacgcaaggggtgcgggcagtcacatctgtcaccgcttctgcggtggtcacaaccaacttgaccccagtgcaaaccccggccagaagcctcgtccctcaagtgtcccaagccaccggcgttcagctcccgggtaagactattacgcccgcacatttccagcttcttagacagcagcaacaacagcagcaacaacagcagcaacagcagcagcaacaacagcagcagcagcagcagcaacagcagcagcagcaacagaccacgaccacatcccaggtgcaggttccccagatccaaggtcaggcgcagtctcctgcccaaatcaaggctgtgggaaagttgactcctgagcatctgatcaagatgcagaaacaaaaattgcagatgcccccccagcccccacccccacaggcccagtctgcacccccacaacctactgctcaggttcaagtgcagacctcccagcctccacagcaacagagcccccagctgacaaccgttactgcaccgcggcccggtgccctgctcactgggactactgtggctaacttgcaagtggcacgcttaactcgggtgccaaccagtcagctccaagcacagggacagatgcaaacccaagccccacagccagctcaggtggcacttgccaagcctcccgtggtcagtgtgcctgctgcggttgtgtcttctcccggagttacaactcttcctatgaatgtcgcaggcatctcagtcgcgatcgggcaaccccagaaagccgctggacaaaccgtcgttgcacagcctgtccatatgcagcaactgcttaaattaaagcagcaggctgtgcaacaacaaaaagccattcagccacaggcggctcaggggccggccgccgtccagcagaaaattacggcgcagcaaattaccacacccggagctcaacagaaggttgcttatgcggcccagcctgccttgaagacacagttcttaaccacccctatcagtcaggcacagaagcttgcaggagcccagcaggtgcagacacagattcaggttgccaagctgccccaggtggtgcagcaacagaccccggttgcctctattcaacaggttgcctccgcaagccagcaggcctctcctcagaccgttgctctcacccaggctaccgccgccggtcagcaagtgcaaatgatccccgcggtaactgctactgcacaggttgtgcagcaaaagttaatccaacagcaggtggtgaccaccgcctctgcacctctccagacccctggagctcccaaccccgcccaagtccccgctagcagcgatagcccgtcacagcaacctaaactacagatgcgcgtgccagcggtccgactgaagacccccactaagccaccttgccagtag

SEQ ID NO: 115408 - DNA, 9372 bp, Artificial Sequence
  Description of Artificial Sequence: Synthetic coding sequence
atgcaccacgggactggaccccagaatgtccagcaccagttgcagcgcagcagagcctgccccggcagtgagggtgaggagcaacccgcccatcccaaccctccgccatccccagccgccccttttgctccatctgcttctcctagtgcaccacaatccccgtcttatcagattcagcagctcatgaatcgatcccctgccactggacagaatgttaatattactctccagagcgtgggcccagttgtaggcgggaatcagcaaatcaccctggccccccttcctctcccttctcctacctccccagggtttcagttcagcgcccaaccccgacgcttcgagcacggttccccatcttatatccaagtcacgtcaccactgtctcaacaggtgcagacacagagtccaacacagccttccccaggacccggtcaggctctccaaaatgtacgggctggcgcacccggcccgggcttggggctctgttcaagttcccccaccggagggttcgtggatgcttctgttctggtcaggcagatttcactgtcgcccagctccggaggacactttgttttccaggacgggagcggactgacacagatagctcaaggagctcaggtgcaattacagcaccccggcacccctatcaccgtgcgggaaaggaggcctagtcagcctcacacccaatcaggagggacgattcatcacctcggaccgcaatcccccgctgccgccgggggggcaggactccagcccctggcctccccctcacacattactacggccaacctgccgcctcaaatttccagcattatacaggggcagctcgtccaacagcagcaggtactgcaagggcctccgttaccaagaccattaggttttgagagaacccccggggtgctgctcccaggtgcagggggcgcggcgggcttcggaatgaccagcccaccgccaccaacaagtcctagccggacggctgtccctcctgggctttcaagtttgcccctgacgagtgtgggtaacaccgggatgaagaaggttcccaagaaactcgaggagatccctccggccagcccggaaatggcccagatgcggaaacaatgtttagattaccattaccaggagatgcaggccttaaaagaggtgttcaaggaatacctgatagagcttttcttcttgcaacacttccagggaaatatgatggactttttggccttcaaaaagaagcattacgcccctctgcaggcctatctgcgacagaatgacctcgacattgaggaagaagaggaggaagaggaagaagaggaagagaaatctgaggtgatcaatgatgagcaacaggccctcgccgggagcttagtggctggggccggaagcacggtggaaacggacctcttcaaacggcagcaggctatgcctagcactggtatggcagagcaaagcaagcggccacgattggaagtgggacatcagggcgtcgtgtttcagcatccaggcgccgacgctggcgtgccattgcagcagctcatgccaaccgctcaggggggaatgccccccactccccaagcggctcagctggcaggtcagcggcagtcccaacagcagtatgacccctctaccggtccccctgtgcagaatgcagccagcctccacacacccctgccacagcttccgggccgcttgcctcccgccggagtgcctactgccgcattaagctccgccctccagtttgcccagcagcctcaggttgtggaggctcagacacaattgcagatacccgttaagacacagcagccgaacgtgcctatccccgcgcccccctcttcccagctacctataccccccagtcaaccggcacagctagccttgcatgtgcccacccctgggaaggtgcaggtccaggcaagtcagctgtccagccttcctcagatggtggcaagtacccgtctgcctgtggaccctgctcctccgtgtcctcggcccctgcctacttccagcactagcagcctggctccagtgtctggcagcggtcctggcccctccccagctagaagctccccggtgaaccgtccctcctccgcaactaacaaggccctcagccctgtgaccagtaggactcctggtgtggtcgcatcagctccgaccaagccacaaagtcccgcacaaaacgctactagcagccaggactccagccaggacactctgacggagcagattaccttggaaaaccaggtccaccagcgaatcgccgagctcaggaaggcagggctgtggtctcagagaaggcttcctaagcttcaggaggctccacgacctaagtcacactgggactacctgttggaggagatgcagtggatggctactgacttcgctcaggagcgacggtggaaggtggctgccgccaagaaactggtgcgcacggtggtccggcaccatgaagagaagcaactgagggaagagagaggcaagaaggaggagcaatcacgcctccgtcgcatcgctgcctctacagctcgagagatcgaatgcttttggtcaaacatcgagcaggtcgtggagattaagcttcgagtggaactggaagagaagaggaaaaaagcgttgaatcttcagaaagttagtcggcgaggaaaggagctacgccccaaagggttcgacgcattacaggagtcctctctcgattccgggatgtccggaagaaagaggaaggcatcaatcagtttgactgacgacgaggttgacgatgaggaagagaccatcgaagaggaggaggctaatgagggcgtggtggaccaccagaccgagcttagcaacctggctaaggaggctgaattgcctttattggacctcatgaagttatatgaaggggccttcctgccaagcagccaatggccccggcctaaacccgacggagaggatacctccggtgaggaggatgccgacgactgtcccggtgatcgcgagtcccggaaggacctagtgctgattgattcactattcatcatggaccaatttaaagccgcagagcgaatgaatattggaaagcccaatgcgaaagacatcgccgacgtcactgcagtagccgaggcaatcctgccaaaaggcagtgcccgggttacgacctcagtcaagttcaatgcccctagcctgttgtacggtgctcttagggactatcaaaagataggtttggactggcttgctaaactgtatagaaaaaatctaaacgggattcttgctgatgaggcaggcctggggaaaacagtccagatcatcgcgttctttgcccatttggcttgtaacgaaggaaactggggaccacatctcgtggtggttaggtcatgtaatatcctaaaatgggaacttgaactgaagaggtggtgtccaggcctgaagattctgtcttacataggctcacaccgggagctgaaagctaaacggcaagaatgggctgaacccaattcttttcatgtgtgcatcacctcctacacgcaatttttccgtggtctcaccgccttcactagagttcgctggaagtgtttggtaattgatgaaatgcagcgggtgaaaggaatgactgaacggcattgggaagccgtgtttacgctccaatcgcaacagagactccttcttatcgactctcccctccataacaccttcctggagctatggacaatggtgcacttcctggttcccggtatatctcggccttacctgtcgtctccgttgagggctccctcagaagagagccaggactattatcacaaggtggttatcagacttcatcgggtcactcagccatttattttgagaaggaccaagcgcgacgtggagaagcagctgacaaaaaagtacgagcacgtgctcaagtgcagactgtccaatcggcaaaaggctctgtatgaggacgtaatcctccagccagggacacaggaggctcttaaaagtggccattttgttaacgttctgagcattttagtgcgcttacagcgcatttgcaaccatcctggattagtcgagcctaggcaccccgggtcctcttacgtggccggccccctggaatacccatccgcaagccttatccttaaggctttggaacgcgatttttggaaagaggcggatctgagcatgttcgaccttatcgggttagagaacaaaatcactcgtcatgaggcggaactactctcgaaaaaaaagatccccaggaagctaatggaagagatctccacctctgccgccccggctgcccggcctgccgctgccaagcttaaagccagcaggctattccaacccgttcagtacgggcaaaagccagagggaaggacagtagcttttccctccacacaccctccccgcacggctgctccgaccaccgcaagcgctgcaccgcagggacctttgcggggaagaccccccattgctaccttttctgcaaaccccgaagctaaggctgctgccgcaccattccagacctcccaggctagtgcctcagccccccggcaccaaccagcttctgcatcttctactgcagcgagccctgctcatcccgctaagctgcgtgcccagaccacagcacaggcttctacaccgggacagcccccaccgcagccacaagccccatcacatgcagcagggcaaagcgcactgccccagcgccttgtgttacctagccaggcacaggcccgcctgccctccggggaggtcgtgaagatcgcccagctggcctccatcactgggccccaaagccgagttgcccagcctgagacaccagtcaccttgcagtttcagggttctaaatttactctcagtcactcacaattgcgacagctgaccgcggggcagcccctgcagctgcagggttccgtgctgcagattgtgagcgcaccagggcagccctacttgcgcgcaccaggccccgttgtcatgcagacagtgtcacaggctggcgcagttcacggtgctttgggtagtaaaccaccagctggtgggcctagccccgctcctctgaccccccaggtgggcgtgccagggcgggtcgccgtgaacgcgctggcagtgggggaacctgggacagcatccaaacctgcctcaccaatcggcggacccacccaggaggagaagacccgcctcctaaaagagcgactagaccaaatttaccttgtgaacgagcggcggtgttcacaagctcccgtgtatggcagagatctgttacggatttgcgcactgcccagtcacgggcgtgtacagtggcgcggttctctggacggccggcgcggaaaggaggccgggccagcccactcctacacctcctcatctgaatctccgagcgaattgatgctcaccctgtgccgctgtggagaatcgctgcaagatgttattgaccgggtggccttcgttatccctcccgtcgtggctgcccctccatcccttagggtgcctcggcccccacccctgtacagtcacagaatgcgcattctgagacagggcctcagggagcacgccgcgccatattttcaacaactccgacagacaaccgctccccggctactccagtttcccgaacttaggctggtacaattcgatagtggcaaactggaagccttggccatcctgcttcaaaaactaaaatctgaaggtaggagggtgctcatcctgagccagatgatactgatgctcgacatcctggagatgttcctcaattttcattatctcacgtacgtgagaatcgacgagaatgcatctagcgagcagcgacaggagctgatgcgctcatttaaccgtgatcgcaggatcttttgtgcaatactgtctacccactcccggacaaccggcatcaacctggtcgaggcagatacagtggtattttatgataatgacttgaatccagtgatggatgcaaaagcgcaggaatggtgcgaccggatagggcgatgtaaggacatccatatctatcggctcgtgtccggtaactctattgaagaaaaactgctgaagaatggcaccaaggatttgattagagaagtggcagcacaaggaaatgactatagcatggccttcttaacgcagcgcacaatccaggagttgtttgaggtgtattcacccatggatgatgccggattcccagttaaagccgaagagttcgtggtgctctctcaggaacccagtgtcaccgagactatagcgccaaagatcgctcgcccattcatcgaggccttgaagtcaattgagtacctggaggaggacgcgcagaagtctgcacaggaaggagtgctgggacctcacaccgacgctcttagctccgactcagagaacatgccatgtgatgaagagccttcccagctcgaagaacttgctgacttcatggagcagctgacccctattgagaagtacgcactcaactaccttgaactattccacacgtcaatcgagcaggagaaggaacggaattctgaggacgctgtgatgaccgctgtgcgggcctgggagttttggaacctcaaaacccttcaggaaagggaggcccgactgcgactcgagcaggaagaggcagagcttctgacatataccagagaggacgcctattctatggaatatgtgtatgaggacgtggacggccaaaccgaagtgatgcctctttggaccccccccacgccgccccaagacgattctgacatatatctggactcagtgatgtgtctaatgtatgaggctactccgatacctgaggccaagctgccgccggtgtacgtcaggaaagagcgcaagcgacacaagaccgatccaagcgccgctggacggaagaagaagcagcggcatggagaggccgtagttccacccagaagtttattcgacagggcaacacctggactgcttaaaattaggcgggaagggaaggagcagaaaaagaatatccttttgaagcagcaggtacccttcgccaagcctctcccgacctttgcgaaaccaacggccgaacctggccaagataatcccgaatggctgatctctgaagactgggcgctgttgcaggccgtaaagcagcttctcgagcttcccctgaaccttactattgtaagcccagcacacacacctaactgggacttagtgagtgatgtagtcaattcttgttctcgcatctataggtcatcgaagcagtgtagaaacaggtacgagaatgtgattatcccacgggaggaaggcaagtcaaagaacaaccgacctttgcggacctcacagatttacgcacaggacgaaaacgccacacacacccagctgtacacttcacacttcgatctcatgaaaatgaccgctgggaaaagatccccacctattaagcccttgctcgggatgaatcccttccaaaaaaaccctaagcatgcgtccgttctcgccgagagcggtatcaattacgataagcccctcccgccgattcaagtcgctagcctgcgagccgaacggattgcaaaagaaaaaaaggcccttgccgatcagcaaaaggcgcagcaaccagccgttgcacaaccaccccccccccagccacagccccctccccccccccagcagcctccgcccccactgccccaaccacaggccgcgggctcacagccgccagcgggtccccccgctgtgcagccccagccccagccgcagcctcagacccaaccacaacccgttcaggctcccgcgaaagcgcaaccggctatcaccaccggtggctcagctgcagtactggccggaacaatcaagacttccgtgacaggaaccagtatgcctacaggagcagtctccggcaatgtaatcgttaacacgatcgcaggtgtgccagccgccacctttcagtctattaacaagagactcgcatcacctgtggcccctggagccctgactactccaggaggatcagctccagcccaggtggtgcatacccagccacctccaagggcagtgggctctcccgcgaccgccacacccgatctggtctctatggcaaccacacagggcgttcgggctgtaacctccgtgaccgcaagtgccgtggtcactaccaatctcacccctgtccagacgccagctcggtctcttgtgccccaagtctcacaggctaccggggtccagcttcctgggaaaactattacccccgcgcacttccagctactgcggcagcagcagcagcagcaacagcagcaacagcaacagcagcagcaacagcagcagcagcagcagcagcaacaacagcagcagcagcaaaccacaactaccagtcaggtccaagtgccacagattcaaggccaggctcagagcccagcgcagatcaaggctgtcgggaaacttacccccgagcaccttataaagatgcagaaacagaaactgcaaatgccaccacagcctccgccacctcaagcgcaatccgccccgccccagcccaccgcacaggtgcaggttcagaccagccagccccctcagcaacaaagccctcagctcaccacagtaaccgcacctcgaccaggtgcactgttaactggcaccacagtggccaatctacaggtggcacggctgacccgcgtcccaacatctcagctgcaggctcagggacagatgcaaactcaggccccccagcctgcgcaggtagcactcgctaagcctcccgtcgtaagcgtacctgccgcggtggtttcatccccaggcgtcaccaccctacccatgaatgtggccggcatttctgtggctatcggacagccccagaaggccgccgggcagacagtggtggctcagcccgtgcatatgcagcagctcttaaaactgaagcagcaggctgttcagcaacaaaaggccatccagccacaggccgctcagggccccgccgccgttcagcagaagataacagcccagcaaataacgaccccaggagcacagcaaaaggtggcctacgctgcacagccggccttgaagacgcagttcctgacaactccaatctctcaagcgcagaaactggccggggctcagcaggttcagacccagatacaggtggccaaactgccacaggtggttcaacagcaaaccccagtcgctagtattcaacaagtggcctctgcctcccagcaggcgagccctcagacagttgccctgacgcaggccaccgctgctggtcagcaggtgcaaatgatcccagcggttactgccaccgcgcaggtggtacagcaaaaactgatccaacagcaggtggtgaccaccgcatctgcacctcttcagaccccaggggcacccaaccctgcacaggtgccagcaagctcagattcaccaagtcagcagcccaaactgcagatgagggtacccgccgtacggctgaaaacgccaaccaaaccaccctgccagtag

SEQ ID NO: 115409 - DNA, 9369 bp, Artificial Sequence
  Description of Artificial Sequence: Synthetic coding sequence
atgcaccacggcactgggcctcagaatgtgcagcaccagctacagcgcagccgagcttgtccaggctctgagggcgaggaacagcccgctcaccccaaccccccgcctagtcctgcggcccccttcgccccttcagcgtcccctagtgccccccagtctccgtcttaccaaatccagcagcttatgaacagatcccccgctaccggtcagaatgtaaacatcacgttgcaatccgtcggcccagtggttggtggcaatcagcaaatcactttggcccctctgcccctccctagcccaacaagtccaggattccagttttcagcccagccaagacggtttgagcacggcagccccagctacatccaggtgacaagcccgctgagccagcaggtgcagactcagtcccccacccagccctcccccgggccgggacaggctctccagaatgtaagagcaggcgcgccaggaccaggcctcggcctgtgcagttcatcccccaccggtggatttgtggacgcctctgtcttggtgagacagatttcactgtctccatctagcggtggacatttcgtgtttcaggacggctcgggtctcacacagatagcgcaaggggcccaggtgcagctgcagcacccaggaacaccaattacagtgcgtgagagacggccttctcagcctcatacacagtccggcgggacaattcatcacctcggaccccagagccccgctgccgctgggggtgcagggctccagcctcttgcctccccgtcccatattacaaccgctaacttgccaccccaaatctcttctatcatccaggggcagctggtccaacagcaacaagtgttgcagggccctccactacctagacctctgggtttcgaaaggacaccaggcgtgctacttcctggggctggaggggcggccgggtttggcatgacgtcaccaccacctcctacgtccccttcacggaccgctgtcccacccggcctttcctcactgcctctgactagtgtcggcaataccggaatgaaaaaggttccaaaaaaattggaagagatccctccggcaagtccggagatggctcaaatgcgaaagcaatgcctagactatcattatcaggaaatgcaagccctaaaagaagtgttcaaggaatatcttattgaactttttttcctccaacatttccagggcaatatgatggatttcctggcctttaaaaagaaacattacgctccccttcaagcatacctgaggcaaaatgatctagatatcgaagaggaagaggaagaagaagaggaagaagaagagaagtccgaagttatcaacgacgaacaggcactggcagggtctctggtggctggagccggctctactgtggaaaccgacttgtttaagaggcagcaggccatgccctcgactggtatggccgagcagagtaagcggcctagactagaagttgggcaccagggagtagtcttccagcaccctggagccgatgccggtgtgccactccagcagctgatgcccactgctcagggcggaatgcctccaaccccccaggcagcacagcttgccggtcagaggcaatcacagcagcagtacgaccctagcacaggacctcccgtgcagaatgcagcctccttgcatacacctctccctcagctgcccgggaggctgccacctgctggcgtccccaccgctgccctttcatcagcccttcagttcgcgcagcagcctcaggttgtcgaagctcaaacacagctccaaatccccgtgaaaacacagcagcctaatgtgcccatcccagccccgccctcaagccaacttccaataccccctagtcagcctgcgcaattagccctgcacgtgcccactccgggaaaagtccaagtccaggcctctcagctatcctctcttccccagatggtcgctagcacccggctcccagtcgatcccgcccctccctgccccaggcccttgcccacctcctctaccagtagcctcgccccggtcagcgggtctgggcctgggcctagtcccgcacggagttcccccgtcaaccggccctccagcgccacaaataaggcgctatcccctgtgacttctagaaccccaggcgtggtggcatcagctcccacaaaaccccaatctcccgcccagaatgcgacatcatcacaagattccagccaggatactctaacagaacaaattacactggagaatcaagttcaccagcgcatcgcagaactgcgtaaagccggtctctggtcacagagacggttgcccaaacttcaggaagcaccacgccccaaaagccactgggattatctcctcgaggagatgcagtggatggctaccgattttgcccaagagcggagatggaaggttgcggccgccaaaaaactggtgaggaccgtggtccgacatcacgaggagaagcagctccgagaggagcggggcaagaaggaagagcagtctcgcctacggcggatcgccgcgagtacagcgcgggagatcgagtgcttctggtcgaatatcgaacaggtcgttgaaatcaaattacgagtagaacttgaggaaaagaggaagaaagcactgaacctgcagaaggtctccaggaggggaaaggaactgcggccgaagggctttgacgcccttcaagagagtagcttagatagcggcatgtctggaagaaaacggaaagcctctatcagtctgaccgatgatgaagtcgacgatgaggaggagacaattgaggaggaagaggccaacgaaggagtggtcgatcatcagactgagctgtccaacctggcaaaagaagctgaactgcccctgttagacttgatgaagctctacgagggtgcctttttgccttccagccagtggccccgccctaaaccagacggggaggatacctctggagaagaagacgctgatgactgccctggggatcgggaatccaggaaggatctggtgctaattgactcattatttattatggaccagtttaaagcagcggagcgaatgaacattggtaaaccgaacgccaaggacattgctgatgtcaccgctgtggcagaagccatacttcccaaaggctcagctcgagtcaccacatccgttaagttcaatgccccctccctgctgtatggggcactgcgcgattaccaaaaaatcggacttgactggctcgccaaactgtataggaaaaatctgaacggcatccttgcagacgaagcagggctcgggaaaaccgtacagataattgccttttttgcccatctcgcctgcaacgaaggtaactggggtcctcacttggtggtggtgagatcttgtaatatactgaagtgggagctcgagctcaaacgatggtgccctggattgaaaatcttgtcttatatcggcagtcatcgtgagctcaaggcaaagcgtcaagaatgggccgagccgaacagttttcacgtgtgtatcactagctacacccagttcttccgtggccttacagcgtttacgcgagtccgatggaagtgcctggtgattgacgaaatgcagagagtgaagggtatgactgagagacattgggaggcagttttcactttgcagagccagcaaagactgctgctaattgacagtcctctgcataacacttttctcgagctttggaccatggttcactttctcgtgcccggcatttcacgcccttacctatcttcaccactgcgcgcccctagcgaagaaagccaggattactaccataaagtggttatacggctgcaccgggttacccagcccttcattctgcgccggaccaaacgagatgttgaaaaacagctaactaagaagtatgaacacgtgctgaagtgtcgtctgagcaaccggcagaaagctttgtatgaggatgttatcctccaaccagggactcaggaggcacttaagtctggccacttcgtgaacgtcctttcaattctcgtgcggttgcagaggatctgcaaccatcccggactggtggagcctagacaccccgggtcttcctacgtggcagggccccttgaatatccatctgcgtcgctcattctcaaggccctggagcgtgacttctggaaggaagccgatctgtccatgtttgatctgattggactggagaacaaaatcacaaggcacgaggctgagctgctctcaaaaaagaagattccgagaaaactgatggaggaaatttcaacaagcgccgctcctgccgcacgccctgccgctgcaaagctcaaagccagcaggcttttccagcctgtgcagtacggacagaaacccgagggaagaacagtggcttttccatcaactcatccacctcggacggctgcacctaccaccgcttcagctgctccccaggggcccttgaggggacggccccccattgcgaccttttcggccaatccggaggccaaggcagccgccgccccatttcaaacttctcaggcctctgcctcagcgcctagacaccagcccgccagtgccagtagcactgccgctagcccagctcatcctgcgaaacttcgcgctcagactactgcccaggcctcgaccccaggccagcctccaccccagccccaggccccctctcatgcagctggccagagcgcattgccacagcggcttgtgttgccatcacaggcacaggcacggctgcccagcggtgaggtggttaagatcgcgcagcttgcctctattaccggcccgcaatcacgcgttgctcagcctgaaacacccgtgactttgcagttccagggtagcaagtttactttgtcccactcacagcttagacagttaactgccgggcagccactgcagcttcaggggagtgtgctgcagatagttagtgctccaggacaaccttatctgagggctcccgggcccgtggtgatgcaaaccgtttcacaggcgggggcagtccacggcgccttaggctccaagccgccggcaggtggcccctcgcccgctcctttaactccccaggtcggcgttccaggccgggtcgcagtgaacgcccttgccgtcggagaacctggcacagcctcaaagcctgctagccctatcggagggccaactcaagaagagaaaacccgactgttgaaagagcgcctagaccagatttatttggttaatgaacgccgatgttctcaggctcctgtctatggcagagatctgctgaggatctgtgccttgccttctcacggaagggtacaatggagaggctcgctcgacggaaggagagggaaggaggccggccctgcccactcgtatacatcatccagcgagagccccagcgaactaatgctgactctgtgccgctgcggtgaatcactgcaggacgtgatcgatagagttgcgttcgttattccccctgtcgtagccgcaccaccttctctaagggtgccgcgaccgcctccactgtactctcatcgtatgcgcattctgcggcagggactccgcgagcatgccgccccatattttcagcagttacggcaaacgaccgctcctaggctcctgcagtttcccgagttgcgcctcgtgcagttcgacagcggcaagcttgaggcgttggcgatactcttgcagaagctgaagtcggagggccggcgcgttctgatactgtcacaaatgattcttatgttggacattctcgaaatgttcttaaacttccattatctgacctatgtcagaattgacgagaatgcatcatccgagcagcgtcaagagctaatgaggtcattcaaccgcgaccgcaggatcttttgcgcaattctcagcacacattctcgcaccaccggtatcaacctcgttgaagctgacacagtcgtcttctacgataatgatctgaatccggtgatggacgccaaggcccaggaatggtgcgatcggattggccggtgtaaggatattcatatttaccggttagtctcaggcaatagcattgaagagaaactcctgaaaaacggcacaaaagacctgatcagagaggtggccgcacagggtaacgactactctatggcgttcctcactcagcggacaatccaggagctgttcgaggtgtactcacctatggacgacgccggtttccccgtcaaggccgaagaattcgtcgttctcagccaggaaccaagtgtcacagaaactatagcccctaagattgcccgcccctttattgaagccctgaagtctattgagtatctggaagaagacgcccagaagagcgcccaggagggggttctgggtcctcacacagatgcattgtcttcagattccgagaacatgccgtgtgatgaagagccctcccaactggaggaacttgcagactttatggagcagttgactcctatcgagaaatatgccctaaactacctggaattatttcataccagtatcgagcaggagaaagaacgaaactctgaggatgcagtcatgaccgctgttcgggcgtgggagttttggaacctgaaaacgctccaggagcgtgaggctcggctccgcttagaacaagaagaggccgaattgctgacttacaccagggaggatgcatatagtatggagtatgtgtacgaagatgtggacgggcaaaccgaggtgatgcctttatggacaccacccacacctccgcaagacgattctgacatttatctggatagtgtgatgtgcctgatgtacgaggctacgcctatcccagaggccaagctccctccggtgtatgtgcgcaaggaacgcaagcgtcacaagacagatccttctgctgccgggcgaaagaagaaacaacgccatggcgaggctgtcgtcccaccacggtccctgtttgacagagcaacacccggactgctgaagatccggagggaaggtaaagagcagaagaaaaacatcctgctgaagcagcaggtgccatttgctaaacccttaccaactttcgccaaacccacagcagagcctggacaagacaatccagagtggctaatctccgaggactgggccctactgcaggcagtaaagcagctcctggagctcccgctcaatctgaccatcgtgtcaccagcccacacgcctaattgggatctggtgtctgacgttgtgaacagctgttccaggatctatagaagctccaagcagtgtcgaaataggtacgagaacgttataatccctcgagaagaagggaaatctaagaacaaccgtcccctacgtaccagtcagatttacgcccaagacgaaaatgcaacacatacccaattgtatacaagccattttgacctgatgaaaatgaccgccggaaagcgatcacctccaataaagccgctgctcgggatgaatccctttcagaaaaacccaaagcacgcgtctgtcctggctgagtccggcataaactatgataaaccactgccccctattcaagttgccagcctcagagccgaacgtatcgcaaaagaaaaaaaagctctagccgatcagcaaaaggctcagcagccagctgtggcccagccaccaccccctcagccccagcctccaccgccaccccaacaacccccccctcctcttccacagcctcaagctgcagggagtcagcccccagctggtccacctgcggtgcagccccaaccccaaccccaaccacaaactcagccccagccagtgcaagcacccgcaaaggcacagccagctatcacaaccggaggttcagcggctgtgttagcagggacaatcaaaactagcgtcactggcaccagcatgccaacgggcgccgtgagtggaaatgtgattgtgaatacaatcgccggcgtcccagctgccactttccagagtatcaataaaaggctagcatcacctgtcgcgcccggggccctaactactcccggcggctcagcccctgcccaggtggttcatacacagccccctcctcgggcagtgggaagcccagccacagcaacacccgacctcgtctccatggccacaactcagggcgtgagggcagtgaccagcgttacagcaagcgcagttgttaccactaatctaacccccgtccaaacaccggcccgcagcttagtgccacaggtgtcccaggccacgggcgttcaactgccgggcaagacaatcactccagctcacttccagctgctgcggcagcagcaacagcaacagcagcagcagcagcagcagcagcaacaacagcagcagcagcagcagcaacagcagcaacagcagcagcagaccacgacgaccagtcaagtgcaggtgccacagattcaggggcaagcacagagccccgcgcagatcaaagcagtggggaagttgactcctgagcatctgattaaaatgcaaaaacagaagctgcagatgcctccacagcctccacccccacaggcacagtctgcccccccacagcctacggcacaggtgcaggtgcagacatcccagcccccgcagcagcaatcacctcagctgacaacagttacagcccctaggccgggagccctcctcacagggactactgtcgccaatttgcaagttgcccggttgactcgcgtcccaacatctcagctgcaggcccaggggcagatgcagacccaagctccgcagcctgctcaggtagctctcgccaagcctccagtggtgtcagtcccagccgctgttgtgtccagtcctggtgtgacaaccttgcccatgaacgttgcgggaatctccgtagctattggccaaccccaaaaagccgccggccaaactgtcgtagcacagcccgtccacatgcagcagttgcttaagctgaaacagcaggccgtgcaacagcagaaagccatccagccccaggcagctcaaggccccgcagccgtgcagcagaagataacagcacagcagattaccacaccgggcgcccagcagaaagtagcgtacgctgcccagcccgcactcaagacccagttcctgactacccccataagtcaggcacagaaattggccggtgcacagcaggtgcagacgcagattcaggtggcaaaacttcctcaggttgtccagcagcagacacctgtcgcttctatacaacaggtcgcctccgcctctcagcaggcttcgccacagactgttgcccttacgcaggctaccgccgcggggcagcaggtacagatgattcctgccgtgaccgctactgcccaggtcgtccagcagaaattaattcaacagcaggttgtcaccactgcctccgcaccactccagacccctggcgctccaaatccagcccaagtcccagcaagttctgatagccccagtcagcagccaaaactgcagatgagggtgcccgctgttagactgaaaacccccactaagccaccctgtcaatag

SEQ ID NO: 115410 - DNA, 2475 bp, Artificial Sequence
  Description of Artificial Sequence: Synthetic coding sequence
atgcaccacggaactggccctcagaatgtgcagcaccagttacagaggtcaagggcctgccctggaagcgagggggaagaacagccggcacaccccaacccaccacctagcccagccgcccccttcgcccccagcgcctccccttctgccccacagagccccagctatcagatccagcagctcatgaacagatctcctgccaccgggcagaacgtgaacatcacccttcagtctgtgggccccgtggtcggggggaaccagcagataactctggccccactaccactgccttcacccacgtcccccggtttccaattcagcgcccaacccaggagatttgaacatggctcaccatcctacattcaggtgaccagccctttaagtcaacaggttcaaacccaaagccctacccagccgagcccagggcctgggcaggctctacagaacgtgagggctggggcccccgggccgggcctgggtctctgctcctcttccccaaccggcggatttgtggacgcgagtgtactggtcaggcagatctcgctttctccctcctctggcggccacttcgtgtttcaggatgggtctggcctgactcaaatcgcccaaggggcccaggtgcagcttcaacaccccggtacgcctatcaccgtaagggagaggcgcccctctcaaccacatacacagtcaggcgggactattcaccacttgggccctcagtccccggctgctgctggaggcgccggccttcagcccctcgcgagcccttcacatatcacaactgccaaccttccccctcagatttctagcataattcagggacaattagtgcagcaacagcaggtcctgcaaggacccccactccctcggccattaggttttgagaggactccgggtgtgttgctgcccggggcggggggcgccgcaggtttcgggatgactagcccgccgcctcctacttctccaagcaggacagccgtgcctcctggcttgtcaagtctccctctgactagtgtgggcaatactggtatgaaaaaggtccccaaaaaattagaagaaattccgcccgcctctcctgagatggcgcaaatgcgcaagcagtgtttagactatcactatcaagagatgcaagcactaaaggaggtttttaaagaatacctgatagagcttttttttctgcagcactttcaggggaacatgatggacttcctggcgttcaaaaagaaacactatgccccactgcaggcttatcttaggcagaacgacctagacatcgaagaggaggaggaggaggaggaggaagaagaggaaaagtccgaggtcatcaatgacgaacaggcactcgcggggagcctcgtggcgggggcaggttctactgtcgagaccgacctgttcaagcgccaacaggccatgcccagcactggaatggccggcggtatgcccccaaccccacaggcggcacagcttgcggggcagcggcaatcccagcagcagtacgatcccagcaccgggccacccgtccaaaatgctgcctctctgcatactcccctgccccaactgccgggccgcctacctcctgccggggttccaacagcagccctcagctctgcacttcagtttgcccagcagccccaggtggtagaggctcaaacccagttgcagattccagtgaaaacacagcaacctaatgttcctatccccgcgcctcccagttcacaattgccaattccaccatctcagcctgcccagctggccctccatgtccccacaccaggcaaagtgcaagtccaggcctcccaactgtcctcccttccccagatggtggctagcacgcgcctcccagtcgaccctgcacctccatgtcccaggccgctccctactagttccacctctagcttagcacctgtctccggctcagggcctggcccttcaccagcccgatcatcacccgtaaatagacccagttctgctaccaacaaggccttgtcacctgtgacttcaaggacaccaggggtggtggcttcggcgccgacaaagcctcagtcacccgctcagaacgccacctcaagtcaagactcctcacaggacactctgaccgagcagataacactggagaatcaggttcaccagagaattgcagagctacggaaggcgggcctgtggtcacagaggagactgccaaaactgcaggaggctccccggccaaagagccactgggattatctgcttgaggaaatgcagtggatggccactgacttcgcgcaggagcggcgttggaaagtggcagccgcaaagaagctggttcgcactgtggtgcgtcatcacgaagagaaacagctgagggaggaacggggaaagaaggaggagcaatcaaggctacggcgaattgccgccagcactgctagggaaattgaatgtttctggtcgaacatagagcaggttgtagaaatcaagctgcgggtggagctggaatag

SEQ ID NO: 115411 - DNA, 9372 bp, Artificial Sequence
  Description of Artificial Sequence: Synthetic coding sequence
atgcaccacgggaccgggcctcaaaacgtacagcatcagctccagagatcgagagcatgtcctgggagcgagggcgaagaacaaccagcccatccaaatcctcctccctctcccgcagccccctttgcaccaagtgcttcgccgtcagctccccagagtcccagctaccagattcaacaattgatgaaccgatcacctgccactgggcagaatgtcaatatcactttgcagtccgtcggacctgtagtcggggggaaccaacaaatcaccctggccccactccctttaccctctccaacatcccccggcttccagttctcagcacagccgagacggtttgagcacgggtcaccgtcttacattcaggtaacgtccccacttagtcagcaggtgcaaacccagtctcccacccaaccgtctcctggccctgggcaggctctgcagaatgtcagggcaggggccccgggcccaggcctgggcttgtgtagtagctccccaaccggcggcttcgtggatgccagcgtgctggtgcggcagatttctctgtccccatccagtggcggacactttgttttccaggatggttcgggactaacacagatcgcgcagggagcccaggtgcagctgcagcaccctggcacgcccatcactgtccgcgaacgtcgcccatcccagccacatacccaatctggcgggaccattcatcacctcggaccccagagcccggccgccgccggcggagccgggctacagccactggcgtccccaagtcatatcaccacggctaatctcccaccgcagatttccagcattattcaaggtcaattggttcagcagcagcaggtcttgcagggccccccccttccacggcctctcggcttcgaacgtacccccggagtgctcttaccaggggcaggaggggctgccgggttcggcatgacatctccaccaccgcccacctcaccgtctcgcactgccgtgccacccggcctgagttcgctgcccctaacatccgtggggaacaccggcatgaaaaaagttcccaaaaaactggaagagatacctcctgcttcacccgagatggcacaaatgaggaagcagtgcctagattatcattatcaggagatgcaggccctgaaggaggtgttcaaggagtatcttattgaactatttttcctgcagcattttcaaggcaatatgatggattttctcgcatttaaaaagaaacactatgcaccgttgcaggcctatctgcgccagaatgacctcgacatcgaggaagaagaagaggaggaggaggaagaagaagaaaagtcagaggtgataaatgacgaacagcaggccttggccggctcacttgtcgctggcgctggttcaacagttgaaaccgatctgttcaagcgccagcaggcaatgccatcaaccggcatggcagaacagtccaagcgaccaaggctggaagtggggcatcagggggttgtttttcagcaccccggcgcagatgcaggcgttcctctgcaacagctcatgcctaccgctcagggaggaatgcctcctacgcctcaagctgctcagctcgccgggcagaggcagtcacagcagcagtatgatccgagtacaggtcctccagtacagaatgcggcttcgctccacacacctctgccccaactgcctggacggctgccccctgcaggagtccccaccgctgctctgtcatcagccctccaatttgcacagcagcctcaggtcgtagaagctcaaacccaactgcagatcccagtgaaaacccagcagccaaatgtgccaatccctgccccaccttctagccagctccctattcccccatcccagcctgcacagctggcactgcatgtcccaacacccggtaaagttcaggtacaagccagtcagctgtccagtctgcctcagatggtggctagtacccgactgcccgttgatcccgcccccccctgtcccaggcccctccctacctccagtaccagctctctagctcctgttagcggctctggtcctggcccttcaccggctcgcagttctcctgtgaacagaccctcttctgcaactaataaagcgctttccccagtgacctcaagaactccgggtgttgtcgccagcgcccctaccaagccacagagcccagctcagaatgccacaagcagccaggattccagtcaggacactcttacagagcagatcaccctagagaaccaggtgcatcagcgtattgctgagctgcgcaaggccggcctatggtctcaacggcggctccccaaactgcaggaggccccccggcctaagagccattgggattacctgttagaggaaatgcagtggatggctacggattttgctcaggagcggcggtggaaggtagcagcagctaaaaagttagtgcggactgtggtccggcaccacgaagaaaaacagcttcgagaagagcgaggcaagaaagaagaacaaagcaggctcaggcgaatcgctgcctcaactgccagagagatcgaatgcttttggagcaacattgagcaagtcgtggagattaagctaagggtggagctcgaggaaaaaagaaaaaaggcattgaatcttcagaaggtgtcccggcgcgggaaggagctgaggccaaaggggttcgacgccttgcaggaaagcagccttgatagtggcatgagtggaagaaagaggaaagcaagcatttctttgactgacgacgaagtggacgacgaggaggagactatcgaggaggaggaagccaacgagggcgtggtcgaccaccagactgagctgtcgaaccttgccaaagaagctgagctgcccctgctcgatctgatgaagctgtacgagggcgcctttctcccaagcagccaatggcctcggcccaaacctgacggtgaggatacatccggagaggaagacgccgacgactgcccgggcgatcgagagtcccgcaaggacctggtgctgatagattcacttttcatcatggatcagtttaaggcagctgaaaggatgaatatcggcaaaccaaatgctaaggacatcgctgatgtgaccgcggtcgctgaagctattctgcccaagggctctgccagggtaaccacatccgttaagtttaacgcaccatccctgttatacggcgctctgagagattaccaaaagatcgggttagattggctggctaaactatataggaagaacttgaacggtatcctagcagatgaggctggcctgggaaagaccgttcagattatcgcatttttcgcacatttggcctgcaacgaaggcaactggggccctcatctcgttgttgtgaggtcatgcaatatcctcaaatgggagcttgagctcaagagatggtgtcctggattaaagatactcagttacattggcagccaccgagagctgaaagctaaacgacaagagtgggccgaacctaactcatttcatgtgtgcattacgagttacactcagttcttcaggggtctcacggcctttacgcgtgtgcgatggaagtgcttagtgattgatgagatgcagcgagtgaagggcatgacagagaggcactgggaggccgttttcacgctccagtcacagcaaaggctgctgctgatcgattctcctctgcacaacacttttctagagttgtggactatggtacacttcctcgtgcctgggatttcccgcccctatctgtcctcccctttacgggccccatctgaagagtcccaggattactaccacaaagtcgtgatacgcctccatagggtcactcaaccatttattctgcgccggactaagcgggatgtcgaaaaacagttaactaaaaagtacgaacacgtgttaaagtgccgactttctaaccgtcagaaggctctgtacgaagacgtgatccttcagccagggacacaggaagccctgaaaagcggccatttcgtgaacgtgttaagcattctagtgaggctgcagcgcatctgtaatcacccaggactggtggagccaagacatccaggatcaagttacgttgccgggcccttggaatacccttctgcgagcttgatcctcaaggctctggagcgagacttctggaaggaggctgatctttctatgtttgatcttatcggactggagaataaaattacacgacatgaagccgaactgctgagtaaaaagaagatcccgcgcaagctcatggaggagatatccacctccgccgctcccgctgcccgcccagccgctgcgaagcttaaagctagcaggttgttccaaccagtccagtacgggcaaaaacctgaagggagaacagttgccttcccctctactcacccccctaggaccgctgcaccgaccaccgcctctgccgccccccagggacctttaagaggccgcccccccattgccaccttcagcgccaatcccgaggccaaggcggctgcagccccctttcagaccagtcaagcatcagcgtctgctccgcggcaccagcctgccagtgcgtccagcactgccgctagtcccgcgcatcccgccaaattgcgagctcaaaccaccgcccaggcctcaaccccaggacagcccccccctcaacctcaggctccgtctcacgcagctggacaatctgctttaccacaaagactggtgctgcctagtcaggcccaagcacgcctccccagcggggaagtggtcaagattgcccaacttgcttctattactggcccccaatctcgcgtggctcagccagaaacacccgtgacgcttcagtttcagggaagcaaatttacattgtctcattctcagctcagacaactgacggccggacaacccctccagctgcagggaagcgtcttgcagattgtatctgccccaggtcagccataccttcgagccccgggccccgtcgtgatgcagactgtgtcccaggccggggctgtgcatggtgctctcggaagcaaaccgcctgcagggggcccatcacccgcgcctcttaccccgcaggtgggagtacctggcagggtggcagtcaatgcactggcagtcggagagcccggtaccgcttctaagcccgcaagcccaatcggtgggcctacacaagaggaaaagacacgcctgctaaaagagcgattagatcagatatatctggtcaacgagagaagatgtagccaagccccagtgtacggccgggacctcctcaggatctgcgcactgccctctcacgggcgcgtgcagtggcggggcagcctggacgggcgaagaggaaaagaggctggccccgcacactcctacacgtctagctcagagagccccagtgaactcatgctcaccctttgcaggtgcggtgagtccctgcaagatgttattgacagggtagccttcgtcatccctccagtcgtcgctgcacctccaagtcttcgggtcccacggcccccccccctttactcacataggatgaggattttaagacagggcctgcgggagcatgctgcgccctatttccagcaactgcgtcagacgactgccccccgactgctgcagtttcccgagttgagactcgtgcagttcgactccggcaagctcgaggccctggcgattttgcttcaaaagctgaaatctgaaggcagaagggttctcatcctcagccagatgatccttatgctggatattttagagatgtttttaaatttccattatctgacttacgtgagaatcgacgagaacgctagctctgaacagcgccaggaattaatgcgctcctttaacagggataggaggatcttctgtgccattctgtcaacgcattcccgcacaactggaatcaacctggtggaagccgacacggtggtcttttatgacaatgacctgaacccagtcatggatgctaaggcacaggagtggtgcgaccggatcggacggtgcaaagacattcacatctatcggctggtctcgggcaactcgatagaagaaaagctgctcaagaacggcaccaaagacttgatcagagaggtggctgcacagggaaacgactatagtatggcttttctgacacagcgaacgatacaagagctgttcgaggtttatagcccaatggacgatgccggctttcctgtcaaagcagaggaattcgtcgtgctcagtcaggagccgagcgtgaccgaaacaatcgctcctaaaattgccaggccctttatcgaggccctgaaaagcatcgagtatctggaggaagatgctcagaaatcagcccaggaaggtgtgttaggcccccacaccgatgccctcagcagcgacagtgaaaacatgccctgcgatgaggagccttctcaattggaggagctggcagacttcatggagcagctcacccccattgaaaaatatgccctgaactaccttgagttgttccacactagtattgagcaggaaaaagagcggaactcagaagacgcagtaatgactgcagtacgcgcgtgggaattctggaacctgaaaacgctacaggaaagggaggcacgattaagactagaacaggaggaggccgagctcttgacatatactcgtgaagacgcctattcaatggaatacgtgtatgaggacgtggacggacagacggaggtgatgccactctggaccccacctaccccccctcaggacgactctgatatttatcttgacagcgtcatgtgtctgatgtacgaggccacaccaattcccgaggcgaaactcccccctgtgtatgtcaggaaagagcggaaacgccataagactgatccctctgcagctggaaggaagaagaagcagcgtcatggggaggcggtcgtcccaccacgctctctgtttgatcgcgctacgccaggactcctgaagatccgacgcgaaggaaaggagcaaaagaagaatatcctcctgaaacagcaagttcctttcgctaagccccttccaacctttgcaaagcccacagcagaacctggccaggacaacccagaatggctgatttctgaagactgggctctcctgcaggccgtgaagcaactgttagaacttcctttaaacctgacaattgtcagccctgcccataccccaaattgggacctggtgagtgacgtggtgaattcctgtagcaggatatatcggagtagtaaacagtgcagaaatagatatgagaacgttattattcctcgagaagaaggcaagagcaaaaataataggccgcttagaaccagccagatttacgctcaggatgaaaatgcaacccacacacagctgtatactagccacttcgatctcatgaaaatgaccgccggaaagagatcaccgcctatcaagcctttgttgggcatgaatccctttcagaagaatcctaagcacgcgtccgtgctggcggagtccgggataaactacgacaagcccttacctcccatacaggtcgccagcttgcgcgctgaaaggatcgcaaaggaaaagaaggccctcgccgaccagcagaaagcacaacagccagctgtcgcccagcctccccccccccagccacaacccccacccccaccacaacagcccccacctcccttaccacagcctcaggcggctggctcacagccccctgctggacctccagctgtacagccccagccgcaacctcagccccagacacaacctcagcccgtgcaggcccccgctaaggctcaacccgctatcaccaccggcggaagtgctgctgtgctggctggcactattaaaaccagtgtgacaggcacgagtatgccaactggagcagtgtcaggtaatgtcatagtcaacaccatcgctggcgtgcctgcagcaacatttcagtccatcaataaaagactggctagtcccgtggctcccggcgctcttacaacacccggcggcagtgcaccagcccaagtcgtccacacccaacccccaccccgcgccgtagggtccccggccaccgccaccccggacctggtgtcaatggctacaacccagggggtaagagcagttacttctgtgactgcatccgctgtggtcaccacaaacctgacaccagtccagactcctgccaggagccttgtccctcaggtctcccaggccaccggagtgcagctgccagggaagactataacacctgcccactttcagctcctgcggcaacagcagcagcaacaacagcaacagcagcagcaacagcagcagcagcaacagcagcagcagcaacagcagcagcagcagcagcagactacaactaccagtcaagtgcaggtgcctcagatccaggggcaagcacaatcacccgcacagattaaggctgtcggcaaactcacccccgagcacctgattaaaatgcagaagcagaagttgcagatgccgcctcagccgcctccgcctcaggcccagtccgctccaccccagccaacagctcaggtccaggtgcaaacatcccagccgcctcaacaacagtccccccagttgaccaccgttactgcgcctagacctggtgcacttctcaccggcaccaccgtcgccaatttacaggttgcccgtctgactagggtgccaacatcgcagttacaggcacagggacagatgcagacacaggcccctcagcccgctcaggttgccttagccaagcctccggtggtgtcggttcccgcagccgtggtgtcctctcccggagtaacaactcttccaatgaacgtagctgggatctccgtcgcgatcggccagcctcagaaggcagccggccagacagtggtggcccagcccgttcacatgcaacagctgctcaagctgaagcagcaggctgtgcagcaacaaaaggccatccagccacaagctgcgcagggaccagccgcagtgcagcagaagattaccgcccagcagatcaccaccccaggagcacagcagaaagtagcctacgccgcccaaccagctctgaaaacccaatttctgaccaccccgataagtcaggcccagaagctggccggagcccagcaggtacagacacagatacaggtggctaagctaccccaggtggtgcagcaacaaacaccagtcgcatcgattcagcaggtcgcaagtgcgtcacagcaggctagcccccagactgttgccctcacccaggcgaccgccgctggccagcaggtgcagatgattcctgcagtcaccgccacagctcaagtggtccagcagaagttaatccaacaacaagtggtaactaccgcttccgcacctcttcagacaccaggggccccgaatcccgcccaagtccctgcaagcagtgactctccaagccagcaacccaaactccagatgcgcgtgcccgccgtgcggctcaagacacctaccaagccgccgtgccagtag

SEQ ID NO: 115412 - DNA, 1314 bp, Artificial Sequence
  Description of Artificial Sequence: Synthetic coding sequence
atgctgcagggtccccgggcactggcatcagcagctggtcaaactcccaaggttgtgcccgccatgagtcccacagagctgtggcccagcggactgagctctccacaactctgcccggctacagctacgtattacactccactgtacccacagacagccccccccgccgcagcccccgggacgtgtctggatgctacccctcacggtccagagggacaggtcgtgcgctgcctgcccgccggcaggctgccagccaagagaaagcttgacctcgaaggaataggacggcctgttgtgccggaattccctacgcctaaggggaagtgtattagggttgatgggctgccgagccccaaaacccccaaatcacctggcgaaaaaacgcgatatgacacgagcctcggccttctgaccaaaaaattcatctacctcttgtccgagagcgaggacggcgtgttagatctgaactgggccgctgaagtactggatgtccagaagaggcgtatctatgacatcactaacgtattggagggaatccaactcatcagaaaaaaagcaaagaataacatccagtgggtcgggagaggaatgtttgaggacccgacacggccggggaagcagcagcaactggggcaagagctgaaggagctgatgaacacagaacaagctctggaccagctgatccaaagctgcagtctctccttcaaacatctcacagaggataaggcaaataagcggttagcttatgtcacatatcaagatatccgcgccgttggcaattttaaggaacaaacggtgatagcagttaaggctcccccacagacccggcttgaggtcccagataggacagaagataaccttcagatctatctgaaaagcacacagggaccaattgaagtgtacctgtgccctgaggaagtgcaggagccagacagcccaagtgaggaacccctcccaagtaccagcactctgtgcccctcacccgattccgcccaacctagcagctcaaccgatccgtccattatggagcctaccgcatccagcgtgccagcccctgcaccaacaccacagcaggcgccccccccccctagcttggtgcccctggaggccacagatagtttactggaactgcctcacccactgctgcagcagacagaagaccagtttctgagccccactctagcctgcagtagtccactgatctcgttttcacccagtctcgatcaggatgactacctgtggggtctcgaggccggagaaggcatctccgacctatttgactcatatgatctgggagacctgctgatcaactag

SEQ ID NO: 115413 - DNA, 1398 bp, Artificial Sequence
  Description of Artificial Sequence: Synthetic coding sequence
atgagaaaaggcattcagccagcactggaacagtacctcgttactgctggtgggggtgaaggggctgctgtagtagcagctgccgccgcagcgtctatggataaacgagcacttctggcctcccccggattcgctgcagctgccgctgctgctgcagctccgggtgcatacattcagatcttaaccacgaacacctctactacgtcctgcagttccagtcttcagtcaggagctgttgccgcagggcccctgctcccatcagccccaggagccgagcaaaccgctggaagtctgctctacaccaccccccacggaccgtctagtagggctggtctactccagcagcctccagccctgggtcgcggcggttctggaggtggaggcggcccacctgccaagcgtcggctggaactgggagagtcagggcaccaatatctgagcgacggcctgaagactccaaagggtaaggggcgggccgctctgcgatccccagattccccaaagacacctaagagcccatctgaaaagactcggtatgacacttcacttggtctgctgaccaaaaagtttatccagttactgagccagagccccgacggggtcctggatctgaataaagcggctgaagtgctcaaggtccagaagagaagaatttatgatattaccaacgtgttggagggtattcatctgataaagaagaagtcaaaaaacaacgttcagtggatggggtgctctctctcggaagatggggggatgttggcccagtgccaggggttaagcaaagaagtgacagagcttagtcaggaggagaagaagctggatgagctgattcaaagttgtacactagacttgaagctgctcaccgaagactctgaaaaccagcgtctggcttacgtcacataccaggacataagaaaaattagcggcctgaaggatcaaacggtcatcgtcgtgaaggcgccaccagagactcggctggaggtccctgattctattgaatcgttgcagattcacctggcctcaactcaaggacccatcgaagtgtacctgtgcccagaggaaacagaaacacatagcccaatgaagacaaataaccaggatcacaatggtaatatcccaaagccagccagcaaagatctcgcttccactaattccgggcatagcgattgtagcgtgagcatgggcaacctgtctccccttgcatctccagctaatcttttgcagcagaccgaggatcaaatcccatccaaccttgagggccctttcgtgaatttgcttcctcccctgttgcaggaggattatttattgagcttgggagaggaggaagggatttctgacctatttgacgcatacgaccttgagaagctcccattagtggaagattttatgtgttcctag

SEQ ID NO: 115414 - DNA, 387 bp, Artificial Sequence
  Description of Artificial Sequence: Synthetic coding sequence
atggataagcgggccctgctagccagcggcggcggggggggcccccctgctaaaaggcggctggaacttggtgagagcggacatcagtatctaagtgacggacttaagaccccgaaaggaaagggccgggcagctcttcgatcccccgactcccccaaaaagaaaactcggtatgacacttccttgggcctgctgaccaagaagttcattcagctgctgtcgcagtctcccgacggggtccttgatctgaataaggctgccgaggtgttgaaagtgcagaaaaggaggatttatgatattacaaacgtcctggagggtattagtgacttattcgatgcctacgaccttgaaaaactgcctctggtggaagatttcatgtgctcctag

SEQ ID NO: 115415 - DNA, 1005 bp, Artificial Sequence
  Description of Artificial Sequence: Synthetic coding sequence
atgccactacagcagcaggctaaacgccgccttgagctgggagagtcaggtcaccaatatctgtccgacgggctaaagacgccaaaagggaagggccgcgccgccctgaggtccccggatagccctaaaaagaaaacaaggtacgatacttccctgggcttactcaccaagaagttcattcagctgctgtcccagagtcctgatggtgtcctggacttaaacaaagccgccgaagttctcaaggtacaaaaacggagaatctatgacattacaaatgtcctggagggtatccacctaatcaagaagaagtcaaagaacaacgtgcagtggatgggctgtagtctgtcagaagacggaggaatgcttgctcagtgtcaggggttgagtaaggaagtaacagaactgtcacaggaggaaaaaaaactggacgaactcatccaatcctgcactcttgatctaaagctgctgaccgaggattctgagaaccagcggctggcttatgtgacataccaggacatacgcaagatttccggattaaaggatcagaccgttatagtcgtgaaggcccctccggagacccgactggaggttccagactccatcgagtccctccaaatccatctggcttctacacaggggcccatcgaggtttatttatgtccagaagagacggagacacattcaccaatgaagaccaataaccaggaccataacggcaatattcctaagcccgcaagcaaagatctggccagcaccaacagtggacattccgactgcagtgtcagcatgggaaacctgtcgcctttggcatctcccgcgaacttgttgcagcagacagaagaccagataccctcaaatttggagggccctttcgtgaaccttctaccacctcttctccaagaggactacctcttgagtttaggagaggaagagggcatctccgacctgttcgatgcgtatgaccttgagaagctccccttggtagaagattttatgtgctcttag

SEQ ID NO: 115416 - DNA, 2736 bp, Artificial Sequence
  Description of Artificial Sequence: Synthetic coding sequence
atggaggtaaattgtctgacactgaaagacctgataagtcctaggcaacctaggctggatttcgcagtagaggacggtgagaatgcacagaaggaaaacatctttgtcgaccgcagccggatggcgccgaaaacccctatcaaaaatgaaccaatcgacctgtcaaaacagaagaagttcacaccagaaagaaaccccatcacaccggtcaaatttgtggatcgtcagcaagctgaaccgtggactcctacagccaacctcaaaatgcttatctctgctgcctcgcccgatattcgagacagggagaaaaagaaaggactcttcaggcccattgagaataaagacgatgcgttcaccgacagtctgcagctggatgttgtcggagacagcgccgtagacgaattcgaaaagcagcggccttcccgaaaacagaaaagcctcggtctcctgtgccagaaattccttgcccggtatcctagttatccactctcaacggaaaaaaccacaatatcacttgatgaagtggctgtgagtctaggggtggaaaggaggcggatctacgatatagtaaacgtgcttgagtcgctgcatcttgtgagccgtgtggcaaagaatcagtacggatggcatggcaggcattccctccccaaaaccttacgcaatttacagcgcctgggtgaagaacagaagtacgaggagcaaatggcttacctgcagcaaaaggagctcgacttgattgattataagtttggcgagcgcaagaaagatggtgacccggatagccaagagcagcagctgttggacttctcagagccagattgcccaagctcctctgctaactcaaggaaggacaaatccctgaggatcatgagccagaagtttgtgatgctatttttagtgtcaaagaccaaaattgttaccctcgatgtggccgctaagattcttattgaagaatcccaggatgcacctgaccatagcaaatttaaaacgaaggtgcggagattatacgacatcgctaacgtcctgacttctctggccctgattaaaaaggtgcacgtgactgaagaaagagggaggaagccggccttcaagtggatcggtcccgtggatttcagcagttccgatgaagagctggttgacgtaagcgcatccgtgttgcccgagctgaagagggaaacttacggacagatccaggtctgtgctaagcagaaattagcgcgccatggatcttttaacacagtccaggccagtgagcgtatccaaaggaaggttaatagtgagccaagctcgccataccgggaggaacaaggcagtggtggttattcacttgagatcgggtcactagcggctgtgtaccgacagaaaatcgaagataacagccaaggtaaagccttcgcctcaaagcgagttgtgccccctagctctagtttagatcccgttgccccctttccagtgctgagcgtcgatcccgaatattgcgtgaacccactagcccacccagtgttctcagtcgctcagaccgatctgcaggcgttctccatgcagaacggtctaaatgggcaggttgatgtatccttagcctcagctgcgtccgccgtcgagtcccttaaaccagcactgctcgctggacaacccttggtgtacgtcccctctgcctctctgttcatgttatacgggagcctccaggaaggcccagcctccggttccgggagtgagagagatgatcgcagctccgaggcccctgccacagtggagctgagctcagcacccagcgcccagaagagactctgtgaagagcgtaagccccaagaagaggatgaaccagcaaccaaacgacagagcagagagtacgaggatggccccctgagtcttgtgatgccgaagaagccgagcgatagtaccgaccttgcaagccccaagactatgggtaaccgcgccagtattccacttaaggacatccacgtcaatggccaattgccggctgcggaggagatctcaggaaaagccaccgccaactccctagtatcatctgagtgggggaacccgtcccggaatacggatgtcgagaaaccatcaaaagaaaacgagagtacgaaggagccgagcctgttacaatacctgtgcgtgcagtcccctgctgggttgaatgggtttaatgtcctccttagtggcagccagacaccccctactgtgggccccagcagcggacagttgccaagtttctctgtgccctgcatggtgctccccagcccacctctgggccccttcccggttctatattcccctgcaatgcctggaccggtcagttccactctcggcgccctccctaatacagggcccgtgaacttctcactccctggactgggctcgatcgcccagctgctcgtgggccccacagccgttgtgaaccctaagtcttctactctaccttccgccgacccacagttgcagagtcagccaagcttaaacctgtcaccagtaatgtccaggtcgcacagcgtcgtgcagcagcctgaatcccctgtgtacgtcgggcaccctgtttcagtggtcaaactccatcagagcccagttccagtgactccaaagtccatccaaaggactcatagggaaactttcttcaagacacctggctcgctgggcgatcctgtgctgaagagacgcgagaggaaccagtccaggaatacttctagtgctcaacggcgcctcgagattccttctgggggtgcagattag

SEQ ID NO: 115417 - DNA, 1149 bp, Artificial Sequence
  Description of Artificial Sequence: Synthetic coding sequence
atgcagaatggattgaatgggcaggtggacgtcagtttggcaagcgctgcctctgccgtggagtcactgaagcctgctcttctggcaggccagcccttagtctacgtcccctcggcctctctgtttatgctgtatggctcacttcaagaggggcccgcatccggctcagggtccgagcgggacgatcgatcaagcgaggcccctgccactgtggagctcagctcggcccccagcgcccaaaaaaggctatgtgaggaaaggaaaccccaggaagaggacgaacctgctaccaagcgccagtcacgtgagtacgaggacgggccactctcgctggtcatgccaaaaaaaccatctgacagcaccgatcttgcctctccaaaaactatgggcaacagggcctcaatcccgctgaaagatattcatgtgaatgggcagcttcctgccgctgaggaaatttcaggtaaggcgaccgctaactctctcgtcagtagtgagtggggtaacccctcacgcaacacagacgtggagaaacccagtaaggaaaatgaaagtaccaaggagcctagtctgctgcaatacctctgcgtgcaatccccggccggcctcaatgggtttaacgtccttctgagcggctcccagacccctccgacagtgggccctagttcggggcagctgccttccttttcagtgccttgcatggtcctccccagccctcccctgggaccctttccggtgctctatagtccagcgatgcctggacccgtgtcaagcactttagggagtattgcacagttacttgttggccctacagccgtcgtgaaccccaaaagctcaacactgcccagcgccgatccgcagctccaaagccagcctagtctgaacttgtcccccgtgatgtctagatctcacagcgtggtccaacaacccgaaagcccagtatatgtgggacatcctgttagcgtcgtcaaactgcaccaaagccccgtgcctgtcaccccgaaaagcattcagcgaacacacagggaaactttttttaaaacccctggctcccttggagatcctgtactgaagcggcgtgaacgcaatcagtcacgcaatacgagttcagcccagcgtcgcttagaaatcccctccggcggagccgattag

SEQ ID NO: 115418 - DNA, 2187 bp, Artificial Sequence
  Description of Artificial Sequence: Synthetic coding sequence
atggaagtgaattgcctgaccctgaaagatcttatatcaccaagacagcctcgcctagacttcgcggtggaggatggcgagaatgcccagaaggagaatatcttcgtggacagaagcaggatggcacccaagacccctatcaaaaatgaaccaatcgatctgtctaagcagaaaaagttcaccccggagagaaatcccataacacccgttaaattcgttgacagacagcaggccgagccctggacaccgacagccaatctaaagatgctcatcagtgcagcctcccccgacattagagatcgtgagaagaagaaggggttgttcaggccgatcgagaataaggatgacgccttcacagatagtctgcagctcgacgtggtgggggactccgctgtcgatgagtttgaaaagcagcgcccttcccggaagcaaaaatctctgggattgctgtgtcagaagtttcttgcccgttacccttcataccctctcagtacagaaaagacaacgatctctctagatgaagtcgcagtgtcattgggggtggaacgcaggagaatttacgatatagtaaatgtactggagtcactacaccttgttagccgcgtggccaagaaccagtatgggtggcacggccggcacagcctgccaaagacactgcgcaacctgcagcgcctgggcgaggaacagaagtatgaagagcaaatggcctatcttcaacagaaggaacttgatcttattgactacaagttcggtgagcgtaagaaagacggagatccggattctcaagaacagcagctgctggacttttcagagcccgattgcccatcttctagcgcgaactctcgcaaggacaagtctctgcgcattatgagccaaaaattcgttatgctgttccttgtctctaagacgaagatcgtgacgctcgacgtagccgctaagatcctgattgaggagagccaggatgctccggaccattccaaattcaagaccaaggttagaagattgtacgacatcgcaaacgtcctcacaagcttagctctgattaagaaagtgcatgttaccgaggagaggggcaggaaaccagcatttaagtggattggccctgttgatttctcctcatccgacgaggaattagtggatgtgtcagctagcgtcttgccagaactgaagcgtgagacctacggacagatacaggtatgtgcaaaacagaaactggcgcggcatggttcctttaatactgtgcaggcgtctgaaagaattcagcgcaaagtgaatagtgagccctcatccccctacagggaagagcagggtagcgggggctattccttggagatcggatctctagcagccgtataccggcagaaaatagaggacaatagccaagggaaagctttcgccagcaagcgggttgtgcccccctcctctagcctggatccggtggctcctttccccgtgttgagtgttgatcccgagtactgtgtcaaccccctggcacatccagtgttctcagttgctcaaaccgacctgcaggctttttccatgcaaaatggattgaacggccaggtggacgtgtctttggcctccgccgcctcagctgtagagtctctgaagccggccttactcgccggacagccactcgtgtatgtgcccagcgcgtcactctttatgctgtacgggtccctgcaggaaggccctgcctccggtagcggttcagagagggacgacaggagttcggaggcccctgcgacggtggaactttcttctgccccttccgctcagaagagactctgcgaggagcgtaagccacaggaagaggacgaaccagccaccaaaaggcagtctagggaatacgaggacgggcctctgagcctggtgatgcccaagaagcccagtgatagcaccgacttggcctctcctaagacgatgggcaaccgcgcttccattcctttgaaggacatccatgtgaacggtcagctgcctgccgccgaggaaattagcgggaaggccacagccaacagtttggtgagcagtgagtgggggaatccaagccgaaacacagacgtggaaaagccgagcaaggaaaatgagagtaccaaagagccatccttgctccagtatctctgtgtacaatcccctgcagtcacctcttccagcgaccctcaggagcaccccactcacacgtcctag

SEQ ID NO: 115419 - DNA, 348 bp, Artificial Sequence
  Description of Artificial Sequence: Synthetic coding sequence
atggaagtgaactgtctgacattgaaggacctgatttctccccgccagcccaggctagactttgcagttgaagacggagagaacgcccaaaaagagaacattttcgtcgaccgctcccgcatggcacctaaaaccccaattaagaatgaacctatagacttatctaagcagaaaaaattcactcccgaacggaatccaattacccctgtcaagttcgtcgaccgccagcaggctgaaccatggactccaactgcgaaccttaagatgctgatcagcgcagccagtccggacatacgggacagggagaaaaagaagggcctgtttagacctatcgagaataaagattag

SEQ ID NO: 115420 - DNA, 2604 bp, Artificial Sequence
  Description of Artificial Sequence: Synthetic coding sequence
atggagaacgaaaaggagaatctgttctgtgagcctcacaagagagggttgatgaaaactccccttaaagagtccactaccgccaacattgtccttgccgagatccaacctgatttcggacctttgaccaccccgaccaagcccaaggagggatctcagggggaaccctggacccctaccgcaaatctgaagatgctgatttctgccgtgagccccgaaataaggaacagagaccagaaacgaggccttttcgacaatcggtccggcctccctgaggcaaaagattgtattcacgagcacttgagtggcgacgagttcgaaaaatctcagcccagcagaaaggaaaagtctctcggacttctgtgccataaatttctagctcgctaccctaactaccctaaccccgcagtgaataacgacatctgcctggacgaggtggctgaggagctgaatgtagagcgaaggcggatttacgacattgtgaatgtgttggagtcgctacacatggtgagccgactagccaaaaaccgctatacctggcacgggcggcacaatttaaacaaaactctggggacactcaagagtattggtgaggagaacaagtacgccgaacagatcatgatgattaagaaaaaagaatacgagcaggaatttgacttcataaagagttactctattgaggatcatatcattaaatccaacaccggcccaaacggccaccccgacatgtgtttcgtcgaattgcctggggtcgagtttcgggccgcaagcgtgaatagccgtaaagacaaaagtctgagggtgatgagccagaagtttgtcatgctgttcctcgtgtccaccccccaaattgtctctttggaagtagccgccaagatcttaatcggcgaggaccacgtcgaagatttggacaaatctaaatttaaaacaaagatcagacggctttatgatattgccaatgtcctctcatccctagacttgataaaaaaagtccacgtgaccgaggagcgcggccgcaaaccagcattcaagtggaccggcccagaaatcagcccaaacacaagtggctcctcccccgtgatccactttacaccttccgatttggaggtgaggcggagttcaaaagaaaactgcgctaagaatttgttttccaccaggggtaaaccaaatttcacacggcacccctcattgatcaaattagttaagagcattgaaagcgacaggaggaaaatcaacagtgcccccagctctcctattaaaacgaataaggcagaatcatcccaaaactccgctcctttcccctcaaagatggctcagttagcggcgatttgtaagatgcaattagaagagcagtcctccgaaagccgacagaaggtaaaggtgcaactggctaggtccgggccttgcaagccagtggcccccctggacccccccgttaatgccgagatggagcttactgcaccgtcacttatccagcccttagggatggtgcctctgattccttcccccctgtcaagcgcggtccctctgatccttccccaagctcccagtggaccctcctacgccatttacctccagcccactcaggcccatcagtctgtgacacctccccaggggctgagcccaaccgtgtgcacaactcattcaagcaaggccactggctcaaaagattcaaccgacgctactaccgagaaagctgccaacgacacaagtaaggcgtccgcctcaactcgcccaggcagcctcctgcctgcccctgaaaggcagggagccaaatctcgtaccagagagcccgccggggagcgaggatccaaacgggcaagcatgctggaagactccggaagcaagaagaagtttaaggaagaccttaagggtctggagaatgtttcagcaaccctgttcccaagtggttacttgatcccactgactcagtgctcgagcctgggtgccgagtccatcctcagtgggaaggaaaatagctccgccctgtcgcccaatcatcgtatctacagctcacccatcgccggcgttattcccgtgacatccagtgaactgaccgccgttaactttccgagcttccatgtaacgccactcaaattgatggtgtctccaaccagtgtcgcagccgtgcccgtcgggaattccccagctctggcgtccagtcaccccgtgcctatccagaacccatcctcagcaatcgttaactttaccctgcagcacctgggattgatcagtccaaacgtccaactgagtgcaagcccaggatctggcattgtacctgtgagtccccgaattgagagcgtgaatgtggcgccagagaacgccgggacccagcagggtagagccaccaattacgatagcccagtgcctggccagagccagcccaacggccagagtgtcgctgtgaccggggcccagcagccagtccctgtgacacctaaaggctcacagttggtggccgagtccttttttcgtactcctgggggacccacaaagccaacaagctctagttgtatggatttcgagggcgcgaacaaaacctcgttaggtactctgttcgtgccacaaagaaaactagaggtcagcacggaggatgtgcactag

SEQ ID NO: 115421 - DNA, 2604 bp, Artificial Sequence
  Description of Artificial Sequence: Synthetic coding sequence
atgcagaaaaagaaggagaacctgttctgtgagccccataagcggggcctaatgaagactcccctgaaggagtcaacaactgcaaatatcgtccttgcagagatccagccagacttcgggcccctgaccactccgactaagccaaaggaggggtcacaaggagagccgtggaccccaaccgctaatctgaagatgctgatcagtgcagtgagccctgaaatccgcaaccgggaccagaagcgcggcctgttcgacaaccgctctggactaccggaggcgaaggattgcattcacgaacatctaagcggcgatgagtttgagaagagccagccatctagaaaggagaaatctctgggacttctgtgccataaattcctcgcaagataccccaactatcccaaccccgctgtgaataacgacatctgcttggatgaggtggccgaggagcttaatgtagaaaggcgtcgcatctatgatattgttaatgtgcttgaatccctgcatatggtgtcaagacttgccaaaaacaggtacacttggcacgggagacacaatcttaataagacactgggaacactgaaaagtatcggggaagagaacaaatatgccgaacagataatgatgataaagaagaaggagtacgagcaagaatttgattttatcaagagttattccattgaagatcacatcattaagtccaacacaggaccaaatggccatcctgacatgtgctttgttgaattgcctggggtcgaatttcgggccgcaagtgtgaactcaaggaaggataagagccttagagtgatgagccagaaatttgtcatgctctttctagtaagtactccacagatagtgtcattagaggtggccgccaagattcttattggagaggatcacgtggaagacctcgataagtcaaagttcaaaacaaaaatacgacggctgtacgatattgccaacgtcctctcgtccctcgatctgattaaaaaagtgcacgtgaccgaggaaaggggaaggaagccagcctttaaatggacaggccctgagatctcccctaatacttccgggagcagtccagtcatacatttcacaccgtcagaccttgaagtgcgtcgctcgagtaaggagaattgtgcaaagaacttgtttagcactcgcggcaagccaaatttcactagacacccctcgctgattaagctggtcaagagtattgaatcagacagacgcaaaattaacagcgccccctcctcaccaattaagaccaacaaggcagaatcatctcagaacagtgccccattcccctctaaaatggcccagctggccgctatttgtaaaatgcaactggaggaacagtcatcagagagcaggcaaaaggtaaaggttcagctggcaagaagtggcccctgtaagcctgttgccccattagatccaccagtaaacgctgagatggagctgaccgcaccctcccttattcagcccctgggtatggtacccctgattccatctcccttatcatctgccgtgcctcttattcttcctcaggctccctctggtcccagctacgctatttacctccaacccacacaagcccaccaatctgtcacaccaccccagggtttatctccgacagtgtgcacaacacattccagtaaggccacagggtccaaagactctactgatgctactacagagaaggccgcgaacgacactagcaaggccagcgctagcacaagacctggttcacttttaccggcccccgaaaggcagggcgccaaatcacgcactagagagcctgcaggcgagcgagggagcaaaagagcgagcatgctcgaggacagtggatcaaagaagaaatttaaggaggacctgaaagggctcgaaaacgtgagcgccaccttattccccagcggctacttgatccccctcacccagtgtagctcccttggggcagagtccatattgagcggcaaggagaattctagtgccctgagcccgaaccatagaatctactcatcaccaatcgcgggagtaatcccagtaacaagtagcgaactaaccgccgtcaattttccctcgttccacgtaactccattgaaactgatggtctcaccaacttcagtggccgccgttcccgtgggtaactctccagcgctcgcctcctcgcacccagtgcctatccagaacccaagtagtgctattgtcaactttaccttacagcatctgggtctcatctcccctaacgttcaactctcagcctcacctggttccggaatagttcctgtcagtccacgaatcgagagcgtgaacgtggctcccgaaaacgccggcactcaacaaggcagagccaccaactacgattctcctgtgccagggcaaagtcaacctaacggtcagtccgttgcagtgacaggagcccagcagccagtacccgtcactccgaagggtagccagttggtagctgagtcattcttccggaccccaggaggccctaccaaacctacaagtagcagttgcatggactttgagggagcgaacaagacctcactcggaacactgttcgttccccagcgcaagctggaagtctccactgaagatgtgcactag

SEQ ID NO: 115422 - DNA, 2604 bp, Artificial Sequence
  Description of Artificial Sequence: Synthetic coding sequence
atggagaacgagaaggaaaatctcttttgcgagccgcataagcggggtttaatgaagacacccttgaaggagagcaccaccgcaaacatcgtgctggccgaaattcaacctgacttcggacctctgacaacgccaacaaagcctaaggaagggtcccagggcgagccctggactccaactgcgaatctgaaaatgctgatcagcgcggtttcccccgagattcgaaacagggaccagaagagaggcctgtttgataacaggtctgggctgccagaagcgaaagattgtatccatgagcatctttcaggggacgaattcgagaagagccagcccagccgcaaagaaaagagcctcgggctgctctgtcacaaatttctggcaaggtaccctaactatccgaatcctgccgtgaataacgatatttgtctcgatgaggtggccgaggaactcaacgtggagcgcagacgaatctatgacatagtcaacgtgctggagtctctccatatggtgagtcggctggcaaagaaccggtacacctggcatgggcgtcataatctgaacaagacactgggtacgctgaaatctattggagaggagaacaagtacgccgaacaaatcatgatgatcaaaaagaaggagtatgaacaggagtttgatttcatcaaaagctacagcatcgaagaccacatcatcaaaagtaacacaggtcctaatggccatccggacatgtgttttgtggagctgccgggggtggagtttagagctgctagtgtgaacagccgtaaggataaatccttgcgtgtaatgtctcagaagtttgttatgttattccttgttagcacacctcagatcgtgtcccttgaagttgcggctaagattctgatcggagaagaccacgtagaggatttagataaatcgaaattcaagacaaaaatccgaagactgtacgacattgcaaatgtgctttcctctctggacctaatcaagaaggtacacgttacagaggaaagaggccgcaaacccgcctttaagtggaccggacccgagattagtccaaacacttcaggcagctctccagtaattcatttcaccccctctgacttggaagtgcggagaagtagcaaagagaattgtgctaagaacctcttcagtacaaggggcaagcctaatttcaccagacacccctctcttatcaaactggtgaaatctatcgaaagtgacagacgcaagatcaactctgcaccgagctctccaataaaaaccaataaggccgagagcagtcagaacagcgcaccttttccgagcaaaatggcacagttggctgccatatgcaagatgcagctcgaggagcagagtagcgaatccaggcaaaaagtgaaagttcaattggcccggagcggcccatgtaaacccgttgcgcccctggatcctcccgtaaacgctgagatggagcttactgccccctcactgatacaacccctgggcatggtgcctctgattccttctccattgagtagcgcagtgcccctcatcctgccacaggctccatccggaccatcatacgccatatacttgcagccaacccaggcacaccagtctgttactccccctcagggccttagccctacggtgtgcacgacccactctagcaaagccactggatcgaaagacagcaccgacgcaactactgaaaaggccgctaacgacacttcgaaggcctctgcgtctaccaggccagggagcctgttgccggctccagaacggcagggcgccaaatcaagaactcgggaaccggccggtgagaggggctctaagcgggcatcaatgctcgaagactcagggtctaaaaaaaagtttaaagaagacttgaagggtctggaaaacgtgtctgctacactattcccatcaggctaccttattccactgacccagtgttcatctctcggtgccgaatctattctatccgggaaggagaactcctcggctttaagtccaaaccataggatatatagctctcccatcgccggggtcatcccggtaacttcctccgagcttactgcagtaaattttccatcttttcacgttaccccactaaagttgatggtttctcccacctccgtggcagccgtgcccgtcggtaacagccctgcacttgcctcctcgcaccctgtgccaattcaaaacccttccagtgctatcgtaaacttcactctgcagcatctcggtttaatcagccccaatgtacagctttccgcgagcccgggctccggcatagtcccagtgtcaccccgcattgagtcagtgaacgtggcccccgagaatgctgggactcagcaggggagggcaaccaattatgactctcctgtgccagggcagagccagcctaatgggcagtcagtcgcggtgactggcgcccaacagccggtgcccgtgacacctaagggatcgcagctggttgctgagagtttcttccgaactcctggcggtccaacgaaacccacttcctccagctgcatggacttcgagggtgcaaacaagacttcactgggaaccctgtttgtgccccaaagaaaattggaggttagtacggaagacgtgcactag

SEQ ID NO: 115423 - DNA, 2355 bp, Artificial Sequence
  Description of Artificial Sequence: Synthetic coding sequence
atggaaggcgccatggcggttagggtgaccgccgcccatacagcggaagcacaagcggaagcaggcagagaagccggcgagggagcagttgcagcagtcgccgccgcactcgcgccatcgggattcctgggccttccagcgccttttagtgaagaggacgaagatgatgtgcacagatgtggcaggtgtcaggccgaatttactgcgctggaagattttgttcaacataagatccaaaaggcttgccagcgtgctcccccagaggccctgcctgcgacacctgcaactactgccctcctgggccaggaagtggttcccgcagctcccggtccggaggagcctattaccgtcgcgcacatagtcgtagaggcggcatccttggccgctgacatcagtcatgccagcgatcttgtgggcggcgggcacatcaaagaagtgattgtggcggcagaagcagagttgggagatggggagatggcagaggcccctggatccccccggcagcaaggtctaggtctggccggtgagggggagcaagcccaagtaaagcttctggtcaacaaggacggtcgctatgtctgcgcattatgccataaaacttttaaaacaggcagtatccttaaggcccacatggtcacgcatagctcaaggaaggaccacgaatgtaaactgtgtggtgcttcttttagaactaagggctcgttaataagacaccatcgtcgccataccgatgagagaccttataaatgctctaaatgcgggaagtcattcagggagagtggtgccctgactagacacctgaaatccctgaccccttgtactgagaaaatacggttcagtgtgtccaaggacgtcgtcgtatctaaggaggacgccagggctggatctggggcgggggccgccggattgggtaccgccacttcctccgtgacaggcgaaccaattgagacctcgcccgtcattcatctggtcaccgacgccaagggcactgtgatccacgaagtgcacgtgcagatgcaagagctgtctttggggatgaaggccctggcccctgaaccacctgtgagtcaggaactgccttgtagctcggagggctccagagagaacctgcttcaccaggctatgcagaattcgggtatcgtactggagcgggcggccggagaggagggcgccctggagcccgctccagcagctggctcgtccccacagccgctggcagtggcagcccctcagctgcccgtcctggaggttcagccactcgaaacccaagtagcatctgaggcctccgccgtgcccagaacacacccctgtcctcagtgcagcgagacgttcccgactgccgctacacttgaggcccacaaacgtgggcacacaggcccacggccctttgcctgcgcccagtgtggtaaggcattccccaaagcatatttgctcaagaaacaccaggaggtgcacgtgagagaaaggcgatttcggtgtggagactgtggcaagttgtataagacaatcgcccatgtgcgaggacaccggcgggttcactcggacgaaaggccttacccatgtcccaaatgcgggaaaaggtacaagacaaagaacgcgcagcaggtccactttcggacccacctagaggagaagccccacgtgtgtcaattttgcagtcggggcttccgcgaaaagggcagtctggtccgacacgttaggcatcacactggggaaaagccgttcaagtgctacaaatgtggaaggggcttcgcggagcacggaaccctgaatcgtcatttacggactaaagggggctgtctgctggaggttgaggagttactcgtcagcgaagacagtccagcagcggcaacaaccgttttgactgaagacccacacactgtgctcgttgaattttcctctgtggtggccgacacgcaagagtatattatcgaggcaacagctgacgatgctgagacatcggaggccactgaaataatcgaaggaactcagacggaggttgactcccatatcatgaaagtcgtgcagcagatcgttcaccaagcctccgctggacatcaaattatcgtacaaaacgtgacaatggatgaagagaccgctctggggcctgaagctgcagcagcagacaccattaccatagctacccctgagtcactaactgagcaggtggctatgaccctcgcctccgcgatatcagaggggacagtattggctgcccgcgctggtacatcaggtaccgagcaggctactgtaactatggtgtcttcggaagacatcgagatactggaacatgccggtgagctggtgattgccagcccagaaggtcagctcgaagtgcaaaccgtgatagtctag

SEQ ID NO: 115424 - DNA, 1047 bp, Artificial Sequence
  Description of Artificial Sequence: Synthetic coding sequence
atggcagctacttgtgagatcagcaacattttctcgaactattttagcgccatgtatagcagcgaggattcaaccctggcctccgttcctcccgctgccacttttggggctgatgatctggttttaaccttgtctaacccacagatgagtttggagggcactgaaaaggcgtcatggctgggagagcaacctcagttctggtccaaaacccaggtactcgactggattagttaccaggtcgagaagaataaatatgatgccagcgctattgacttctcccgctgtgatatggatggcgctactctgtgtaattgtgcactggaggagctgaggctggtattcggaccgctgggcgatcagcttcatgcgcagctccgggacctgacaagctcatctagtgatgagctttcatggattattgaattgctggagaaagacggaatggctttccaggaagcccttgatccaggtccgttcgatcagggatcaccatttgcccaagaactgctggatgatgtctcaaccgcgggcacaggcgcgtcaagatcttctcactccagcgatagtggcggctccgatgtggatttggacccaaccgacggcaaactcttcccttcagatggctttcgggactgtaaaaagggcgaccctaaacacggaaaacgcaagcgcggtcggcctcgtaagctgagcaaggagtactgggactgtttggagggaaaaaaaagcaagcatgcacccagggggactcacctgtgggaatttataagggacatcctgatccacccagaactgaacgaaggtctgatgaaatgggaaaataggcatgagggcgtgtttaagttccttcgctccgaggccgttgctcagctgtggggtcagaaaaagaaaaatagtaacatgacctatgagaaactctcgagggcaatgaggtactactacaaaagagagatccttgagcgggtggacgggaggcgcctggtgtacaagtttggtaaaaattcgagtggctggaaggaggaagaggtgctgcagagccggaactag

SEQ ID NO: 115425 - DNA, 1116 bp, Artificial Sequence
  Description of Artificial Sequence: Synthetic coding sequence
atggccgcaacgtgcgaaattagcaacatcttcagtaactattttagtgccatgtattcgagcgaagatagcaccctggcatcagtgcctcctgccgccacctttggagcagatgaccttgtgctaactttgagcaatcctcagatgtccttagaaggaaccgaaaaggctagttggctcggggagcagccccagttttggagcaagacccaagtgctggattggatatcttaccaggttgagaaaaacaagtacgacgccagcgccatcgacttctctaggtgtgacatggacggggcaactttatgcaactgcgccttggaagagcttaggctggttttcggacctctcggagatcagctgcatgcccaactacgggacttaaccagctcttcttcagacgagctgagttggattatagaactgctggagaaagatggaatggctttccaggaggctctggatccgggaccattcgatcaagggagtcctttcgcccaggagttacttgatgatggtcagcaggcatccccctatcatcccggttcatgtggcgccggggccccgagcccgggcagtagcgacgtgtcaaccgccgggacaggcgcctcaagaagctcccacagttcagacagcggcggttctgatgtggacctcgatccaactgatggtaagctgtttccatcagatggcttccgggactgtaagaaaggtgaccccaagcacggaaagaggaagagaggcagacctcgaaagctgtctaaggagtattgggactgcctcgaaggtaagaagagtaagcacgcccctcgcggcacacacttgtgggaattcatacgcgatattctgatccatccggagctaaacgaaggcctcatgaaatgggagaaccgacacgagggagtgttcaagtttctcagatcagaggccgtcgcccagctgtggggtcagaagaaaaaaaattctaacatgacctacgaaaaactatcgcgagctatgagatattactataaacgagaaattctcgaaagagttgacggtaggaggttagtgtacaaattcggcaagaatagttccggctggaaggaggaagaggtccttcagagccgcaactag

SEQ ID NO: 115426 - DNA, 1116 bp, Artificial Sequence
  Description of Artificial Sequence: Synthetic coding sequence
atggcggccacgtgcgagatttctaacatcttctcaaattacttcagtgctatgtactcctcggaggactcaacactggcctcagtgcccccagcagcaactttcggcgcagacgaccttgtgctgaccttgagcaacccacagatgtctttggagggcacggaaaaagcgtcatggctgggggaacagccacagttttggtccaagacgcaagtgcttgattggatctcctatcaggtggaaaaaaataaatatgacgctagcgccatcgatttctcgcgctgtgatatggatggcgctaccctgtgcaactgcgctctggaagagttgagactggtgtttggacccctaggagatcagcttcacgcccaactgcgagatctgacttcctctagtagtgacgagctgtcttggatcattgagttacttgaaaaggacggtatggctttccaggaagcccttgaccctggaccatttgatcagggcagtccattcgcccaggagctactggacgacggacagcaggccagcccatatcacccaggatcctgcggggctggcgcgccgagccctggctcgagcgacgtctctacagccggaacaggtgcctctaggtcttcacattccagcgactctgggggatctgatgtggacctcgatcctacagatggcaagcttttccctagcgacggtttccgcgactgcaagaagggcgatccaaagcatgggaagaggaagagggggaggcctaggaagctcagcaaggagtattgggactgcttggaaggaaaaaagtcaaaacacgctccccgcggcacacacctctgggagtttatacgtgatattctgatccaccctgagcttaatgaggggctcatgaagtgggagaaccgacatgaaggagtgtttaagtttctacgcagtgaggctgttgcccagctgtgggggcagaaaaagaaaaacagcaatatgacctatgagaagctgagtagggctatgagatattactacaaaagggagatattggagcgggtcgacggccggcgcctggtctacaaattcggcaaaaactcctccggctggaaggaagaagaggtactgcaatcgaggaattag

SEQ ID NO: 115427 - DNA, 1116 bp, Artificial Sequence
  Description of Artificial Sequence: Synthetic coding sequence
atggctgccacgtgtgagatttcaaacattttctctaactacttcagcgccatgtactcatcagaggattccactctggcttctgtacccccagccgccacctttggtgccgacgatttagttctgaccctatctaatccccagatgtccctagagggtacagagaaggctagctggttgggcgagcagccccagttttggagcaagacacaggtgttagattggatctcttatcaggtcgaaaagaacaaatatgacgcgtcagccatcgattttagtagatgtgacatggacggggccacactttgtaactgcgctcttgaagaactgagacttgtgttcgggccacttggcgaccaactgcacgcgcagctaagagacttgacctcctcaagtagcgatgagctctcatggatcattgaactcctggagaaggacgggatggccttccaggaggcccttgatccaggcccattcgatcaggggtcgccttttgcccaggaactgctagacgacggacaacaggcctccccctatcatccaggctcatgtggtgcaggcgctccttcacctggctcctccgacgtctctactgcgggaacgggcgcgagcagatctagccattcatcagattctggcggcagcgatgtagaccttgacccaaccgacggcaagttgttccctagcgacgggttcagagactgcaaaaagggtgaccccaagcacggaaaacgcaagcgcggccggccccggaaactgtccaaagagtattgggactgtcttgagggtaagaagtcgaaacatgccccccgcggaactcatttgtgggagttcatacgtgatatcttgatccacccagagcttaacgaaggtttgatgaagtgggaaaacagacacgaaggcgtgttcaaattcctaaggagtgaagccgtcgcccagctgtggggacagaagaaaaagaattcaaatatgacctatgaaaaattatctcgggctatgcggtattactataaaagggagatacttgagcgcgtggacggccgaaggttggtttacaagttcggaaagaactcttcaggctggaaggaagaggaagtactccagagccgcaattag

SEQ ID NO: 115428 - DNA, 699 bp, Artificial Sequence
  Description of Artificial Sequence: Synthetic coding sequence
atggcagctacctgtgaaatttctaacatcttttcgaactatttctccgctatgtacagtagcgaagactccactctggcctctgttccacctgctgccacatttggagctgatgacctggtcttaacactaagtaatccacagatgagcctcgaggagaaagcaagctggctcggggagcaaccacaattctggtccaaaacccaggtgctggactggatctcctaccaggtggaaaaaaacaaatatgacgcctccgcaattgatttttccagatgtgatatggacggagctactctatgcaattgtgcgctggaggagctgcgtctcgtctttggacctttgggcgatcagttacacgctcagcttcgggacctgaccagtagctcttcagatgagctcagctggattatagaactgttggagaaggatggcatggcattccaggaggctctggatcctggaccttttgatcaaggatctcccttcgctcaagaacttctggacgacggccaacaggcttccccctatcatcccggcagttgtggtgccggtgctccctccccaggtagtagtgatgtgagcaccgccggtaccggagcctcccggagtagtcattcctcagactccggaggctctgatgtagacctggatcctaccgacgggaagctgtttccatctgacggttttcgcgattag

SEQ ID NO: 115429 - DNA, 1992 bp, Artificial Sequence
  Description of Artificial Sequence: Synthetic coding sequence
atggctattacgctgcaacccagtgacctgattttcgaatttgcatccaatggaatggatgacgacatccatcaattggaggacccatccgtattcccggcggtgattgtcgagcaagtgccttatcctgatttgctacatctgtatagcggcctcgagctagatgatgtgcataatgggattattactgatggtactctgtgcatgacccaagatcaaattctggagggtagctttttgcttaccgacgacaacgaagccacttcccacaccatgagcacagcagaagtccttttgaacatggagtctcccagtgacattttggatgagaaacaaattttctcaacatccgagatgctgccagacagtgacccagctcccgccgtaaccttgcccaattatctttttcccgcatccgagcccgacgccctgaatcgggctggcgacacctctgaccaggagggacactcactggaggagaaagcctccagagaggagagcgcaaagaaaactgggaaaagtaagaaacggatcaggaagaccaaaggaaatagatccacttctcccgtcacagatccctcgatcccaattcgaaagaaaagcaaggacggaaaggggtccaccatttacctttgggaatttctcctggccctgctgcaagatcgcaacacatgtccaaaatatattaagtggactcagcgggaaaagggtatcttcaagctggtggacagtaaggctgtgagcaagctgtggggaaaacaaaaaaataagcccgatatgaactacgaaacaatggggcgcgccctgaggtactactaccagcggggaatcctggctaaagttgaaggacaaaggctggtgtaccagttcaaggagatgcccaaagatctggtggtgattgaggacgaggatgagtctagtgaggctacagcggccccgcctcaggcctcgacggccagtgtggccagcgcatcgacaacccgacgcactagttccagagtttcctcaaggtctgccccccagggcaaaggaagctcatcctgggagaaaccaaaaattcagcacgtaggccttcagccttcagcttccttggagttgggaccatctttagacgaagagataccaactacctccaccatgctcgtcagtcccgccgaggggcaagtgaagctgacaaaggctgtttctgccagttctgtgccctccaacattcacctcggcgtcgcccctgtgggatccggatctgctctgacattacaaacaatcccactcactaccgttctaaccaacggccccccagcatctacaacggcccccacacagttggtgttacaatcagtaccggccgctagcacatttaaggacacctttactctgcaggctagttttccactgaatgccagttttcaggactcccaggtcgccgccccgggtgcccccctgatattaagcgggctccctcagctcctggctggcgcaaatcggcctacaaaccctgccccaccgacggtaaccggcgccggaccagccggacctagctcccaacccccaggaaccgtaatcgctgcgttcattcgcacgagcgggaccactgctgctccgagagtgaaagaggggcctctcagatcctcctcttacgtgcagggcatggttactggagcccccatggaggggctgctcgtaccagaggaaacattgcgagagcttctgagagatcaagcccatctgcagccattacccacccaggtggtctcaagggggtcccataacccaagtctgctcgggaaccagaccttatcaccccccagtaggccgaccgttggcttaacccccgtggcagaacttgaactgtccagcggcagtggatcgttgcttatggctgagccatccgtgacgaccagcggatccctgctgaccaggtcgcctacccccgcacctttttctcctttcaatcccacaagcctcatcaagatggagccacatgacatttag

SEQ ID NO: 115430 - DNA, 1992 bp, Artificial Sequence
  Description of Artificial Sequence: Synthetic coding sequence
atggcaattaccttacagcctagcgatctcatcttcgaattcgctagcaacggcatggacgatgatatacaccagctcgaagatcccagcgtgttcccagctgtgattgtcgaacaggtgccgtacccggatcttctccatctttactccggactggaactggacgatgttcataacggcattatcacagacggcactctatgcatgacgcaagatcaaatactagagggcagctttcttctaaccgatgacaatgaagcaaccagccatactatgagcacggcagaggtgttgttgaatatggagtccccttctgatatcttagatgaaaaacagatcttctctacgagtgaaatgttaccagattcagaccctgcaccagcggtgacacttcccaactatcttttcccagccagcgagcccgacgcactgaatcgcgccggggacacatccgaccaggaaggccattccctggaagagaaggcctctagggaggagtcggccaagaaaacaggcaaatcaaaaaaacgcattaggaaaactaagggtaataggtccacaagtccagtcaccgacccctccatccctatcagaaagaagagcaaagacggtaaaggcagcacaatatatctatgggaatttttactggctttgctgcaggaccgcaatacctgtcccaaatacattaagtggacacagagagaaaaggggatttttaagctggtggatagcaaggctgtcagtaaactgtgggggaaacagaaaaataagccagatatgaactatgagactatgggcagggccctgcgctactactatcagcgcggcattctcgctaaagtagaggggcagcgacttgtataccagtttaaagaaatgcccaaggatctggtcgtcatagaagacgaggacgaatcatcagaggccactgccgcccctcctcaggcttctacggcttctgtagccagtgcatctaccacgcgcaggacgtcctctagagtctcctccaggagtgcccctcaaggtaaaggaagctcctcctgggaaaagccgaagatacagcatgtgggcctccagccttcggctagtctcgagctgggaccttcactggacgaagagattcctaccacgtcaaccatgctggtctcccccgccgaaggtcaggtaaaactgacaaaagctgtttcagcttcatccgttccatctaacattcacctgggggtggcccctgtggggagtggttctgcactgacacttcagacaatcccgcttaccacagtgctcacaaacggacctccagcctcaaccaccgctccgacccagctggtactccaaagcgtgcccgccgcgagcacgttcaaggataccttcaccttgcaagcctcgttccccctcaacgcctcatttcaggactcacaggtggccgctccgggcgcccccctcattctctcggggcttcctcaacttctggccggtgcaaacagaccaacaaaccccgccccccccaccgttacaggagccggccctgcaggtccctcaagccagcccccaggcacggtgattgcagcgtttatcagaacttcagggaccacagccgcacccagagttaaagaagggcctctccgtagctcaagctatgtccaggggatggtgacgggagctcccatggaaggcctgttggtgcccgaagagaccctgagggagctgctgcgcgaccaggcccacctgcagcccctgccgacccaagtggtgagccgtggctcccataatccatccctattgggcaaccagactctctcccctccatctagacccaccgtcggtctgacccccgtggcagagttggaactaagttcgggatcagggtccctgcttatggcggaaccgtccgtgaccacaagcggcagccttctcacccgcagcccaacgcccgccccgttttcaccgtttaaccccacgagtctgatcaaaatggagccacatgacatttag

SEQ ID NO: 115431 - DNA, 234 bp, Artificial Sequence
  Description of Artificial Sequence: Synthetic coding sequence
atggacgatgacatacatcagctcgaggatcccagtgtctttccagcagtgatagtggaacaggtgccttacccagatctgctccatctgtacagcgggctcgaattagatgatgttcacaacggaataattacagacggaacattgtgcatgacacaggatcagatcctggagggctcattcctcttaacggacgacaatgaggccaccagtcatacaatgtcaaccgcatag

SEQ ID NO: 115432 - DNA, 768 bp, Artificial Sequence
  Description of Artificial Sequence: Synthetic coding sequence
atgttagatagcgtgacacacagcacattcctacctaacgccagcttttgtgatcccctgatgagctggaccgatctgttcagcaacgaagagtactatcccgccttcgagcatcagactgcctgtgattcctactggaccagtgtccatcccgagtactggacaaagcggcacgtttgggaatggttgcaattctgctgcgaccagtacaaactggacacgaattgtatcagcttttgcaacttcaacatctctggactccagttatgctctatgacccaggaggagttcgtggaagctgctggtttgtgtggcgagtatctgtactttatcctccagaatatccgaacccaagggtattcgttctttaacgacgcggaagaaagcaaggcgacaattaaggactacgctgactctaactgtttgaaaaccagcggcatcaagtcccaggactgtcatagtcactctcgaacctccttgcagtctagtcacctctgggaattcgtgcgtgacctcctgcttagtcccgaggaaaattgcggaatactggaatgggaggaccgggaacagggcattttccgggtggtaaagagtgaagcccttgctaaaatgtgggggcagagaaagaagaacgacaggatgacatatgagaagctaagccgggccctgaggtactactataaaaccgggattctggaacgtgtagatagacgtttagtgtataaattcggtaagaacgcacacggatggcaggaggacaagctttag

SEQ ID NO: 115433 - DNA, 798 bp, Artificial Sequence
  Description of Artificial Sequence: Synthetic coding sequence
atgcctagtcttccccacagccacagggtcatgttggacagtgttacccacagtacctttctgcctaacgcttctttctgcgatccactcatgagctggactgatttgttctctaacgaggaatattatcctgcctttgagcatcagacagcgtgcgactcatactggacatcagtccatccagaatattggacgaagagacacgtctgggaatggctgcagttctgctgcgaccagtataagctggacacaaactgcataagtttctgcaacttcaacattagcggattgcagctctgctctatgacccaggaagaattcgtggaggctgccggcctgtgcggcgagtacctgtactttattcttcaaaacattaggactcagggatactcatttttcaatgatgcagaagaaagtaaggccactattaaagattatgctgacagcaactgcctgaaaacctctggcatcaaatctcaagactgtcactctcattccagaacctctctgcaaagttctcacctgtgggagtttgtgagagacctgctgctttctcccgaagagaattgcggcattctggagtgggaggatagagagcagggaatctttcgtgtggtcaaatcagaggccctcgcgaagatgtgggggcagcggaagaagaatgacagaatgacatatgagaagctgtctagagccctgaggtactattataagactgggattctcgagagagtcgataggcggctagtgtacaagttcggaaagaatgcccatgggtggcaagaggacaaactgtag

SEQ ID NO: 115434 - DNA, 483 bp, Artificial Sequence
  Description of Artificial Sequence: Synthetic coding sequence
atgctggattcggttacccatagcacattcctgcccaatgccagcttttgtgaccccctgatgagctggaccgacctgttctctaacgaggagtactaccccgcgttcgaacatcagacagacgcggatagtaattgcctgaagacttcagggataaagagccaagactgccattcgcatagtagaaccagccttcagagttcccacttatgggaattcgtacgcgatctgctactcagtccggaggagaactgtggtattttggaatgggaagatagagaacaggggatcttcagggtggtgaagtccgaagcacttgctaagatgtggggccagaggaagaagaacgatagaatgacatatgagaagctttctcgagctcttaggtattactataaaactgggattttggagcgcgttgaccgtcggttggtttataagtttgggaaaaacgcccatggctggcaggaggacaagctgtag

SEQ ID NO: 115435 - DNA, 1728 bp, Artificial Sequence
  Description of Artificial Sequence: Synthetic coding sequence
atgttcggcatccaggacacacttgggcgaggccccaccctcaaagagaaaagtctcggagcagaaatggatagcgttaggagctgggtcagaaatgttggggtagttgatgctaacgtcgctgctcaatccggggtcgcactgagtcgagcccattttgagaagcaaccaccatcaaacctgagaaagtccaatttttttcactttgtcctggccttgtacgataggcaaggccagcccgtcgagatcgagcgaaccgctttcgtggatttcgtggagaatgacaaggagcaaggcaacgagaagaccaataacgggacccactacaaacttcagctgctctatagcaatggcgtacgcaccgagcaggatctttacgtcaggctcatcgattccgtgactaaacagccaattgcatatgaaggtcagaataagaatcctgaaatgtgtcgggttctgttgacacatgaggttatgtgtagccgctgctgcgaaaagaaatcctgcggtaaccgtaacgagacaccctccgaccccgtcattattgaccggttcttccttaagttcttcctgaagtgcaaccagaactgcctgaagacagccggcaacccacgcgacatgcgacgttttcaggtggttctgtctaccacggtaaacgtggacgggcatgtgcttgctgtgtcagacaacatgtttgttcataacaattcaaaacatggcaggagggcccgccgcctggaccctagtgaagcgactccatgcattaaagccatcagtcctagcgaaggctggacaactggcggggcaatggtgattataatcggagataatttcttcgacgggctacaggttgtgttcggaaccatgcttgtgtggtctgagctcattacgccccacgcaatacgggtccaaacgcctccacggcacatccccggcgtggtggaggtgacactgagctacaagtccaagcaattctgcaagggtgcgcccggaagatttatctatacagctctcaacgagcctacaattgactacggcttccaacgcctccagaaagtcattcctcgtcacccaggggacccagagaggctggcgaaggagatgctcctgaaaagggcagccgatctggtggaagccctgtatggcactcctcacaacaaccaagatattatcctgaaaagagcagccgacatcgctgaagcgctgtacagcgttccccgaaacccctcccagttgcccgccctgtcttcatctcctgcccatagcggcatgatgggcatcaatagctatggtagtcagttaggcgtgagcatctcagaatccactcagggtaacaaccagggatacattaggaacacctcttctatctccccaagggggtactctagtagttcgacaccgcagcagtctaactactcaaccagttccaacagcatgaacggttacagcaatgtgccaatggcaaatctaggagtgccaggaagccccgggttcctcaacgggtctcccacaggtagcccctacggaattatgtcgtcttccccaaccgttggatcctcttccacctcctccatattgccctttagcagctccgtgttccctgctgtcaagcagaagtctgcctttgctcctgtgatcagaccccagggcagcccctcccctgcctgctcaagcgggaacgggaacggtttccgcgcgatgacaggtctcgtggtcccaccaatgtag

SEQ ID NO: 115436 - DNA, 795 bp, Artificial Sequence
  Description of Artificial Sequence: Synthetic coding sequence
atggtgatcatcatcggggacaacttcttcgacggactccaggtcgtcttcggtacaatgcttgtctggtcagaactgatcaccccgcatgcaatccgcgtccagacgcctccacggcacattccaggcgtggtggaggtgacactgtcatacaagtcaaagcagttctgcaagggagccccaggccgtttcatttacactgcgctcaacgagccgacaatcgattacggtttccagcgccttcaaaaggtgataccacggcaccctggtgatccagaacgcctggccaaggaaatgctgctgaagagagccgcggacctggtggaagctttgtatggcactcctcataataaccaggacattatcctgaagcgcgcagctgatatcgctgaagcgttatatagtgtgccccgtaatccctcccaactccccgcactgagctcctctcccgctcacagtggaatgatgggcattaattcgtatggatctcagctcggcgtgagcatcagcgagtctactcaaggaaacaatcagggatatatccgcaacacatcaagtatctccccgcgcgggtattcctccagctcaaccccgcagcagtccaattactcaacatcatctaatagcatgaacgggtacagcaatgtgcccatggcaaatctcggggtgcccggatcccctggctttctgaatgggagcccaaccggctctccatacggcaccggactctggctgacttggttgctgaaagcgttttgggggaagaagcgcattgagactatcccatttctgtag

SEQ ID NO: 115437 - DNA, 1791 bp, Artificial Sequence
  Description of Artificial Sequence: Synthetic coding sequence
atgtttggcattcaggagaatatcccgcgcggtgggacaactatgaaagaagagcccctgggctctggcatgaaccctgtccgctcttggatgcatactgccggggtggtggacgctaacactgccgctcagtctggtgtcggtctggcacgcgcacatttcgaaaaacagccgccgtcaaacttgcgcaaatctaatttctttcatttcgtgttagccttatacgacagacaaggccagccagtggaaattgaacggaccgcatttgtggacttcgtggagaaggaaaaagaacccaataatgagaagacgaataacggaattcattataagctgcaactgttatatagtaatggcgtacggacggagcaagacctgtatgtcagattgatcgactccatgaccaagcaggctattgtctacgagggacaggacaagaatccggaaatgtgtagggtgctattgacccacgagataatgtgtagcaggtgttgcgataagaagagctgcggcaatcggaacgaaactcccagcgatcctgtgatcatcgacagattttttctgaagttttttctgaagtgcaaccagaactgtctgaaaaatgcggggaatccaagggatatgcggcggttccaagtggtcgtgtccacgacagtaaatgtggatgggcatgtactggcagtgtccgacaacatgtttgtccacaataactcaaagcatggaagacgcgctcggcgcttggaccccagcgagggtacagcccctagttacctggagaacgccaccccctgcattaaagccattagtcctagtgagggctggaccaccggcggggcaactgtgatcataatcggggataactttttcgacgggctccaagtggtgttcggtacgatgctggtgtggtctgaacttatcactcctcacgccattagggtgcagactccacctcgtcacattcccggtgtggttgaagtgaccctatcctacaaatctaagcagttctgtaaaggagccccaggtcgtttcgtgtacacagccctcaatgaacccaccattgattacgggtttcagaggctgcagaaggtgattccacggcaccccggagatcccgagcgattgcccaaggaggttttactcaaacgagctgctgacctagtggaggcattatatggtatgccgcataataatcaggagattatcctgaaaagagctgccgacatcgctgaagccctctactccgtcccgaggaaccacaaccaaatacctactctgggcaataacccagcgcacactggcatgatgggcgtaaacagcttttccagtcagctggctgtgaacgtgagcgagacgagccaggccaatgaccaagtcggatattctagaaatactagttccgtctcacccaggggatacgtgcctagtagcaccccccagcagtcaaattataataccgtgtccacatctatgaacggctacggctctggggcgatggcctcgcttggggtgcctggctctccgggctttctgaacggtagctctgcaaactccccatatgggattgtgccaagcagcccaactatggcagcttcctccgtgacactcccctcgaactgttcaagcacacatgggattttttcttttagtcccgccaacgtcatctcggccgtgaagcagaagtctgctttcgctcccgttgtcaggccacaggcttcgcctcctcctagctgcactagcgctaacggtaacggcctgcaagccatgtcgggattagttgtccctcccatgtag

SEQ ID NO: 115438 - DNA, 1656 bp, Artificial Sequence
  Description of Artificial Sequence: Synthetic coding sequence
atgttcggaattcaggaaaacataccgcgcggtgggacaaccatgaaggaggagccactcggatcaggaatgaatcccgtaagatcctggatgcatactgcaggagtggtcgacgccaacactgcagctcaatctggagtcgggctggctcgggcgcatttcgaaaagcaaccaccttcaaatctaagaaaatcgaacttcttccactttgttctcgcactctacgacaggcagggccagcccgtggagatcgaaaggaccgccttcgtcgattttgtggagaaagagaaagaacccaataacgaaaaaaccaataacggtatacactacaagctgcagctcctctattccaatggagttaggaccgaacaggatttgtacgttcggttaattgatagtatgacgaagcaggccatcgtatatgaaggccaggataagaacccggaaatgtgtcgcgtcctgctcacacacgagatcatgtgttcaaggtgctgcgataagaagtcatgcgggaaccgaaacgagaccccctcagaccctgttatcatagacagattctttttgaaattcttcctcaagtgtaatcaaaattgtctgaagaatgcagggaatcccagagatatgagaaggttccaggtggtagtcagcacaacggttaacgtggacgggcatgtactggcggtttctgataacatgttcgttcataataactctaaacatgggcggcgggcaagaaggcttgatccttcagaagccaccccctgcatcaaggcgatatccccatcagagggctggactaccggaggcgctactgtcatcatcatcggagacaacttcttcgatggtctgcaagttgtcttcggcactatgctggtctggtccgagctcatcactccccacgctattcgcgtccaaaccccaccccggcacattccgggggtggttgaggtcaccctgtcatataaaagcaagcagttttgcaaaggagccccaggccgttttgtttataccgccctgaacgaacccaccattgactatgggttccagcggctgcagaaggtgatcccgcgccatccaggggaccctgagaggctgccaaaggaggtgcttttaaaacgcgctgcggacctcgtggaagccttgtatgggatgccccacaataatcaggagatcattttgaagagggcagcagacatagctgaggccctttactccgtgccgcgaaatcataaccagattccaactttaggaaataatccggctcacactgggatgatgggcgtgaattccttcagtagccagctcgccgtgaacgtatcagaaactagtcaggccaatgaccaggtgggctatagtcgcaacacgagctctgtgagtcccagggggtatgtgcccagctccactccccagcaatccaattataatacggtgtcaactagcatgaacggttacggcagcggtgcaatggcctcccttggggtcccaggaagcccaggttttctgaatgggagcagcgcaaacagtccctacggaatgaagcagaagtccgcttttgcccccgtggtcagacctcaagcgagtccaccccctagctgtacttcagcgaatggcaatggcctacaagctatgtctgggctagtggttccccccatgtag

SEQ ID NO: 115439 - DNA, 576 bp, Artificial Sequence
  Description of Artificial Sequence: Synthetic coding sequence
tagttttccagccaacttgccgtcaacgtcagtgagacaagccaggctaatgaccaggtggggtatagcagaaatacttcgtccgtgagccccagaggctacgttccgtcttctacccctcagcagtctaactacaacactgtgtctacttcaatgaacggttacgggtctggagcaatggcaagtctcggtgtgcctggttccccaggattcctgaatgggtcttctgccaactccccttatggaattgtcccttcctcacccaccatggctgcctcttcagtcactctgcccagtaattgctcctcaacacacggaatctttagtttctcccctgccaatgtgatttccgcggtgaaacagaaatcggcctttgcccctgtcgttaggccacaggcgtctccacctccgagttgtacttcagcgaacgggaatggcctgcaggggtctctgctcggggctgaagacgtggcagcagagaaaacaaattggcccttttgtgaagtgggggggattttccatttcgacgaactcatgcttaagaaaggcaccgggaagctttgtttgggatggtag

SEQ ID NO: 115440 - DNA, 1809 bp, Artificial Sequence
  Description of Artificial Sequence: Synthetic coding sequence
atgttcccagcccaggatgcactgccccgctctggattgaaccttaaggaggagcccctgctcccagccggccttggttcggtgaggtcatggatgcagggcgcagggattcttgacgcatctactgcagcccagagtggtgttggactagcaagggctcatttcgagaaacagccgccctctaacctgcgcaagtctaatttctttcattttgtcctggcgatgtacgacaggcaaggacagccggttgaagtggaacgcacagcctttattgacttcgtcgaaaaggacagggagcccggggcagagaagacaaataacgggatacactatcgcctcagattggtgtacaataatggactacgtactgagcaggatctgtatgtgaggctaattgactctatgtcaaaacaggctatcatctacgagggtcaagacaagaatccagaaatgtgccgtgtattactgactcatgaaatcatgtgctctagatgctgcgaccgaaaatcatgtggaaaccggaatgagactccaagcgatcccgtaattatcgacaggttttttctaaagtttttcctgaaatgcaatcagaactgtctgaagaacgcgggaaaccctcgcgacatgcgccggttccaggtagtggttagtacaactgtcagcgtggatggacatgtcctggcggtatccgacaatatgttcgttcacaacaatagtaaacacggaagaagagccaggcgactggatccttcggaggccgctacaccttgcatcaaagctataagtccaggcgaggggtggaccactggcggagcgactgtaattgtgatcggagacaattttttcgatggactgcaggtagtcttcggcaacgtactcgtgtggagcgaactcatcactccgcacgcaataagggttcagactcctccacgccacataccaggagtagtggaggtgacactatcctataagagtaagcagttttgcaagggatgccccggcagattcgtgtacacggccctgaatgaacccaccatcgactatggttttcagaggctccagaaagtcatcccaagacatccgggcgaccctgagaggctgccaaaagaggtgttactcaaacgcgctgccgacctggccgaggccctgtacggagtcccaggcagcaaccaggagctgctgttaaaacgggccgccgacgtggcagaggctctttatagcaccccacgggccccgggtcccctggccccattggctcctagtcacccccatccggcggtggtggggattaacgccttctcaagccctctggccatcgctgtgggagacgccacacctggccctgaaccgggatacgcccgctcctgctcgtcggcttcaccacgggggttcgcaccaagccctggttcacaacagagtggctatggtgggggcctcggcgctggactcggcggatacggggctccaggcgtagctggtttgggagtgcccggatccccatcatttttaaacggcagcaccgctacatcaccttttgctatcatgccctccagtccacccctggccgccgcaagctctatgtccctgcccgcagccgcaccgaccacgtccgtctttagcttctctcctgtcaacatgatttccgcagtcaaacagcgtagtgcctttgcaccagtgctccggccacctagcagtcccccacaagcttgcccccgcgctcacggagaaggcttgcctgaccaatcttttgaagactccgacaagttccacagccctgcccgagggttgcagggactggcctatagttag

SEQ ID NO: 115441 - DNA, 1797 bp, Artificial Sequence
  Description of Artificial Sequence: Synthetic coding sequence
atggatgcgctgccgcgcagcggcctaaacctcaaggaagagcccctactcccggccggcctaggctccgtgcggtcatggatgcagggtgcgggcatcctggacgctagtactgccgcacagtccggagtcggcttagccagggcccactttgagaaacaaccaccctccaatctgcgcaagtctaatttcttccactttgtccttgccatgtatgatcgccaagggcagcccgtcgaagtcgagcgcacagcctttattgactttgtggaaaaggacagagaaccgggagcagaaaagacgaataatggcatccactacaggttaaggctcgtctataataacggcctcagaactgagcaagatctgtatgtcaggctcatcgactccatgtccaagcaggcgatcatatacgagggccaggataagaatcccgaaatgtgtcgtgttctgctgacccatgagatcatgtgctccaggtgctgcgatcggaagtcctgtggaaaccggaacgagaccccctcagacccagtgattatcgatcggttttttctcaagttctttcttaagtgcaatcagaattgtctgaaaaacgcgggcaacccccgggacatgcgaagattccaggtcgtggtgtctacaaccgtgtctgtggacgggcatgtcctggccgtgtccgacaatatgttcgtgcacaataattcaaagcacgggcggcgcgcccgccggctggatccatcagaggctgcaaccccttgcatcaaggcgatcagtccaggcgaaggttggacaaccggaggggccaccgtcatcgtcatcggagataatttttttgatggccttcaagtcgtgttcggcaacgtgttggtctggagtgagcttattacgcctcacgccattagagtgcagacaccgccaaggcatattcccggagtagtagaggtaactctgagctacaaatccaagcagttttgcaaaggctgccctggaagattcgtgtacacagctctgaatgagcccacgattgactacggtttccagcgtctgcaaaaagtgattccccggcatcccggtgaccccgagcgcctcccaaaagaagttttactgaagcgagcagcagatctcgcagaagccctctatggagtgccaggatcaaatcaggagctgctcctaaaaagggccgccgatgtcgcagaggctctatactcgactcccagagcacctggacccctggccccccttgctcccagccacccccaccccgctgtggtcgggatcaacgccttttcttctcctctcgccatagcagtgggggatgccactccaggcccggagccggggtatgcccgcagctgctcaagcgcttcccccaggggcttcgcaccttctcctggctcgcagcaatctggctacggtgggggtctaggggcgggtctcgggggctacggggcaccgggtgtggccggccttggcgtccccgggtctccatccttcttgaatggcagcacggccacatctccatttgcaatcatgccctcatcccccccactggctgcagccagctccatgtctctgccggccgccgcacccacgactagtgtattctcttttagtcccgttaacatgattagcgctgttaaacagaggagcgcgttcgcgccggtactgcggccccccagctcccccccacaagcttgtccacgcgcacacggagagggcctgcctgaccagagttttgaggacagcgacaaatttcatagtccagctcgcggactgcagggactcgcctactcctag

SEQ ID NO: 115442 - DNA, 555 bp, Artificial Sequence
  Description of Artificial Sequence: Synthetic coding sequence
cgcgggtctgttcaacaccctcccgttgttggcatcaacgcgttttcttctcctttggctattgccgttggcgatgccacccccggacctgaacccggatacgctcgaagctgttcgagtgcctccccacgcggattcgctccctcccccgggtctcagcagtccggatatgggggaggcctgggagctggtctggggggatatggcgcccctggggttgctggactgggcgttccaggcagtccaagcttcctgaacgggtctaccgccacctcaccctttgctatcatgccctcctctccacccttggcagctgcctcaagtatgagcctgcctgccgctgcacctacaacttcagttttctcattcagtcctgtgaatatgatcagcgccgttaagcaaagatctgcctttgctccggtgctgaggcctccttcttctccacctcaagcatgtccccgtgcccacggcgaggggctgccggatcagtcgtttgaagattcggacaagtttcactcccctgctaggggattgcagggcctcgcttacagctag

SEQ ID NO: 115443 - DNA, 1632 bp, Artificial Sequence
  Description of Artificial Sequence: Synthetic coding sequence
atggctgccgcaaaagccgagatgcagcttatgagtcctctgcagatctccgatcccttcgggtctttcccacactctcccacaatggacaattacccaaaactcgaggaaatgatgctccttagcaatggcgcaccccagttcttgggcgctgctggcgcaccagaaggcagcggctccaatagttcttccagctcatctgggggtgggggcggcggaggcggcgggtccaatagcagtagtagcagctcaacattcaatccccaagcggacaccggggagcagccctacgaacacttgacagctgagtccttcccagatataagcctgaacaacgagaaagtccttgtggaaactagctacccatcccagacgacacgactgccgcccatcacctatacgggcagattctctctagagcccgctcctaacagtggtaataccctctggcctgaaccacttttctcactcgtgagcgggctcgtgagcatgacaaatcctcctgcttccagcagctccgcccctagtcccgccgcctcttccgcttcagcttcgcaaagtccaccattaagttgtgcagttccgagcaatgattctagcccaatttattcagcggcccctacgttccctactcctaacacagacatcttcccggagccccagtcacaagctttccctggttcagcaggaaccgctctgcagtatcctccacccgcttatcctgccgctaaagggggatttcaggtgcctatgatcccagattatctgttccctcaacaacaaggcgacttaggcttgggaacacccgatcaaaaaccgttccagggtctggagagccgcacccagcagccctctcttactcctttgagtactataaaagctttcgccacccagagtgggagtcaggatttgaaagccctgaacacgagttatcagtctcagctgatcaagccgtctcgtatgcggaagtacccgaataggcctagtaaaacacctccgcatgagagaccatacgcttgccccgtggaatcctgtgaccggcggtttagcaggagcgacgagcttactagacacatccggatccatacggggcagaagccctttcaatgtagaatttgtatgcggaattttagccgcagcgatcatctgaccacacacattcggacccacaccggagagaagcctttcgcctgtgatatttgcgggcggaaattcgcccgtagtgatgagagaaaaagacacaccaagatccatctaaggcagaaggataaaaaggcagacaaatcagtggtcgcgtcatcggctacgtccagtctctcaagctatccaagccccgtggcgacctcatatccaagtcccgtgaccacttcctatccaagtccagccaccacctcttatcccagccccgtacctacttcattctcctcccctggatcaagtacgtaccccagccccgtccactccggttttccctccccatctgttgcaaccacatatagttccgtgcccccagccttcccggcacaagtgagttcttttccttccagtgctgttacaaatagcttttctgcaagtaccggcctgtccgacatgactgccacatttagccctcggacaatcgaaatatgttag

SEQ ID NO: 115444 - DNA, 603 bp, Artificial Sequence
  Description of Artificial Sequence: Synthetic coding sequence
atggcggccgcaaaggcagagatgcaactgatgagccccttacagatcagtgacccattcggctcctttccccactctcccaccatggacaactatcctaagttagaggagatgatgttactgtctaatggcgcaccgcagttcctcggcgccgcaggagccccggaaggtagtggcagtaattctagctcttctagttccggaggtggtggtggcggggggggagggagcaactcatcttcttcctcatctacgtttaaccctcaggctgacaccggggaacagccttacgaacatctcacagccgagtcctttcccgacattagtctgaacaacgaaaaggtgctcgtggaaaccagttatcccagtcagacgacccgacttcctcctatcacgtacaccggacggttcagcctcgaaccagcgcccaattcaggcttcccctctccatcagtggccactacctattctagcgtgcccccagcgttcccagcacaggtttccagcttcccttcgagcgccgtgaccaactccttcagtgcatctactggcctatcagatatgacggcaacattttctccccggacaatagagatttgctag

SEQ ID NO: 115445 - DNA, 699 bp, Artificial Sequence
  Description of Artificial Sequence: Synthetic coding sequence
atggctgctgctaaggccgagatgcaactgatgtctcccctgcagatctctgacccattcggatctttcccgcacagcccaacgatggacaactacccaaaacttgaagagatgatgctgttgagtaacggggcgccccagtttcttggtgcggccggtgcaccagagggcagcggctccaactcttccagtagtagttccggtggcggtggaggcggcggaggcgggtcgaactcctccagtagctccagtacttttaacccccaggccgacaccggcgaacagccttacgaacacctaaccgcggaaagcttccctgacatctccctcaacaacgaaaaggtcttagtggagacatcataccctagccagaccactcgactgccgccgatcacatacacaggaagattttcgctcgaaccggctcccaattcgggcaacacactctggcctgagccactgttttctctcgtttctgggctggtaagtatgaccaaccctcctgcgtcttcctcctctgcaccctcaccagccgctagttctgcctccgcatcccagtcccctcccttgtcttgcgccgtccccagcaatgacagcagtccaatctactccgctgcccccacttttccaacccctaacacagacatctttcccgagactgctatgtcaaaattctttacatcgattcagcgcacgtag

SEQ ID NO: 115446 - DNA, 1431 bp, Artificial Sequence
  Description of Artificial Sequence: Synthetic coding sequence
atgatgactgcaaaagccgtggataaaatcccggtgaccttgtcgggattcgtacaccagctttcagacaacatatacccggtggaggatcttgccgctacaagcgtgacaatcttcccgaatgccgagcttggaggcccatttgatcagatgaatggggtcgccggggacggcatgatcaacattgacatgaccggcgaaaaaagaagcctcgacctgccctacccttcgtcgtttgcacccgtctctgccccgcgcaatcagaccttcacatatatgggcaaatttagtatagaccctcagtacccgggcgcaagttgttatccagaaggaatcattaatatcgtcagcgctggcattttacaaggcgtgactagcccggcttccacgacagcctctagcagcgtgaccagcgccagccctaacccactggcaaccgggcctctcggagtctgcaccatgtcacagacacagcctgacctggatcacctatatagccctccaccccccccccctccatacagcggatgtgcaggtgatctctatcaggacccatccgctttcctgagtgccgcgactacaagcacaagcagcagtctggcctatcccccccccccaagttacccctctcccaaacccgccacagacccaggtctctttcctatgatcccggactaccccggcttttttccatcccaatgtcagcgagacttacacggcaccgccggaccggatcgcaaacctttcccatgtccactggacacgctacgggttcccccccctttgaccccactgtcaacaataaggaattttaccctagggggcccatcagctggggtgacaggccccggtgcgtctggcggcagcgaagggcctaggctgccaggctccagttctgctgcagctgcagcggccgccgcagctgcctacaacccacaccacctcccactcagacccatactgagaccccgcaagtacccgaatcgcccaagtaagacccccgtccatgagaggccctacccatgccccgcagagggctgcgatcggagattttcccgatccgatgagctgactaggcacataagaatccatacaggacacaagccgttccagtgccggatttgcatgcgcaatttcagccggtctgatcatctgaccactcatattaggacccatactggtgaaaaacctttcgcctgcgattactgcgggcggaaatttgctagatcggacgagcgcaagcgtcatacaaaaattcatctgcggcagaaggaaaggaagagctcagctccatctgccagcgtgcccgcgcccagcactgcctcttgcagtgggggcgttcagcccggaggcaccctctgttcctccaattccagtagtttgggcggggggcctctggctccgtgcagctctaggacccggacaccttag

SEQ ID NO: 115447 - DNA, 1281 bp, Artificial Sequence
  Description of Artificial Sequence: Synthetic coding sequence
atgaacggcgtcgctggtgacgggatgatcaatattgatatgactggcgaaaagcggagtctggatttaccctatcctagctcgttcgcccctgtctccgccccaaggaatcagacttttacttatatgggcaagttctccatagacccccaatacccgggtgcatcctgctaccccgaggggattatcaacatcgtatccgcaggcattctccagggagttacttctcccgcctctaccaccgccagctcaagcgtgacctccgcctctcccaatccactcgctaccggccctctcggggtctgtaccatgagccagacgcaacctgacctcgaccatttatatagccccccaccgcctccccctccgtatagcgggtgcgccggggacctgtatcaggacccatctgcatttctgtctgctgccacaactagcacaagtagttccctggcatatccgccccctccgtcgtatcctagcccaaaacccgctacagatccgggactgttcccaatgatacccgactatccgggattttttccctcccaatgtcagagggatctgcatggcaccgccggccccgacaggaaacctttcccttgccccctcgatacactcagggtgccacctcccctgactccgctgagtacgatccggaatttcacacttggggggccgagcgccggtgtgaccggccctggcgccagcggcggcagcgagggacctcggctgccaggtagctcctctgccgctgctgccgctgcagccgcggctgcctataatccccatcatctgccgttacggccaattctgcgtcctagaaagtaccccaatagaccatctaaaactcccgtgcacgaacgcccctacccttgccctgccgagggatgtgacaggcgcttctctaggtccgacgagttgacaaggcacattcgaattcatacaggccacaagccttttcagtgcaggatttgtatgaggaatttttcgaggagcgaccacctgacaacacacatcagaacccatacaggagaaaagccgtttgcgtgcgattactgcgggcgcaaattcgctcgatctgatgagcgtaagagacacactaaaattcatctccggcagaaggaacggaagtcaagcgctccttctgcttccgtgcccgctcccagcaccgcatcttgctcaggcggagtacagccaggcgggactctgtgttcatctaacagttccagtctgggtgggggcccactggccccctgcagtagcagaaccaggaccccatag

SEQ ID NO: 115448 - DNA, 786 bp, Artificial Sequence
  Description of Artificial Sequence: Synthetic coding sequence
atgcgcgtcggcctgcccagcgaggcatcatcttgcccctggagcgctaggggtccaagggatccacctgagcgtaggcgctcaggcctggcacacgtacttagcgacaatatctatcccgttgaggacctggctgccacctctgtcaccatctttccaaatgcagagctgggcggaccctttgatcagatgaatggtgtggccggagacggcatgataaatatagatatgaccggcgaaaagcggagcctggatttgccttatccttcaagtttcgcgcctgtctccgctccccgcaatcaaacgttcacatatatggggaagttcagcatcgacccacagtatccaggtgcaagttgctatcctgaagggattatcaacattgtctctgccggaattctgcagggagtgacaagtcctgcgagtaccactgcttcttcgtcagttacctcagcctctcccaatcccctggccactggcccactcggcgtatgtaccatgtcacagacacaaccagatctagatcacctgtactccccccctcctccaccccctccctacagcggatgcgctggcgacctgtatcaggacccttccgcctttttatcagctgcgacaacctccaccagtagtagtttggcttaccctccaccacccagctacccatcccctaaacctgtggaagccgcccgtgatcccgggtgcctggtcgccgcgcagcaacagcagcaaccccccccgccaccacctatcacacataccacgtgccattgcggaccattctag

SEQ ID NO: 115449 - DNA, 1431 bp, Artificial Sequence
  Description of Artificial Sequence: Synthetic coding sequence
atgatgactgccaaagcagtggataagattccagttacgttgtctggcttcgtccaccagctatcagacaatatttatccagtggaggacctcgcggcaacatcggtgactatcttcccaaatgcagaactaggcgggccatttgatcagatgaacggagttgcaggcgacggcatgataaacatcgatatgactggcgagaaaaggagtttggacttgccctatccatcgtcttttgcgcctgtttccgcaccgagaaaccaaacctttacctacatgggtaagtttagcatcgacccccagtatcccggcgcgtcttgctaccctgagggcattatcaatatcgtttcagcaggcatcctgcagggcgtcaccagccctgcctccacgacggcctcctctagcgttacttcggcctcaccaaacccattggctacggggcctcttggcgtgtgcaccatgagccaaacccagcccgacctggatcatctgtactctccgccacctccaccccccccatattccggatgtgctggtgacctctatcaggaccccagtgccttcctgagcgccgcgacaacatctacatcatcttcccttgcatatcccccccctccgtcataccccagtccaaagcccgcaactgatcccggtctcttccccatgattccagattaccccgggttcttccctagtcaatgtcagcgggacctgcacggcaccgccggccccgatcggaagcccttcccgtgtcctttggatacactacgcgttccccccccattgacacccttgtcaactattagaaatttcacattagggggcccttccgccggcgtgactggcccaggggcaagcggcggcagcgaaggccctaggctgccgggctcaagcagtgctgctgctgccgccgcagccgccgctgcctataaccctcaccacctccctcttaggcctatcctccggcctaggaaataccctaaccgcccctctaagacacctgtccatgaaaggccatacccctgccctgctgaggggtgtgatcgccgattttccaggtccgatgagctcactaggcacatccgcatccatactggacataagccatttcagtgcaggatctgtatgcgtaatttctcccggtctgatcacctcaccacccatatccgcactcacactggcgaaaagcctttcgcgtgcgattattgtggccggaaattcgctcggtcagatgagagaaagcgccataccaagatccacttgcgccaaaaagagcgaaagtctagcgccccttccgcttcagtgccagccccttcaacagcttcttgttccgggggggtccagccaggcgggactctgtgttcatccaacagttcctcactgggtggggggccgctagctccctgctcctccagaaccagaaccccatag

SEQ ID NO: 115450 - DNA, 1461 bp, Artificial Sequence
  Description of Artificial Sequence: Synthetic coding sequence
atgctccatctgtccgaattctctgagccagatgccttgctagtcaaaagcacggaagggtgttgtgctgagccgtccgctgagctccccagactccctgccagggatgcaccagcagcaactggatacccaggtgctggcgatttcctcagctgggccctcaactcttgtggtgcatcgggagatctggcagactcatgcttcctggagggtccagcacctacgccaccccctgggttgtcttactcaggttccttcttcatccaggcggtcccagaacaccctcatgacccggaagccctgtttaatctcatgtccggaatcctcggattggcccctttcccaggaccagaagcagccgcctctagatctcctctagacgccccctttcccgctgggtctgatgcactgttgccagggccccccgatctctatagtcccgacctgggggctgcccctttccccgaggcattctgggaggcctccccttgtgcgggagccccttcacagtgtctgtacgaacctcagctatccccaccagacgttaaaccaggcctgagggcgcctcctgcatcaccagccctggacgccgtctctgcgttcaaagggccttacgccccatgggaactgttgtcagtgggggctcccgggaactgtggcagccaaggtgactaccaggccgcccctgaagcccgcttccccgtgattgggaccaaaatcgaggatttgcttagtattagctgccctgcagagttgccagcggtccccgccaatcgcctgtacccctcaggagcatacgatgcctttcccctggcccccggcgatctgggtgagggtgctgaaggacttccgggtttgctgactccacccagtggggaaggggggtcaagcggcgatggaggcgagttcctggcctccacccagcctcaattaagtccactcggactacggagcgcagccgctgccgacttcccaaagcccttagtggctgatatccctgggagctcaggcgtggccgcacccccagtacctccccctccacccaccccttttccccaagcaaaggcccgacgaaaaggcagaagaggagggaaatgctccactaggtgtttttgtccacggcctcatgccaaagcattcgcctgcccagtggaatcatgcgtgagatcatttgcccgcagcgacgaacttaataggcacctgcggattcacaccggacacaagcccttccagtgtagaatttgcttaagaaatttctcaaggtccgaccatctcaccacccatgtgcggacacatacaggagagaaaccctttgcttgcgacgtgtgtgggcggaggttcgcacggtctgatgagaaaaaacggcactcgaaggtgcaccttaaacagaaggccagagctgaggaacgactcaagggcctgggcttttactcactcgggttatcattcgcaagcctgtag

SEQ ID NO: 115451 - DNA, 1770 bp, Artificial Sequence
  Description of Artificial Sequence: Synthetic coding sequence
atggcggtggcgcgaggagtgggctcaccagaacccgcccctcctcagctgtataagtgggggggttgtgggctgggagagccgggaagcgctttggagcgtcgtggcgctgctgctcggggacggtgcggtcgagcccgcgcccctcgactaccagatagttttcctaggggcgaatgcccaaagcctggggctagggcacctaggtctgtgagatgtggggaacccctgccgccagcgtccccaccaccagcacggccccaagcacagcgcgctcgccccagggctccccacagccgtcgcagagccatgttgcatttgtcagagttcagtgagcctgacgcccttctcgtcaaatccacagaaggatgttgcgccgagccctctgcagaactgcctaggctgcccgcccgggacgctccagccgcaaccggctatccaggcgctggtgattttcttagttgggcactcaactcatgtggagctagtggagatcttgccgacagctgttttcttgagggacctgcgcctacgcctcctcctggcctgagctattccggttctttctttatccaggccgttcccgaacatccgcatgacccagaagcactttttaacttgatgtctggcatcctagggcttgccccctttcctggcccagaagctgcggcgtccagatcaccgctggacgccccatttccagcaggctctgatgcactgcttcccggtccacccgacttgtactcccctgacctgggagccgccccgttccccgaggccttttgggaagcctcaccttgtgccggggctcccagccagtgtctctatgagccccagctcagcccacctgacgttaagcccggcttgagagctccccccgcgtcccctgctctggacgccgtgtctgcctttaaggggccttatgctccttgggagctcctgtcggtgggggcccccggcaattgcgggtcacagggggactatcaggcggcccctgaggcccgctttcccgtgataggtaccaagattgaagacctactctctattagttgccctgcagagcttccagccgtgccagcaaacagactgtacccctcaggggcatatgatgccttcccacttgcaccaggcgatctcggcgaaggagctgagggtcttcccggccttctgaccccaccgagtggcgaaggaggcagcagcggtgatgggggagagttcctcgcctcgacacagccgcagctgagccctttagggctccgcagtgccgccgccgccgactttcctaagccactggttgctgatatccctggctcttcgggagtggctgccccgccagtgcccccacctcctcctaccccattccctcaggcgaaagctcgacgcaagggcaggagaggaggaaagtgcagtactcgctgtttttgtccccgacctcatgctaaagcctttgcttgtcctgttgagtcttgtgttaggtccttcgcacgttcagacgaattgaataggcacctccgaatccacacagggcataagccctttcagtgcaggatctgcctacggaactttagtcgtagtgatcacctaaccactcatgtgcggacacatactggtgagaaaccgttcgcctgcgatgtttgtggaaggcggtttgcacgttctgatgagaagaaacgacacagtaaggtgcacctgaagcagaaagctcgcgccgaagagaggctcaaggggctgggcttctattccctggggctgagtttcgcctccctgtag

SEQ ID NO: 115452 - DNA, 921 bp, Artificial Sequence
  Description of Artificial Sequence: Synthetic coding sequence
atggacacacctcccttgtcagattctgagagcgaaagcgatgagagtctcgtcaccgaccgcgagctgcaggacgctttcagccgcggcctcttgaagcccggattaaacgtggttctcgagggacctaaaaaagccgtcaatgatgtcaatggactgaagcagtgcctcgcagagtttaagcgggatcttgagtgggtcgaaaggctcgacgtgaccttaggcccagtgcctgagatagggggctccgaagctccagcgcctcagaataaggaccagaaggctgtggaccccgaagacgattttcagagagagatgagtttctatagacaggcacaggctgcggtgctggctgtattgcctcgactgcaccagttgaaggtcccaactaagagaccaaccgactatttcgcggagatggctaagagcgatttgcaaatgcagaaaattcgccaaaagttgcaaactaagcaagctgctatggaaaggtctgagaaggcgaagcagcttcgggcgctccggaagtacgggaagaaggtccagaccgaggttttacagaaaagacagcaagagaaggctcatatgatgaacgcaattaagaagtaccagaaggggttcagtgataagctcgacttcctggaaggggaccaaaagcctctcgcccaacgcaagaaggcaggcgccaagggacagcagatgagaaaagggccttcagccaagcgccgctacaaaaatcagaaattcggatttggcggcaagaagaaaggcagcaagtggaacacgagagagtcctacgatgacgtctccagttttagggccaaaacggcgcacggccgcgggctgaaacggccgggcaagaagggctctaataagcgtcccgggaagaggacgcgggagaaaatgaaaaatcggacacactag

SEQ ID NO: 115453 - DNA, 1086 bp, Artificial Sequence
  Description of Artificial Sequence: Synthetic coding sequence
atgtacccagaagcactgccagtggggattctgagcaatccagatactttcaaacgccggtccggcagctactctaacgataaacctgaagtgtggtttgccgccggctctggttctccgaaccagaagctaagctccagctgcgtggggcgtgcctgcggcgagatggatacaccccctctgtcagattccgagagtgaatcagacgagtccctggtgacagatagggagctgcaagacgccttctctagaggtttactgaagcccggactgaacgtcgtgttggaaggcccaaagaaagcggtgaatgacgtgaacggtctgaagcagtgcttagctgaattcaaacgcgacctggagtgggtcgaacggctggatgtcacactggggcccgtacctgagatcggcggttcagaggcacctgctccccaaaacaaggatcagaaagcagtggatccggaggacgactttcaaagggaaatgtccttttaccgccaggcacaagccgccgtgttggccgtactgccccgtcttcaccagctgaaagtaccaacaaaaagaccgacagactacttcgcagaaatggctaagtcagatctgcagatgcagaaaatcaggcagaagctgcaaacaaagcaggccgctatggaacgcagtgagaaagcgaaacagttgcgggcactgcgtaaatacgggaagaaagtgcagaccgaggttctgcagaagaggcagcaggagaaagcgcatatgatgaacgccatcaaaaagtaccagaaggggttctccgataaactggacttcttagaaggcgaccagaagccgctggctcagaggaagaaagccggtgcgaaggggcagcagatgcgaaaggggccatccgctaagagaagatataaaaatcagaagtttggtttcggcggaaagaagaaaggctccaagtggaatactcgggagagctacgatgacgtctcctcattcagggcgaagaccgcccacggccggggcctcaagaggccagggaaaaagggctccaacaagcgaccaggcaagaggactcgagagaagatgaaaaaccgcactcactag

SEQ ID NO: 115454 - DNA, 2448 bp, Artificial Sequence
  Description of Artificial Sequence: Synthetic coding sequence
atggaagatggcttcagcagctactcctcactgtatgacacaagtagccttctgcagttctgtaacgatgactccgcctcagctgcctccagcatggaggtgacagatcgcatcgcttctttggagcagcgggtgcagatgcaagaagatgatattcaactgctgaagtcagcccttgctgatgttgtgcggcgactgaacattacagaggaacagcaggccgtcctgaaccgcaagggacccactaaggcccgacccctgatgcaaaccctgcctctcaggaccacagttaacaatggtacggtgctacccaaaaagccaacaggtagtctgccgtctcccagcggcgttcgtaaagagacagccgtgccagctactaaatccaacatcaagcgcacttcaagcagcgagagagtcagcccaggcgggcgacgggagagcaacggagactccagagggaatagaaatcggactggaagtacctcttcttcctcatccggaaagaagaacagcgaatcaaagccaaaggagcccgtattcagcgcggaggagggatacgtaaaaatgttcctacgcggaaggcccgtgacgatgtacatgccgaaggaccaggttgattcttattcactggaagcgaaagtggagttgcctaccaagcggcttaaactggaatgggtttatggataccgcggtcgagactgtcgcaataatctgtatctcctcccaaccggcgagactgtctattttattgctagcgttgtggtcctgtataatgtggaagaacagctgcagcgtcactatgccggtcacaacgacgatgttaagtgcttggctgtccatcctgaccggattactatagctaccggtcaggtggctggaacgtcaaaagacgggaaacaactccccccacatgtgcgcatttgggactccgtgacccttaacactttgcacgtgattggcataggatttttcgatcgggctgtgacctgcattgcattctctaagagtaacggcggaacaaacctgtgtgcggtggacgattctaacgaccatgtgctcagcgtgtgggattggcaaaaagaagagaagctggctgacgtgaaatgcagcaacgaggcggtctttgccgctgatttccaccctactgacacaaacatcatagtgacctgcggcaagagccacctctacttttggacactcgagggctcctccctcaataagaaacaggggctttttgaaaagcaggagaagccaaagtttgttctttgtgttacattcagcgaaaacggggatacaatcacgggagatagctctgggaacattctcgtgtggggaaaagggaccaatagaatttcctatgcagtgcagggcgcgcatgagggggggatcttcgccctctgcatgctgagggatgggacactggtctccggaggcggaaaagaccgaaagttgattagctggtccggaaattaccagaaactaaggaaaaccgagatacctgaacagttcggccccatcaggactgtggcagagggcaaaggcgacgttattctcatcggaaccacaagaaattttgtcctccagggcactttgagcggggactttaccccaattacacagggccatacagacgagttgtgggggctggccatacatgctagtaaaagccaattcctaacttgcggacatgataagcacgcaacactttgggatgccgtgggtcacaggcctgtctgggacaagattatcgaagacccagcacagtctagcgggttccacccttccggctccgtcgtggctgtcggcaccctgactggccgctggttcgtgttcgacaccgaaaccaaggatctcgtgactgtgcataccgatgggaacgaacagctgtcggtcatgcgatacagtccagatggcaattttctcgccattggctctcatgacaactgcatatatatctatggcgtctcagataatggtcgcaaatacacccgcgtaggaaaatgtagcggccattcttccttcatcacccacttggattggagtgttaacagtcagtttctcgtgtccaacagcggcgattacgagatactctactgggttccgagcgcctgtaagcaagtggtcagcgtggagaccacccgtgatattgaatgggcaacatacacatgtacgttggggtttcacgtatttggagtttggcccgagggatccgacgggaccgatattaacgccgtttgtcgggcacacgaaaagaaactcttgtccacgggcgatgactttggtaaagtgcatttatttagttacccttgctcccagttccgggccccttcccacatttatggagggcattcttctcatgtgacaaatgtagactttctttgtgaagacagtcacctcatctccaccggggggaaggatactagcataatgcaatggagagtaatttag

SEQ ID NO: 115455 - DNA, 2505 bp, Artificial Sequence
  Description of Artificial Sequence: Synthetic coding sequence
atggaagacggttttagctcatattcaagtctttacgataccagttccttgctgcagttctgtaacgacgatagcgcctcggcagcctccagtatggaagttactgatcgcatcgccagtcttgagcagcgcgtgcaaatgcaggaggatgacattcagctattgaagtccgccttggccgatgtcgttaggagacttaacatcactgaagagcaacaggctgttctaaaccgtaaagggcctactaaggctcggcctttgatgcagactttacccttgcgtacaacggtgaataatgggaccgtgttgcctaaaaagcccacaggttctctgccatctccatcgggtgtccgaaaggaaacagccgtgcctgctacgaagcgcctcaatcgctccgtgagcctcctgaatgcctgcaagctcaatcggagtacaccatccaatatcaaacgaacatccagctcagagagagtcagccccggcgggaggcgggaaagcaacggagacagcagaggtaatcgcaatcggaccggtagcacctcttcgagcagtagcggaaaaaagaatagcgaatccaaacctaaagagcccgtttttagcgctgaagaaggatatgtgaaaatgtttttacggggccgccctgttacaatgtatatgcctaaagatcaggtggactcctactccttagaggccaaggtggaactccctaccaagcgtctgaagctagaatgggtctacggctatcgaggtagggactgccgcaataacttatatctccttcctactggtgagaccgtctacttcattgccagcgtcgttgtgctgtataatgttgaagaacagctgcagcggcactacgccggccacaacgatgacgtgaagtgtctggccgtccaccccgacaggattaccatcgccacgggccaggtcgctggcacatcaaaagatgggaagcaattacctccccatgttcggatctgggattcagtcactttgaacacactccatgtgattggcataggattctttgaccgggcagttacatgtatcgccttttccaagtccaacggcggaacgaacctctgcgctgtcgatgactctaatgatcacgtgctgtcggtttgggattggcaaaaagaggaaaagcttgctgatgtgaaatgctcgaacgaagccgtatttgctgccgactttcacccaactgataccaacatcatcgttacctgtggcaagtctcacctgtacttctggactctggagggctcatctcttaataaaaaacagggcctgttcgaaaaacaggagaaacctaagttcgtgctctgcgtaactttcagtgaaaacggcgatactataacgggagactcttccgggaacatcttggtctggggtaagggcacaaacaggatcagttacgctgttcagggtgcccatgaggggggcattttcgctctgtgcatgttgcgcgatggcactctggtctcaggaggaggtaaggacaggaagctaatcagctggtcaggtaattaccagaagcttcggaagaccgagattcctgagcaattcgggcccattcgcaccgtggctgaaggaaaaggcgatgtcatcctgattgggactaccaggaacttcgtgctgcagggtaccctgtcaggggactttactcctatcactcagggacacacagatgagctgtggggactcgcaatccatgcttctaagtcgcagttccttacctgcggccacgataaacacgccaccttgtgggacgctgttggacataggcctgtctgggataaaatcatcgaggatcctgctcaatccagcggctttcaccccagtggcagcgttgttgctgtgggcacgttgacagggaggtggttcgttttcgacactgagaccaaagatctcgtcaccgtccatacagatggcaacgaacagcttagcgtgatgcggtactcgcccgatggcaatttccttgccatcggttcccatgataattgcatatatatctacggagtatccgacaacgggaggaagtacacacgcgtgggcaagtgctccggccactccagctttattacacatttagactggtccgttaattcccagttcctcgtgagtaacagtggcgactatgagattttatattgggtgccctccgcctgtaaacaggttgtgtctgtcgagactacccgagacatcgagtgggccacatacacctgcaccctgggtttccatgtctttggcgtatggccggagggatctgacggtacagatattaatgccgtgtgccgcgcccacgaaaaaaagctgctcagtactggggacgattttggaaaagtacacttgttttcttacccctgctctcagtttagagcaccatcccatatctatggaggccacagttctcatgtgaccaacgtcgattttctgtgcgaagattctcatctgatctcaacgggcggcaaggacaccagcatcatgcagtggcgagtcatctag

SEQ ID NO: 115456 - DNA, 2505 bp, Artificial Sequence
  Description of Artificial Sequence: Synthetic coding sequence
atggaagatggattcagctcatattcaagcttatatgacacatccagtctgcttcagttctgtaatgatgactcagctagcgcagctagtagtatggaggtcaccgaccgaatcgcctcactggagcaacgggtgcagatgcaggaggacgacattcagctgctgaagagcgctctagcagatgtggttcgacgtctgaatatcacagaagaacagcaggcagtcttaaataggaagggcccaacaaaggctcgccccttgatgcagaccctgcccttgcggacgaccgtcaataatggtaccgtcttaccaaagaaacccactggcagtttgccatctccctccggcgtgcgcaaagaaaccgctgtcccggccaccaaaagactgaatagatccgtgtctctgttgaacgcatgtaaactcaaccggagtacaccttcaaacattaagcggacttcaagtagtgagcgagtgtcaccaggggggcgtcgggaatctaatggcgacagtagggggaaccggaataggaccgggtcaactagttctagctcttctggaaagaaaaattctgagtctaagccgaaagaaccagtttttagtgccgaagaaggctatgtcaaaatgttcctgcgaggacggcctgtcactatgtatatgcccaaagatcaggtggattcctactctctagaggccaaggtcgaactgccgacgaagcgtttgaagctcgagtgggtttatggctataggggacgagactgccgaaacaatctgtacctgcttccgaccggcgagacagtgtactttatcgcctctgtggtagtgctctataatgttgaggaacaattacagaggcactatgcagggcataatgacgatgtgaagtgcctggccgttcacccagaccggataactatagctaccggtcaagtggctggaacttcaaaagatggaaaacaacttccaccacacgtgcgcatatgggattcggtgacactgaacactcttcacgtaatcgggattgggttctttgatcgggcagtcacatgcatagccttctcaaagtccaatggaggtaccaacctgtgcgcagttgacgattctaacgatcatgtcctgtccgtctgggactggcaaaaggaagagaagctcgccgacgtgaaatgttcaaatgaggctgtcttcgccgctgactttcaccctacagatactaacattatagtgacttgcgggaagagccacctctacttttggacccttgaaggtagttctttgaataaaaaacagggcctcttcgagaagcaggagaagccaaaattcgtgctgtgcgtgacattctcagagaatggcgatacaattacgggggatagcagtggtaatatactggtctggggtaaggggaccaaccggatcagctacgctgtgcaaggagcgcacgaggggggaatcttcgctctgtgtatgctgcgggacggcacgctggtctctggaggtggtaaagacagaaagttaattagctggagcggcaattatcagaagctgaggaagaccgaaatacccgagcagtttggccccattcgcactgtcgcggagggcaaaggggatgtaattctcattggcactacaagaaattttgtgcttcagggcacactatccggggattttacaccgatcacccaggggcatacagacgagctatggggactggccatccacgccagcaaaagccagttcctgacttgtgggcatgacaagcatgctactctgtgggacgctgttggccacaggcccgtgtgggacaagatcattgaagaccccgcccagagcagcggcttccacccatctgggtcagtcgtggccgtgggcacgctgacaggccgctggtttgtgttcgatacagagacaaaagacctggtgaccgtgcacaccgatggcaatgaacagcttagtgttatgaggtactcaccggatggaaatttcctggctataggatctcacgataattgcatatacatctatggcgtgtctgacaacgggaggaaatatacccgtgtggggaaatgtagtggccactcatcctttattacacatctggattggagcgttaactcccagttccttgtatcaaattccggcgattacgagatcctctattgggtgccctcagcatgcaaacaggtggtgtctgtggaaaccacacgcgatatcgaatgggccacctacacttgtactctcggctttcacgtattcggggtttggcccgagggctctgacggcaccgatatcaacgcggtgtgccgcgcacatgaaaagaagttgctcagtacaggagatgacttcggtaaggtgcatctcttttcatacccctgttctcagtttcgggccccgtcccatatctacgggggacattcttcccacgttactaacgtggacttcttatgtgaagactcacatctgatcagtacaggaggcaaagatacaagcatcatgcagtggcgcgtaatttag

SEQ ID NO: 115457 - DNA, 2946 bp, Artificial Sequence
  Description of Artificial Sequence: Synthetic coding sequence
atggatggttttgcaggctccctagacgatagcatatcagcagcctctactagtgatgtacaagaccgcctgagcgctctagagtccagggtacaacagcaggaagatgaaattactgtgctgaaagccgccttagcagacgtgctgcggcgattggcaatctccgaagatcacgtagccagcgtgaagaagagcgtgtcctccaaaggccagcccagccccagggccgtgattcctatgagctgcattactaacggctcaggcgccaatcgtaaaccgtcccatacctctgcagtatccatagcaggcaaggaaacactgagcagcgcagccaagagtggcaccgagaagaaaaaggaaaaaccccaaggacagagagagaaaaaagaagaatctcatagtaatgaccagtccccacagattagggcttcccccagcccacagcctagcagccagccccttcagattcaccggcagacgcctgagtccaaaaacgccacacccactaaatcaattaagaggccatctcctgccgaaaaaagccataatagctgggaaaattcggacgatagtcgtaataaactgtccaagatccctagcacccctaaactcatccccaaggtcactaaaacggctgacaagcacaaagatgtgatcattaatcaagaaggcgaatatatcaagatgttcatgagaggaagaccaatcacaatgttcatcccctccgacgtagacaattatgacgacatccgtaccgagctacctccggagaagcttaaactagaatgggcatacggataccggggaaaagattgccgcgctaacgtgtacctgcttccaacgggtaaaattgtgtattttattgcctccgttgttgtgctttttaactacgaggagcgaactcagaggcactatcttggccatacagactgcgtgaagtgcttggctatccatccggataaaatccgcatcgctacgggtcaaatagccggcgtagataaggacggaagacctctccagcctcatgtgcgcgtctgggattcggtgaccctatctacccttcagataattggcctgggaacattcgaacggggggtcgggtgtctggactttagtaaggccgacagcggagtgcatctgtgtatcattgacgacagtaacgagcacatgctcactgtgtgggattggcagaagaaagctaagggtgctgaaattaagacgacaaacgaagttgtgctggcggtggagttccatcctaccgatgccaacactattataacgtgtgggaaaagccatatctttttctggacgtggagcggcaatagcctgacaaggaaacagggaatcttcggcaagtacgaaaagccgaaattcgtgcagtgcttggcattccttggaaatggtgatgtgctgacaggtgactcggggggagtaatgctgatctggtccaaaaccacggttgagcccacccctgggaagggccctaaaggcgtgtatcagattagcaagcagatcaaagcccacgacggctcggtgtttaccctgtgtcaaatgcggaacggtatgctccttacaggcggcgggaaggaccgaaagatcatactctgggaccatgacctcaacccagagagagagattgaggtgcctgatcaatacggtacaatcagagccgtcgccgaaggaaaggcggatcagttcctcgttgggacgagcaggaatttcattcttcgagggacattcaatgatggttttcagatcgaggtgcagggacacaccgacgagctgtggggactggctacccacccatttaaagatctgctccttacatgtgcccaggaccgccaagtttgtctgtggaatagcatggagcaccggctggaatggacccggttggtggatgagccaggacactgcgctgatttccatccctccggtaccgttgtggcgatcggcacacactctggacgctggtttgtgttagatgctgagacaagagatcttgtgtccatccacactgacggcaacgagcagctgtctgtgatgcgctactccatcgatggcaccttcttggctgtgggcagccacgataattttatttatctgtacgtcgtgtctgaaaatggacggaaatactctcggtacgggcggtgtacaggtcactcctcctacatcacccacttggactggtcacctgataacaagtacattatgtctaacagcggcgattacgaaatcctgtattgggatatacccaacggatgcaaactcattcgtaaccgctccgactgcaaagatatcgactggacgacatacacgtgcgtcttgggcttccaggtcttcggggtttggccggagggatcggacgggactgacatcaacgcccttgtccggagtcataatcgcaaggtcattgctgtcgcggacgatttttgcaaggttcatctctttcagtacccatgttccaaagcaaaggctcctagtcacaagtattctgcacattccagccacgtgaccaatgtgagctttacacacaatgactcccacctcatctcaacaggggggaaagacatgtcaattatacagtggaaactcgtagagaaactttctctgccccaaaatgaaacagttgctgatacaacccttactaaagcccccgtgtcctctaccgaatcagtcattcagtctaacaccccaactccgcctccttcccagccgctaaatgagactgccgaggaagaatcccggatctcctcatcacccacactgctcgagaattctctcgagcaaaccgtggagccctctgaagatcacagcgaggaagaatccgaggaaggctcgggggatttgggcgaacccttatatgaggaaccttgcaatgagatctccaaagagcaagccaaggcaaccttgctggaagatcagcaggatcctagcccgtcttcttag

SEQ ID NO: 115458 - DNA, 738 bp, Artificial Sequence
  Description of Artificial Sequence: Synthetic coding sequence
atgtctaactccggcgactatgagatcctttattgggatattcccaatggctgtaaactcattcggaatcgctcagattgcaaggacatcgactggacaacatacacctgcgtcctgggcttccaggtgtttggagtgtggcccgaggggtctgatggaacagatattaacgccctcgtaaggtcccacaaccgcaaggtaatcgcagtggcagatgacttttgtaaggttcatttattccaatacccttgctcaaaggcaaaagcaccttctcataagtattccgcccacagtagtcacgtcaccaatgtgtctttcacacataacgacagtcacctcatcagtactgggggtaaagacatgtcaattatccagtggaaactagtggagaagctctcactccctcagaatgagactgtggctgataccaccttgaccaaggccccagtgtcgtctactgaatcggtgatccagagcaatacaccaacccctcctccgagccagcctctaaatgagacggccgaagaggaatctaggatctcaagttcacctaccctgctagagaattctctcgagcaaaccgttgagcctagcgaggatcactcagaggaggagagcgaagaaggctcaggggatttgggagaacctctgtacgaagagccttgcaacgagatttctaaggaacaagccaaagctacacttttggaggaccagcaggacccctctccatccagttag

SEQ ID NO: 115459 - DNA, 2772 bp, Artificial Sequence
  Description of Artificial Sequence: Synthetic coding sequence
atggatgggtttgctggtagcctggacgattcaatctccgcagctagcacaagcgacgtgcaggacagactctcagccctggaatccagggtgcaacagcaggaggatgagattaccgtccttaaagctgccctggccgacgtgttacggagactggctatttctgaggaccatgtggcgagcgtgaaaaagtctgtctcttctaaaggccagccttccccgcgcgcagtgatccccatgtcttgtattacaaatggatcgggcgctaatcggaagcctagccacacaagtgccgtgagtatagccggaaaggaaactctctcttccgccgcgaagagcatcaaaaggccaagccccgccgagaagagtcacaatagctgggaaaattctgatgactcgagaaacaaactcagcaagattccttcaacccccaagctgatcccaaaggtgacaaagaccgccgataaacacaaggacgtgatcatcaaccaggagggtgaatacattaagatgttcatgcgggggcggcccatcaccatgtttatcccctccgacgtggataactacgacgacataagaactgagctgccacctgaaaagctgaagctggagtgggcctacggctaccggggtaaggattgccgggctaacgtctatcttctgcctaccgggaaaatcgtttattttatcgctagcgttgttgtgctcttcaactacgaggagaggactcagagacattacctcgggcatacagattgcgtaaaatgtctcgccatccacccagataagattaggatcgcaaccggtcaaattgccggcgttgacaaggacgggcgccccctgcagccgcacgtgcgagtgtgggacagcgtcactctcagtaccttgcagatcattggcttgggaacctttgaacgaggagtgggttgtctggacttcagcaaagcagattccggtgtccacctatgcattatcgacgactccaatgagcacatgctaactgtgtgggactggcaaaaaaaggctaaaggtgccgagatcaagacaacaaacgaggtggtactcgcagtcgagtttcatccgaccgatgctaatactattattacgtgcggtaaaagtcacatcttcttctggacctggtctggcaactctttgaccagaaaacaaggtatctttggaaagtatgagaagcctaaattcgtccaatgcctcgcgtttttaggcaatggtgatgtgttaaccggagactcagggggggtaatgctcatttggagtaagactacagtggagcctacaccgggcaagggccccaagggtgtctaccaaatcagtaaacagattaaagcccacgacgggtctgtcttcaccctttgccagatgcgcaatgggatgctgctaaccggcggcggcaaggaccgcaagatcatcctgtgggatcatgacctgaaccccgaaagggaaattgaagttccagatcagtatgggacaattagagcggtcgcagagggtaaggctgaccagttcctggtcggcacaagtcgcaactttatcttaagggggactttcaatgatggcttccagattgaggtacaaggccacactgacgagctgtgggggctggccactcatccttttaaagatctcctgctgacctgtgctcaggaccggcaggtgtgtctgtggaattcgatggagcaccggctggaatggacacgtctggtggacgagccagggcattgtgccgattttcatccgagtggaaccgtggttgcaataggcacccacagcggccggtggttcgttctcgacgccgaaacaagagacttggtgtcgatccatacagatgggaatgaacaattaagtgtaatgcggtacagtatcgatgggacatttctggccgtcggcagccatgacaattttatatacctttatgtcgtgtctgagaacggacgcaagtactctcggtacgggcggtgcactggacacagctcttacattacgcaccttgactggtccccggacaacaagtatataatgagtaattccggggattacgagatactgtattgggatatcccaaatgggtgtaagctgataaggaatagatccgactgtaaggatatagactggacaacctatacctgcgtactgggtttccaggtgtttggtgtctggccagaaggaagcgacggaacagacattaacgccctggtgcgctcccacaatcgtaaggtgatcgctgtggcagacgatttttgtaaggtccacctttttcagtacccttgctccaaggctaaagctcctagccataagtattcagcccactcatctcacgtgactaacgtgagctttactcacaatgattcccacctgatctccaccggcggaaaggatatgtctattattcagtggaagctcgtggaaaagctgtctctccctcagaacgagaccgtcgccgatacaacattaaccaaagctccagtgtccagcaccgaatctgttatccagtcaaacacaccgactcctccaccgtcacaacccctgaacgagacagccgaggaggaatcaaggatttctagttcaccaaccttgttggaaaatagccttgagcagaccgtggaacctagtgaagatcattccgaagaggagtctgaggaaggatctggagatctcggggagccactttatgaggagccctgcaatgagatttccaaagagcaggctaaggctacactattagaagatcagcaggatccatcgccatcctcctag

SEQ ID NO: 115460 - DNA, 780 bp, Artificial Sequence
  Description of Artificial Sequence: Synthetic coding sequence
atgcttctgcgtagttggttcgggaataaagacttccaggccctccctattctggcccgcttaccgtccatgccaaccgacatggagcacacaggacactatctgcatcttgcctttctcatgaccacagttttctccctgagtcctggaacaaaggctaattacacaaggttatgggccaatagtacaagctcctgggatagtgttatccagaataaaactggccgcaaccagaatgaaaacattaatacaaacccgattacccctgaggtcgactataaggggaattccaccaatatgcctgagacttctcacatagtcgccttgaccagtaaaagcgagcaagagctgtatattccgtccgtcgtgtctaattcgccttcaacagttcaatccatagagaacacttcaaaaagccatggcgagattttcaaaaaggacgtgtgcgccgagaacaataataacatggctatgctgatatgcctcatcatcatcgctgtgctgtttctgatttgtaccttcttgttcctgtccaccgttgtactggctaacaaagtttcatctttaaggaggagtaagcaggtgggaaagaggcagccacggagcaacggcgattttttagccagcggattatggcccgccgaatcagatacgtggaaacgaacaaagcaattgactggacctaatctcgttatgcagtctacaggcgtgctgaccgcaacccgggagcgaaaggatgaggagggcacagagaagctcacgaataagcagatcggatag

SEQ ID NO: 115461 - DNA, 711 bp, Artificial Sequence
  Description of Artificial Sequence: Synthetic coding sequence
atgccgacagacatggagcatactggtcactatctccacctcgccttcctcatgacgacagtattctccctatctcccggtacaaaagccaattacactagactctgggctaactccaccagctcttgggacagtgtcatccagaacaaaaccggaagaaatcagaatgagaatattaacaccaacccaataactcctgaggtggattataagggaaacagcaccaatatgcctgagacttcccacatcgtagccctcactagcaaaagcgaacaggaactgtacattcccagcgtggtaagcaatagccccagcacagtgcaatcaattgaaaatacatccaagtcccatggggagatcttcaaaaaggatgtgtgcgcggaaaacaataataatatggctatgctaatctgtctcattataattgcagtgttgttccttatttgcactttcctgttccttagtaccgtcgttctcgcgaataaagtgtcaagcctgagacggtctaaacaagtgggtaaacggcagccacgtagcaacggcgatttccttgcctctggcctatggcctgccgagagcgacacctggaagcgcacaaagcagctgaccggccctaatctggttatgcagagtaccggagtcttgacggctacccgggagcgcaaagatgaagagggcaccgagaagctgacaaataaacagatcgggtag

SEQ ID NO: 115462 - DNA, 711 bp, Artificial Sequence
  Description of Artificial Sequence: Synthetic coding sequence
atgccaacggacatggagcatactggtcactacctgcacttagcatttctgatgacaaccgtattctcgctctctccgggaactaaagctaactacaccaggctctgggcgaactctacgtcatcatgggatagtgtcatacagaataagacaggaaggaaccaaaacgaaaatattaatactaaccccattacaccagaggtggattacaaaggaaattccaccaacatgccagaaacaagccatatagtggccctaacatccaaaagtgagcaggagctgtatattccctctgtggtgagtaattctccctccactgttcagagcatcgaaaacacttctaaatctcacggagagatttttaagaaggatgtgtgtgcagaaaacaataataatatggccatgctgatctgcctcatcattattgctgttctgtttctgatctgcaccttcctcttcctttccactgtggtgctggcaaacaaagtgagttcactgcgaagaagtaagcaggtgggaaagcggcagcctaggtctaacggggatttcctggcaagcggactttggccagccgagagtgatacatggaagcggacaaagcaactgactgggcctaacctggtaatgcagtccactggcgttctaactgctactcgtgagaggaaggatgaggagggcaccgagaaactgacaaataagcagatcggttag

SEQ ID NO: 115463 - DNA, 699 bp, Artificial Sequence
  Description of Artificial Sequence: Synthetic coding sequence
atggagcacactggccactatctgcacctcgcgttcttaatgactacggtgttttcattaagccccggcacaaaagccaactacactagactgtgggccaatagcacctctagctgggacagcgtaattcaaaataagaccggccgaaatcagaacgaaaatatcaacactaatcctataactcccgaggttgactacaaaggcaattctactaatatgcccgaaacatcccacattgtcgccctgacttctaaaagcgagcaggagctctatattccgagcgtcgtgtctaactctccttctactgtacagtcaatcgaaaataccagcaaaagccacggggaaattttcaagaaggatgtttgtgccgagaataacaataatatggctatgctaatttgtctgataataattgccgtgttgttcttaatttgcacatttctcttcctgagtactgtggttctcgccaacaaagtgtcaagtctaagacgatcaaaacaagtggggaaaaggcaacctagatcaaatggcgactttctagcctcgggactctggcctgcggagagtgacacctggaagcgaaccaagcaacttacaggaccaaatttggtaatgcagtccacaggtgtcctgaccgctacccgcgaacgcaaggatgaagaaggcaccgaaaaactcacaaacaagcaaattggatag

SEQ ID NO: 115464 - DNA, 1347 bp, Artificial Sequence
  Description of Artificial Sequence: Synthetic coding sequence
atggacccaaagtacttcattctaatcctcttctgtggccacctgaataatacttttttcagcaaaacagaaactatcacaaccgagaagcagagccagccaacgctctttacaagttctatgtcgcaggtcctggcaaacagtcagaacacaacaggaaatccgttggggcagcccacccagttttctgacactttctccgggcaatccatctcacccgccaaagtgactgctggacagccaaccccagcagtatacacgagttcagaaaaacctgaggctcacaccagtgccggacaacccctcgcctataacaccaagcagcccaccccaatagcaaatacatcttcacaacaagccgtgtttacaagtgccagacagctgcccagcgctagaacttctactacgcagcctcccaagtcctttgtttataccttcacgcagcaatcctcctctgttcagattccgagcagaaaacagatcacagtgcataacccgagtacacagccgacaagcaccgtgaagaactctcccagaagcacacccggattcatactggacaccacttctaataaacagacgcctcagaaaaacaattataattccattgccgctatattaatcggagtgctcttgacctctatgctggtcgccattataataatagtactgtggaagtgtctgcgtaagccagtcttaaatgaccaaaactgggccggtagatccccattcgccgatggcgaaacccccgatatctgtatggataacattagagagaatgagattagcacaaaaagaacaagcattatcagcttgacaccctggaagccatccaagagcaccctgcttgctgacgacctcgagattaagcttttcgaatcatctgagaacatagaagattctaacaatccaaagaccgagaagatcaaggatcaggtgaatggaactagcgaagattccgcggacggttccaccgtggggacagccgtgtcgagcagcgacgacgccgatcttccgcctccccctcctttgctagatctggaggggcaggagtcaaatcagtccgacaaacccaccatgactattgtgtctcccctgcccaacgacagtacaagtttgccaccctcactggattgcctgaaccaggactgcggagaccacaagtccgaaatcattcagtctttccccccgctggactctctcaacctgcctcttccccccgtagatttcatgaaaaaccaggaagatagcaacttggagatccagtgtcaggaattctccattccccccaactcagatcaagatcttaatgaatccctgcccccacctccggcagagctgctatag

SEQ ID NO: 115465 - DNA, 1392 bp, Artificial Sequence
  Description of Artificial Sequence: Synthetic coding sequence
atgctcttccggtacgctgaaaagattacgaggaagtattctgagatggacccaaagtattttatcttgattcttttctgtggccatttgaacaacacatttttctccaaaactgaaaccataacaacggagaagcagtctcagccaaccctgttcacatccagcatgtcccaggtgctggcgaatagtcagaacacgacaggcaaccccctgggccagcctacacagttttcagatactttcagcggccagtctattagcccggccaaagtcaccgcaggacaacctacaccagcagtctacactagtagcgagaagcctgaggcacacacctctgctgggcagcccttggcatataataccaaacagcccactccaattgccaatacaagctctcagcaagcagttttcactagtgcacgtcagttacccagcgcacggacttctaccacccagccacccaagtccttcgtttacacattcacacaacagtcgagttcagtgcaaattccttcgagaaagcagataaccgtgcacaatccctcaactcaacctacttcaaccgtaaaaaactcaccacgatccacgcctggcttcattctcgataccactagcaataaacagactccacagaagaataattacaattccatcgcagccatcttgatcggagtgcttcttaccagcatgctcgtggctatcattataatagtgctctggaaatgcctaagaaaacccgtgcttaatgaccaaaattgggcaggccgctcgcccttcgccgacggcgaaacgcccgacatatgcatggacaatattagagagaacgagatttccaccaagcggactagcatcatcagtctgaccccctggaagccctccaagtccaccctgttggctgatgacctcgagatcaaacttttcgagagctccgaaaatatagaagacagcaacaatcccaaaacagaaaagatcaaagatcaggtgaacggtacgtctgaggactccgccgacggctccacagttggaacagccgtgtccagcagcgacgatgccgatctacctcccccccctcctttgttagatctggagggacaggaatctaatcaatccgacaaaccaacaatgaccatcgtgtctccactcccaaatgatagcacctctctgcctccatccttggactgcctgaaccaggactgtggagatcataaaagcgaaataatccagagtttccctccgttggatagtctgaacttaccattgcccccggtggacttcatgaaaaaccaggaggacagtaatttggagatccagtgccaggaattctccattcccccaaattctgatcaggacctgaacgagagcctcccacctcctcccgctgagttgttgtag

SEQ ID NO: 115466 - DNA, 924 bp, Artificial Sequence
  Description of Artificial Sequence: Synthetic coding sequence
atgaatcaagccgagctgatgcagttagacatggagggtatgcttcagcacttccagaaagtgattccccatcagttcgatggcgtccctgataaactgattcaggctgcctaccaggtgaagtacaattcgaagaagatgaaaaaactggagaaggaatacactacgataaaaactaaggagatggaagaacaagtggagatcaaacgactcaggacagaaaaccgccttctgaaacaacggattgaaactctggagaaagaaagcgcttccctggccgataggctcatacaagggcaggtgacccgggcccaggaggcagaagagaattacctaatcaaacgcgagttagctaccattaagcagcagtccgatgaggccagcgctaagctggaacaagctgagaacaccattagaaaattgcaacaccaacaacagtggcacaaatgtagcagtaactacaacgaggactttgtgctccagttggagaaggaactcgttcaagcacggctcagcgaggctgagtcccagtgtgccctgaaagaaatgcaggacaaagtgctagatatagagaagcgaaataatagtctgcccgacgaaaacaacatcgcccgtttgcaggaagagctgattgccgtgaagctgcgggaggccgaagcaattatgggtttgaaggaactcagacagcaggtcaaggacctggaggagcactggcaacggcatctggctcgaacaaccggtagatggaaagatcctcccaagaagaatgctatgaatgagctccaggatgaactcatgaccatccgcctgcgcgaagcagaaacccaggccgaaatcagggagattaagcagaggatgatggagatggaaacacagagtggtacctgtggcccccttctaaagatcattttttttaatgcatag

SEQ ID NO: 115467 - DNA, 2433 bp, Artificial Sequence
  Description of Artificial Sequence: Synthetic coding sequence
atggttactaacaagatgactgccgcctttcgcaacccctccggtaaacaggtggccacagataaggtcgctgagaaactgagctcaactctgagttgggttaagaataccgtctcacacaccgtctcacagatggcaagccaggtcgcctcccctagtacttcactgcacaccaccagcagttcaaccaccctgtcaacccccgccctaagccccagcagtccatcccaactgagcccagacgacttggaattgctcgccaaactggaagagcagaacagactcctggagacagattcaaaatcgttaaggtccgtgaatgggagtagaaggaacagtggcagctctcttgtgtcttcatcttcagcctcctctaacttatcacacctggaagaggactcttggatcctgtggggaaggattgtgaacgagtgggaagatgtacgcaaaaagaaggaaaagcaggtaaaagaactggtccataaagggatcccccatcattttagggccatcgtatggcaattactgtgcagtgcccagtcgatgccaattaaggatcagtatagcgaattattaaagatgactagcccatgtgaaaaactgataaggcgtgatatcgcacgcacttaccctgagcataattttttcaaggaaaaggatagtctcggtcaagaagtcctatttaacgtgatgaaggcgtattcactggtagaccgggaggtgggctactgtcagggttccgcgttcattgttggcctgctgctgatgcagatgcctgaggaggaggctttttgtgtgtttgttaaactgatgcaggattatcggctgcgtgagttgttcaaaccatccatggctgagctagggttatgcatgtaccagtttgaatgcatgattcaggaacacctgcctgagctgttcgtacattttcaatctcaatcctttcacacctctatgtacgcttccagctggttcctcactatcttcctgacgactttcccactccctatcgccacacggatttttgatatcttcatgagtgagggactggagatcgtgttccgggtaggtcttgcactgcttcagatgaaccaggctgagctaatgcagttggacatggaagggatgctgcagcacttccagaaagtaattccccaccaattcgacggcgtcccagacaagctcatccaggcggcttatcaggtgaaatacaattctaagaagatgaagaagcttgagaaggagtatactacgatcaagaccaaggagatggaagagcaggtggaaattaaacgcctccgaaccgagaaccgcctgctgaaacaacgaatcgagactttggagaaacacaagtgttcctcaaactataatgaggacttcgtactacagctggagaaggagctggtccaggcccggctgagtgaagcagaatctcagtgcgcattgaaagagatgcaggataaagtgctggatatagaaaaaaggaacaacagcctgcccgacgaaaacaacatcgccaggctgcaggaagagctgatcgcagtgaagcttcgggaggctgaggcgatcatgggcctaaaagagctgcggcagcaggtgaaagatttagaggaacactggcagcggcatttagctcggaccaccggcagatggaaggacccccctaagaaaaacgccatgaacgagctgcaggacgagctgatgaccatcaggttgcgcgaggccgaaactcaagctgaaattcgagaaattaagcaaagaatgatggagatggaaactcagaaccagatcaactcgaaccatctgcgccgagctgaacaagaggtcatctccttacaagagaaggttcagtacctcagcgctcagaacaagggcttgctcacacagctgtcagaggctaagcgcaagcaggctgagattgaatgtaagaacaaggaagaggtgatggctgttcggttgagagaggccgatagcattgccgccgtagcagagctgcggcagcacatcgctgaactcgaaattcaaaaggaggaagggaaactgcagggtcagttaaacaaaagcgactctaatcaatacattggtgagcttaaagaccagatcgcagaactcaaccacgagctccggtgcttgaagggacagagaggcttctcaggccaacccccgtttgacggcatacacatcgtcaatcacttgatcggcgatgatgaatccttccatagttcagacgaagatttcatcgataattctctgcaggaaactggtgtaggctttccactccacggcaaaagtgggagcatgagcctcgatcctgccgtggccgatggctccgagagtgagaccgaggatagcgtgctggaaacacgcgagtcaaaccaggtcgtccaaaaggaaaggcctccacgaaggagggagagttactcgacaaccgtgtag

SEQ ID NO: 115468 - DNA, 2433 bp, Artificial Sequence
  Description of Artificial Sequence: Synthetic coding sequence
atggtgacaaacaaaatgaccgccgccttccggaatccatcagggaaacaagtagcgaccgataaagttgcagagaaattgtcatctaccctttcctgggtgaaaaatacggtgagccacaccgtctctcagatggcttcacaggtggcctccccgagcacatccctccatacgaccagtagcagcactaccctgagcacacccgctttgagtccctctagcccaagccagctgagccctgacgatttggaactgttagccaagttggaagaacagaatcgccttctggagactgacagtaagtctctccgttctgtgaacggctcaaggaggaactcaggttcctcgctggttagctcttctagcgcgtcaagtaacctgtctcacttagaagaggactcgtggattttgtgggggcggatagtgaatgagtgggaggatgtaagaaagaaaaaggaaaaacaggtgaaggagctggtccacaaggggatcccacatcacttccgcgccattgtgtggcagctgctgtgttctgcgcagagtatgcccattaaagatcagtacagcgaactgctgaagatgacttctccttgcgagaagctcattcggcgggatatagccagaacgtaccctgagcataacttttttaaggagaaagattcgctgggtcaggaagtgctgtttaatgtcatgaaggcttatagtctggtggatcgtgaagttggatattgtcagggatccgcatttatcgtaggactcctcctgatgcagatgcctgaggaggaggcattttgtgtgttcgtgaaacttatgcaggactataggctcagggagttgtttaaacccagtatggctgagttgggcttatgtatgtatcaattcgaatgtatgatccaggagcacctacctgagctgtttgtgcactttcaaagccagtctttccataccagtatgtatgccagcagttggtttctcaccatctttctgactacattccctcttccaatcgctacccggatcttcgacatatttatgagcgaagggttagaaatcgtgttccgagtaggattggctctgcttcaaatgaaccaagctgagctcatgcagctagacatggagggtatgttgcagcacttccaaaaagtgatccctcatcaatttgacggtgtgcccgataaactgatccaggccgcatatcaggtgaaatacaactctaagaaaatgaaaaagctggagaaggagtataccacaattaaaactaaggaaatggaagaacaagtggaaataaagcggctgaggactgaaaatcgacttctgaaacagaggatcgagactctggagaagcataagtgtagtagcaactataatgaggactttgttttacaattggagaaggagcttgtacaggccagacttagtgaggcagaatcccagtgcgccttaaaggaaatgcaggacaaggtgctggatatagaaaagcgcaataattcactgcctgatgagaacaacattgctaggttacaggaggagctaatagctgtcaaactgagggaggcggaagccatcatgggcctcaaggagctacggcaacaggtcaaggatctggaggaacactggcaacggcatctcgccaggactacaggccgatggaaggatccgccaaaaaagaatgcaatgaacgagctgcaggacgaactcatgacaatccgcctccgcgaagctgagacgcaggcggaaatccgggaaatcaagcagcgcatgatggagatggaaactcagaatcaaatcaattccaaccatctgcgtcgggctgaacaggaagtaatttcactgcaggagaaagtgcagtacctgagcgcacagaacaaaggtctgctaacccaactcagcgaggccaagagaaaacaggcagaaatagaatgtaagaataaagaagaagtgatggccgtgaggctccgagaggctgacagcattgccgcggtggcagaactccgacaacatatcgcagaacttgagattcagaaagaggaaggcaagctccagggccagttgaacaaatcagactctaaccaatatataggagaactgaaggaccagatcgcagagctgaaccacgaactgagatgcttaaaagggcaaagaggcttctctggacagcccccattcgatggaattcatatcgtgaatcacctcatcggagatgacgagagcttccacagcagcgacgaagacttcattgacaacagtcttcaggagacaggtgtcgggtttcccctgcacggtaaatccggatcaatgtctctggacccagccgttgccgacgggagtgagagcgagacagaggatagtgtgctggaaactagggaatccaaccaggtcgtgcaaaaggagagacctccgcggcggcgagagagttactcaactacagtctag

SEQ ID NO: 115469 - DNA, 2466 bp, Artificial Sequence
  Description of Artificial Sequence: Synthetic coding sequence
atggtgacaaataagatgactgctgcctttcgcaacccttccggaaagcaggtcgcaacagacaaggtcgccgagaagctgagttccaccctgtcttgggtcaagaatacagtctctcataccgtgagccagatggcaagccaagtggcctctcccagtaccagcctccacaccacatccagctccacaaccctcagcactcccgcactgtctccgagcagtccatcccagctgtcaccagacgatctcgagttgttggcaaaactggaagagcagaatagactgttggagacagattctaaatcccttcgatcggtgaatggctcccgcaggaatagcggcagcagcctggtaagttcctccagcgcctctagcaatctctcacacctggaagaagattcttggattctgtggggacgtatcgtcaacgaatgggaagatgtgagaaagaaaaaagaaaaacaagttaaagaattggttcacaaaggtatcccccaccactttcgagccattgtgtggcaacttctgtgctctgcccaaagcatgcccatcaaagaccagtatagcgagttgctgaagatgacaagcccctgtgaaaagctcatcagacgggacatcgcacgtacatatcccgagcataatttcttcaaggagaaggatagccttggtcaggaggtgttgttcaacgtaatgaaggcctatagcctcgttgaccgggaagtgggctactgtcagggtagcgctttcatcgtaggcttactcctgatgcaaatgcctgaagaagaagctttctgcgtgttcgtgaaattaatgcaggactaccgcctgcgggagctgttcaagccatctatggcagaactcggattgtgcatgtaccagtttgagtgcatgatccaggagcatctgcccgagctgttcgttcactttcaaagccagagttttcacacctccatgtatgcaagcagctggttccttacaatctttttaaccacatttccactgccaattgccacccggatcttcgatatttttatgtccgagggtctcgaaattgtgttcagggtggggctcgctcttctacagatgaatcaggccgaacttatgcagctggacatggagggcatgctgcagcatttccagaaagtcataccccaccagtttgatggagttcccgacaagctcatacaggccgcatatcaggtgaaatataatagtaagaaaatgaaaaaattggagaaggagtataccaccattaaaacgaaggagatggaggaacaggttgagatcaaacggctgaggacagagaacagacttctgaaacaacgaattgaaacgttggaaaaagagagcgccagcctcgccgatcgactaattcaacataagtgtagtagcaattataatgaagattttgtccttcagctggaaaaggagctggtgcaggcccgtctcagtgaggcggagtcgcagtgtgcactaaaggaaatgcaggacaaggttctcgatatcgagaaaagaaataattcccttccagatgagaacaacattgccagattgcaggaggagcttattgccgtcaagctccgggaggccgaagccatcatgggtttaaaggaactgaggcaacaagtgaaggacctcgaagagcactggcagagacatctagctagaacaactggccgctggaaagaccctccaaagaagaacgccatgaacgagctacaggatgagctaatgaccattaggttgagagaagctgagactcaggccgaaattagagaaatcaaacagagaatgatggaaatggagacccagaaccagataaattcaaaccatctaagaagggcagagcaagaagtgatcagtcttcaagagaaggtccaatacctttctgcccaaaacaaaggtttgctaactcagttaagtgaggctaagagaaagcaggctgagatcgaatgcaaaaataaagaggaggtgatggcggtgaggctgagagaggcagatagtattgcggcagtcgcggagcttcggcaacatattgccgaacttgagatccaaaaggaagaaggcaaacttcaaggccagctcaataaaagcgatagcaatcagtacattggagagctgaaagaccagatcgccgagctcaatcacgaactaaggtgtcttaaagggcagagagggttttccgggcagccccctttcgacggtattcacatagtgaaccacctgatcggggacgacgaatctttccatagctctgatgaggacttcatcgacaattcactgcaggagacaggagtcggttttcctctacacggaaaaagcgggagcatgtcgctggatcctgccgtcgccgatggctcagagagcgagaccgaagatagcgtacttgagaccagggaatccaaccaggtggttcagaaagagcggccccccagaagaagagagtcgtacagcacgactgtatag

SEQ ID NO: 115470 - DNA, 891 bp, Artificial Sequence
  Description of Artificial Sequence: Synthetic coding sequence
atgtcctgggtccaggccaccctgctggctcgcgggctttgccgggcttgggggggcacctgtggagccgcgctaaccgggacttctatctcgcaggtaccaaggcgcctcccacggggtctgcattgctctgctgcagcacattctagcgagcaatcgctcgtgccctcccctcctgagccccggcagaggccaactaaagcgctcgtacctttcgaagatttgttcggccaagcccctggcggtgagagggacaaggcttcctttctccaaactgtccaaaaatttgcagagcatagtgtaagaaaacgcggtcacatagactttatttatctggcgttgaggaagatgcgggaatatggggtcgagcgcgacctggccgtttacaatcagctgctcaatattttcccaaaggaggtgtttcggcctaggaacatcattcagagaattttcgtccattaccctcgacagcaggagtgcggcattgctgttctggaacagatggagaatcacggcgtgatgcccaacaaggagactgaatttctgttgatccagattttcggtagaaagtcatacccaatgctgaaactggtccggctaaaactgtggttcccccggttcatgaatgtcaatccttttccagtgcctcgggatctgccacaggaccccgtcgaacttgcgatgttcggtctaaggcatatggaaccagatctgtccgcgagggtgactatctaccaggttccacttcccaaagactctactggggcagcagatccaccccagccacacattgtgggaagcggcagagatgcaggaggcgtagagcctttgctgccggatgccgccggccctggggtgtgcgaggaatggctgggacagctgcgggtgtag

SEQ ID NO: 115471 - DNA, 1296 bp, Artificial Sequence
  Description of Artificial Sequence: Synthetic coding sequence
atgtcttgggtgcaagcgacactgctcgcccgcggactgtgccgtgcctggggcggaacatgcggagccgcactcactggaaccagcatctcccaggttccaagacgcctgccaagagggttgcactgtagtgctgcagctcactcttctgagcagtcattagtgccttctcctcccgaacctcgtcagcgcccgacgaaggccctggtgccttttgaagacttgttcgggcaggctcccggcggcgagagagataaagcaagctttctgcagacggtgcaaaagttcgcagagcacagtgtccgaaagcgggggcatatagatttcatatacctcgctctgcggaaaatgagggaatacggcgtggagagggaccttgctgtatacaaccagttgctcaatatatttccaaaagaagtgttcagacctaggaacattatccaacggatttttgtacactacccacgccaacaggaatgtggcattgcagtgctggaacaaatggagaaccacggggtcatgccaaacaaagaaacggagttcctgctcattcaaatcttcggtagaaagtcatatccaatgctgaaactggtgaggcttaagttgtggtttcctaggttcatgaacgtcaacccgttccccgtacccagggatcttccacaggatccggtcgaattagctatgtttggtcttaggcatatggaacccgacctgtccgctcgtgtcacaatttaccaagtacctttaccaaaggattctacaggggcggcggacccaccccaaccccatattgtgggtatccagtccccagaccagcaggctgcacttgcccgtcacaaccccgcccggcccgtttttgttgaaggcccattcagcctgtggctaagaaacaaatgcgtctattaccacatccttcgtgcggatcttttaccacctgaagagagggaggtggaggaaactcctgaggagtggaacctgtattacccaatgcagctggacctggaatacgtccgaagcgggtgggacaactatgagttcgacattaatgaggttgaggagggccctgtatttgctatgtgtatggctggggcacatgatcaagctacaatggctaagtggatccaagggctgcaagagaccaacccaacgctcgctcaaattccagtggtcttccgcctcgctggctcaactagagagcttcagaccagctccgcggggctcgaggagccaccgttgcctgaggatcaccaggaagaggatgataatctccagcgccaacaacagggacaatcttag

SEQ ID NO: 115472 - DNA, 654 bp, Artificial Sequence
  Description of Artificial Sequence: Synthetic coding sequence
atgtcttgggtgcaagctactctgctggctagaggtctgtgccgcgcctgggggggaacatgcggtgccgccttgacaggtacctcgatttcgcaagtgcctctcccaaaggattctactggagcagctgatccgccccagcctcacatcgttggtattcagtcccccgaccagcaggccgccttggcccggcataatcccgctcgaccagtattcgtggagggccccttctctctgtggctacgcaacaaatgcgtgtattaccacatactgcgagccgaccttctccccccagaggaacgagaggtggaggagactcccgaggaatggaatctgtactaccccatgcagctggacctagaatacgttagatccgggtgggacaactacgagtttgacattaacgaagtggaagaggggcccgtgtttgccatgtgcatggctggcgcacacgaccaggccacaatggctaagtggattcaaggccttcaggagaccaacccgaccctcgcccagatcccggtagtgtttcgcctggcaggcagtacacgagagctacagactagttccgcagggcttgaagagccaccacttccggaagatcaccaggaggaggatgacaatctccagcgtcagcagcagggccaatcatag

SEQ ID NO: 115473 - DNA, 891 bp, Artificial Sequence
  Description of Artificial Sequence: Synthetic coding sequence
atgtcatgggtccaggcgactttgctcgccaggggcctatgtagggcctggggcggcacttgcggagccgccttaaccgggacatcaatctcacaagtaccccgacgtctgccgagaggactgcactgttcagcagccgcccattcctcagaacagtcccttgtcccctctccaccagaacccaggcaacggcctaccaaagcattggtcccatttgaggatctcttcggccaggctccaggcggagaacgcgataaggctagcttcctgcaaaccgtgcaaaagtttgcagagcacagtgtccgcaaaaggggccatatagattttatatacctggctctgaggaagatgagagaatatggcgtggaacgggacctcgccgtctacaatcagcttttaaacattttcccaaaggaagtttttaggccccggaatataattcaacggattttcgtgcactatccgcgtcagcaggaatgtggaattgctgtcctggaacaaatggaaaaccatggcgtcatgcctaataaagaaactgagttcctactcatacagatttttggacgtaaaagctatcccatgttgaagctggtacgcctgaaactgtggttcccccgcttcatgaacgtgaacccttttcctgtgcctagggacctgccccaggatccggttgaactcgccatgttcggcctgcggcatatggaacccgacctgtctgctagagtgaccatctaccaggtgcctctcccgaaggactcgacaggggccgctgacccaccccagccgcacattgtggaactgacatgctgtccccgaagaagaggaaagtggaagcggaggcggcgcagcggaacttccacaacccggtgcagttggacatggtctatgtag

SEQ ID NO: 115474 - DNA, 1770 bp, Artificial Sequence
  Description of Artificial Sequence: Synthetic coding sequence
atgagcgtgagtgtacacgagaacagaaagagcagggcctcaagcggcagcatcaacatctacttattccataaatccagttatgcagacagcgtgctgacccacttgaaccttctccgtcaacaaaggctgtttactgacgtgctgctccacgccggcaataggacattcccttgccaccgagcggtgctggccgcctgcagccgttattttgaagcgatgttttcagggggattaaaagaatcacaggacagcgaagttaatttcgataactcaatacatccagaggtcttggaacttctgctagactatgcatatagctctcgtgttattataaacgaagaaaacgccgagagtctgctggaggctggcgacatgttggaattccaagacatccgggacgcatgtgccgaattcctggagaagaatctgcatcccaccaattgcctgggcatgctgctgttgagcgatgctcaccagtgcacaaagctgtacgagctgtcttggcggatgtgcctcagcaacttccagacgatccgaaaaaatgaggatttcttgcagctcccccaggacatggtggtccagctcctgtcttccgaggagctggagactgaagatgaacgtcttgtctatgagagcgcgattaattggatctcttacgatctgaaaaagcgttactgctacctgcccgagctgctgcagaccgtccggctcgctttgctgcctgcaatctatctgatggaaaacgtagccatggaagagctgataaccaaacagcgcaaatcgaaagagattgtggaggaggccatcagatgtaagcttaagatcttgcagaatgacggggtggtaacgtctctgtgtgcaagaccccggaaaacaggccatgctctattcctcttgggggggcagacattcatgtgtgataagctgtacctggttgatcagaaagccaaggagattatacccaaagccgacattccctcgccacgaaaagaattctctgcatgcgccatcgggtgtaaggtgtacatcactggaggccgcggtagcgaaaacggggtgtctaaggatgtgtgggtgtacgatacactgcacgaagaatggtccaaggctgctcccatgctggtggctcgctttggccacggttctgctgagttaaagcactgcctgtacgtcgtaggagggcataccgccgcaacagggtgcctgcccgcgtccccctctgtatcactaaagcaggtcgagcactacgatcccaccattaacaaatggacaatggtcgccccactcagagagggcgtatccaacgcggcagtggtctctgccaaactcaagctcttcgcgttcggggggacctcagtgtcccatgacaaactgcccaaggtccaatgttatgaccaatgcgaaaacagatggaccgtgcccgccacatgccctcagccttggaggtacaccgccgctgccgtgttaggcaatcagattttcattatgggtggagacactgagttttctgcatgctccgcctacaaatttaatagcgagacctatcaatggactaaggtgggggacgtcaccgccaagagaatgagctgccatgctgtggctagtggtaataaactgtacgtcgtagggggttattttggaattcaaaggtgcaagactctggattgctacgacccgaccctcgacgtttggaacagcattacaactgtgccttatagcttgatccctaccgctttcgtttccacctggaagcatttaccctcctag

SEQ ID NO: 115475 - DNA, 153 bp, Artificial Sequence
  Description of Artificial Sequence: Synthetic coding sequence
atgtccgtgagtgtccacgagaatcggaaatcaagggccagctccggcagcattaacatttatcttttccataaatctagctacgccgacagcgttctcacccatcttaatcttctgaggcaacagagattgtttacagacgtcctgctgtag

SEQ ID NO: 115476 - DNA, 15 bp, Artificial Sequence
  Description of Artificial Sequence: Synthetic coding sequence
atgtccgtctcttag

SEQ ID NO: 115477 - DNA, 1770 bp, Artificial Sequence
  Description of Artificial Sequence: Synthetic coding sequence
atgtccgtatctgtgcacgagaatcgcaagagcagagcatcctccggtagtattaatatctatttgtttcacaaatcaagttacgcggattccgtccttacccacctcaacttactaagacagcagaggttgttcacagacgtactgctgcatgcgggaaaccggaccttcccgtgccatagagcggtgctagcagcgtgctcccggtactttgaggccatgtttagcggcggcttaaaggagagccaggactccgaggtgaactttgataatagtatccatcctgaggtcctcgaactgctcttggattatgcatacagcagtcgtgtgatcataaatgaggaaaacgccgagtctttgctggaggctggagatatgctggaattccaagacatcagggacgcatgcgcggagttcttagagaagaacctgcaccctactaattgcctcggcatgctcttgctcagcgacgcgcaccaatgcaccaaattgtatgagttatcctggagaatgtgtctgagcaattttcaaaccatccgtaaaaacgaagacttcctgcaactcccccaggacatggttgtacagttattatcttccgaggagctggagacggaagacgagcgtctggtgtatgaaagcgcaatcaactggatatcctacgacctgaagaagaggtactgctatctgcccgagctgctccagacagtgcgactggcgcttctgcctgccatttacttgatggaaaatgtcgctatggaagaactgatcacaaagcagcgcaagtcgaaggaaatcgtcgaagaagccatccgatgcaaactgaaaatcctccagaacgacggggtcgtaacgtcactgtgcgcacggccccggaagaccggacacgccctcttcttgctagggggccagacttttatgtgtgataaattgtacctggttgatcagaaagccaaggaaattatcccaaaagctgatattcctagtccacgaaaagagttctccgcctgtgcaatcgggtgtaaggtgtatatcaccggcggccggggctctgagaatggggtatctaaggacgtatgggtttacgataccctgcacgaagagtggagtaaagcagcaccaatgctggtggcccgattcggccacggtagcgccgaactcaaacattgcctgtatgtcgtcggcggccacacagccgccactggctgcctgcccgcctccccatcagtctctctaaaacaggttgagcactatgacccaacaataaataagtggacgatggtcgcccctttacgcgagggggtgtctaacgccgctgtggtgtccgccaagttaaaacttttcgccttcggagggacctccgtaagccatgataaattgcctaaagttcagtgttatgatcagtgcgaaaatcgatggacggtccccgcgacatgtcctcagccctggcggtataccgctgccgcagtgctgggtaatcagatctttattatggggggcgatacagagttcagcgcatgcagtgcatacaaattcaatagcgagacctaccagtggaccaaggtcggtgatgtaacggccaaacggatgtcgtgtcacgccgtggctagtggcaacaaattgtacgtggtcggcggttatttcgggatacagcgctgcaaaaccctcgattgttatgaccccacacttgatgtgtggaacagcataacaacagtgccatattctcttatccccacagccttcgtctccacctggaagcacctcccttcgtag

SEQ ID NO: 115478 - DNA, 1551 bp, Artificial Sequence
  Description of Artificial Sequence: Synthetic coding sequence
atgttcagcggaggcctgaaggagagccaggactctgaagtaaactttgacaatagcattcatcctgaggtcctggagcttctgctggattacgcttatagctcccgggttatcattaacgaagagaacgcggaaagtttgcttgaggctggagacatgctggaattccaggatatcagagatgcttgtgccgaatttctggaaaaaaaccttcaccctacaaattgtctgggcatgctcctcctctctgatgcgcatcagtgtacaaagctgtacgagttgtcatggcggatgtgcctctctaacttccagactattcggaaaaatgaggatttccttcagctcccccaggacatggttgttcagcttcttagcagtgaggaactggagacggaagacgaacggcttgtatacgagtctgcaatcaattggatttcttatgacctcaagaagagatactgttacctgccagagttgctgcaaactgtccggctggctttactgccagcgatctacctgatggaaaacgtggcgatggaggagctgatcaccaagcagaggaagagtaaggaaatcgtggaagaggcgatcaggtgcaaattgaaaatccttcagaacgatggcgtggttacctccctctgtgctcggccaagaaagacaggacatgcactgtttctccttggggggcagactttcatgtgcgataaattgtacctggtcgaccagaaagccaaggaaattataccaaaggcagacatcccaagcccgcggaaggaattttccgcttgcgctatcggctgcaaagtgtacatcaccggaggcagggggagtgagaatggcgtatccaaagacgtatgggtgtacgatacgttacacgaagaatggtcaaaggccgcacctatgctggtggccaggttcgggcatgggtccgcagagctgaagcactgtttatatgtggtgggtggccataccgccgctaccggatgcctgcccgctagcccttccgtttcgctgaagcaagtcgagcactatgatcctactattaacaagtggaccatggttgcgcctctgcgcgagggagtctctaacgcggctgtggtgagcgccaaactaaaactattcgcctttggtgggacctccgtctcacacgataagctcccaaaagtgcaatgctatgaccagtgcgagaacaggtggaccgttccagccacctgcccccaaccttggcggtacaccgcggccgcggtgctgggaaaccagatttttattatgggaggcgatacggagttctccgcttgctccgcttataaatttaactccgaaacataccagtggaccaaggtgggagacgtcacggctaaaaggatgtcttgccatgccgttgcatctggaaacaagttgtatgtcgttggcggatatttcggaatacagcgctgcaagacgttggactgctacgatcctaccttggatgtgtggaactccatcaccacagtgccatatagcctcattcccaccgcctttgtctccacatggaagcacctgcccagttag

SEQ ID NO: 115479 - DNA, 1932 bp, Artificial Sequence
  Description of Artificial Sequence: Synthetic coding sequence
atggtggacgctggaggagtcgaaaatataacccaactgccccaagaactaccacagatgatggctgcagccgcagatgggcttggctccattgccatagacacaacccagctgaacatgtcagttacggaccccaccgcatgggccacagcgatgaataatttagggatggtgccagtgggactccccgggcaacagctggtgtcggactctatttgcgtacccggattcgatccctctcttaacatgatgacgggcatcacgccaataaacccaatgatccctgggctgggactagtaccccctccaccacctacagaggtcgctgtggtgaaagaaatcatacactgtaaaagctgtaccctgtttccccagaatcccaatttacctccaccctcaacccgcgagcggccaccagggtgcaagactgtgttcgtaggcgggctcccggagaacgcgacagaggagatcatccaggaagtttttgaacagtgcggggacatcactgccatcaggaaatctaaaaagaatttttgccatattaggttcgctgaagaattcatggtcgataaggccatttaccttagcggctaccgtatgagacttggttcatcaactgataagaaagattcgggtcgccttcatgtggactttgcccaggcccgtgacgatttctacgagtgggagtgtaagcagcggatgcgcgccagagaggaaaggcaccgccgtaaacttgaggaggacagacttcgtcccccttcccctcctgcaatcatgcactattctgaacatgaggccgcactattggccgagaagttgaaagacgactccaaattctctgaggctataaccgtgctgctatcatggatcgaacgtggggaggttaacaggcgcagtgcgaatcagttctatagtatggtgcagtccgccaattcccatgtgcgcagactgatgaatgaaaaggccacccatgaacaggaaatggaagaggcaaaggagaactttaagaatgcactgactggcatcctaacccaatttgagcagatcgtagctgtatttaacgcttccactcgtcagaaggcttgggaccatttttccaaggcccagaggaagaacattgatatctggaggaaacacagcgaagagcttcgcaatgcacagtcagagcaactgatggggatcagacgagaagaggagatggaaatgtccgacgacgaaaactgtgactctcccaccaagaagatgcgggtagatgagtcggccttggctgcccaggcctacgcgttaaaggaagaaaatgactccctgcgttggcagttggacgcataccggaatgaagtagaactcctgaaacaggaaaaggagcagctcttcagaacagaagaaaacttgacaaaggaccagcagctgcagtttctgcagcagactatgcaggggatgcaacaacagttgctgactatccaggaagagctcaataataaaaagtcagaactggaacaggctaaggaggaacagtcccatacccaggcacttctgaaggtcctgcaggaacaattgaaggggaccaaggagctggtggaaaccaacggacactcgcatgaggactccaacgaaatcaatgtccttacagttgccctggtaaatcaggatagggagaataacattgaaaaacggagtcaggggcttaaaagcgaaaaagaagctcttctcattggcattatcagtacttttctgcacgtgcatcccttcggagcaaatattgagtatctatggtcctatatgcagcagctcgattccaagattagcgcgaacgagatagagatgctactgatgagactccctcggatgtttaagcaggagttcacaggcgttggtgctaccctggaaaagagatggaagctgtgtgcttttgagggaatcaagactacatag

SEQ ID NO: 115480 - DNA, 1932 bp, Artificial Sequence
  Description of Artificial Sequence: Synthetic coding sequence
atggtggatgcgggtggcgtcgaaaatattacccaactgccccaggagcttccacagatgatggccgccgctgccgacggactgggtagtatcgctatcgacaccacacaattgaacatgtctgtgacagatccaactgcttgggccacagctatgaacaacctcgggatggtccccgttggcctgcccggccagcaactcgtctccgattctatttgcgtacccggctttgaccctagtctgaatatgatgacaggaatcactcccatcaaccctatgatccccggactggggctagtaccacctccaccccctacagaagtcgccgtggtgaaagagattatccactgcaagtcctgtaccctgttcccacagaatccaaacctccccccacccagcacccgagagcgtcctcctggatgcaagaccgtattcgtgggtggtctgcccgaaaatgccaccgaggagatcattcaggaggtgtttgagcagtgcggtgacatcacagctatccggaaatccaaaaagaacttttgccacattagattcgccgaggaattcatggtggataaagctatctatctcagcgggtacaggatgagattgggaagcagcaccgacaaaaaggattcaggccggcttcatgtggacttcgcccaagcgcgagacgatttttacgaatgggaatgtaaacagagaatgcgggcccgagaagaacggcaccggcggaagctcgaggaggatcgtctgcggcctcccagtccgcctgccattatgcactactccgaacacgaagccgccttgctggcggagaaactgaaggacgactcaaagttctccgaagccattactgtgctcctttcttggattgagaggggcgaagtcaataggcggtctgccaatcagttctacagcatggtccagagcgctaatagccatgtacgcaggctaatgaacgaaaaggccacgcatgagcaggagatggaagaagcgaaagaaaactttaagaacgctctgactggtatactcactcagttcgaacagatcgtggccgtctttaatgccagcacgcgacagaaagcctgggaccacttcagcaaggcccagagaaaaaacatcgatatctggcgaaaacacagcgaagagctgaggaacgcccagtccgagcagctcatgggaataaggcgggaagaggagatggagatgtccgatgacgagaactgtgatagtccaacaaagaagatgcgggtcgacgaatccgcactggccgcgcaagcttatgctctgaaagaggaaaacgactccctgcgatggcagctggatgcataccggaatgaggtggagctgctgaagcaggagaaggagcaactcttccggacagaagagaacctcacaaaagatcagcagttgcagttcctacagcagactatgcaggggatgcagcagcagctgctaaccatccaggaggagctgaataataaaaaaagcgagctcgagcaggccaaagaggagcagagccacactcaggccctattgaaggttttgcaggaacagctcaaaggaacaaaggagcttgtggagactaacggacattcccatgaggacagcaacgagatcaatgttctgacagtggctttagtcaaccaagaccgcgaaaacaatattgagaagcggagtcaagggttgaaatcagaaaaggaagcacttctgatcgggataatctctacatttttgcacgtgcatccttttggggccaacattgagtacctctggagctacatgcagcagttggatagcaagatcagtgccaacgaaattgaaatgctattaatgcggctgccacggatgttcaagcaagagttcactggcgtgggcgccaccctggaaaagagatggaaattgtgcgcttttgagggtatcaagacgacatag

SEQ ID NO: 115481 - DNA, 708 bp, Artificial Sequence
  Description of Artificial Sequence: Synthetic coding sequence
atggtggacaaggccatctacctgtctggatataggatgagactgggcagctctaccgacaagaaagacagcggacgacttcatgtagactttgctcaagccagagacgatttctacgaatgggagtgcaaacaacggatgcgtgctcgcgaagagaggcatcggcgcaagctagaagaggaccggctccgtcctcctagtcccccggccatcatgcactactccgagcatgaagcagccctcctggccgagaagctgaaggacgactcaaaattctcagaggccattaccgtcctgctaagctggatcgagaggggcgaggtaaatcgccgctctgcaaatcagttctactctatggttcagagcgccaatagccacgtccgcagactcatgaacgagaaagctactcacgagcaagaaatggaagaggcgaaagagaatttcaaaaacgccctgacggggattctgacccagtttgagcagattgttgcagttttcaatgcctctaccaggcagaaggcctgggaccatttctcaaaagcccagagaaagaacatcgatatatggaggaaacattccgaggagctgagaaacgctcaaagcgaacaactcatgggcatacggagggaggaggaaatggagatgtcagatgacgaaaactgcgatagtccaactaagaaaatgcgggtggatgagagcggggcatag

SEQ ID NO: 115482 - DNA, 1833 bp, Artificial Sequence
  Description of Artificial Sequence: Synthetic coding sequence
atgcagcgggacttccgctggctctgggtgtatgaaatcggctacgccgcagacaactcccggaccttaaatgttgatagtacggccatgacgctaccaatgtctgaccccacagcttgggccaccgcgatgaacaacctgggaatggcccccttgggtatcgccgggcagccaatattgcctgacttcgatccagcgctcggaatgatgaccggtatcccaccaattacccccatgatgcccggtctcggcattgtacctcctccaatccctccagatatgcccgtggtgaaggaaattattcactgcaaatcttgcaccttgtttcccccaaatcctaacttaccccctcctgccacccgggaaaggcctcccgggtgtaagactgtttttgtgggtggcttgcccgagaacggaactgaacagatcattgtggaagtgtttgagcagtgcggcgagattattgccatacgaaagtctaagaagaatttttgtcacatcagattcgccgaagagtatatggtcgataaagcgctatacctatctggttaccggatcagactgggctcatctaccgataaaaaagacacaggaaggcttcatgttgatttcgcccaagcccgtgatgatctgtacgagtgggaatgtaagcagaggatgttagcacgcgaagagagacataggaggcgcatggaagaggagcgtttgagaccaccaagtccccctccagtggtgcactacagcgatcacgagtgttccattgtggccgagaaattgaaggatgatagcaaattcagtgaagccgtgcagaccctactcacatggattgagagaggcgaagtgaacaggagatctgcgaataatttctacagcatgatccagagtgctaatagccacgtgaggcgcctagttaacgaaaaagcagctcacgagaaggacatggaggaggctaaagagaagttcaaacaggctctgagcggaatcctcattcagtttgagcagatcgtggcggtctatcacagtgccagcaaacagaaagcatgggatcacttcacgaaggctcaacgcaaaaatatatctgtgtggtgtaaacaggccgaggagattaggaatatccacaacgatgagcttatgggcattcggcgggaggaggagatggagatgagtgacgatgaaatcgaagagatgaccgagacaaaggaaacagaagagtccgcgctggtgagccaggcggaggccttgaaagaggagaacgacagcttgcggtggcagttggatgcctatcgcaatgaggtcgagctgctcaagcaggagcaggggaaggtgcatagggaagacgacccaaacaaagagcagcagctgaagctgctgcaacaggctctgcagggaatgcagcaacatttgttgaaggtccaggaagaatacaaaaagaaggaggccgagctggagaagctcaaggatgacaagttgcaggtcgagaagatgctcgaaaatctcaaggagaaagagtcttgtgcaagccggttgtgtgcttcaaatcaagactcagagtatcctttagagaagacgatgaacagttcccccatcaagagtgagagggaggccttgctggtgggtattatcagcacttttctgcacgtgcatcctttcggagcgagtattgaatacatctgctcgtacctgcaccggctcgacaacaagatttgcacctccgacgtcgagtgcttgatggggcggttacagcatacattcaagcaggaaatgaccggggtgggagcttcattggaaaagaggtggaaattttgcgggtttgagggcttgaagcttacatag

SEQ ID NO: 115483 - DNA, 1917 bp, Artificial Sequence
  Description of Artificial Sequence: Synthetic coding sequence
ttacctttcgacccggctaataataatgagccactccagttcgggtccgccagtggaccgctcgtaaccgaaggattaattgaaaatggtggagaatccagcaagaaaagaaagcggactaataccccctccgctgacaacagccgcacgcttaatgttgatagcactgccatgaccctccctatgagtgatcctaccgcctgggccacagctatgaacaatctgggcatggctccactgggcatcgcgggccaacccatcttgcctgactttgatcccgccctggggatgatgacgggcattccaccaattacccctatgatgcccgggttaggcattgttcctccccccatcccccccgatatgcctgtggtcaaagagattattcactgcaaaagttgcaccttgttccccccaaatcctaacctgcccccacccgccacccgagagcgcccccccggctgtaaaactgtgtttgtcggcggtctgccagagaacggaacagagcaaatcattgtagaagtgttcgagcagtgtggcgagatcatcgccatcaggaaaagtaagaagaatttttgtcatataagatttgcagaggaatacatggtggacaaagcgctatacctttctggatatcgaattagattgggctcctctaccgataagaaggacactggcaggctccacgtggactttgctcaggctagagacgatctgtatgaatgggagtgcaaacagaggatgctggcaagggaagaaagacaccggcggcggatggaggaggagaggttgaggcctcccagccctccaccagtcgtccactacagcgatcatgagtgctcaatcgtggccgagaaactgaaggacgactcaaaatttagtgaagccgtacagactctactgacctggatcgaacggggggaggtcaacaggaggtcggctaataacttttactcaatgatacagtccgccaactctcacgtgagaagactggtcaatgagaaagccgcgcatgaaaaggatatggaggaggcaaaggagaagttcaaacaggccttgtcaggaatcctaatccaatttgagcagatcgtggcagtataccactccgcatccaaacagaaagcctgggatcattttaccaaagcgcagcgaaagaatattagtgtgtggtgtaaacaagcagaagaaatacggaacatccacaacgacgaattaatgggaatcagacgtgaagaagagatggagatgtcagacgacgagatagaagagatgactgagactaaggaaacagaagagtccgctcttgtttcacaggcggaggccctgaaggaagagaacgactccctgcggtggcagctcgatgcttaccgcaacgaggttgaactgttgaagcaagagcagggcaaggtgcaccgcgaggacgatcctaataaggaacagcagttgaaactgctgcagcaggcattgcagggaatgcagcaacatctcctgaaggtgcaggaggagtacaaaaagaaggaggctgaactggagaagctgaaggatgataagcttcaggtagaaaagatgctggagaatctcaaggagaaggagagctgtgcaagtagactgtgtgccagtaatcaggactccgaatacccgctggagaagaccatgaacagtagcccaataaagagcgagcgcgaggcccttcttgtgggcatcataagcacctttttacatgtgcacccatttggagcgtccatcgaatacatttgctcttacctccatcgactggataataaaatttgcacgtctgacgtcgaatgcctgatgggacgattgcaacacacctttaaacaggaaatgactggggtgggggccagtttggaaaagaggtggaaattctgtggcttcgagggactcaagcttacttag

SEQ ID NO: 115484 - DNA, 1833 bp, Artificial Sequence
  Description of Artificial Sequence: Synthetic coding sequence
atgcaacgcgatttccgatggctatgggtctacgagattgggtatgctgccgataattccaggacactgaacgtggattcaacagccatgacacttcctatgtctgatcccacagcatgggccacagcaatgaataacttgggcatggcccccctgggcattgctgggcaacccatcctgccggatttcgatcctgccttaggaatgatgacagggattccccccatcacccctatgatgcccggcctgggtatcgtgccaccacccatccctcccgacatgcctgtggtgaaagagattatacactgcaaaagctgcaccctgtttccacctaatccaaacttgcccccccccgccaccagagagagacctcccgggtgcaaaaccgttttcgtgggagggctcccagagaatgggaccgagcagattattgtggaggtctttgaacagtgtggcgaaattatagcaatcaggaaatcaaagaaaaatttctgccacataaggtttgccgaagagtatatggtggataaagccctgtatctgtctgggtatcgcattcgcctgggatcaagtactgacaaaaaggatactggccgtttacatgttgatttcgcacaagccagggatgatttgtatgaatgggaatgcaaacagcgtatgttggcccgagaagagagacaccgtcggcggatggaagaagagaggctcaggcccccctccccaccaccagtggtgcactacagcgatcatgagtgtagcatcgttgccgagaagctgaaagacgattcaaaattttccgaggcggtgcagaccctactaacttggatcgaacggggcgaggtgaacaggcggagcgcaaacaacttttacagtatgatacagagcgcaaattcccatgtgagacgactggttaatgagaaagcagcacatgagaaggacatggaggaggctaaagagaaatttaagcaggcactctccggcatcctgatccagtttgagcagatcgttgccgtctaccattcagcatctaagcagaaggcatgggatcactttactaaagcccaaagaaagaatatttcagtgtggtgtaaacaagctgaagaaattcgcaacatccataatgacgaattgatggggataaggagagaagaggagatggaaatgagcgatgacgagattgaagaaatgacagagacaaaggaaactgaggaatctgcacttgtttcgcaggctgaggcactgaaggaagaaaatgactcacttcgttggcagctagatgcctataggaacgaagttgaactgctaaagcaagagcaggggaaggtgcacagagaggatgatccgaataaagagcaacagctcaagctgctacagcaggcattgcagggcatgcagcagcatctgctgaaggtccaggaggagtacaagaagaaagaggccgagctcgagaaactgaaggatgataaactccaggtggagaagatgctggagaacctcaaggagaaagaatcttgtgcgtcacgcctgtgcgcaagcaaccaggactccgaataccctctggagaagaccatgaactcttcacccataaagtctgagcgagaagctcttctggtcggtataataagcactttcctgcatgtacaccccttcggtgcttcaattgaatacatttgttcctacctgcataggctggacaataagatttgcacgtcagacgtggaatgcttgatggggcggctgcagcacacctttaagcaggagatgacaggagttggggccagtctggagaagcgatggaagttttgtggcttcgagggactgaaattgacctag

SEQ ID NO: 115485 - DNA, 1746 bp, Artificial Sequence
  Description of Artificial Sequence: Synthetic coding sequence
atgactctcccaatgtccgacccgactgcctgggctaccgctatgaataacctggggatggcaccactggggatcgcaggacagcccatcctgcccgatttcgatcccgctcttgggatgatgactgggatacctccaataacccccatgatgcccggtctgggtatcgtccctccccccatccccccagatatgccagtcgtcaaggaaatcattcattgtaaatcctgtaccctcttccctcccaaccctaatctccctccacctgccacccgcgagagaccccccggatgtaagaccgttttcgtcggcggccttccagaaaacggaaccgaacagatcattgtggaagtgtttgaacaatgcggcgagataattgccattaggaagtccaagaagaacttctgtcacattaggtttgcagaagaatatatggtggacaaagctctctacctctctgggtatcgtatccgactcggtagttcaacagataaaaaagatactggacggttgcatgtggacttcgctcaagcacgtgacgatctgtatgaatgggagtgcaagcaacggatgctggctagagaggaacgacaccggagacggatggaagaggagcgactccgccccccttcccctccccctgtcgtccactacagtgatcatgagtgttccatcgtggctgagaagctcaaggatgacagcaaattcagtgaggctgttcagactctcctcacctggatcgaacggggggaggtcaaccggcgatctgccaacaacttttattctatgatccagagcgctaactctcatgtgcggcgtctcgtgaacgaaaaagccgctcatgagaaagatatggaagaagccaaggaaaaatttaagcaggccctcagcggaattctcatccagttcgagcaaattgtggctgtgtatcattctgcaagtaagcagaaggcatgggatcactttacaaaggcacagaggaagaacatcagcgtatggtgcaaacaggctgaggagatccggaacattcacaacgacgagctcatggggatacggcgcgaggaagagatggaaatgagcgacgacgagatcgaggaaatgactgagactaaagaaacagaggagtcggcccttgtctcacaggccgaggcactcaaagaagagaatgactctttaaggtggcagctggatgcttataggaatgaggtcgaactcctcaaacaagagcagggcaaagtccaccgagaagatgaccccaataaagagcaacagttgaagttgcttcagcaggcactgcagggtatgcaacaacatctcctgaaagtgcaggaggaatacaagaagaaagaggctgagcttgagaaattaaaggatgataagcttcaggtggaaaagatgttagaaaacctgaaggaaaaagagagttgcgcctcccgcctctgcgccagtaaccaggattccgagtatcctctggaaaagaccatgaattcatcacctatcaagtcggagcgcgaagctctcctggtgggaattattagcacctttctgcacgtgcatccatttggggctagcatagagtacatctgcagctatctccaccgcctcgataacaagatttgtacatcagacgtagagtgcctgatgggtagacttcagcacacattcaaacaggagatgacaggtgtgggggcgagcctcgaaaagcgctggaaattttgcgggtttgagggactgaaactcacctag

SEQ ID NO: 115486 - DNA, 1746 bp, Artificial Sequence
  Description of Artificial Sequence: Synthetic coding sequence
atgacactccctatgagcgatcccacagcttgggctaccgccatgaataacctcgggatggcgcctctagggatcgctgggcagcccattctaccagactttgaccccgcattaggcatgatgaccggtatccctccgattacaccgatgatgcccggattaggtatcgttccaccgcccattcctcccgacatgccggtagtgaaggagataattcattgcaagagctgcacattgtttcctcccaaccctaacctcccccctccagccaccagggaacgaccaccgggctgcaagaccgtattcgtcggtggccttcctgaaaacggtaccgagcaaatcattgtggaagtgtttgagcagtgtggtgagatcatcgctatcagaaaatctaaaaaaaacttttgccatataagattcgctgaagagtacatggttgataaggcgctgtatctctccggataccgcatccgtttgggatcctccacggataagaaggataccgggagactgcatgtcgacttcgctcaggcaagagacgatctttacgaatgggagtgtaaacaacgaatgctggcccgggaggagaggcaccgtcggcgcatggaggaggagagattgcggcctccatctcctcctcccgtggtgcattacagcgaccacgaatgtagcattgtggctgagaagctaaaggatgacagcaaattctcggaggcagtgcaaactctcttgacatggattgagagaggcgaggtcaatcgtcgaagtgcgaataatttttattccatgattcagagcgccaacagtcatgttcggaggctggtaaatgaaaaggcagcacacgagaaggacatggaggaggccaaagaaaagttcaagcaggctctgtcaggcatccttattcagtttgaacagatagtagctgtttaccactcagcttctaaacagaaggcctgggatcattttactaaggcacagagaaaaaacattagtgtatggtgtaagcaggcggaagagatccgcaacatccacaatgatgagctgatgggcatacggcgagaggaagaaatggaaatgagcgacgacgaaattgaagaaatgactgagacaaaagagacggaggaaagcgccctcgtttcccaagccgaggcactcaaggaggagaacgattccctgagatggcagttggatgcgtatcgcaatgaggtcgagctgctcaagcaagagcagggcaaggtgcaccgcgaggacgatccaaataaggagcagcaacttaaactactgcagcaggcccttcagggcatgcagcagcaccttcttaaagtgcaggaggagtataagaagaaggaagccgaactggaaaaactcaaagacgacaagctacaggtggaaaagatgctggagaacctcaaagagaaggagagctgcgcctcgagactgtgcgcctccaaccaggactcagaatacccgcttgagaagactatgaactcatcccccatcaagagtgagcgggaggccctcctggtgggcatcatatcgacctttctgcacgtgcacccgtttggagcttcgatcgaatacatatgcagctatctgcaccgcctagataacaagatttgcacctcagatgtggaatgcctaatggggcggctgcagcacacctttaagcaagaaatgaccggtgtgggcgcaagtcttgagaagcggtggaaattctgtggcttcgaggggctgaagctcacatag

SEQ ID NO: 115487 - DNA, 1131 bp, Artificial Sequence
  Description of Artificial Sequence: Synthetic coding sequence
atgaccctcccgatgtccgaccctacagcctgggctaccgcaatgaataacctcgggatggctccattggggattgccggacagccgatcttgcccgattttgatccagctctcgggatgatgactggcattccccccattactccaatgatgcctggccttggcattgtgcctcctcccattcccccagatatgccagtagtcaaggagatcatccactgtaagtcctgtacactttttccacccaatcctaacctgcccccacccgcaacaagggagcgtccgcctggctgcaaaacagtattcgtgggcggcctccccgagaatggcaccgaacagattatagtggaggtgtttgagcagtgtggggagattattgccatccggaagagtaagaaaaacttttgtcatattaggttcgccgaggagtacatggtggacaaggccctctatctttccggttacaggatcagattgggctcaagcacggacaaaaaggatactggccggctccacgttgattttgcacaggccagggacgacctgtatgaatgggaatgcaaacagcgtatgctcgcccgcgaagaacggcaccgacggcggatggaagaggagaggctcagacccccgtctcctcctcctgtggtgcattatagtgatcacgagtgctctatcgtggccgaaaagcttaaggatgacagcaagttcagcgaagccgtgcaaacccttctgacatggatagagaggggcgaggtaaacaggagatccgcgaataacttctattcaatgattcagtctgcaaatagtcacgtacgacgcttagtgaacgaaaaagctgcccatgaaaaagacatggaggaagcaaaggaaaagttcaaacaggcgttgagcgggatactgatacaatttgaacagatcgttgccgtgtaccactcggcatccaagcagaaagcttgggaccacttcaccaaagctcaacgcaagaatatctcagtctggtgcaagcaagctgaagagattaggaacatccataacgatgagctcatgggaattagacgcgaagaagaaatggagatgtcggatgacgagatcgaggagatgactgagacaaaggaaaccgaggaaagttag

SEQ ID NO: 115488 - DNA, 1407 bp, Artificial Sequence
  Description of Artificial Sequence: Synthetic coding sequence
atgactcttcccatgagcgacccaactgcctgggcaactgcaatgaataacttagggatggctcccttgggcattgctggccaacccattcttccagatttcgaccccgccctaggcatgatgaccggcattccaccaatcaccccaatgatgccaggattggggattgttcctccccccattccacccgacatgccagtcgtcaaggagataattcattgcaaatcctgcaccctctttccacccaacccaaacctccctccaccggcaacccgggagcggccgcctggatgtaagacagtatttgtggggggactcccagagaatggcacagagcaaataattgtggaggtctttgaacaatgtggagaaattatagctatcagaaaaagcaagaagaacttttgtcacatccgttttgccgaggagtatatggtggacaaggccttatatctcagcggctacaggatcaggctgggctcttccaccgacaagaaagatactggcagactgcatgtggatttcgctcaggcccgagacgatctttacgaatgggagtgcaagcagcgcatgctcgcccgggaagaacgccaccggagacgcatggaggaggaaagattgcgtccgccctcccccccacccgtagtccactactccgatcatgaatgcagcatagtggctgaaaagttgaaggatgatagcaagttttctgaagctgtccagacgctgctgacctggatagagcgtggagaggttaaccgacggtccgccaacaacttttactccatgatccagagcgcgaactctcatgttaggcgactggttaatgagaaggcagcacatgaaaaagacatggaggaggcaaaagaaaagtttaagcaggccttgagcggaattctgatccaattcgagcagatcgtcgcagtttaccacagcgcatctaagcagaaggcatgggatcactttacaaaagcacaaagaaagaatattagtgtctggtgtaaacaggctgaagagataagaaacatacacaatgacgagctgatggggataagaagagaagaagaaatggaaatgagtgacgatgagattgaggaaatgactgagaccaaagaaactgaggaatcggccctcgtgtcacaggccgaggcactgaaagaagaaaacgattctctgaggtggcagttggacgcctatagaaacgaagtggaactgctgaagcaggagcagggaaaggtgcatcgggaggacgacccaaacaaggaacagcagctgaagcttttgcagcaggcacttcagggcatgcaacagcacttactgaaggtgcaggaggaatacaagaagaaggaggccgaactggaaaaactgaaggacgacaaattgcaagtggagaaaatgaaaaaatag

SEQ ID NO: 115489 - DNA, 1119 bp, Artificial Sequence
  Description of Artificial Sequence: Synthetic coding sequence
atggaatctgaagaactggcagatcgggttctcgatgtggtggagagatccctcagcaattatcccttcgattttcagggtgcccgcatcatcaccggccaagaagagggcgcctacgggtggatcaccataaattacctgctgggtaagttttctcagaagaccaggtggttttccattgtaccttacgaaaccaataaccaggagactttcggtgcccttgatctaggtggcgcctcgacccaggttacattcgtgccgcagaaccagactattgagagcccggacaatgcactccaatttcgactctacggtaaggattataatgtttacacccattcctttctgtgttatgggaaagaccaagccctgtggcagaaactggccaaggatattcaggtcgcatctaacgagatcctcagagacccctgcttccaccccggctacaaaaaagttgttaatgtcagcgatctgtataagacgccctgtactaagagattcgaaatgacactgcccttccagcagtttgagattcaggggataggtaactatcagcaatgccaccaatccatcctcgagctttttaacacgtcctactgcccctatagtcagtgtgcttttaatggcatcttccttccacctctgcagggggacttcggagctttcagcgcgttttacttcgtgatgaagttcttgaaccttacgagtgagaaggtatcacaggagaaagtgacggagatgatgaagaagttctgtgcccaaccctgggaggaaatcaagacctcttacgccggcgtcaaggaaaaatacttgtctgaatattgtttctctggcacctatattctgagcctgcttctccagggttaccattttaccgcagacagttgggagcatattcattttataggtaagatccagggctccgacgcagggtggacactggggtacatgttgaatctaaccaatatgattcccgctgagcagccactgtccacaccgctgtctcattcaacctacgtctttctgatggtactctttagcctcgttctgtttaccgtggctattatcgggctgctgatctttcacaagccaagctatttctggaaggatatggtatag

SEQ ID NO: 115490 - DNA, 1533 bp, Artificial Sequence
  Description of Artificial Sequence: Synthetic coding sequence
atggaagacaccaaagaatctaacgtgaaaaccttttgctcgaaaaatatattggcaatcctgggcttctcatcaattatcgcggtaatcgctctcctagccgttggccttacgcagaacaaggcgcttccagagaacgtgaagtacggcatcgttctcgacgccgggtcctctcacactagcttatatatctacaaatggccagctgagaaggagaacgacacaggcgtcgtgcaccaggttgaggagtgtcgcgtaaagggacctgggatctctaaatttgttcagaaggtgaacgaaattggtatttatctaaccgactgtatggaacgagcaagagaggtgatcccccggtcacagcaccaggaaacaccagtgtatctgggagcaacagcaggcatgcggcttttgagaatggagtccgaggagctcgcagaccgggtgctggatgtggtcgagcggtctctgagcaattatccttttgacttccaaggggcgagaataataacaggacaggaggagggcgcctatgggtggatcacgatcaactacctgctgggcaaattctcacagaagacgagatggttttcaattgttccttacgagaccaataatcaagagacatttggggctcttgacctgggtggcgcctctactcaggtgacttttgtgccgcagaaccagacaattgagagccctgacaacgcactccagttccggctgtacggaaaggattacaatgtgtacacgcacagctttctctgctacggcaaagaccaggctctttggcaaaagctagccaaggatatccaggtagcttccaatgagattctgagagacccttgtttccaccctggttataaaaaggtagtaaacgtgagcgatttgtacaagacaccatgtactaaacgcttcgagatgactctcccatttcagcaattcgagatccagggcattggtaattatcagcaatgtcaccagagtattctagaacttttcaacaccagctattgcccatattcacagtgtgcgtttaacgggatttttcttccgcccttacagggtgacttcggggcttttagtgccttctactttgtcatgaaatttctcaatctgacaagtgaaaaggtcagccaggaaaaagtgactgaaatgatgaaaaagttttgcgctcagccttgggaggagatcaagacctcctatgccggtgttaaagagaagtacctgtcggaatactgtttctcaggtacctacattctatctctgttgttacagggatatcacttcacagcagactcctgggagcacatccacttcataggtaagatccagggttcagatgctggctggacactcggctacatgttgaacctcacgaatatgattccagcggaacagcctctttctacaccactctcacattccacctacgtgttcctgatggtcctgttttccctggttctcttcactgtggcgattatcggactgcttatctttcataaaccttcctacttttggaaagatatggtatag

SEQ ID NO: 115491 - DNA, 921 bp, Artificial Sequence
  Description of Artificial Sequence: Synthetic coding sequence
atgaaggggactaaggatcttacttcccaacagaaggagtccaatgtcaagactttttgcagcaaaaacatactggccatcctggggtttagttcaataatcgcggtcattgctctgttggccgtcggactcacacagaacaaagccctgccggagaatgtgaaatacggcatagtcctggacgcaggaagcagccacaccagcttgtacatctacaagtggcctgccgagaaagagaatgacactggcgtggtgcatcaggtagaggagtgtagggtgaaaggacccggcattagtaagtttgtgcaaaaggtgaatgaaataggtatctacttgacagactgtatggagcgagctagggaggtcattccacggtcccagcaccaagagacgcctgtgtatctgggcgcaacggcaggtatgcgattgctcaggatggagtccgaggagctggcggatcgcgtcctcgacgttgttgagcggtctctctcgaattatccatttgatttccagggcgctcggatcatcaccggacaagaggagggcgcctacggatggatcacaattaactatttactgggcaaatttagccaaaagacccgttggtttagtatagtgccatacgagaccaacaatcaggaaacttttggtgcacttgacctcggcggcgctagcacccaggtgacgttcgttcctcagaaccagactatagagtcacctgacaatgcactgcagtttagattatatggtaaggattacaacgtgtacacacactctttcctgtgctacggaaaagatcaggcattatggcagaagttagccaaagacatacaggccagcataacccagtccaggccggctccctttacaagtgcccccccagcccccaccagctgttgctttctgttccagattcagtag

SEQ ID NO: 115492 - DNA, 1569 bp, Artificial Sequence
  Description of Artificial Sequence: Synthetic coding sequence
atgggccgagaagaactttttctgacctttagcttttccagcggattccaagagtccaacgtcaagactttctgtagtaagaacatccttgccatcctcgggttctccagcattatcgctgtgatagctctcctcgcagtgggactcacccaaaacaaggctcttccagaaaacgttaaatatgggatcgtgctagatgccggcagcagtcacacatctttgtatatctataagtggccggccgaaaaagaaaacgacacaggagtagttcatcaggtggaggaatgccgggtgaaaggaccaggcatatccaagttcgtgcagaaagtgaacgagatcggaatctacttaactgactgcatggaacgggctagggaagtgattccacgctcccagcaccaggaaacaccagtatatctcggggcaaccgctggcatgcgcctcctgagaatggagtctgaagagctggccgatcgggttctggacgtcgttgaaagaagtctgagcaattatccctttgactttcagggagcgcgcattataacaggtcaggaggagggagcttatggatggatcacgatcaactaccttctgggcaagttctcccaaaagacccggtggttttctatcgtcccatatgaaactaacaaccaggaaacctttggggccctcgatcttgggggagccagcacgcaggttacctttgtgccccagaaccaaaccatcgagtctccggataatgcgctgcaatttagattgtacgggaaggactataacgtttatacacattcttttctgtgctacggcaaggaccaggccttatggcagaagctggcaaaagatattcaggtcgcatctaatgagatcttgagggacccctgcttccaccccggatataaaaaagtggtcaatgtttccgacctttacaagactccatgcactaaacgcttcgaaatgactttgccgttccagcagttcgaaatccaaggcatcggaaactaccagcagtgtcaccagagtatcctggaattatttaatacttcatactgcccttacagccagtgtgctttcaacggcatcttcctccccccacttcagggtgactttggagccttttccgccttttactttgtgatgaagttcctgaacttgacatccgagaaggtaagtcaggaaaaagtgaccgagatgatgaaaaaattctgtgcgcagccatgggaagaaattaaaacatcatacgcaggggtcaaggagaaatatctcagcgaatactgtttcagcggtacgtatatcctgtcactcctgctgcaggggtatcacttcactgcagattcttgggagcacattcacttcattggaaaaatacaggggagtgatgccggctggaccctgggttacatgctcaatctcacaaatatgattcctgctgagcagccactctccactccactcagtcattctacttacgtgttcctgatggttctcttcagcttggtgctatttaccgtagcgatcattgggttgttgatctttcacaagccctcatatttctggaaagatatggtgtag

SEQ ID NO: 115493 - DNA, 1554 bp, Artificial Sequence
  Description of Artificial Sequence: Synthetic coding sequence
atgaaggggactaaggatctgacaagccaacagaaggagtccaatgttaagacattctgttcgaaaaacattctggcaattcttggcttctcgagcattattgcggtgatcgcattactcgcagtagggttgacccagaataaagcccttccagaaaacgtcaagtacggcatcgttctggatgccggtagttctcatacatcactatacatttataagtggccggccgagaaagagaatgacaccggcgtggtccaccaggtagaagagtgtcgcgtcaagggccccggaattagcaagttcgtgcaaaaagtgaacgaaattgggatatacttgacagattgcatggagagggccagagaagtcataccacgctcccagcaccaagaaacgcccgtttacctgggggctaccgctggaatgcggctgctgcggatggagtccgaagagctggccgacagagtcctcgacgtggtggagcgaagcctgtccaactatccttttgattttcagggcgcccgcatcatcaccggccaggaagagggtgcgtatggatggattacaatcaactacctcctcggtaaattctctcagaagactcgttggttcagtattgtgccttacgagactaataatcaagagacatttggcgcactagacctgggcggggcgtccacccaggtaacattcgttccgcagaaccagaccatcgaaagccccgataacgctttgcagttccgcctctacgggaaggactacaatgtctacacgcacagcttcctgtgttatggaaaagatcaagccctgtggcaaaaactggctaaagacatccaggtagccagtaatgagatcctacgtgatccttgtttccatccaggctataaaaaggtagttaacgtgagtgatctgtataaaacaccctgcacaaaaaggttcgagatgacattaccattccagcaattcgagatccaggggatcggaaactaccagcagtgtcaccaaagcatcttagagctctttaatacatcatattgcccctactcccaatgcgctttcaatggaatatttctccccccgctgcagggggatttcggggcgttctctgctttctattttgttatgaagtttctgaatctgaccagcgagaaggtgagccaggaaaaagtcacagagatgatgaaaaagttctgtgcgcagccttgggaggagataaaaacatcctatgcaggcgtcaaggaaaagtacctgtcagagtactgcttcagcgggacatacatcctttccctgttacttcaagggtaccattttaccgccgacagttgggaacacatccattttattggaaaaattcagggaagtgacgccggctggactctggggtatatgctcaacctgacgaacatgatccccgccgaacagccactgtccactcccctttcccattctacatatgtcttcctcatggttctgttctcactagttctgttcaccgtggccattattggcctgctcattttccataaaccgtcttacttctggaaagatatggtgtag

SEQ ID NO: 115494 - DNA, 1119 bp, Artificial Sequence
  Description of Artificial Sequence: Synthetic coding sequence
atggagagcgaagagctcgccgatagagtcctcgacgtggtcgaacgcagcctgagcaattatccctttgactttcaaggcgctcgcattatcaccgggcaggaagagggagcgtatggctggattactatcaactatctcctagggaaattctcacagaagaccaggtggttctcgattgtcccctacgaaaccaataatcaggaaacgttcggcgctttagatcttggcggcgcatctacacaagtgacgttcgtgccacagaatcaaaccatcgaatctccagataacgccttacagttcagactgtacgggaaagactacaatgtttacacacactcgttcctctgttacggaaaggatcaggccctatggcagaagctggcaaaggacattcaggtggcctcgaatgagatcctcagagacccctgcttccacccagggtacaagaaagtggtgaacgtgagcgatttgtacaagaccccttgcacaaaacgcttcgagatgacactaccattccagcagttcgaaatacagggaatcggtaattaccaacagtgccaccagtccattctggaactgttcaacacctcatactgcccttactcacaatgcgcgtttaatggaatctttctccccccactgcagggggattttggagctttctcagcattctactttgtgatgaagttcctgaatttgacctcagagaaagtgagccaggagaaagtgaccgagatgatgaagaaattctgtgctcaaccatgggaggagattaagacctcatatgctggcgtcaaagagaagtatctgtcggaatactgtttttccggcacttacatcctgagtttactgcttcaggggtatcacttcacagcagatagctgggagcatattcatttcatcggcaagatccaaggtagtgatgcgggatggactttgggatatatgcttaatctcactaatatgatccccgccgagcagcccctctctaccccattgtcccattcaacctatgtattcctcatggttctcttcagcctagtactgttcactgtggcgataattggattgctgatcttccacaagcctagttatttctggaaggatatggtctag

SEQ ID NO: 115495 - DNA, 1209 bp, Artificial Sequence
  Description of Artificial Sequence: Synthetic coding sequence
atggagcgggcaagagaagtcattcctcggtctcagcaccaagagacccccgtttatcttggcgccaccgccggcatgcggcttctcaggatggaaagcgaagagttggccgaccgcgttctggacgtggtcgaacgttcactgtctaactatccttttgattttcagggggccagaattatcacgggccaagaggagggcgcatatggctggattaccatcaactaccttttggggaaatttagtcagaaaaccaggtggttcagcattgtcccttacgagaccaacaaccaagaaacctttggagcactcgacctgggaggagcatccactcaagtgacgtttgttccccaaaaccagaccatagaaagtcctgataacgcattgcagttcaggctttatggcaaggactacaatgtctacacgcatagctttctatgctacggtaaggatcaggccctgtggcagaagctggcgaaggacatacaggttgcaagcaatgagatccttagagacccttgtttccatccgggctacaagaaggtggtgaacgtgagcgatctgtacaagacgccatgtacaaagaggttcgagatgactctaccatttcagcagtttgaaatacaaggcataggtaattaccaacagtgtcaccagtctattctggagttgttcaacaccagctactgtccttatagtcagtgtgcatttaatgggattttcctgccccctctgcagggggacttcggcgcatttagcgcgttttattttgtcatgaagttcttgaacctcacttcagagaaagtctcacaggaaaaggtgaccgaaatgatgaaaaaattttgcgcccagccctgggaagagattaagacgtcctatgcaggcgtaaaggagaaatatctcagcgagtactgcttcagtggcacttatattctcagcctcctgttacagggctaccatttcaccgctgattcctgggaacacattcactttatcggcaaaatacagggctcggatgcaggttggacattaggttacatgctgaaccttactaatatgatacccgccgagcaacctctttctactcctctctcgcattctacctacgttttcctcatggtgctcttctccctagtgctcttcaccgtggccatcattggactgctgatctttcataagccgtcgtacttctggaaggatatggtgtag

SEQ ID NO: 115496 - DNA, 1419 bp, Artificial Sequence
  Description of Artificial Sequence: Synthetic coding sequence
atggccggcaaagtgcgatctctcctgcctccactactgttggcagcggccgggcttgcagggcttcttctgttatgcgttcccactagagacgtgcgggagccacctgctctcaaatatggtatcgtactggatgcaggctcgtcacatacaagcatgtttatatacaagtggccagctgacaaggagaacgatacagggatcgtgggccaacactcttcctgcgacgtcccaggcgggggcatatcgagctacgctgataacccaagtggcgcatcccaatcattagtgggttgcctcgaacaggcccttcaagacgtaccaaaggagagacacgcggggacgcccctctacttgggcgcgactgcaggtatgaggctgctgaatctcacaaacccggaggccagcactagcgtgctgatggccgtgacccatacactgactcagtaccccttcgattttaggggagcacgaatattaagcggacaagaggagggagtcttcggctgggtgaccgccaactatcttttagagaattttattaagtatggttgggtaggacgctggtttcggcctcgtaaaggaaccctcggcgccatggacctaggaggcgcttcaacccagattacatttgaaacaacaagcccagcagaagatcgggcttccgaagtgcagctacatctgtacggtcagcactaccgggtgtatacacattcctttttatgttacggacgggaccaggtgctccagcggctgttagcctctgccctgcagactcacggatttcatccgtgttggcccaggggattctctacccaagtgctcctgggagacgtttaccaaagtccttgcacgatggcccagcgccctcaaaacttcaatagcagtgcaagggtctccctgtccggctcttctgacccccatctctgccgggacttggtgtcggggctcttctctttcagttcttgtcctttctccagatgtagttttaatggagtgtttcagcccccagtggccggaaattttgtggcgttctcggcattcttttataccgtggactttctgcgcacatcaatgggtctacctgtcgcaactctgcaacagctggaagcagcagctgtgaatgtgtgcaaccagacttgggcccagcagctgctctcacgggggtatggctttgacgaacgcgcgttcggcggagtgatatttcagaaaaaagctgcggacaccgccgttggatgggcgctgggctacatgctgaacttgacgaatctgatccccgccgaccctcccggcctccgaaagggcaccgatttctcttcttgggttgtgctactcctcctgttcgccagtgccctcctggctgccctcgttctcctacttcggcaggtgcattcagcaaagctgccctcaactatatag

SEQ ID NO: 115497 - DNA, 1488 bp, Artificial Sequence
  Description of Artificial Sequence: Synthetic coding sequence
atggccggaaaagtgcgctccttgttgccgccactactgctggccgctgccggactggcaggcctcctgctactctgtgtgcctaccagagacgtgagggagcccccagctctcaaatacgggatcgtgctggacgctggttccagccacaccagtatgttcatttacaagtggccggccgacaaggagaacgataccggcatagtgggacagcattcctcttgtgacgttccggggggcggtatctccagctatgcagataatcctagtggagcgtcccagagcctggtcggctgcttggagcaggccctccaggatgtccccaaggagcggcatgcaggcactccgctgtatctgggagctacggccggaatgcgcctgctgaacttgacaaaccctgaagcctcaacgagtgtcctgatggccgtaacccacacgctcacccaatatccttttgactttcgaggtgcccggattttgtccggacaggaggagggggttttcggctgggtgactgcgaattaccttctggagaattttattaagtacggttgggtgggccgttggttcagaccccgcaagggcaccctgggcgcaatggacctgggtggggcctcaacacagattacattcgaaaccaccagcccagccgaggacagagcatctgaggtccagctgcatctgtatggacaacactacagggtatacactcactcctttctctgctacggcagggatcaggttcttcagcgtttgctggcttctgcactgcagacacatggattccacccatgctggccgcgcggtttctccactcaggtgttgcttggtgacgtttatcaaagcccttgcacgatggcacaaagaccccaaaattttaacagctccgcccgggtttctcttagtggctcttcagatccacatctttgcagggacctggtctctggtctgttttctttctccagctgtccattttcgagatgttcattcaatggcgtctttcagccgccggtggctggaaacttcgtggccttttccgcctttttttataccgtggatttcctgcgtactagcatgggtctgccagttgccaccctgcaacagttagaggcagctgctgtcaatgtgtgtaaccagacgtgggctcaactgcaggcccgcgtgcctggtcaacgcgcccgactggccgactattgtgctggagctatgttcgtgcaacagctgttatcccgcggatacggattcgatgagcgagcatttggaggtgtgatcttccaaaagaaggctgcagacacagccgtaggttgggcattggggtacatgcttaacctgacgaacctaatccctgccgatccacctggcttacgaaaagggaccgatttctcctcgtgggtggtacttctattgctctttgcctcggccctgttggcggctctggtgctcctgctgcgacaggtgcacagtgctaaactccccagcaccatctag

SEQ ID NO: 115498 - DNA, 1590 bp, Artificial Sequence
  Description of Artificial Sequence: Synthetic coding sequence
atgttcacggtgctgacacgtcagccatgcgagcaagcaggtttgaaagcattataccggaccccgacaattatcgccctggttgtattacttgtgtcaatcgtggttttagtctccattacagtgatccagattcacaagcaggaggtgctcccacctggactgaagtacggaattgtgctcgatgctggaagcagcagaaccaccgtctatgtgtaccaatggccagctgagaaagagaacaacacaggcgttgtcagccagaccttcaaatgttcagtgaaggggagcggaatttcatcgtacggcaataacccgcaggacgtacctcgagccttcgaagaatgtatgcaaaaggttaaaggacaggttccaagccatcttcacgggagcactcctattcatctgggcgccacggcaggtatgaggctgcttagacttcaaaatgaaacagccgccaacgaggtgctggagtcaattcagagttatttcaaaagtcagccatttgatttccgtggggctcagataatttccggtcaggaggaaggggtttacggatggatcacagccaactacctcatgggcaatttcctagaaaagaatctgtggcacatgtgggtgcacccccatggcgtggagacaaccggcgcactggacttgggcggagcgtccacacagatctcttttgtggctggagagaagatggacttgaacacatccgatataatgcaggtaagcctgtatggctatgtttataccctgtacactcatagcttccaatgctacggccggaatgaggctgaaaagaaatttctggctatgctgctgcagaacagccccacaaaaaaccatttaacaaacccctgctatcctagggactactctatttccttcaccatgggtcatgtgtttgattctctttgcaccgtggaccagcgccctgaaagttataaccccaatgacgtgatcactttcgaaggtactggcgacccttccctgtgcaaagagaaagtggcatctatctttgactttaaggcgtgccacgaccaagaaacctgcagttttgacggcgtctaccagccaaagattaagggcccattcgtggcttttgctggcttctactatacagcatccgccctgaacttgagtgggtcttttagtcttgacacatttaactctagtacctggaatttctgcagtcagaactggtcacaactgcccctgctactgcctaagttcgacgaagtgtacgctcgctcttattgcttctctgccaactacatttatcacctgttcgtgaatggatataaatttaccgaggagacctggccacagatccactttgagaaggaagtggggaattcctccatcgcatggagtcttggctatatgttatcgctcaccaaccaaataccggctgagtcccctcttatcagactgcctatagagccacccgtctttgtaggtactttggccttcttcacggctgccgcgttactgtgtttggcctttctggcttacttgtgtagtgccacccggagaaaacgacactccgaacatgcctttgatcatgctgtggactcagattag

SEQ ID NO: 115499 - DNA, 1590 bp, Artificial Sequence
  Description of Artificial Sequence: Synthetic coding sequence
atgttcactgtgctgaccagacagccctgcgagcaggcggggctgaaggccctgtaccggaccccgactattatcgccctggtggtgttgttagtgtcaatagtagtgctggtcagtattaccgtaattcagatccacaaacaggaggtcttacctccgggcctgaagtacggtatcgtgctcgacgccggttcctcacgcacaacagtctatgtgtatcagtggcccgctgaaaaggaaaataataccggcgtcgtgtcacaaacttttaaatgctctgtgaaagggtctggtatcagcagctacggcaataacccacaagatgttcctcgcgcctttgaggaatgcatgcagaaggtcaagggccaagttccctcacacctacatggctccactcctatccatttgggtgctactgccggcatgcgattactcaggcttcagaacgagaccgccgccaacgaagtgcttgagtcaattcagtcctacttcaaatcacagccatttgacttcaggggtgcccagataatttctggacaggaagagggtgtatacggctggataactgccaattatctgatgggcaacttcctggagaagaacttgtggcatatgtgggttcacccacatggagttgagacaaccggggctttggacctcggcggggcgagcacgcagatctcctttgtcgccggggagaagatggacctgaacactagcgacattatgcaggtgagtctgtacggttacgtatataccctctacacgcattcttttcagtgttatggaaggaacgaagcagagaaaaaattcctggccatgctgcttcagaattccccgacgaagaatcatctaaccaacccctgttaccccagggattactcaatcagcttcactatgggccacgtcttcgattccctttgcactgtcgaccaacgaccggaatcttacaatccaaacgatgtcattacattcgaaggaactggtgatccctcactgtgcaaagaaaaagtggcatctatcttcgatttcaaagcttgccacgaccaagaaacttgttcctttgacggagtgtatcagccaaagattaagggcccgttcgtggcttttgcaggcttctactataccgccagtgcactaaacctctctggctctttttctctggacacctttaattcatcaacgtggaacttctgttctcaaaactggtctcagctccccttactgctgcccaaatttgatgaggtgtacgctagatcttattgtttttctgccaactatatctaccacctctttgtcaacggatacaagttcactgaggaaacctggccccagatccactttgagaaagaggtgggaaattcttccatcgcatggtctctcggctacatgctgtccctgaccaaccagatcccagccgagtcccctcttatacgcctcccgatcgagcccccagtttttgtaggcactctcgccttttttaccgctgccgctctcctgtgcctggccttccttgcgtacctttgttcagcaacccggaggaaacgtcatagcgagcatgcgttcgatcacgcagttgacagcgactag

SEQ ID NO: 115500 - DNA, 1287 bp, Artificial Sequence
  Description of Artificial Sequence: Synthetic coding sequence
atggctacctcctggggtactgtattcttcatgttagtcgtcagttgtgtctgcagcgcggtcagccaccggaatcagcagacctggtttgagggcatctttctatccagtatgtgccccatcaacgtgtccgctagcactttgtatggtatcatgtttgacgcaggctctaccggaacacgcattcacgtgtacaccttcgtgcaaaaaatgcccggccaactgcctatcctcgagggagaggtttttgacagcgtgaaacccgggctaagtgcctttgtggatcagccgaagcagggagctgagactgtccaaggtctgcttgaggtggcgaaagactcaattccccggtctcattggaagaaaacacccgttgtgctaaaagctacagctggtctgcggctcctaccagaacataaggccaaggctcttttattcgaggtcaaggaaattttcagaaaatcaccgtttcttgtccctaaaggatcggtttccataatggatggctcggacgagggaattctagcttgggtcactgtcaacttcctcactggacagctgcatgggcaccggcaggaaaccgtcggcaccctggacctcggcggcgcttccacccaaatcacatttctacctcagttcgaaaagaccctggaacagactccacggggttatctaacctcttttgagatgtttaatagcacttataaactctacacccacagctatctgggatttggtctgaaagctgccagactggccacactaggagcacttgagaccgagggaaccgacggccacacctttcgctcagcgtgcctgcctcgttggcttgaggccgagtggattttcggcggggtaaagtaccagtacggcggaaaccaggagggtgaggtcgggtttgagccctgttacgctgaggtcttaagagtggtgaggggcaaactacaccagcccgaggaggtccaacgggggagtttttatgccttctcttattattatgatcgtgccgtggatactgacatgatcgactatgaaaagggaggaatactgaaagtcgaagatttcgagcgcaaagcccgggaagtttgcgacaacctagagaacttcacctcgggttcccctttcctctgcatggacttgagctatatcactgcacttttgaaagatggattcgggtttgcggactctactgtgttgcagctgaccaaaaaagtgaacaacatcgaaactggttgggccttaggcgcaacctttcacttgctgcaatccctgggcatttcccactag

SEQ ID NO: 115501 - DNA, 1404 bp, Artificial Sequence
  Description of Artificial Sequence: Synthetic coding sequence
atgcaacctcagcacgggccctggcaaacgcgcatgagaaagatctctaaccatgggtccctccgagtcgcaaaggtcgcatatccactgggcctctgcgtgggcgtgtttatatacgtggcttatatcaagtggcaccgcgccacagccacccaggcatttttttctataacacgagcggcgccgggtgctcgttggggacagcaggcccactcccccctcggcacggctgcagacggacatgaagtgttttatggcataatgtttgatgctggctcgacaggcacacgggtgcatgtcttccagttcactaggccccccagagagacccctacgctgacccacgagaccttcaaggcactgaagccgggcctgagcgcatatgccgatgatgttgagaaatcagcgcagggaatacgtgagctgctggacgtggctaagcaggacatcccatttgatttttggaaagccactccgttagttctgaaagcgacagccgggttaaggttacttccaggggagaaggcccaaaaacttctgcaaaaggtgaaaaaggtttttaaggcttccccttttctggtgggtgacgactgtgttagcatcatgaatggtacggacgaaggggtttccgcttggattactataaactttctgacaggatccctgaagacgcctggtgggtccagtgttggcatgctcgatctgggtggcggatcaactcagatcgcgttcctgccgagagtggaaggaaccttacaggctagtcctccaggttacttgaccgccttgaggatgttcaatcgcacttataagctctattcttatagttacctcggactgggactgatgtctgctcgactggccatcttgggaggggtagaaggccagcccgccaaggacggaaaggagctagttagcccatgcctatcccctagtttcaaaggcgaatgggagcacgccgaagtcacctatcgtgtgtcaggacaaaaggctgcagcatccttacacgagctctgtgcagccagagtttccgaagtcctccaaaaccgagtccatagaactgaagaggtcaagcacgtggacttttatgctttttcatattattacgacctggctgcaggggtggggctcatagacgccgagaaaggtggctcattggtggttggagactttgaaattgccgcaaagtacgtgtgccggactcttgagacccaacctcagtctagcccgttctcttgtatggatctgacctacgttagcctcttgctccaggaattcgggttcccgcgttccaaggtgctcaaactaactaggaagatagacaatgtagaaacctcctgggccctgggagctatctttcactacatcgatagccttaacagacagaagagccctgcgtcgtag

SEQ ID NO: 115502 - DNA, 1452 bp, Artificial Sequence
  Description of Artificial Sequence: Synthetic coding sequence
atgaagaagggaatcagatacgaaaccagcaggaagacatcttacattttccagccccaacacggaccttggcagaccagaatgagaaagatttcaaatcacgggtcattgcgagtggccaaggtcgcgtaccccctaggattgtgcgttggagtgtttatctatgtcgcctacataaagtggcacagagctaccgccacacaggcttttttctcaatcacccgcgccgcccctggagcaagatggggtcagcaggcacacagtcccctggggacagcagccgacgggcacgaggtcttctacggcatcatgttcgatgcggggagcactggaactcgtgtgcacgtgttccagtttaccagaccccctcgggagacgcctactttgacccacgaaaccttcaaagcactgaagcccgggctgagcgcttacgccgatgacgtcgaaaagtccgcccagggaattagagaattgttggacgttgcaaagcaggatataccatttgacttttggaaggctacaccactggtgctcaaagccacagccggactgagactcctgcctggagagaaggctcagaagttactccagaaggttaagaaggtcttcaaagcttcaccattcttggtcggcgatgactgtgtgtcaattatgaacggaaccgacgaaggcgtgtctgcctggattaccattaattttttgacaggttcccttaaaacccccggcggtagctccgtgggcatgctagatctcggcgggggtagcacacagattgctttcctgccaagagtggaagggaccctgcaggcctctcctccggggtacctgacggccttgcggatgtttaaccgcacctacaagttgtacagttatagttacttgggactgggtctgatgtccgcgaggctggccatactggggggggtggaaggacaaccggctaaggacggcaaagagctggtgtccccctgtctgtctcccagcttcaagggcgaatgggagcatgccgaggtgacctatagggtgagcggtcagaaagctgctgcatctctgcatgagctttgtgccgcccgggtgtctgaggtactgcagaaccgcgtgcatagaaccgaagaggttaagcacgtggacttttatgcgttttcttattactacgaccttgccgcaggcgtgggactgattgacgcagagaaaggaggtagcctggtggtgggggattttgagattgctgccaagtatgtctgccgcaccctggagactcaacctcagagttctcccttctcctgtatggatctgacctacgtctcccttctactgcaagagttcggatttccaagaagtaaggtgcttaagctgactcgtaaaatcgacaacgtggagacttcctgggccctcggtgccatatttcactatattgatagccttaaccgccaaaaatcacctgcctcctag

SEQ ID NO: 115503 - DNA, 1104 bp, Artificial Sequence
  Description of Artificial Sequence: Synthetic coding sequence
atgttcgatgcaggctccacaggcacccgggtgcatgtgtttcagttcacccgcccccctcgcgagacacccactctcacacatgagacttttaaggctctaaaaccaggcctctcggcttacgcggacgacgttgaaaaatccgcacagggtataagagagctccttgatgtggccaagcaggacattccttttgacttctggaaggctacgcccttggttctgaaggccaccgcgggcctgagactgctcccaggcgagaaagcccaaaagttattacagaaagtcaagaaagtgttcaaagcatcaccttttctcgtgggagatgactgcgtctcgattatgaatggaaccgacgaaggagtctccgcctggataaccataaacttccttactggaagcctaaagacccctggtggcagctccgttggcatgctggatctgggtggaggaagtacccagattgcttttcttcctagagtagaggggacacttcaggcctcccccccgggatacctgacggccctccgcatgtttaataggacctataaactttactcctacagctacctggggctggggctgatgtctgctcgcttggccatcctgggcggagtggaaggacaaccagccaaggacggcaaagagttagtgtcaccctgtcttagcccatctttcaagggcgaatgggagcatgcagaggttacttatcgggtttcaggccagaaagctgctgcttccctgcacgagttatgtgccgcgcgcgtcagtgaggtactgcagaacagggttcatcggactgaggaagtgaaacacgttgatttctatgccttctcgtactattatgacttggccgccggggtgggcctcattgatgccgaaaaaggcggctctctagtcgtgggtgactttgaaattgctgcaaagtatggaggtagccacctcgagagggaggggacctgtcttataccttctgtgagcgacccaggggataccgctgcagaacagccactgctgatgcacggaccacaccttaggcaaccagccacccctggagtgagactctctcaggagcagagcgctgaagctcactccgagaactag

SEQ ID NO: 115504 - DNA, 1455 bp, Artificial Sequence
  Description of Artificial Sequence: Synthetic coding sequence
atgaaaaagggcatccgatacgaaacttccagaaaaacgtcttacatcttccagcagccccaacacgggccatggcagacaaggatgagaaaaatctcaaatcacggcagtttgagggtggctaaggttgcttaccccctgggcctgtgcgtgggagtgtttatatatgtcgcttacatcaaatggcatagggccaccgccacgcaggcgttctttagtatcacccgggccgctcctggagcccggtgggggcagcaggctcacagtccgctcgggactgccgcggacggccacgaggtgttctacggaataatgtttgacgcggggtccaccggaacccgtgtgcacgtgttccagtttacccgcccacctcgggagacgcccacgctcacacatgagacctttaaggctctcaagcctggcttaagcgcatacgccgacgatgtggagaagagcgcccagggcatcagggagctgctagacgtggccaaacaggatataccttttgatttttggaaagcgaccccactcgtgctgaaggcgactgccggactcaggttactgccgggcgagaaagcccaaaaacttctgcagaaagtgaagaaagtgtttaaggcttccccatttctagtcggcgatgactgtgtctccattatgaacgggactgacgaaggagtgagtgcctggataaccataaattttcttaccggctctctgaaaactcctggcggtagctctgtgggtatgctggatctgggcggtggcagcacacagatagcctttctgccccgcgtcgaaggcacgcttcaggcaagtccgccaggctacctgacggcattgcgtatgtttaatcgaacatataagctttatagttacagttatctgggtctcggactcatgtccgccagactggccatcttggggggggtggaaggacaacctgccaaagacggtaaggaacttgtaagtccctgtctgagccctagcttcaagggggaatgggagcatgctgaagtcacctatagggtcagcggccagaaagccgctgcttccctgcacgaattgtgtgcagcccgagtgtcagaagttctgcaaaacagagtgcacaggactgaggaagtgaagcatgtggatttctatgcatttagctattactatgacctggctgcaggtgtaggcctgatcgacgccgaaaaaggcggaagtctcgtcgttggcgattttgaaattgctgccaaatatgtatgtaggactttggaaacacaaccccagagctcaccctttagctgcatggacctaacgtacgtgtcgttactgctgcaagaattcggctttccacgcagcaaggtcctgaagctgacccgcaagattgataacgttgaaacctcctgggctctgggagccatctttcattacatagacagtttaaaccgacagaagagtccagcatcctag

SEQ ID NO: 115505 - DNA, 888 bp, Artificial Sequence
  Description of Artificial Sequence: Synthetic coding sequence
tgagtcctgaaggcaacggccggcctgcgactcctacctggggaaaaggcccagaagctattgcaaaaggtaaagaaggtgttcaaggccagtccattcctggttggtgatgactgtgtgagtatcatgaatggaactgatgaaggagtctctgcttggatcaccatcaactttctaactggttctttgaagacgccaggaggaagtagcgtgggcatgttggatctgggcggaggatccacccagatcgcatttctgccacgcgtcgaaggcacgttacaggcctcccctcccggctatctgacggctctccggatgttcaatagaacctataaactgtacagttattcatacttgggcctaggcttgatgtcagcccgcttggccattctggggggggtcgagggtcaaccagccaaggacggaaaagagctggtgagcccttgcttaagtccctccttcaagggggagtgggaacacgcagaggtcacctatagggtgagcggccagaaagcagcagccagcttgcatgaactctgtgccgctcgggtaagtgaagttctgcagaatagagtacatagaacggaagaggtcaaacacgtggacttctatgccttctcctactactatgatctggccgccggcgttggactgatcgatgccgagaagggtggctccctcgtcgtgggcgatttcgaaatcgctgcaaaatacgggggttcccatctcgagagggaaggaacatgcttgattccctccgtgtcggaccccggcgacaccgccgcggagcagcctctattaatgcatgggccccatctcagacagcccgctacgcccggggtccgcctgagtcaggagcagagcgctgaagcacatagcgaaaattag

SEQ ID NO: 115506 - DNA, 681 bp, Artificial Sequence
  Description of Artificial Sequence: Synthetic coding sequence
atgccgcagcacggtccttggcagactcggatgaggaaaattagtaatcacgggagtctgcgggtggcaaaggtggcgtatcccctggggctgtgcgtgggtgtattcatttatgtcgcgtatatcaaatggcatagggccactgcgacacaggcctttttcagcattactagggccgcaccaggagctcgatggggtcaacaagcccatagtccactgggaactgccgctgacggtcacgaggtgttctatggaattatgttcgacgctggctccacgggtactagggtgcacgtgtttcagttcacacgcccaccacgggaaactcccaccctgacacacgagacattcaaggccctgaagcccggtttgtctgcgtatgccgatgacgttgagaaagtgaaaaaagtgttcaaagcatcaccttttctggtgggcgatgattgtgtgtctatcatgaacggaaccgatgaaggtgtttccgcatggataactatcaactttctcaccggctccttgaagactcctggcggctcctcagttgggatgttggacttgggcggggggagcacacagattgcctttctccctcgggtggaggggacactgcaggcatcccctcccggctacctcaccgcacttcgaatgttcaaccgcacttacaaactgtattcttattag

SEQ ID NO: 115507 - DNA, 588 bp, Artificial Sequence
  Description of Artificial Sequence: Synthetic coding sequence
atgcagccacaacatgggccctggcagacacgcatgcgtaagattagcaaccatggctcactgcgcgttgccaaggttgcttacccactagggctctgtgtcggggtgtttatctacgtcgcctatattaaatggcatcgggccacagccacacaggcctttttttctattacgcgcgctgcccccggagctaggtggggccagcaggcccacagcccgttggggaccgccgccgatggccatgaggtgttttacggaatcatgtttgatgccggtagtacaggaactcgggtacacgtattccagtttacacgacctccacgggaaacccccaccctcacacatgaaacttttaaggccctaaagcccggtctcagcgcatacgcagacgatgtggaaaaagtaaaaaaagtctttaaggccagccccttcctcgtgggcgacgattgcgtatccatcatgaatggcaccgatgagggcgtgtctgcctggataaccattaattttttaacgggatccctgaagacaccaggcgggtcatcagtgggcatgctcgatctgggaggcggaagcacccagatcgcctag

SEQ ID NO: 115508 - DNA, 903 bp, Artificial Sequence
  Description of Artificial Sequence: Synthetic coding sequence
atgaagaaaggtattcgatatgaaacaagcagaaagacgtcttatatcttccaacaacctcaacatggaccgtggcagacaagaatgaggaaaattagcaatcacgggagtctgcgcgtggcgaaggtggcttacccacttggcctttgcgtgggagtttttatctatgtggcatatatcaagtggcaccgcgccacagccacacaggcattcttcagcatcacgcgggcagcgcccggcgcccgttgggggcagcaagcccatagtcccctgggaaccgccgctgatgggcacgaggtgttttacggaatcatgtttgacgcgggtagtactggtacgagggtgcacgtgttccagtttacaaggccaccaagagagacccctacccttactcacgagactttcaaggccctaaaacccgggctctctgcctacgctgacgacgtcgagaaggttaaaaaggtcttcaaagcctccccctttctagtcggggacgattgcgtttctataatgaatggaacagatgaaggcgtgagcgcctggataactatcaacttccttactgggagcctcaaaacacccggcggcagctctgtgggcatgctggacctgggggggggctctacccagatcgccttcttgccgagagtggagggtaccctacaagcttcccctcccggttatctaaccgcgctgagaatgtttaaccggacgtataagctgtacagctacagctatctaggcttggggctgatgagcgcgcgactggccattctgggcggagtagagggacagcctgctaaagacggaaaggaattggtgagcccatgtctctccccgtcttttaagggagagtgggagcatgctgaagtgacatatcgtgtgagcggacagaaagcctag

SEQ ID NO: 115509 - DNA, 453 bp, Artificial Sequence
  Description of Artificial Sequence: Synthetic coding sequence
tgacctggacggggctctcccaaagatcggctaccccctgccccacgcaaacgggcgttggtgagcgttggggtggccgagcgtgctgttcatgaaactcccactctgacacacgagactttcaaagccctcaaaccagggctgagcgcctatgccgacgatgtggagaaggttaagaaagtcttcaaggcttcacccttcctggttggggatgattgcgttagcatcatgaacggcacggacgagggcgtgagcgcatggatcaccataaatttcttgacaggctctctgaagacacctggaggttcttccgtcggcatgctcgatctgggaggagggtccacgcaaatcgcattcttgcctagagtcgaggggacactccaggcttcaccacctggttatttgacagcactgcgcatgttcaaccgtacttataaactctacagctattag

SEQ ID NO: 115510 - DNA, 1314 bp, Artificial Sequence
  Description of Artificial Sequence: Synthetic coding sequence
atgaagaagggaatcagatacgaaacctcaaggaagacatcatacatcttccaacaaccccagcatggcccatggcagacacgcatgcgcaaaatcagcaaccacgggtctctaagggtggccaaggttgcataccctctcggcctgtgtgttggggtctttatttacgtggcctacattaagtggcacagggccactgccacacaggccttcttctccatcacccgggccgccccaggtgcgcgttggggccaacaggcccatagccctctaggcaccgccgccgacggtcatgaggtgttttatggaatcatgtttgatgctggatcaacaggaaccagagtacacgtattccaatttacccggccacctagagaaactccaactttaacccacgagaccttcaaggcgctaaaaccaggtctcagtgcctatgccgatgacgtggaaaaaagcgcccaggggatccgcgagcttttggacgtggcgaagcaagatatcccttttgatttttggaaagccacgcccctcgtgctgaaagcaaccgctggactccggctcctgcccggggagaaagcccagaaactgctacagaaggtcaaaaaagtgttcaaggccagtcccttcctggttggcgacgattgcgtgagcatcatgaatgggaccgatgagggggtgtctgcttggataaccattaatttcttgaccgggtcattgaaaactccaggaggatcgagcgtggggatgctggacctggggggcggcagcacgcagattgcctttctccctcgagtggaaggtaccctccaagcaagcccgccaggatacctcaccgccctgagaatgttcaacagaacttacaagctctactcatactcataccttggactcggcctgatgagcgcacgcctagccattttgggcggcgtcgagggacagcccgctgcatccctccacgaactctgcgccgccagggtgtcggaggtgctgcagaatcgcgtacataggacggaagaggttaaacatgttgacttctatgcttttagctactattacgacctcgctgccggagtggggcttatcgatgcagaaaaaggcggctccctcgtggtaggcgattttgaaattgcagcaaagtacgggggcagccatctagagcgggaaggaacttgcttaatccccagcgttagcgatccgggggacactgccgctgaacagcccttacttatgcacgggccgcatcttaggcaaccggcaacacctggggtaaggttgtcacaggaacagtccgctgaagcgcacagcgagaactag

SEQ ID NO: 115511 - DNA, 945 bp, Artificial Sequence
  Description of Artificial Sequence: Synthetic coding sequence
tgaaatcggggagtagttagcaggggctggcgcccgggatggcggcggcctgggagaggaagccccaaagaccgactgcctcctgctccacgcaagagagccttagtcagcgtcggggttgctgaaagggcggttcacgaaacaccaacccttactcacgagacattcaaggctttaaagcccggactctctgcctacgccgatgatgtggaaaaaagcgcgcaggggatccgcgagttgctggacgttgccaaacaggacattccctttgacttttggaaggctacccccttggtccttaaagctacagcaggcctccggctgctgccaggcgagaaagcacagaagttgctccagaaggtgaagaaagtgttcaaagcgagtccgttccttgtgggagatgattgtgtgtccatcatgaacgggaccgacgaaggcgtctcagcttggattacaataaattttctgaccgggtccttgaaaaccccaggtggttcctccgttgggatgttggacctgggcgggggatccacacaaatagccttcctgccaagagtggaggggaccctccaggcttctccgccaggatatctaaccgcccttcggatgttcaatagaacgtacaaactctatagttatagctacttggggctgggactgatgagcgcaagactggccatcctcggtggagtggagggacagccagccaaggatgggaaagaactcgtctcaccatgcctctcaccctcattcaagggggagtgggagcatgctgaggtgacatacagggtgtctggtcaaaaggccgctgccagtttgcacgaactttgtgctgctcgggtgtccgaggtgctccagaaccgtgtccacaggactgaggaggttaagcatgtggacttctacgcattctcatactattacgacctcgccgctggagttggctag

SEQ ID NO: 115512 - DNA, 567 bp, Artificial Sequence
  Description of Artificial Sequence: Synthetic coding sequence
atgaagaaaggcatcagatacgagacctctcggaaaacgtcctatattttccagccacagcatggtccctggcaaacccgaatgcgaaagatatccaaccacgggtccctgcgggtcgctaaggtcgcgtatcctctgggcctgtgtgtgggcgtttttatctatgtggcctacattaagtggcaccgagcgactgccacacaggcatttttctcaatcactagagcagccccgggagcccgttggggccaacaggcacattctcccctcggaacagcggccgacggtcatgaggtcttctacggaatcatgttcgatgccggctcaaccggcactagggtgcacgttttccagtttacccgcccaccacgagagacacccacgctaacccatgaaaccttcaaggccctcaagcccgggctgagtgcctatgctgacgacgtcgagaaatccgcccagggaattcgcgaactgcttgatgtggccaaacaggatatcccatttgatttctggaaagccacacctctggtgctcaaggccacagcaggccttcgcctgctgccttag

SEQ ID NO: 115513 - DNA, 891 bp, Artificial Sequence
  Description of Artificial Sequence: Synthetic coding sequence
atgcctcagcacggaccatggcagacacggatgcgaaaaataagcaaccatggctctctcagggtcgccaaagttgcttaccctctcgggctgtgcgtgggcgtgttcatatatgtcgcatacataaaatggcatcgggctactgccacgcaggcctttttctcaatcacgagagcagcgccgggcgcccgatggggccaacaagcacactcccctctggggacggccgctgatggtcacgaagttttctatggaataatgttcgacgctgggtccacaggtacacgggtccacgtattccagttcacgaggcccccaagagagacaccaaccctgacccacgaaacctttaaggctctgaagcccggcctgtcagcttacgccgatgacgtagagaagagcgctcaaggtattagagaactcctggacgtagctaagcaagacatcccgttcgacttttggaaggccacgccactggtgctgaaggcaaccgccggactgaggttattaccgggggaaaaagcccagaaactgctgcagaaagtgaagaaagtatttaaagcctcgccatttcttgttggcgacgattgcgtgtcaatcatgaacggcacagatgagggggttagcgcctggatcaccattaattttctcacggggtcactcaagaccccgggtggcagttctgtgggaatgctcgatctcggaggaggtagtactcagatagcgtttctgccaagagtggagggaaccctccaagcttcgccacctggctaccttactgccttgcgaatgttcaacaggacttacaaactgtactcttacagctatctgggactgggcttaatgtccgctagactggcaatcctgggaggcgtcgaaggccagccatag

SEQ ID NO: 115514 - DNA, 936 bp, Artificial Sequence
  Description of Artificial Sequence: Synthetic coding sequence
tagggctctacaggcacgcgcgtccatgtgttccaattcactaggcctccacgggaaacacctactctgacacatgaaacattcaaagcattaaaacccggcttaagcgcctacgccgacgacgtagagaaatcggctcagggaattagggagttgctggacgtggctaaacaggacataccattcgacttttggaaggccacacctcttgtactgaaggcaacagctgggttgaggttactgcctggggagaaggcacagaaactcctccaaaaagtcaaaaaagtcttcaaggcaagtccctttctcgtgggcgatgattgtgtgtcgataatgaatggcacggatgagggtgtttccgcatggattaccatcaacttcctcaccgggtcactgaagactccaggggggagcagcgtcggtatgctcgaccttggaggaggctctacacaaattgcatttctcccgcgagtggaggggacactgcaagcgagtccacctggatatcttactgcccttcgcatgtttaaccgcacgtataagctctactcctactcgtatctaggcctgggccttatgagtgccaggctggcgatccttggaggcgtagagggccagcccgccgctagtctgcacgagctatgtgctgctagagtgagcgaagttctccagaaccgagtgcatcgcactgaagaggttaaacatgtggacttctatgcattcagctactactatgacttggccgcaggggtaggactcatcgatgccgagaagggcggcagcctcgtggtgggagactttgagattgccgctaaatacgtatgtcggactcttgagacacaacctcagagctctcctttctcctgtatggatctcacgtacgtttctcttttgttacaagaattcggttttccacgatctaaggttctcaaatag

SEQ ID NO: 115515 - DNA, 942 bp, Artificial Sequence
  Description of Artificial Sequence: Synthetic coding sequence
aaccgaggagtggtaagcaggggatggaggccaggctggcggaggcccggccgaggctcacccaaggaccgcctcccgcctgcacctaggaagcgggctctggtgtcagtgggagtagctgagcgcgcagtgcacgaaacgccaacactcacccacgaaacgttcaaagccctcaagcccggcctgtctgcatacgctgacgatgtggaaaaatctgcacagggcattagggaactcctggacgtggccaagcaggacatcccattcgacttttggaaggcaactccccttgtgctgaaagccaccgccggtctgcggctgctgccaggcgaaaaggctcagaagctcctgcagaaagtgaaaaaggtgttcaaagccagtccttttttggtcggcgacgattgcgtgagtataatgaatggtaccgatgaaggtgtgagtgcttggatcaccatcaactttttgacaggttccttgaaaactccagggggaagctccgtaggaatgctggatctgggtgggggtagcactcagattgcattcttgccccgagtggagggcactctgcaagcaagcccacctggatacctgacagccttgagaatgttcaacagaacctacaaactgtatagttactcctatctgggactgggtctcatgagtgccaggttggcgatattagggggagtggaaggtcaaccggcgaaggatggtaaggagctcgtgtcaccatgcctttctccgtcattcaagggggagtgggagcacgccgaggtcacttaccgcgtgtctggccagaaggctgccgcttctcttcacgagctgtgcgctgccagggtgtcagaggtcctgcaaaatagggttcatcggactgaagaggttaagcacgtggacttctacgccttttcatattactacgatttagccgccggtgtcggatag

SEQ ID NO: 115516 - DNA, 2778 bp, Artificial Sequence
  Description of Artificial Sequence: Synthetic coding sequence
atggaacgggatgggtgcgccggcggcggcagcagagggggagaaggcggcagagcacctagagaaggtcccgcgggaaacggacgcgatagagggaggtcgcacgccgcagaggcccccggtgatcctcaggctgcagcctccttattggctcccatggatgtcggagaggaaccgcttgaaaaagccgctagggcacgtaccgccaaagatccaaacacgtacaaggtgttgtcattggtcctcagtgtctgtgtcctaacaacaattttaggttgcatcttcgggctgaagccttcctgcgccaaggaggtgaaatcctgtaaagggcggtgttttgagcgcacatttggtaattgcagatgcgacgcagcgtgtgtggaactgggaaactgttgtctggactaccaggagacatgcatagaacctgagcacatctggacttgtaataagtttaggtgtggggaaaaaagactgacacggtcgctttgtgcgtgctctgacgattgtaaggacaagggcgattgttgtattaactattcctcagtctgccagggcgagaagtcctgggtggaggagccatgtgagtccattaacgaaccccaatgtccagcaggtttcgagaccccgcctacattgctgtttagcctggatgggttccgggcagaatacctgcacacctggggagggttgttgcctgtcatctctaagctgaagaagtgcggtacctacacgaagaatatgagaccagtctaccctaccaaaacttttcctaaccactatagcatcgtgaccgggctgtacccagagagccacggcattattgataataaaatgtatgatccaaagatgaacgcctccttttccctgaaatctaaagagaagttcaatccggagtggtataaaggggaacctatttgggttactgctaagtatcagggcttgaaatcaggtaccttcttctggcccggctcagacgtggaaattaatggcatttttccagacatctataagatgtataatggctccgtgccattcgaagagcgaattctggcagtgcttcagtggcttcagctccccaaggatgaacggccccatttttatactttatacttggaggagcctgactcatccggccactcttacggcccggttagctccgaagtcatcaaagctctccaaagggttgacggtatggttggtatgctcatggacggcttaaaggagctaaatctgcaccgttgcctgaacctgattctcataagcgatcacgggatggaacagggtagctgtaaaaagtatatctacctgaacaagtacctgggggacgtgaaaaatataaaagtgatatacggcccagccgcccgactccgcccctcggacgtgccggacaagtattacagcttcaattacgagggcattgccagaaacctctcatgtcgtgagccaaaccagcatttcaaaccgtatctaaagcattttcttcctaagagattgcacttcgcgaagagcgacagaattgagccgctcacattctatctggatcctcagtggcagttggccctaaacccgagcgaacggaaatattgcggttctggctttcatgggagcgataatgtcttttccaacatgcaggccctttttgtaggatacggtccaggctttaagcacggtatcgaggcagatacctttgaaaatattgaagtctataatttgatgtgtgacctccttaacctgactccggctcccaacaacgggactcacgggtccctaaatcacttattaaagaatcccgtctatactcctaaacatcctaaggaggtgcatcctctggtgcagtgcccatttaccagaaaccctagggacaatttgggctgttcttgtaatccaagcatccttcccatcgaggactttcagactcagtttaatctcaccgtggcagaagaaaaaataataaaacatgagacactgccctacggaaggccacgagtgctacagaaggagaacaccatatgtctcctgtcccagcatcagttcatgtccggctacagccaggatattcttatgccattatggacctcttatacggttgaccgcaatgactcctttagcactgaagacttctccaattgcctctaccaggacttcaggatacccttgagtccagtacacaagtgcagcttctacaagaacaatactaaggtgagctacggattcctctcccctccacaactgaacaaaaactcatcagggatatacagtgaggctctgctgaccactaatatagtaccaatgtatcaatctttccaggtcatctggagatacttccacgacacactccttagaaagtatgccgaggagcgtaatggtgtgaacgtcgtatctggaccagtctttgacttcgattacgatggacgctgcgactctctggaaaatctgcggcagaaaaggagagtgattagaaaccaggaaatcctgatcccaactcatttcttcattgtactcacctcatgcaaagacaccagccaaacccccctgcattgtgaaaacctggacacattagccttcatcttgccccaccgaaccgataacagcgagagctgcgtccatgggaagcacgactccagttgggtggaggagctcttgatgctgcacagagctcggatcacggatgtggagcacatcacaggactgtcgttctaccagcagcggaaggagccagtgtcagacatacttaagttaaagacacaccttccgacattctcgcaggaggactag

SEQ ID NO: 115517 - DNA, 2592 bp, Artificial Sequence
  Description of Artificial Sequence: Synthetic coding sequence
atggccagacgatcctcttttcagtcttgccagatcatctctctgttcacattcgcagtgggcgtgaacatctgtttggggttcactgcacatagaatcaagcgggccgagggttgggaagaaggccctccaacggtgctgtctgatagtccttggacaaatatttccgggtcatgtaagggccgttgctttgaactgcaagaggccggaccaccagactgtcggtgcgacaatctgtgcaaatcgtatacctcttgctgtcacgacttcgatgaactatgcctaaaaactgctagaggttgggaatgtaccaaggataggtgtggcgaggtgaggaacgaggaaaatgcctgccactgcagtgaggattgtctggctaggggcgactgttgcacgaactaccaggttgtgtgtaaaggggagagccactgggtggatgatgattgcgaggagattaaggcagctgagtgcccagctggattcgtgaggccacccctgattatcttttcagtggacggattccgggcatcttacatgaaaaaggggtcaaaggtgatgcccaacattgagaagttacgcagctgcggaactcacagtccgtatatgcgccctgtctacccaactaagacgtttccgaatctatatactttggcaaccgggttataccccgaaagccacgggatcgtgggtaactctatgtacgacccagtgtttgacgctacgttccatctgaggggaagagaaaagttcaaccacaggtggtggggcggacagcccctatggataaccgccactaaacagggggtgaaggcaggcactttcttttggtcagttgtcattccgcatgagagaagaatcctgacaatactccaatggctgacgttgcctgaccacgagcggccatcagtatatgccttttacagtgagcagccagatttcagcgggcataagtacggaccctttggacccgagatgaccaacccactgcgggaaattgacaaaattgtgggccagttgatggacggcctaaagcagttaaaattacataggtgtgttaacgtcatctttgtgggcgaccatggcatggaggatgtgacctgtgatcgtaccgagttcctcagcaactacctcaccaacgtggatgatatcacccttgttcctggaaccctgggcagaatcaggtctaagttttcgaacaatgccaagtacgacccaaaagcaattatcgcaaatctgacatgcaagaagcccgatcagcactttaagccatacctgaaacagcatctgcccaaacgactgcactatgcaaataacagaagaattgaagacatccatctcttggtcgagcgccggtggcacgtggcacggaagcctctggacgtctataaaaaacctagcggcaagtgttttttccagggcgaccacggttttgataacaaagtgaacagtatgcagacagtttttgtgggctatggctcaaccttcaaatataagaccaaggttcccccttttgagaacatagaattgtataatgtgatgtgcgacctcctgggtctcaaacccgcccctaataacggcactcacggctccctgaaccatctattacgcactaataccttccggcccaccatgcccgaagaagttacacggccaaactatcccgggataatgtacttgcagagcgactttgatctggggtgcacctgtgacgataaggtcgagcccaaaaataaactcgatgagctgaacaaaaggcttcatacaaagggttcaacagaggaaagacacctgctctatgggcggccagctgttctgtatcgcacacgctacgatatcttgtaccataccgactttgagtcaggctatagcgagatttttctgatgccgctttggacgtcttacacggtgagtaagcaggccgaggtgtcttccgttccagaccatctgactagctgtgtaagaccggatgtacgggtgagcccgtccttttctcaaaattgtctggcctacaagaatgacaaacagatgtcttatggctttttgttccctccctaccttagctcctctcctgaggcgaaatatgatgccttccttgtgactaatatggttcccatgtatccggctttcaagagagtatggaattacttccagcgcgtcctcgtgaaaaagtatgcttcggaacggaacggggtgaacgtaatctctgggccgatcttcgactacgattacgatggtctgcacgacaccgaggacaagatcaagcagtatgtggaggggtcctctattccagtccccacccactactactcgataatcacttcatgcctggattttactcagcccgctgataagtgcgatggccccctgagtgtgtcttcgtttatcctgcctcaccggccggacaatgaagagtcgtgtaactcgagtgaggacgagagcaagtgggtcgaggagctcatgaagatgcacaccgctcgagtacgggacatcgaacatctgacttctctggatttctttaggaagaccagccgaagctaccccgaaatcctgaccctaaaaacgtatctccacacatacgaaagcgaaatctag

SEQ ID NO: 115518 - DNA, 2748 bp, Artificial Sequence
  Description of Artificial Sequence: Synthetic coding sequence
atggcccggagaagcagctttcagagctgccaaataattagcctctttactttcgccgtaggtgttaacatctgcctggggtttacggcgcaccgcatcaagcgcgccgaaggctgggaagagggaccaccgacagtgctgagcgactctccctggacaaatattagcggatcatgcaagggcaggtgcttcgagcttcaagaggcaggtcctcccgattgcaggtgcgacaacctttgcaaaagctacactagctgttgtcacgactttgacgagctgtgcttgaagacagcaagagggtgggagtgtactaaagaccgatgcggcgaagttcgcaacgaggagaacgcatgtcattgctccgaggactgcctggcccgcggtgactgctgtaccaactatcaagtggtgtgcaaaggagaaagccattgggttgacgatgattgcgaggaaataaaagctgcagagtgccctgctggcttcgttcgaccccccctcatcatattcagtgttgatggttttcgcgcctcttatatgaagaagggctctaaagtcatgcccaatatagaaaagcttagatcatgtggcacccacagcccctacatgcgtccagtgtacccaacaaaaaccttcccaaacttatataccctggccaccggcctgtatcctgagtctcatggcattgtcgggaactcaatgtatgacccagtgtttgacgccaccttccatctgcggggacgggaaaagtttaatcatcgctggtggggcggacagccattgtggatcaccgccacaaaacagggtgtaaaggcaggaacctttttctggtcagtggtgatcccacacgagagaagaattcttaccattctgcagtggttgacgctgcccgatcatgaaagacccagtgtgtacgccttctactcagagcagcctgatttttctggacacaagtacggtcctttcggtcccgaagagtccagctatggttcaccgtttactcctgcaaagaggccaaagaggaaggtggctcctaaacgcagacaagaacggcctgttgcccccccgaagaaaagaagacggaaaatccacagaatggaccactatgctgcggagacccgccaggataagatgactaatcctcttcgcgagatagacaagattgtcggtcagctgatggacggccttaagcagctcaagctgcaccggtgtgtgaatgtcatcttcgtgggggaccacggaatggaggacgtcacttgtgatagaaccgagttcctctctaattatctcacaaatgtagacgacattactttagtaccaggtaccctgggccgtatccggtctaaattctcgaacaacgctaaatatgacccgaaagcaattatcgcaaacctgacttgcaaaaaacctgaccagcattttaaaccgtatttgaaacagcacttacccaaacggctgcactacgctaataatcgccggatcgaagacatccacttgctagtggaacgcaggtggcacgtggcacgcaaaccgttagatgtgtataagaaacctagcggcaagtgcttttttcagggggaccatggctttgacaacaaggtgaacagcatgcagacagttttcgtcgggtatggatccacttttaagtataagacaaaggtccccccgttcgagaacattgagctgtataacgtgatgtgtgatctgcttggcctgaagcctgcccccaacaatggaacccacgggtcactgaaccacttattacgcacgaatacctttagacccacaatgccagaggaagtaacaagacctaactaccccggcataatgtatttacagtcagacttcgatctgggatgcacatgcgatgacaaggtcgagccaaaaaataagcttgacgagttaaacaaaaggctgcacaccaagggcagcacagaggagcggcatctgctatacggcaggccggccgtcctttacagaacacgctacgatattctctaccacacagactttgaaagcggttatagcgagatcttcctgatgcccttgtggacatcttatactgtgagtaagcaggcagaggtgagctctgtgccggatcatttgacctcttgtgtgcggcccgatgtcagagtctctccctctttttcccagaattgcctcgcgtacaaaaacgataaacaaatgtcttacggctttttgtttcctccctatctctctagcagccccgaggcgaagtacgatgccttcctggttaccaacatggtccccatgtaccccgcttttaagagggtctggaattacttccagagagttcttgtcaaaaagtacgcatctgagagaaatggagtgaatgtcatttctggacccatatttgattacgattacgatggtcttcatgataccgaggacaagattaaacagtatgtggagggctcaagtattcccgtgcccacacactattactcaattataaccagctgcctggacttcactcagcccgccgacaagtgtgatggtcccttgagcgtctctagctttattttgccgcaccggcccgataatgaggagagttgcaactcatctgaagacgagagcaagtgggtggaagaactcatgaagatgcacacagctcgggtacgagatatcgagcaccttacttccctggacttttttaggaagacaagccgaagctaccctgagattcttactctgaaaacctacctccacacctacgaatcagaaatatag

SEQ ID NO: 115519 - DNA, 2667 bp, Artificial Sequence
  Description of Artificial Sequence: Synthetic coding sequence
atggctcgccgctcttccttccagtcctgccagattataagcttgtttaccttcgccgttggggtcaacatttgcctgggtttcaccgcacaccgaatcaaacgagccgagggatgggaggaagggccgccaaccgtgctgtcagacagtccttggactaacatcagtggttcctgcaagggcaggtgttttgaattgcaggaagcagggccccccgactgtagatgtgacaacttgtgtaagtcttatacatcttgttgtcacgacttcgacgaactctgtcttaagactgcccgcggctgggagtgtaccaaggaccgttgtggtgaggtgagaaacgaagagaacgcctgccattgttctgaagactgtttagcccgcggggattgctgtactaactaccaggttgtttgtaaaggagaatcccactgggtggacgacgactgcgaggaaatcaaggccgccgaatgtcccgcagggttcgtgcgtccacctctcataattttttcggttgatggcttccgcgctagctacatgaaaaaagggagcaaggtgatgccaaatattgagaagttaaggagctgcgggactcattccccctatatgcggcccgtataccctaccaagacctttccaaacctctatacccttgcaactggactgtatcccgagtcccacggaatagttggtaattctatgtacgaccctgtgtttgatgctacatttcacctccgcgggcgagagaaattcaatcatcggtggtgggggggacagcctttgtggataactgcaaccaagcagggcgtgaaagcaggcacttttttctggagtgtggttataccgcatgagagaaggatcctgaccatactgcagtggctcacacttcccgaccacgagcgcccatcagtgtacgcattctacagtgagcagcctgacttttccggccacaaatatggacctttcggccccgaaatgacgaaccccctgagagaaatcgataagattgtgggtcagctgatggatggtctcaagcagctgaagctgcataggtgtgtcaacgtgattttcgtgggggatcatggcatggaagacgttacatgcgatcgcaccgaatttctttcgaactacctcaccaatgtcgatgacattaccctcgtgccaggcactctgggcagaattcgttctaagttttctaacaacgcgaagtatgaccctaaggctatcatagccaacctaacgtgcaagaaacctgatcagcatttcaaaccctatctcaagcagcacctccccaaacggcttcactacgccaacaacaggcgaatcgaggacatccacttactggtcgagaggcgctggcacgttgctcggaaacctctggacgtgtacaaaaaaccgtcaggaaagtgtttctttcagggagatcacggtttcgacaataaggtaaactctatgcagactgtctttgtgggttacggaagtacttttaaatacaagacaaaggtgcctccatttgagaatatcgaattatataatgtgatgtgcgacctgctcgggttaaagccagcaccgaacaacggtactcatggttcactgaatcacttactccggactaatacgtttaggcccaccatgcctgaggaggtgacgaggccaaactatccagggatcatgtacctgcaatcagattttgacctcggctgcacctgtgatgataaagtggaaccgaagaacaaacttgacgagctgaataaacgcctccacacaaagggatcaacagaggcagaaactaggaagttccgtggctctaggaacgaaaacaaggaaaacataaatggaaacttcgagcccaggaaagaaagacacctgctttacggtcggccagccgtgctgtaccggaccagatatgacattctgtaccacactgacttcgagagtggctattccgagatctttctcatgccactgtggacctcttacacggttagcaagcaggcagaggtctctagcgtgcccgaccacctgaccagctgcgtgcgccccgatgtgcgcgttagtccttcattctcacaaaactgtctcgcatacaaaaacgacaaacagatgtcttacgggttcctgttccccccctacctgtcatcttccccagaggcgaagtatgatgccttcctggtgaccaacatggtccccatgtaccctgctttcaagcgagtctggaactacttccagagagtgctggttaagaaatacgcatcagagaggaatggcgtgaacgtcatttccgggcccatattcgactatgactatgacggtctccacgacacggaggataagattaagcagtatgtggaaggctcctcaatacccgtcccaacccattattattccattataacaagctgccttgatttcacccagccagcggataagtgtgatgggcctttgagtgtgagctctttcatcctaccccatagaccggacaacgaggagtcttgtaattcatcagaagacgagtctaagtgggtggaggaactgatgaaaatgcatacagctagggtaagagacatcgagcatctgacctcactggatttctttcggaaaacgtcacggtcatacccagagatactgactttgaaaacctatttacacacgtacgaatccgaaatctag

SEQ ID NO: 115520 - DNA, 2628 bp, Artificial Sequence
  Description of Artificial Sequence: Synthetic coding sequence
atggagtcaaccctcacgctggctacagaacagcccgtgaaaaaaaacaccctgaagaagtataagattgcctgcatagtgttgctggcattgctcgtgatcatgtccttgggactggggttgggactcggcctgaggaagctggagaagcagggatcctgtagaaagaagtgcttcgacgcgagtttccgtggactggaaaattgtaggtgcgatgtggcctgtaaggatagaggtgattgctgctgggatttcgaagacacatgcgtggagtccacaagaatctggatgtgtaacaagtttagatgcggcgagactcgtctggaggcctccctatgttcttgtagcgacgactgcttgcaacggaaggattgctgcgccgactacaaaagcgtctgccagggcgaaacgtcctggttagaagagaattgcgacacagctcagcagagtcagtgtcccgaggggttcgaccttccacccgtgatcctgtttagtatggatggttttcgtgcagagtatttatatacatgggatactttgatgccaaacatcaacaaattaaagacgtgcggcatccatagcaagtatatgcgggctatgtaccccacaaaaacgtttccaaaccattacacaatcgtcacaggtctttatccagagagccacggcatcattgacaacaatatgtatgacgtaaatcttaacaaaaatttctctctttcatcaaaagagcagaataaccctgcatggtggcacggacagcccatgtggctgactgccatgtaccagggtctgaaagctgctacgtatttttggcccggcagcgaagtggccataaatgggtccttcccctctatatacatgccgtacaatggcagcgtcccttttgaggagaggatctcaaccctgcttaagtggctggatctgccgaaggctgagcgcccaaggttttatacaatgtactttgaagagccagactcaagtggccatgcaggcggtcccgtgagtgctagggtgatcaaagccctgcaggtagtcgatcacgcctttggcatgctgatggaagggctcaagcagaggaacctccacaattgtgttaacatcatcctccttgctgaccatggaatggatcagacttactgcaacaagatggagtacatgactgactacttcccgcggatcaacttcttctacatgtatgagggcccggctcccaggattcgcgcccacaacatcccacacgactttttttctttcaacagcgaggagatcgtgcggaaccttagctgtagaaagccagaccagcacttcaagccatacctgacacccgacctgcctaagcgcctgcattatgccaagaacgtgcgaattgacaaagttcacctgttcgtcgaccagcagtggctcgcagtcaggagtaagtctaatactaattgtggaggcggaaatcatggttataataacgagtttaggagtatggaggccatcttcctcgcgcacggccctagctttaaggaaaaaacggaagtcgagcccttcgaaaatattgaagtgtacaacctgatgtgcgatcttctacgcatccagccagcacccaacaacggcactcatggctcactcaaccatcttcttaaagtgccgttctatgaaccgagccacgctgaggaagtgtccaagttctcagtgtgtgggtttgcaaaccctctcccaaccgagtcccttgattgcttttgtcctcacttgcaaaactctacgcaactcgaacaggttaaccaaatgctgaatcttacacaggaggaaatcacggcaactgtgaaagtcaatctgcccttcggtcggccgcgcgtgctacagaagaacgtagaccactgcctgctttatcatcgcgagtacgtgagcggcttcgggaaagccatgcggatgccgatgtggtcatcctacacagtgccgcagttaggtgacaccagtccgttgcctcccacggtcccagactgtctgagggcagacgtgagagtgccccccagtgaatcccagaaatgtagcttttacctggcagataagaatatcacacatggttttctctacccccctgcaagcaacagaaccagcgatagtcagtacgatgcactcataacaagtaatctagtccctatgtacgaagaatttagaaagatgtgggattattttcatagtgttttgctgatcaaacatgcgaccgaaagaaacggtgttaatgtcgtgtccgggcctatcttcgattataactacgatggacacttcgacgcacccgacgaaatcaccaaacatctggccaacacagacgtgcctattcctacgcactacttcgtggtactcacatcctgtaaaaataagtcccatacacctgaaaactgtccaggctggctggacgtactgccctttatcattccacacaggcctacaaatgtggagtcttgtccagaagggaagccagaggcactttgggtagaggagaggttcaccgcacacatagctcgggttcgggatgtcgaattactgactggcctggacttctaccaggacaaggtgcagcctgtgtccgagatacttcagcttaagacctacctgcccaccttcgaaacgacaatatag

SEQ ID NO: 115521 - DNA, 1992 bp, Artificial Sequence
  Description of Artificial Sequence: Synthetic coding sequence
atggaatcaaccctcactttggctaccgagcagcccgtgaagaagaacacactgaagaagtacaaaattgcctgtatagtcctgcttgcgcttctggttattatgagtctgggactggggttgggactcgggctacgtaaactcgaaaagcaaggttcttgccggaagaagtgtttcgatgcttccttccgcgggctggaaaactgcaggtgtgacgtggcgtgcaaagacagaggggattgctgctgggattttgaggacacctgtgtcgagagtacacgaatctggatgtgcaataagtttagatgtggagagaccaggctggaggcatcgctctgttcttgctcagatgattgcctgcaacgaaaggactgttgcgcagattataagagtgtgtgtcagggggagacatcatggctagaagagaattgcgacaccgcgcagcaaagccagtgtcccgagggcttcgatctgccacccgtcattttgttcagcatggatggcttccgagctgaatatctctatacttgggatacccttatgcctaatataaacaagctaaagacatgtgggattcacagcaagtacatgagagctatgtatcccacaaaaacgtttccgaaccactacacgattgtgaccgggctttatcccgaatcccacggcataatcgataacaacatgtacgatgtgaacctcaataagaattttagcctgtcttcaaaggagcagaacaatcctgcctggtggcacggccagcccatgtggctgaccgctatgtatcagggattgaaggccgccacatacttctggcccggctcagaagttgcgatcaatggctcattcccctcaatttatatgccatacaatgggtccgtgccatttgaggagcgcatatcaaccctgctgaagtggcttgatctgccgaaggccgaacgtcccagattttatactatgtatttcgaggaaccagactcttccgggcatgctggcggccctgtatcggcacgcgtgattaaggccctccaggtggtagatcacgcgtttgggatgctgatggagggcctgaagcagcggaacctgcacaactgcgtgaatatcatactgctggctgatcacggaatggatcagacctactgtaataaaatggagtacatgacagattactttccacggattaatttcttttacatgtacgagggccccgcccccaggattagggcgcacaacatcccacacgattttttctctttcaattccgaggaaatcgtcaggaatctttcatgcagaaaacccgatcagcactttaagccctacctgacccccgatctaccaaagaggctgcactacgccaaaaatgtaaggattgacaaggtgcatttgtttgtggatcagcagtggctagccgtgcgaagcaagagcaatactaattgcggcggaggaaaccatggctacaacaatgagtttcgcagcatggaggccatctttcttgcccacggacctagcttcaaagaaaaaacagaagtcgagccatttgagaacatcgaagtgtacaatctgatgtgcgacctgctgaggatccagccagccccaaacaatggaacccatggatccctgaatcacctcctgaaagtacctttctacgagcctagtcacgccgaagaagtgtctaaattttcagtctgtggttttgcaaatccgctgcccaccgagtcgttggactgcttttgcccccacctgcagaactccacccaactggaacaggtgaatcagatgcttaatctgacccaggaagagattacagccactgtgaaggtgaacctgccctttgggagaccaagagtgctgcaaaaaaatgttgatcactgcctattatatcacagggaatacgtctcagggtttgggaaggccatgcggatgcctatgtggtctagttacaccgtgccacagcttccagccattgagcatcagattgcaaatatgatgttgtag

SEQ ID NO: 115522 - DNA, 2628 bp, Artificial Sequence
  Description of Artificial Sequence: Synthetic coding sequence
atggagagcacactcacactcgcaaccgagcagccagtgaaaaagaacactctaaagaagtataagattgcttgcatcgttctcttggccttactcgtcatcatgagcttaggactaggcctcgggttgggactgagaaagctcgaaaagcagggatcttgtaggaagaaatgcttcgacgcttctttccgcggacttgagaactgccgctgtgacgtagcatgcaaagatcggggggattgctgctgggacttcgaggatacttgcgtggaaagcacgaggatctggatgtgtaacaaattcagatgtggggaaactcgcctcgaggcctccctctgttcctgttccgatgactgtctgcagcgtaaggattgttgcgctgactacaaatcagtgtgccagggcgagacaagctggctcgaagaaaattgcgacactgcgcagcaaagccaatgtccagagggtttcgatctcccaccagttatcttattcagtatggatggatttcgggccgagtatctctacacatgggatacgttaatgccaaatattaataagctgaagacctgcgggattcacagcaagtatatgcgagccatgtatcctacgaaaacttttccaaaccactatacaatcgtgacagggctttatcccgaatctcatggaataatcgataacaacatgtatgatgttaacctgaataagaacttttccctcagctcgaaggagcaaaacaaccccgcatggtggcacggacaacccatgtggttgactgctatgtatcagggcctgaaagcagccacttatttttggccaggatcagaggtggccattaacggctctttcccgagcatctacatgccgtacaacgggagcgtgcccttcgaagaacgaatcagtacgctgctgaaatggcttgacctcccaaaggctgaaagaccccggttttataccatgtacttcgaagaacctgacagcagcgggcatgcaggcggacccgtcagcgcgcgggttattaaagctctccaggtagtggaccacgctttcggcatgcttatggaggggttgaaacaacggaacctgcacaactgtgtcaatattattctgctggctgatcacggaatggaccagacttactgtaataagatggagtatatgacagactactttccacgtatcaacttcttttatatgtacgagggccctgcaccccgcatcagagcacataacatcccccacgattttttcagtttcaattcggaagaaatcgtgcgcaatctttcatgtcgcaagcccgatcagcattttaagccctacctgactcctgacctgccgaagagattacactatgcaaaaaatgtgcgcattgacaaggtgcacctttttgtggaccagcaatggctggccgtgagaagtaagagtaatacgaattgtggtggaggcaaccatggttacaataatgagtttcgatctatggaggcaattttcctggcacatggcccatcctttaaggagaaaacagaggtggagccattcgagaatattgaagtgtataatctgatgtgcgacctcctgaggattcagcccgccccaaataatggtactcacggaagtcttaatcacctgctcaaggttcccttttatgagccaagtcacgctgaggaggtttcaaagtttagtgtgtgcggttttgcaaatcctcttcctacagaatccctggattgtttctgcccccacctgcagaattcaacgcagctagagcaggtaaatcagatgctgaacctgacccaggaggagattacagccactgtaaaagttaacctgccctttgggagacctcgggtgctgcaaaagaatgtggatcactgcctgctgtaccacagagagtacgtgagcgggttcggtaaggccatgcggatgccaatgtggtcatcgtacacagtgccacagttgggagatacttctccccttccgcccaccgtcccagattgtctcagagccgacgtacgggtgcccccctccgaaagtcagaaatgctcattttatctcgctgataaaaacattacccacggatttctgtatccccctgcctcgaaccggacaagtgactcgcaatatgacgctcttattacctccaacctcgtgccgatgtacgaagagttccggaaaatgtgggattatttccattccgtcttactcataaaacacgcaaccgaacggaatggcgttaacgttgtgagcggacccatttttgactataattacgatggccacttcgacgcacctgacgagattaccaagcatctggcaaatactgatgtgcccatccctacccattactttgttgttttaacatcctgcaagaataagtcacatacaccggagaattgtccagggtggttagacgtgctcccttttattatcccacaccgccccaccaacgtcgagtcttgtcctgaaggaaagcctgaagcactgtgggttgaggagagattcactgcacacatcgcaagagttagagacgtggaattgttgactggcctcgatttctatcaggacaaggtgcaacccgtctcggagatcctgcaactcaagacttatctgcccaccttcgaaactacaatatag

SEQ ID NO: 115523 - DNA, 765 bp, Artificial Sequence
  Description of Artificial Sequence: Synthetic coding sequence
atgtcactgggcctgggactgggcttaggcctccgcaagttggaaaaacaggggagctgcaggaagaagtgtttcgacgctagtttccgagggttggaaaactgtaggtgcgatgttgcttgtaaggatcgaggagactgttgctgggattttgaagatacgtgcgtggagagcacccggatttggatgtgtaacaaatttaggtgcggggagacaaggctggaggcctccctgtgtagctgctctgatgattgcttgcagaggaaggattgttgcgcggattacaaatccgtctgtcagggtgagacgtcatggctggaggagaactgcgacaccgctcagcagtcccagtgtcccgagggattcgacctgccccccgtgattctcttttccatggacggcttcagagcggaatacctatacacatgggacacacttatgccaaacattaacaagctgaaaacatgcggcattcattctaaatatatgcgcgccatgtaccctaccaaaacatttcctaaccactatacaatagtaactggcctgtacccagagtcccacggtatcatcgataataatatgtacgatgtgaacctcaataagaatttcagcctgtcatctaaggagcagaataaccccgcatggtggcacgggcagccggtgtgcagcatcctgcatgtcgccacagaagtcacttcgatttctcagtgcgatcgacgcacattgttcagtctgtcgggcgccagctccatgagtccaatctag

SEQ ID NO: 115524 - DNA, 774 bp, Artificial Sequence
  Description of Artificial Sequence: Synthetic coding sequence
atgtctctagggttgggattgggtctaggcctgagaaagcttgagaagcagggcagctgccggaaaaagtgttttgatgcctctttcagggggttagaaaattgccgctgtgacgtagcctgtaaagatagaggcgattgttgttgggattttgaggatacctgcgttgaatctacgcggatatggatgtgtaataagtttcggtgtggagagacacgcctcgaagcgagcctgtgttcctgtagtgatgattgcttgcaaaggaaagattgctgcgccgactacaaatcagtgtgccagggcgaaacctcgtggcttgaggagaattgcgacacagcgcagcagagccagtgtcccgagggctttgacctccccccggtgatactgtttagtatggacggttttagagctgaatacctgtacacatgggacacattaatgccaaacatcaataagctgaagacctgtggtatccatagcaagtatatgcgtgcgatgtatccaaccaagacattcccgaaccactataccatagtaaccggcttgtaccccgaatcccacggaatcatcgacaataacatgtatgatgtgaaccttaataagaacttcagcttgtccagcaaggagcagaataatccggcctggtggcatggacaaccgatgtggttgaccgcaatgtatcagggcttgaaggctgccacttacttttggcccggtagtgaggtcgccattaacggatcctttcctagcatttacatgccgtacaacggctag

SEQ ID NO: 115525 - DNA, 1200 bp, Artificial Sequence
  Description of Artificial Sequence: Synthetic coding sequence
atggctagtccagggaagccaggtgcggacgaggcccaggaggaagagggcgaactggaaggtggatctgcgggcccaagggctgctatcctggaacaagccgaggagttattcctgttgtgcgacaaggaagcaaaagggttcattacgaagcatgacctgcagggcttgcagtccgatctccctttgactcctgagcagctggaagctgtgttcgaatcgctggatcgtgcccacacgggattcttaacggctcgggaattctgtctgggattgggaatgtttgtgggcgtagcttcggcccagggagctaatccctgcaggacgcccgaagagactttcgagtccggaggccttgatgtgcagggtaccgccggaagcctcgatgaggaagaagaggaggaggaacgctttcatacggtcctggagcagttgggagtggctcctgtcctgggcaagcaacgcgccgttcggaccttatgggcaaggctccaacgagaacggcccgagctgctgggatcgtttgaggatgttctgattcgagccagtgcgtgcctagaggaggccgcacgggagcgcgatggacttgagcaggcactgaggagaagagaatctgaacacgagcgcgaggtgcgggccctctacgaggaaaccgagcagcttcgggaacagtctaggaggccccccagtcagaattttgctagaggtgagcgccggagtcggttagaactagagctccagtcaagggagcaggatcttgaacgggccgggctcaggcagcgggagctggagcaacagttgcatgcccaagccgcggagcatttggaagcccaggcccagaactctcagctctggagagcccatgaagctctcaggacacaactcgagggagctcaggaacagatccgcaggttagagtcggaggctcggggacggcaagaacaaacacagagggacgttgtggccgtcagcagaaacatgcagaaggagaaggtgtctctgctgagacagctggagctgctgagagaactcaatactcgtctccgcgatgaccgtgacgcctgtgaagcacgaagagctgggagttcctgcagaaaagctctgaccacagccagattgcctggccctacctgctgctgctgttgttgctgggcacggccacctaggcggggctctgggcaccttccatccgcgcggtag

SEQ ID NO: 115526 - DNA, 885 bp, Artificial Sequence
  Description of Artificial Sequence: Synthetic coding sequence
atggcttctccaggaaagccaggcgccgacgaggctcaggaagaggaaggagagcttgaggggggctccgctgggccccgagctgctatactcgagcaggccgaagagttgtttctactgtgtgacaaggaggctaaagggttcattacgaaacatgacctccaggggttgcagagtgacctgcctctgacacctgagcagcttgaagcggttttcgaatctctagaccgggcacacaccgggttcctgaccgctcgagagttttgcctgggtcttgggatgttcgtcggagtggctagcgcacagggtgccaatccttgtcgaactcccgaggaaaccttcgagtctggagggcttgacgtgcaaggcaccgctggcagtcttgatgaagaagaagaagaggaagagaggttccacactgtgctcgagcagctgggcgttgctcctgtgctcggcaagcagcgcgcggtcaggacattgtgggccaggttgcagagagagcgtccggagctcttgggtagtttcgaggatgtgctgattcgtgcctcagcttgcctggaggaggctgctcgagaaagagacggtttggagcaggcactgagaagacgggaatcggaacatgagcgagaggtcagagccctgtacgaggagactgaacagctgcgggagcagtctcgaagacccccctcccaaaactttgcaaggggcgaaaggcgatctcgcctggaactcgaactacaaagtagagagcaggacctggagcgagccggtctacgacaacgggagaggcgaggccgccgcctccaagagcacgctgaaagggaatctcagcccgcaaccgcgactggggctgcccagggtgctgaatacacagcggccggatag

SEQ ID NO: 115527 - DNA, 267 bp, Artificial Sequence
  Description of Artificial Sequence: Synthetic coding sequence
atggccagtcccgggaagcctggagccgatgaagcgcaagaagaagagggagaactcgagggagggtctgctggtccgagggctgcaatcctcgaacaggccgaagagcttttcctgctgtgcgacaaagaggctaagggtttcatcacaaagcacgatctgcagggcctgcagtcagacctccctttgacgcctgaacagctcgaagctgtctttgaatcattggatagagcacataccggcttcttaacggctcgagagttctag

SEQ ID NO: 115528 - DNA, 105 bp, Artificial Sequence
  Description of Artificial Sequence: Synthetic coding sequence
atggcgtctcccggcaagccaggcgctgacgaggcacaggaggaagagggcgagcttgagggaggatcggccggtcctagggcagcaattctagaacaagcatag

SEQ ID NO: 115529 - DNA, 885 bp, Artificial Sequence
  Description of Artificial Sequence: Synthetic coding sequence
atggcctcgcccggaaagcccggggccgacgaggcacaagaggaagaaggtgaattagagggaggctccgcgggtcctagggcagctatactcgagcaagctgaggaactttttttgctttgcgataaggaggcaaaaggcttcatcacaaaacacgaccttcagggactgcaatcggatctgcctctaacacccgaacagctggaagccgtattcgaatcgcttgatagagctcacacaggctttctgaccgcccgagagttttgtctcggacttggtatgttcgttggtgtcgcctcagcacagggggctaacccttgcaggacaccggaagaaacatttgaatcaggcggcctcgacgtgcaaggcaccgctgggtcactagatgaagaggaagaggaggaagaacgcttccacaccgttctagagcaacttggggtggcaccagtcctcgggaaacagagggcagtgcgcacactttgggctaggcttcagcgcgagcgacctgaactactgggaagcttcgaggatgtactgattagagcctccgcatgcctggaggaagctgctcgagaacgagacggcctggagcaggctctgcgaagaagggagtcggagcatgagcgagaggtgagggcgttatacgaggagaccgaacaactcagagaacagagtaggagacccccctcccagaattttgccagaggtgagagacgatccaggctggagctggagcttcagagcagagagcaagatttagagcgggccggattgcgtcagcgggagaggagaggcaggaggctccaggagcatgctgaaagagagagtcagccggctacagcaactggagccgcgcagggggccgaatataccgccgcgggctag

SEQ ID NO: 115530 - DNA, 162 bp, Artificial Sequence
  Description of Artificial Sequence: Synthetic coding sequence
atggcttccccgggcaagccaggagccgatgaggctcaggaagaagagggtgagctggagggaggctctgctggccccagagccgccatcctcgagcaggcagaggagctgtttctcttatgcgacaaggaagcaaagggtttcataaccaagcacgattag

SEQ ID NO: 115531 - DNA, 246 bp, Artificial Sequence
  Description of Artificial Sequence: Synthetic coding sequence
atggcttctccagggaagcccggcgcagacgaagcccaggaagaagaaggggagcttgaaggcgggtctgccggacccagagcagctatcttagaacaggccgaggagctgttcctcttgtgtgacaaggaggcaaaaggtttcatcactaagcacgacctgcagggtctgcagagcgacctgccgttgacccctgaacaactcgaggcagtgttcgaatccctcgacagagcccacactggctag

SEQ ID NO: 115532 - DNA, 1188 bp, Artificial Sequence
  Description of Artificial Sequence: Synthetic coding sequence
atggccgctcccgacggccgagtggtatcacgtcctcagagattgggacaggggagcggccagggcccaaaagggtccggtgcttgcttgcaccctttagacagcttggagcagaaagagacacaggagcagaccagcggacagttagttatgctacgcaaggcccaggaattctttcaaacatgcgatgccgaggggaaagggttcatcgctcgcaaagatatgcaaaggcttcataaagagttaccattatcactcgaggagttggaggatgtcttcgacgcccttgatgccgacgggaatggttacctaactccacaagagttcacgactggcttctcacacttcttttttagccagaacaatccttcccaggaggacgctggcgaacaggttgcccaaaggcacgaggaaaaggtgtacctgtctaggggagacgaagatcttggcgatatgggagaggatgaagaggcccagtttcgcatgctgatggatcgattgggagcgcagaaggtcttggaggatgagtccgacgtcaaacagctgtggttgcaattgaaaaaagaggaaccccacttgttatctaactttgaagacttcctgactcggatcatctcccagctgcaggaggcacacgaggaaaagaacgagctggagtgcgctttgaaacgtaagatcgccgcttatgatgaagagatacagcatctctacgaggagatggagcagcagattaagtctgagaaagaacagttccttctcaaggatactgagaggtttcaggcccgcagccaagagctcgaacagaagctcctgtgcaaggagcaggaactggaacaactgactcagaaacagaagcgtcttgaggggcagtgcacagccctgcatcatgacaagcatgagaccaaggcagaaaatacaaaactcaagttgaccaaccaagagctggctcgagagctggaaagaaccagttgggaacttcaagacgcgcagcagcagctggagagcctgcagcaggaggcgtgcaagctgcaccaggaaaaggagatggaagtgtacagagtaaccgagagcctccaaagggagaaggccgggctgcttaaacaattggacttccttcgctgtgtgggcgggcactggcctgtgcttcgcgcccctccaaggtctctcggatccgagggccctgtttag

SEQ ID NO: 115533 - DNA, 2196 bp, Artificial Sequence
  Description of Artificial Sequence: Synthetic coding sequence
atggccgccccagacggccgagtggtaagcagacctcagcgcttgggccagggctctggccaggggccaaaagggtcaggggcctgtctacacccgctcgactcattagagcagaaggagactcaagagcagaccagcggacagttggtcatgttaagaaaagcccaggaattttttcaaacgtgtgatgccgaaggcaaaggtttcattgctaggaaggatatgcaacggctgcataaagagctgccattaagcctggaagaactggaggacgtgttcgacgcactggatgccgatggaaatggctacctgacccctcaggaatttactacaggattctcacacttcttcttcagtcaaaacaacccatcgcaggaggacgcaggcgagcaggtcgcacagcgacacgaagaaaaggtgtacctctcccgcggcgacgaggatctgggggacatgggcgaagacgaagaggctcaatttagaatgctcatggataggctcggagcccagaaagtcctcgaggacgagtccgacgtcaaacagctttggctacaactgaaaaaggaggaacctcacctgctgtcaaactttgaggactttctaacacggattatttcccagttacaggaggcacacgaggaaaaaaacgagctcgagtgcgcactgaaaagaaagattgccgcttatgatgaagagatacagcatctgtacgaagagatggagcagcaaattaagtctgagaaggagcagtttttactgaaagatacagagcgttttcaggcccgctcccaggagctcgaacagaagttactttgtaaggaacaggagctggagcagcttacgcagaagcaaaaacgcctagagggtcagtgcactgccttgcatcacgacaagcacgagacgaaagccgagaacaccaagctgaaattgacaaatcaggagttagcccgggagctggagaggacgtcttgggagctgcaggatgcacagcagcagctggagtcattacagcaggaggcctgcaaactgcatcaggagaaggagatggaggtatacagagtgaccgaatcactgcaaagagagaaagcgggactgctcaagcaactcgacttcctgagggaacgcaataagcatctccgcgatgagagggacatttgttttcaaaaaaataaggccgccaaggctaacacggctgcttcccgtgcatcatggaagaagcggagtgggtctgtgatcggtaaatacgtcgactctcggggcatcctgcggtctcaaagtgaagaagaagaggaggtttttggcatccctcggagaagctctctgggactttccggatatcccctgaccgaagaagaacctgggaccggggagccgggccctggaggaccctaccccagacctttgaggcgcatcataagtgtggaggaggatccactccctcagcttctggacggtggctttgaacaaccattgagtaaatgcagtgaggaggaagaagttagtgaccagggtgtgcaggggcaaattccagaggcaccacctttgaaactgactccaaccagtccacggggccagcccgttgggaaggaggctctgtgcaaggaagaatctagcccttccgctcccgataggctcttcaaaatcgtgttcgttggaaacagcgctgtgggaaaaacctcctttttgagaaggttttgcgaggatcggtttagtcctggcatggccgcaaccgtcggaatagattatcgagtcaaaactcttaacgtcgataattcccaagtggcactccagttgtgggatacagccgggcaggagcgctatcggtgtattacacagcagttttttaggaaggcggatggtgtaatcgtaatgtatgatttgacggacaaacaaagcttcctgagcgtgagacgttggctgtcttccgtggaagaggcggtcggcgatcgggttcccgtgctgttgctcgggaataagttagataacgagaaggagagagaggtcccccgcgggctgggggagcagctagctactgagaataatctgattttctacgagtgttccgcttactctggccacaacacgaaagaatccttgctgcacctcgcgcgattcctcaaggagcaggaagatacagtgcgggaagataccattcaggtaggccaccccgccaaaaagaagagttgttgcggatag

SEQ ID NO: 115534 - DNA, 1389 bp, Artificial Sequence
  Description of Artificial Sequence: Synthetic coding sequence
atggcggcccccgatggacgggtggtaagtcgaccacaacggcttgggcaagggtctgggcagggacccaagggctctggtgcctgcctgcatccgctcgactctttggaacagaaagaaacgcaggagcagacatctggtcagttagtcatgctgcgcaaggcccaggagttctttcagacatgcgatgctgagggaaagggattcatcgcgcgtaaggatatgcagaggcttcacaaggaactcccattgagcttggaggaactcgaggacgtgttcgatgcactcgacgcagacgggaatggatacctgactcctcaggaattcaccactggatttagtcatttcttcttcagtcaaaacaaccctagccaggaagatgccggagagcaggtggctcagagacatgaggagaaagtctatctctcccgcggcgatgaagacctgggtgatatgggggaagacgaggaggcgcagttccgcatgctgatggaccgccttggtgcacaaaaggtactcgaggatgagtcggacgtgaaacagttgtggctgcagctgaagaaagaggagcctcacctgttgtccaactttgaggactttctcactcgtatcatcagccagctccaggaggctcatgaggaaaagaacgagttagaatgcgcactaaaacggaagattgctgcctacgatgaggagatacaacacttgtacgaggaaatggaacagcagatcaagagtgagaaggagcaatttcttctgaaagacactgagcgattccaagcccgatcgcaagagttggagcagaaacttctttgcaaagaacaggaattggagcagctcacacagaagcagaagagactggaaggacagtgtacagccctccatcatgataagcacgagactaaggcggagaacacaaagttgaaactgaccaatcaggagctcgcgcgcgagttggaaaggacctcttgggaactgcaagacgctcagcaacagctcgagtccctgcagcaggaggcttgtaagctccaccaggagaaagaaatggaggtctatagagtcacagaatcattacaaagggaaaaagccggcctgcttaagcagctcgatttcctgcgggagagaaataaacacctgcgcgatgagagagacatctgtttccagaaaaacaaggctgccaaggctaacaccgctgcatccagggcttcctggaagaagagatctggaagtgtgattgggaagtacgtagatagtagggggatcctgcgccggtggcctcagcgggaccggggtattccaactttgcagtaccagacccagagggatctagaggattgcaaacatgagatgaaaaagatctgtaaagccgaggttaccctcgaaatgtag

SEQ ID NO: 115535 - DNA, 357 bp, Artificial Sequence
  Description of Artificial Sequence: Synthetic coding sequence
taagagaaggagatggaggtgtatcgggtgaccgagagcctacagagagagaaggctgggcttttgaaacagctcgactttctgagggagcggaataaacacttaagggacgaacgcgatatctgtttccaaaaaaacaaggctgccaaagcaaataccgcagcatcccgagcttcatggaagaagagaagcgggtctgtgattgggaaatacgtggactccaggggcattttgcgacgctggccgcagagggatcgaggcatccccacactgcagtaccagactcagcgtgatttggaagactgtaagcacgagatgaagaagatctgcaaggccgaggtcaccctagaaatgtag

SEQ ID NO: 115536 - DNA, 1923 bp, Artificial Sequence
  Description of Artificial Sequence: Synthetic coding sequence
atggtgtctaaccccgtacatggtctgcctttccttcctgggaccagcttcaaggactcgacaaagacagcttttcaccgatcccagactctctcatacaggaacgggtacgcaattgttcggcgccctaccgtagggatcgggggagatcggctccaattcaatcagctgagccaggccgagctcgatgaattagctagcaaagcaccggtgctgacatacggccagccaaagcaggcgccaccagcagattttattcctgcacacgtggctttcgacaagaaagtgctcaagtttgacgcctacttccaggaggatgttcccatgtccacagaggagcagtatcggatccgacaggtgaatatttactactaccttgaagatgactccatgagtgtaatcgagcctgtggtggagaactcaggaatcctgcaaggaaaactgattaagaggcaacggctcgcgaaaaatgaccgcggggatcattatcattggaaagacctgaatagaggcattaatatcaccatctacggaaagaccttccgagtggtcgactgtgaccaattcactcaagtgtttttagagtcacaaggtattgagctcaatccaccagagaagatggcattggacccgtatacagaactccgcaaacagcctctcagaaaatacgtgaccccctctgacttcgatcagctcaagcagttcctgacattcgacaagcaggtgctgcggttctacgcaatctgggatgataccgattccatgtacggtgagtgtcgcacttatatcatccactattatctcatggacgataccgtggagatccgggaagtgcatgaacggaacgacggccgcgacccctttccactcctaatgaaccgccaaagagttcccaaggtcttagttgaaaatgcaaagaattttcctcagtgcgttttggaaatctctgaccaagaagtgctcgagtggtacactgccaaagattttattgtcggcaaaagcctgacaatcctgggccggacattctttatctacgactgtgacccttttacacgccgttattataaagagaagtttgggattacggacttgccgagaatcgacgtgagtaagcgagagcctcctcctgtaaagcaggagctcccaccctataacggcttcgggctcgttgaggactctgcacagaattgttttgctctgatccccaaggcgcctaaaaaagacgtgatcaagatgcttgtgaatgataacaaagtgctccgatatttggcagtgctggagagtcccataccggaggacaaggatcggaggttcgtcttcagctatttccttgctaccgatatgatctccatttttgaaccacccgtgcggaacagcggtatcatcggcggcaaatacctgggtaggactaaggttgtcaagccctatagcaccgttgacaatcccgtctactacgggcctagcgatttcttcattggagccgtaatagaggtgtttggacacaggttcattattctggacaccgacgagtacgtgctcaagtatatggagtcgaatgcagcccagtacagtccagaggcattggcttccatacagaatcacgttcggaaacgcgaagcccctgctccagaggcagaatccaagcagacggagaaggatcctggggtgcaggagctggaggctcttatcgacaccatacagaagcaactgaaagaccactcctgcaaggacaacatcagagaagctttccagatctacgacaaggaagcctctggatacgtggaccgcgatatgtttttcaaaatatgcgaaagcctcaatgttcctgtggacgatagtttggtgaaagagttaattagaatgtgtagtcacggagagggtaaaataaactattacaacttcgtgagggccttctctaattag

SEQ ID NO: 115537 - DNA, 1653 bp, Artificial Sequence
  Description of Artificial Sequence: Synthetic coding sequence
atgtcctggcctgtactaaaatttgacgcttatttccaagaggatgtgccaatgagtaccgaggaacagtatcgaattaggcaggtgaacatatactactatctggaggatgattccatgagcgttatcgagcccgtcgtggagaattcgggcatattgcaggggaagcttattaagcgccaaagactggcaaagaacgataggggggaccattatcactggaaggacctcaatagggggattaatattaccatttatgggaagacgtttcgagttgttgactgcgaccagttcactcaggtctttctcgagtcacaaggtatcgagctcaaccctccagaaaaaatggctctcgatccatacacagagctgagaaagcaacccttgagaaagtatgtcacaccctcagacttcgaccaactcaaacagtttcttacattcgacaaacaggtcttgcgattttatgccatttgggatgacaccgacagtatgtacggggagtgtagaacctatatcatccactattaccttatggacgataccgtcgaaatccgagaagtgcacgagaggaacgacggccgagaccccttcccgctgctcatgaatcgccaaagggtccccaaggttctggttgagaatgctaagaactttccacagtgcgtcctagaaatcagcgaccaggaggtgttggagtggtatacagcaaaagacttcatcgtgggaaaaagtttaacaattcttgggcgcactttcttcatctacgattgtgaccctttcaccagaagatactataaagaaaagttcggtatcacagatctcccaaggatcgacgtctccaagcgagagcctccacccgtgaagcaagagctccccccatacaacggttttggtcttgtggaagactcagctcagaactgcttcgctctcattcctaaggccccaaagaaggatgttataaagatgcttgtgaatgacaacaaagtgctccgatacctcgccgtcctggagagtcctataccagaggacaaggacagacgctttgttttcagttattttctggcaacagatatgataagcatcttcgagccacctgtacggaattcgggaatcatcggcggcaagtatctgggaaggaccaaagtggtcaaaccctacagcacagtggataatcctgtttactatggcccaagtgacttcttcataggcgcagtgattgaggtcttcggccacagattcataattctcgacacggatgaatacgtccttaaatatatggagagtaatgctgcgcagtatagcccagaagccctggcaagtatacagaatcatgtgaggaagcgcgaggcacctgcacccgaggctgaatccaaacaaactgagaaggatcctggcgtgcaggagctcgaggcattgatcgacacgatacaaaaacagctaaaggatcatagttgtaaagacaacatcagggaggcctttcagatttatgacaaggaagccagcggttacgtggaccgggacatgttcttcaaaatttgtgaatccctcaatgtgccagtcgacgattccctggtgaaggaagtcacctgcaaacgactgctcctccctgccttcaccttcccttcacccgtttggatccccttgtgtggcctatag

SEQ ID NO: 115538 - DNA, 1866 bp, Artificial Sequence
  Description of Artificial Sequence: Synthetic coding sequence
atgctgaaaacagctttccatcggtcacagaccttatcttacagaaacggttatgccatcgttcggcgccccaccgtgggtataggaggcgaccggctgcagttcaaccaactgagccaggctgaacttgacgaactggcaagcaaggcacctgtattgacctacgggcagccaaaacaggctcccccagccgatttcatccccgcccacgttgcctttgacaagaaagtgttgaagttcgatgcttacttccaggaggatgtgcctatgagcactgaagaacagtatagaatccgacaagtcaacatttactattacctggaggacgactcaatgtcggtgattgagcctgtggtagagaattccggcatcctgcaaggcaagttgatcaaaagacagagactagctaagaatgaccgaggcgaccactatcactggaaagatttgaatagagggatcaatattaccatttacggcaaaaccttccgcgtcgtggattgcgaccagttcacacaggtgtttctggagagccagggtattgaattgaatcctccagaaaagatggcccttgacccatacacagagctgaggaaacagcccttgagaaagtatgtgaccccatcagacttcgaccagctgaaacagtttttgacctttgataaacaggtgttacgattttacgcgatttgggacgatacagattccatgtatggggagtgcaggacttacatcattcattattaccttatggacgacactgtagaaatcagggaagttcacgagagaaatgacggtcgggaccctttcccgctactcatgaacagacagagggtaccaaaagtgcttgtggaaaacgctaaaaacttcccccagtgcgtcctcgagatcagcgaccaggaggtcttggaatggtatactgctaaagattttatcgtcgggaagtccttgacaattctcggcagaaccttcttcatttatgactgtgacccattcactagaagatattacaaggagaagtttggaatcaccgatttaccacgtattgatgtatctaagagggagccccctcctgtgaagcaagaattgccaccatacaacggctttgggcttgttgaagactccgctcagaattgttttgccttgatacctaaggcccccaaaaaagatgtcattaaaatgttagtgaatgacaacaaagttttacgatacctagccgtcttagaaagtcccattcctgaagacaaagatcgcagattcgtgttttcctactttctcgccacagacatgattagcattttcgaaccgcctgttcgaaactccggtataatagggggaaaatatctcgggaggacaaaagttgtcaagccctattctactgtcgataacccagtctactatggcccatcggacttttttatcggcgctgtgatcgaagtgtttggtcaccgctttatcatcttagacacagacgaatacgtgctgaagtacatggagtccaatgctgcacaatacagtcctgaggccctggctagtattcagaatcacgtgaggaaaagagaagctcccgccccagaggccgaatcaaagcagacggagaaggaccctggtgttcaggagttagaggcgctgatcgacacgattcaaaagcagctgaaggatcacagctgcaaggacaatattagagaggcctttcagatttacgataaagaggcctctggatacgtagatcgggatatgttttttaaaatctgtgaatccctgaacgtaccggtcgatgattccttagtgaaggagcttatccgaatgtgtagtcacggcgaaggcaaaattaattactataattttgtgcgcgccttctccaactag

SEQ ID NO: 115539 - DNA, 2250 bp, Artificial Sequence
  Description of Artificial Sequence: Synthetic coding sequence
atggccctgccactgttacccgggaactctttcaacaggaatgtcggcaaagagaagttccacaagagtcagcactggggcttttgcaataacgttatgatgctggtatcagatgagaaaccggggatcggaggagagcctctcctgggccagaaaatcaagccaaagtgctctatatatcccaagggcgacggatctgatgtcccgtcatgggtggctttcgataaacaggttctgtcgtttgacgcttacttggaggaagaggttctagacaagagccaaacaaactaccggatcagatactacaaaatctacttctatcccgaagacgatacgatacaggtaaatgagcctgaagtgaagaacagcggcctattgcaaggaacatctatccgccgacatcgcatcacgctgccacctcctgacgaggaccagttctacactgtgtaccatttcaatgtcgggacggaggtggttttctatggcagaacatttaagatatacgactgtgacgcattcacacgcaactttctcagaaaaattggagtgaaggtcaaccctcccgttcagtgcccagaggacccatatatgaagataagacgtgaagtggtggaacacgttgaacccctgcgcccttatgaatccctggataccctgaagcagttcctccagtatcacggcaagattctctgttttttttgcttgtgggacgattcggttagcatgtttggcgaccgacgcgagcttatcttacactactttctctgcgatgatacaatcgaaatcaaggaactactgccgcattcgtccggacgagacgccttgaaaatgttcctgcgacgatctaagttgccaaaaaattgtccaccacgtgtgtaccagccaggacagattactgatagagccgtgctgaattcttatggcgacttcatcaagaaccaggcagatggctacctttttgatagatataagctgggaaaagtggatcaggaattctataaggattctgatctttccctgggcgtcacaattaacgtgtggggaaggaaggtgcttctgtatgattgcgacgagttcacgaaaagctactataagagtaaatacggaatcgaaaactttacctccgtgtcatgtaaaccgccatcccccccccccaagatcgagcggaagttccctccttataatggcttcggcagtgaagaggactccttacggaactgcattgatctcaaacccacaccccatcggcgtaactttaaaaagttcatggaaaaagattcatatggtagtaaaagcaacatcctgcgcttttttgctaagctcgtcactgacaaatgtgtggacctggacaggatgtttgtcattagctattatctcggtgacgacacaatttcagtgttcgaaccgatcgagcgaaactcagggatcgctggcggaatgtttctcaagagaagtagagttaaaaaacctggccaagaggtgttcaaatccgagctgtctgagtacattaaagccgaggaactttacatcggcgttacagtgaatgtcaacggttatttgttccgcctgctcaacgccgacgagtatactcttaattatatggagcaaaacactgataagtaccctttctcaaatctgaagctggcactccagaagctgaagcaggaggaaggaaagagtcgggagcttaagcaggtgttcaaagctgctgactcgaaacatacaaatatggtggactacaatacctttcgggacattttaatgtcgctgaccgttgggaaccttgctgagcaggaattcgtgactatcgcccggcactaccgcgtgcctgagggaacctgcagcgacatggatttcctaatcgccctggcacacgaaaagtttaagaaaaatatgttcgaaaacttcgacaccttcatttacagctgtgtctatgaagatcgagaaaagaaaaatgtactgccaacaaaggacatcaagcgactgtgtaagagctctcggctccccttgagcgatgatcttcttgagagcctcctgtccagattcgaagatagtgagaagcagattgactacaagagttttttctctgcattgaactggagaaaaaaccctgtgccggagctccagccagcatcctatctgaaggagcgctgtgaagacgtttggctcggtatgccttccccaatccctgccaagtacatcgactattggacctttctgaaggatgcctttgggcttgaagaagagtag

SEQ ID NO: 115540 - DNA, 489 bp, Artificial Sequence
  Description of Artificial Sequence: Synthetic coding sequence
atgtcccttacagtcggaaacctggctgagcaggaatttgtcacgatagccaggcattatagagtccccgaaggtacctgtagcgacatggacttcctgatcgctttagctcacgaaaagtttaagaaaaatatgttcgagaactttgacaccttcatctattcctgtgtgtacgaggaccgagagaagaaaaatgttttacctaccaaggacattaagcggttatgcaagtcaagtaggctacccctgtcagatgatctcctcgaaagtttgctatctcggttcgaagacagcgaaaagcagattgattacaaaagtttctttagcgccctcaattggcgtaaaaacccagtcccagaactgcagccagcttcttatctgaaagagaggtgtgaggatgtttggctggggatgcctagtccaatcccagcaaagtatattgactactggaccttcctcaaggacgcctttggcctggaagaagaatag

SEQ ID NO: 115541 - DNA, 753 bp, Artificial Sequence
  Description of Artificial Sequence: Synthetic coding sequence
atgaagattcggagagaagtggtcgaacacgtggagccgctgaggccctacgagtcactggacacactcaagcagtttctacagtaccatggcaaaattttatgttttttctgtttatgggacgatagcgtttcgatgttcggcgataggagagaactcatactgcactattttctgtgtgacgacaccatcgagattaaagaactgcttccccactcaagcggacgtgatgccctgaaaatgtttttgcggagaagcaagctcccaaagaactgcccaccgagggtgtatcagcctggacagattaccgatagggccgtgttgaatagctacggagatttcattaagaatcaggccgatgggtacctattcgacaggtacaaactggggaaggttgaccaggaattctacaaggactcagacctgagtttgggcgtgacaattaacgtgtggggaaggaaggttctgctgtacgactgcgatgaattcacaaagtcctattacaaaagcaagtatgggattgaaaatttcaccagcgtaagctgcaaacctcccagccctcccccaaaaattgaaagaaagtttccaccttataacggcttcggatctgaggaagattcacttcggaactgcatcgacttgaagcctaccccccatcgaaggaactttaagaagttcatggagaaggattcctacggaagcaagtcgaatatcctgtttttttgtaagacaagccatcgccagatgtgctag

SEQ ID NO: 115542 - DNA, 2334 bp, Artificial Sequence
  Description of Artificial Sequence: Synthetic coding sequence
ggcggccagacaacacgaccaggcggggctgcggcctgcagggctctgtcctctggcacactggacttcaggacattgtccgccatggccctcccactgctacccggcaactccttcaatagaaacgttggcaaagagaaattccacaaaagtcaacactggggcttttgcaacaatgtcatgatgctggtgagcgatgaaaagcccggaatagggggagagccgcttctgggccagaaaatcaaaccaaagtgttctatctatcccaagggcgatggctccgacgttcctagctgggtggccttcgacaagcaggtgctctctttcgatgcatacttggaggaggaagtactggataaaagtcaaaccaactataggatacgctattataagatctacttctatcctgaggacgatactatccaggtgaatgaacctgaggtaaagaattctggccttctgcagggaacatctattaggcgccatcgcattacgctgccgcctccggacgaggatcaattctacaccgtttatcactttaacgttggcacagaagtggtgttttatggccgcacctttaaaatttacgactgtgacgcgtttacacgaaatttcctaaggaagatcggcgttaaggtcaacccgccggtgcaatgcccagaagatccctatatgaaaatcaggagagaggtagtggaacacgtagagcctctacggccgtatgagtcactcgatacactgaagcagttcctgcagtaccatggcaaaatactatgtttcttctgtctctgggacgatagtgttagcatgttcggggataggcgcgagctcatcctgcattacttcctctgtgatgacaccatagagatcaaggagctcctgccgcattcctccggcagagacgccctgaaaatgtttttacgtagatccaagctacccaaaaattgtcctcctcgggtgtatcagcccggccaaatcactgaccgagccgtactgaactcctatggcgattttatcaagaaccaggcagacggttatctttttgatcgctacaaactgggtaaagttgaccaggagttctacaaagactccgatctcagcctgggcgtcacaatcaacgtatggggccggaaagtcctcttatacgactgcgacgagtttacaaagtcttactataaaagcaagtacggcatcgaaaattttactagcgtgtcatgtaaaccgccctctcctccgcctaaaatcgaaaggaaatttccaccatacaatggattcggctccgaggaggactctctgcgtaattgtatagacctgaagcccaccccccacaggagaaactttaaaaaattcatggagaaggattcgtacggcagtaagagcaatatcctaagatttttcgcgaaattggtcactgataagtgcgtcgatctggatcgaatgttcgtgatctcgtactatttgggagacgatacaatctccgtctttgagccaatcgaaagaaattcaggtatagccggcgggatgttcttaaagcgtagtagggtgaaaaagccagggcaagaggtgtttaagtccgagctctccgagtacatcaaagcagaagagctgtatatcggagtgaccgttaatgtaaatgggtatttgtttagactcctcaatgccgatgagtacactctgaattacatggaacagaataccgataaatatcccttttctaaccttaagctggcccttcagaagctgaagcaggaggaaggcaagtctagagagctgaaacaggtgtttaaggccgccgattctaaacatactaacatggtcgactataatacattccgcgacatattaatgagcctgactgtggggaacctggccgagcaagaattcgttaccatcgcccgccattatcgtgtgcccgaggggacctgtagtgacatggacttcctcatagctctagcccacgaaaaatttaaaaaaaatatgtttgagaatttcgacacgtttatctactcatgtgtgtacgaagatcgtgaaaagaagaacgtgctcccaaccaaagatataaaacggctgtgcaagagctctcgtctgccactttctgacgatcttcttgaaagcctgctcagtcggtttgaagattcagagaaacagattgactataaaagcttcttcagcgccctgaactggcgtaagaaccccgtgccggagttacagccggcgagttatctgaaggagagatgcgaagatgtctggttgggcatgccctctcccatcccagccaagtacatcgattattggacctttctgaaagacgcattcgggcttgaagaggagtag

SEQ ID NO: 115543 - DNA, 2193 bp, Artificial Sequence
  Description of Artificial Sequence: Synthetic coding sequence
tgaaataatacagcaggccgacggcggtgcttacccggtccgctcttctgggatccaggcttttcagacactgagcggcatggacctgcctctgccgcaggccagcaacttcaacctcagcgggagaaaggcgacgggagtgatgtgcccagttgggttgcatttgacaaacaagtgctctctttcgacgcctacttagaagaggaggtcctcgataaaagtcagacgaattaccgtattcgctactataaaatttacttttaccctgaagacgataccatacaggtgaatgagcccgaagtgaaaaacagcggattgttgcaagggacctccatacgccggcaccggatcaccctgccgcctcccgatgaagatcagttttacaccgtttatcactttaacgtcggaacagaagtggtattttacgggcgtaccttcaagatttatgattgtgatgccttcacacgaaactttctcaggaagattggggtaaaagtgaaccctcccgtgcagtgccctgaagatccgtacatgaaaataagaagggaggtggttgaacatgtggaacctttgagaccctatgaatcgcttgacaccctaaagcagttcttacaataccatggcaagattctgtgctttttttgcctgtgggatgattctgtatcgatgttcggagaccgacgagaactaatcttgcactattttctttgcgacgatacaatcgagattaaggagttactgcctcacagttctggcagggatgccctgaaaatgtttctgcggagatccaagctgccgaagaactgtccgccacgagtttatcaaccaggacagataaccgatcgggccgtacttaactcttacggggacttcattaagaaccaggccgatggctacctcttcgataggtacaagctcggtaaagtcgatcaagagttctataaagacagtgatctgtcactgggcgttacgatcaatgtctggggtcggaaggtgttgctgtacgactgtgatgaattcaccaagtcttactacaaatctaagtatgggattgaaaattttacctctgtttcctgtaagcccccgtcgcccccaccaaagatcgagagaaaattcccaccatataatggcttcggaagtgaggaggacagtctccgtaattgtattgacctgaaaccaacccctcatcggagaaatttcaagaaatttatggagaaggactcgtacggtagcaagagcaacattctcagatttttcgctaagcttgtgaccgataaatgtgtagatcttgaccgcatgtttgtaatatcttactacctgggggacgacaccatttcagtgtttgaacccattgaacggaatagcggcattgcaggaggaatgtttctgaaaaggtctcgcgtaaaaaaacctggccaagaagtttttaagtctgaattgtccgaatacattaaagcggaagaattgtatattggcgtgaccgtcaacgtcaatggctatctgttcagattgctgaacgccgacgagtacacccttaattacatggaacagaacaccgacaagtatcccttctcaaacctaaagctggcactgcagaagctcaaacaggaggagggtaaatcaagggagctgaaacaagttttcaaggccgccgactcaaaacatacaaacatggtggactacaacaccttcagggacatcctgatgtctttgacggtgggaaatctggctgaacaggagttcgtaactatcgcccgacactatcgcgttcccgagggaacgtgttcagatatggattttctgatagctctcgcgcatgagaagttcaaaaagaacatgtttgaaaatttcgacacctttatctatagctgcgtctatgaggaccgcgagaaaaagaacgttcttccaaccaaagacatcaaaaggttgtgtaagagttcccgtctacctctgtctgacgacctattggaatctttgctgtcaagattcgaagattctgaaaagcagatcgattataagtctttcttctccgccctgaactggagaaagaatccggtgcccgaactgcagcctgcctcctacctcaaggagagatgtgaggacgtgtggcttgggatgccgtctccaattccagcaaaatacattgactactggaccttcttgaaggacgcgtttggactggaagaagaatag

SEQ ID NO: 115544 - DNA, 720 bp, Artificial Sequence
  Description of Artificial Sequence: Synthetic coding sequence
atggcatctgaagagctggcgtgtaagttggagcgcaggttgcgaagagaagaggctgaggagagtggcccccagctggcccctctcggcgccccagcacctgagcccaagcctgaacctgagccacctgctcgggcaccgacagcctctgcagacgcggaactgagcgcacagctttctagaaggttggatattaatgagggcgctgcacggccgagaagatgtagagtgttcaacccctatacggagtttccagagttctcaaggcgtcttatcaaagacttagagtcgatgttcaaactctatgacgcgggacgagacggatttattgacctgatggagcttaaactgatgatggaaaaattgggtgcaccgcaaacacacctcgggttgaagagcatgattaaagaggttgacgaagatttcgacggcaagctgtcatttcgggaatttctgctgatattccataaagccgcagcaggcgagctccaagaagattccgggctaatggccctggcgaagcttagtgaaatcgatgttgctctagagggggtaaaaggcgctaagaatttttttgaggccaaggttcaagcactgtcctcggcctctaagtttgaagcggagctgaaggccgagcaagatgagcgcaaacgtgaggaggaagagaggcgcttacgccaggccgccttccaaaagctgaaagctaactttaatacatag

SEQ ID NO: 115545 - DNA, 432 bp, Artificial Sequence
  Description of Artificial Sequence: Synthetic coding sequence
atgggggaactgcagtacgacgcagggagagacggctttattgatctgatggagctgaaattgatgatggagaaactcggcgctcctcaaactcatcttggcctaaagagcatgatcaaagaggtggacgaagattttgatgggaaattgagttttagagagttcctgcttatctttcataaggcagcggccggcgagctgcaggaggacagtggattgatggcactcgccaaattaagtgaaatcgatgtcgccctagaaggggtgaagggggctaaaaacttcttcgaggctaaagttcaagccctgagctctgcttcaaagtttgaagcagagttaaaagccgagcaggacgagagaaagcgcgaagaggaggaacggcggctcagacaggccgctttccagaaactgaaggccaacttcaacacatag

SEQ ID NO: 115546 - DNA, 384 bp, Artificial Sequence
  Description of Artificial Sequence: Synthetic coding sequence
atggagctgaaactgatgatggagaagctcggcgccccgcagacacacctcggcctcaagtcaatgattaaggaagtggatgaggactttgacggaaaactcagcttcagggagttcctactgatctttcataaagctgccgctggggagctccaggaggatagtgggctcatggccctggcgaagctttccgagatcgacgtcgccttagagggcgtcaagggggccaaaaactttttcgaagctaaggttcaggccctgtcgtcagcaagcaagtttgaggcggaactgaaagctgagcaggatgagagaaagagagaggaagaggaacggcggctgcgtcaagctgcctttcaaaagctaaaggccaattttaatacctag

SEQ ID NO: 115547 - DNA, 384 bp, Artificial Sequence
  Description of Artificial Sequence: Synthetic coding sequence
atggaactgaaacttatgatggagaagctcggcgcaccccaaacccatctgggattgaaatccatgataaaagaagtggacgaggacttcgatggaaagctcagtttccgggagtttctattgattttccacaaggccgcagccggtgagctccaggaggatagtggcctaatggccctggcaaagctaagcgaaatcgatgtcgccttggaaggagtcaaaggggcgaagaattttttcgaagcaaaggtgcaagccctaagtagcgcgagcaagtttgaagctgagctaaaagctgagcaggacgaacgcaaaagggaagaagaggagcgccggcttcgtcaggccgccttccagaaactgaaggctaatttcaatacttag

SEQ ID NO: 115548 - DNA, 429 bp, Artificial Sequence
  Description of Artificial Sequence: Synthetic coding sequence
atgtttaaattatacgacgctggtcgcgacggttttatcgatctgatggagctcaagctgatgatggagaaactgggagcccctcagactcatctaggcctcaaatctatgattaaagaagtggacgaggacttcgatgggaaactctcctttcgcgaattcctgttaatctttcacaaggctgcagctggggagctgcaagaggatagtgggctcatggcactggctaaattgtctgaaatcgacgtggcactagagggcgtgaaaggcgctaaaaactttttcgaggcgaaagtccaggcattgtcctccgcctctaagtttgaagccgagttgaaggcagaacaggacgaaagaaaacgtgaggaggaggagcggcgcctacgacaggccgcatttcagaagctgaaagcaaactttaatacttag

SEQ ID NO: 115549 - DNA, 2466 bp, Artificial Sequence
  Description of Artificial Sequence: Synthetic coding sequence
atgccaacccgggtttgctgctgttgttccgctctgagacctcgctacaaacggctagtagacaatatcttccctgaggatcccaaggatggattagtgaaaacggacatggagaagctgacattctatgctgtgtctgctcctgagaaattagacaggataggatcctacttggctgagcgacttagccgggatgtggtaagacaccggagcgggtatgtgcttattgccatggaagccctggatcaactactgatggcctgtcactcccagagtatcaaacctttcgtcgaatcattccttcatatggtggcaaaactgttagagtctggagagcccaaattgcaagtactgggaactaattccttcgtgaaatttgcaaatatcgaagaagatacgccctcataccaccgacggtacgactttttcgtgtcgcgttttagcgcgatgtgccatagctgccactctgatcccgagataaggactgaaatccgcattgccggcatcaggggtatccagggtgtagtcaggaaaactgtgaacgatgaactgcgggccacaatttgggaaccccagcatatggataagatcgtccccagccttctgtttaacatgcagaagattgaagaggtggacagtcgcatcggtccgccaagctcaccctcagctacagataaagaagagaaccccgcggtgttagctgaaaattgttttcgagagctgctcggacgtgctaccttcggaaacatgaacaacgccgtcaggcctgtcttcgctcatcttgaccatcataagctatgggaccctaacgagtttgccgtgcactgctttaagataatcatgtatagtattcaggcacagtatagccaccatgtcattcaggagatcttaggacacttagacgcccgaaagaaagacgctccaagggtgcgcgctggaatcattcaagttctcctggaagcagtcgcaattgccgccaagggatctattggacctaccgttctcgaagtgtttaatacgcttctgaaacaccttcgattgagcgtggaattcgaggctaacgacttgcaggggggaagcgtgggatcggtgaacttaaacacctcttcaaaagataacgacgagaagattgtgcagaatgccattatccagacaatcggcttttttggctcaaacctgcccgattatcagcgctccgagatcatgatgttcatcatgggtaaggtgccggtgttcggcacaagcacacacaccctggacatctcccagctaggggacctgggaacccgcaggatccaaatcatgttgcttaggagcttactcatggtgacttcggggtacaaggccaaaactattgtgaccgcactgcccggcagttttctcgaccctcttcttagtccttccctcatggaggactatgaactccgtcagttggtgctggaggtgatgcataacctcatggaccgccatgacaatcgggctaagctgaggggaatcagaatcatacccgacgtcgccgacttaaagatcaaacgcgaaaagatctgccggcaagatacatccttcatgaagaagaacggccagcagctgtaccgccacatctatctgggatgcaaggaggaagataacgtgcagaaaaattatgaattattatacaccagcctcgctctgatcacaatcgagctggccaatgaggaggtagtgattgatcttattcgactcgctatcgctttacaggatagcgctatcatcaacgaggacaatctgcctatgtttcatcgctgcggcatcatggcactggtggcagcatatttaaacttcgtcagccagatgattgccgtgccagctttttgtcagcatgtgtctaaggtcatcgaaatccggactatggaagccccctatttcctcccagaacatatctttcgggataagtgcatgttgcccaagtctctggagaaacatgagaaggatttgtactttttgactaataagattgcggagtccttgggagggtcaggatattcagtcgaacgtttgtctgtgccatatgtaccacaggtgacagacgaagacagactttctcgtcggaagtctatagtggacacggtttctattcaagtcgacattctatctaacaatgttccttccgatgatgttgtgagtaacacagaagaaataactttcgaggcccttaagaaggcaatcgacacgagcgggatggaggagcaggagaaggaaaagcgtaggcttgttatcgagaaattccagaaagcccctttcgaggaaatcgcagcacagtgtgagtcaaaggctaatctgctgcatgaccgcctagcacaaatcctagagctaaccatcagaccacctccttccccttcaggaacattgacaatcacttcgggtcacgctcaatatcagtccgttccagtttatgagatgaagttcccggatctttgcgtgtactag

SEQ ID NO: 115550 - DNA, 2466 bp, Artificial Sequence
  Description of Artificial Sequence: Synthetic coding sequence
atgaaatcacgtgtgtgttgctgctgttcagccctgcggcccagatacaagagacttgtcgataatatttttcctgaagatcccaaagacggcctcgtaaaaactgacatggaaaagctcaccttttacgctgtgagcgctcctgagaagcttgacagaattgggtcctacctcgccgaaaggcttagcagggacgtcgtccgccacaggagtgggtatgtgcttatcgccatggaggctcttgatcagcttctgatggcgtgccattctcaaagcattaagccatttgtcgagtcctttttacacatggtggccaaactcctggagagcggggagccaaagttacaggttctcgggacaaactcatttgttaagttcgcgaacattgaagaagacaccccatcttaccatcgccgatacgatttttttgtgagtcgtttcagtgccatgtgtcattcttgccactctgatccagagatccggacagaaattcgcattgcaggtatcaggggaattcagggggtggtgcggaaaactgtcaacgacgaattgagagctaccatttgggagccgcagcatatggacaagatagtgccctccctgctgttcaatatgcagaaaatagaggaagttgactcaaggattggccctcccagttcaccatccgccacggacaaggaagaaaatcccgcggttcttgccgaaaattgcttcagagagttacttggcagagcgacttttggaaatatgaataatgccgtaagacctgtgttcgcccatctggatcaccacaagctttgggaccctaacgagttcgccgttcattgtttcaagatcatcatgtattccatccaggctcagtatagccatcatgtgatccaagaaatcctggggcacctcgacgcgcgtaaaaaggacgccccacgggtgcgagccgggatcattcaggtactgcttgaggccgtcgccatagccgccaagggtagcattggaccgactgttttggaggtgttcaacactttattaaagcacctgcggctgagtgtagagttcgaggcaaacgatctgcaagggggcagcgtaggcagcgtgaacctgaacacgtcatccaaggacaacgatgaaaagatcgtccagaatgcgatcattcagactatcgggttcttcggtagcaatttgccagattatcagagatccgagattatgatgttcatcatgggcaaggtccctgtgttcggcacttctacccacactcttgatattagccagttaggagacctgggaacaaggcgcatccagatcatgctcctgaggtccctgctgatggtgaccagcggatacaaagccaaaacaatcgttacagctctccccggcagcttcctggacccactgctatcaccctccctcatggaggactacgaactccgacagctggtgctggaggtgatgcataacttgatggatcggcacgacaaccgggcgaaacttagggggatccggattatccccgatgttgccgacctgaaaatcaaaagggagaagatatgccgccaggacacttctttcatgaaaaaaaacggccagcagctgtatcggcacatttacctcgggtgcaaggaagaggacaatgtgcagaaaaattacgagctgctgtatacctccctggctctcatcacaatagagctagcaaatgaggaagtggtgattgacctgattcgcctggcaattgcgctgcaagactccgctataatcaatgaggacaatctgccgatgtttcatcggtgtggcatcatggcgttggtcgccgcttatctcaatttcgtctcccagatgatcgcggtcccagctttctgtcaacacgtgtctaaggtgatcgaaatcaggactatggaagctccctacttcctgccagagcacatttttagagacaagtgtatgcttccaaaatcgttagaaaagcatgaaaaagacctctacttcctcacaaacaagatcgctgagtcactcggtggctctggctactcagttgaaaggctctccgttccctacgttccacaggtaacggacgaggatcgcttgtccaggaggaaaagtatcgtcgacacagtaagcatacaggttgatatcctctctaacaatgtgcccagtgacgacgtagtctcaaacactgaagaaattactttcgaagccctgaagaaggccattgatacctcagggatggaggagcaggagaaagagaaacgccggctagtgattgagaaatttcagaaggccccgtttgaggaaatcgccgcgcaatgtgaatcgaaagctaacctgcttcacgataggctggcacagatcctagaactgaccattaggccccctcccagccctagcgggaccctaacgatcactagtggacatgctcaataccaatctgtccctgtgtatgaaatgaaatttcctgatttgtgcgtttactag

SEQ ID NO: 115551 - DNA, 2334 bp, Artificial Sequence
  Description of Artificial Sequence: Synthetic coding sequence
atgcctaagggtgtttgttgttgttgttccgccctccgcccccggtacaagcgcctggtggataacatcttccccgaagaccccaaggatggccttgtcaagaccgacatggagaaattgaccttctacgctgtcagcgcccccgagaagctagatagaatcggctcgtatctggccgagagattgagtagagacgtggtgcggcacagaagtggatacgtgctgattgctatggaggctctcgatcaactgcttatggcttgccacagccagtctatcaaacctttcgttgagtcatttttgcatatggtggctaaactgctcgagtccggagaaccaaagcttcaagtcctcggcactaattcctttgttaaattcgcaaatattgaggaggacacccctagttaccatcggcggtatgacttcttcgtgtccaggttcagtgctatgtgccactcttgccactccgatcccgagatccggacagaaatccgaatcgccggcatccgcggtatccagggggttgttaggaagacagtcaacgacgagctaagggccaccatttgggagcctcagcacatggataagatcgtgcccagtctgcttttcaatatgcaaaagattgaagaggtcgactcccggatcggccctccaagttcgccgagtgcgacagacaaagaggagaatcctgctgtgcttgctgaaaactgcttccgcgaactcctggggcgtgccacattcgggaacatgaataacgccgtgcgccccgtatttgcccacctggaccatcacaagctgtgggatccaaacgaatttgcagttcactgtttcaagattatcatgtactccatccaggcccaatatagtcaccacgtcatccaggagatccttggtcacctggatgctcgcaagaaggatgcacccagggtgcgggccggcatcattcaggtcctgctcgaggctgtggccattgctgccaagggaagcatcggccccacagtgttggaagtcttcaacaccttactgaagcatcttcgactgtctgtcgagtttgaagctaatgacctgcaggggggcagcgttggcagtgtgaacctcaatacatccagtaaagataatgacgagaaaatagtccaaaacgcaattattcagaccatagggttcttcggttctaatcttcctgattaccagaggagcgagattatgatgtttatcatgggcaaggtccccgtttttggcaccagtacccacacgctagacatcagtcagctgggggacctgggtactaggaggatccagataatgttgctgagatcgctgctgatggttacgagcggttataaagccaaaactatcgttactgccctccctggaagtttcttggaccccctcctgtctccctccctgatggaggactacgagcttcgccagctggtgctggaagtgatgcacaacctgatggatagacacgataaccgtgctaaactgagagggatccggatcatccccgacgtcgctgacctcaagatcaagcgagaaaaaatctgccgccaggacactagcttcatgaagaagaacgggcagcagctgtatagacatatttacctggggtgtaaggaggaagacaatgtgcagaagaactacgagctactctacacttcactagcgctcataacaattgagctggccaacgaggaagtagtgatcgacttaatccgcctggcaatcgctctgcaggacagcgcaatcataaatgaggacaacctgccgatgtttcacagatgcggtataatggcactggtcgcggcctatttgaatttcgtcagccagatgatcgcggtcccagcattctgccacaagattgcagagtctcttggtggctccggctatagcgtggagcgcctgtcagtaccttacgtgcctcaggtaactgatgaggatcgccttagccggagaaagtctatagtggatacagtcagtatccaagtggacatcctgagtaacaatgtgccaagcgatgacgttgtttcaaacaccgaggagattacttttgaagcactaaagaaagccattgacacaagcgggatggaggaacaggagaaagaaaaacgcaggttagtcatcgagaaattccagaaggccccattcgaggagatagccgcgcagtgtgagtccaaggccaatctgcttcacgaccggctggctcaaatactcgaactaaccatccgccctccaccgtctcctagcgggactctgacgataaccagcggccatgcccaataccaaagtgtccctgtctatgaaatgaaatttcccgacctctgtgtctattag

SEQ ID NO: 115552 - DNA, 603 bp, Artificial Sequence
  Description of Artificial Sequence: Synthetic coding sequence
atgctggctcgcctgctgaagttcgaagaggcaccctactttctgcctgaacatatctttcgagataagtgcatgttgcccaagagccttgagaagcacgaaaaagatctgtacttcctcaccaacaagattgccgagtcgttggggggttcggggtacagcgttgagcgactgtcagtcccctatgtgcctcaggtgactgacgaagaccggctaagtcggaggaagtctatagtcgacactgttagcattcaggtggatattctgtcaaacaacgtgcctagtgatgatgtggtctctaatactgaggagatcacgtttgaggcactcaagaaagccattgatacctctggtatggaggagcaggaaaaagagaaaaggaggctggtgatcgaaaagtttcagaaagctcctttcgaggaaattgccgcacaatgtgaatcaaaagccaatctactgcacgacaggcttgctcaaatactggaattgacaatccgccctccgccctctccatccggaaccctgactatcacctccggacatgcacagtaccagagcgtccccgtttatgagatgaagtttccagacctatgcgtatattag

SEQ ID NO: 115553 - DNA, 2358 bp, Artificial Sequence
  Description of Artificial Sequence: Synthetic coding sequence
atggagaaattaacattctatgccgtgtccgcacccgagaaattagatcgtatcggaagttatctcgccgagcgactgtcgcgggatgtggtcagacacagaagcgggtacgtattgattgctatggaagcactagatcagctcctgatggcgtgtcactcacagtccataaagccctttgttgaatctttcctccatatggttgcaaagttgctggaaagcggggagcctaagcttcaggtgctgggaacaaatagcttcgtaaaattcgcaaacattgaggaggacactccttcttatcaccgtcggtacgattttttcgtctcaaggttctcggcgatgtgtcatagctgtcactccgaccccgaaatacggaccgaaatacgaatcgcaggaatcagaggaatacaaggtgttgtcaggaagaccgtgaatgatgagctgagagccactatttgggagcctcagcacatggacaagattgtgccctccctgttgtttaacatgcagaaaatcgaggaagttgattcccgcattgggcccccctctagtccgagcgctacggacaaggaggagaatccagctgttctcgccgaaaactgcttccgcgagctgttgggaagagcaacatttggcaatatgaacaatgctgtgcgtcccgtgttcgcccacttagaccaccacaaactgtgggacccaaatgagtttgcggtccattgcttcaaaataattatgtactcgattcaggcccaatacagccaccatgttattcaggagatattgggtcacctcgatgctcgaaagaaagacgcgccacgtgtgcgcgcaggcatcatccaagtcctgctggaggcggttgccatcgctgcgaagggcagtattgggccaaccgtgttggaggtctttaataccctgcttaaacacctgcggctctccgtggagttcgaggctaatgacctgcagggaggcagcgtgggaagcgtgaatctaaatacgagctccaaggataatgacgaaaagatcgttcaaaacgccatcatccagactattggattcttcggatccaacctaccagactatcagagaagtgaaatcatgatgtttattatgggcaaggtgcctgtgttcggcacgagcactcacaccctggatatatctcaactgggggacctcggcacccgaagaatccagatcatgctcctgagaagtttactaatggtgacctcaggatataaggccaaaacaatcgtcacagctctccccggatccttcctggacccactgctctcccccagtctaatggaggactacgagctcaggcagctagtcctggaggttatgcataatcttatggatcggcacgataatcgggcgaaactgcgaggcattcgcatcatccccgacgtggccgatctgaagatcaaaagagagaagatttgccggcaagatacatcctttatgaagaaaaacggacagcagctgtacagacacatctatctagggtgcaaggaggaagacaacgttcagaagaactacgaactgctgtacaccagtcttgcacttatcaccattgagctggccaacgaggaagtggtgatcgaccttatccggctcgctatcgcactgcaggactcagcaatcataaacgaggacaatttgcctatgtttcatcgttgcggcataatggccctggtagctgcctatttgaatttcgtaagccagatgattgctgtgcctgccttctgccagcacgtgtcgaaggtcattgaaataagaacaatggaagcaccttactttcttccggaacacatcttcagggataaatgtatgctgccaaagtcccttgagaagcacgaaaaggacctgtatttccttaccaacaaaattgctgagagcctgggcggctcagggtattctgtagaaagactgagcgttccttacgtgccacaggtgactgatgaggatcgcctctcccgtagaaaaagcattgtagacacagtgagcattcaagtagacatcctctcaaacaatgtgcccagcgatgatgtggtgtctaacacagaagagattacattcgaagcattaaaaaaggccatcgatacgtcaggaatggaggagcaagagaaggaaaagagacgtctggtgatcgagaagttccagaaagcgccattcgaggagattgccgcccagtgcgaatccaaagccaatcttctacatgatagactcgctcagatcctcgagctcaccattagaccacctccttctccatcgggaaccctcactatcacatcaggacacgctcaataccagagcgtgccggtctatgaaatgaagttccccgacctctgtgtctactag

SEQ ID NO: 115554 - DNA, 1482 bp, Artificial Sequence
  Description of Artificial Sequence: Synthetic coding sequence
atgctcaaggcactgtttctaaccatgctcactctggcgttggtcaagtcacaggatacagaggagactatcacctatacgcagtgtacagatggttacgagtgggatcccgtgaggcagcagtgcaaagatatcgacgaatgtgatatcgtgccagatgcttgcaagggagggatgaagtgcgtgaaccattacggcggctacttatgcctgcccaaaacagcccaaattatcgtgaataacgagcagccgcaacaagagacccagcccgcagaaggaacaagtggcgcaactaccggggttgttgcagcgtcttccatggccactagcggtgtactgccaggcggtgggttcgtggcgtctgcggccgccgtggccggaccagagatgcagaccgggaggaataacttcgtgatcaggaggaaccccgcagatccacaaaggattccatctaatccctctcatagaattcagtgcgcggcaggctatgaacagagtgagcacaacgtgtgccaagacatcgacgagtgtacagccggcactcacaactgccgcgccgatcaagtctgtattaacctgagagggagttttgcctgtcaatgtccaccaggctatcagaaacgtggagagcaatgtgtagacatcgacgaatgcaccattccaccttactgtcaccagcgctgcgtgaataccccgggctccttctactgccagtgctctccgggatttcaactggcagccaataactacacctgcgtggacatcaatgaatgcgacgctagtaatcaatgcgctcaacagtgctataatattctgggttccttcatttgccagtgtaaccaaggttacgagctgtcatcagacagactgaattgcgaagacatcgacgaatgccgtacatcgtcctacttgtgtcaatatcagtgcgtaaacgaacccggcaagttcagctgcatgtgcccccagggttatcaggttgtgagaagcaggacatgtcaggatatcaatgagtgcgagaccacaaacgagtgccgcgaagatgagatgtgctggaattatcacggaggtttccgctgctatcctcggaacccctgccaggacccatatatcctgacacccgaaaatcggtgcgtctgccctgtctccaacgctatgtgtagagagctgcctcagtccatcgtatataaatacatgtctatccggtccgacaggtccgtacctagcgacatctttcagatccaggccaccaccatttatgcaaacacaataaacaccttcaggattaagtcgggcaacgagaatggtgagttttatctgcgacagaccagtccagtttctgcaatgctggtgctcgttaaatctttgagtggcccacgggagcacattgtggacctggaaatgctgacagtctcaagtatcggcacctttagaactagttcagtcctcaggctcaccatcatagtgggccctttttcgttctag

SEQ ID NO: 115555 - DNA, 1482 bp, Artificial Sequence
  Description of Artificial Sequence: Synthetic coding sequence
atgttgaaagctctgttccttaccatgttgactctggctttggtcaagagccaggatacggaagagaccattacctacacgcagtgcaccgacggctacgaatgggaccctgtgaggcagcaatgtaaggatatagacgagtgcgacatcgtaccagatgcgtgtaagggagggatgaaatgcgtgaaccactacggcggctacctgtgcctccccaaaaccgcccagattatcgtcaacaacgaacagccccagcaggagacacagccggcagagggcaccagcggagctacaactggcgtcgtggccgcgtcttcaatggccaccagcggagtactgcccgggggcggcttcgttgcatcggccgcagcagttgctggccctgaaatgcaaacaggcaggaacaacttcgtgattagaagaaatcctgccgatcctcagcggataccctccaatcccagtcatcgaattcagtgtgctgcgggatatgaacagtcagagcacaacgtgtgtcaagatatcgacgaatgtactgccggtactcacaattgcagagctgatcaggtgtgtataaacttgagaggttctttcgcctgtcagtgcccaccggggtaccaaaagcgtggcgagcagtgcgtggacatagatgaatgcactatacctccatattgtcatcagcgctgtgttaacacacccggcagtttttattgccagtgctcccccggctttcagctggctgccaataattatacttgcgtcgacattaacgagtgcgacgcaagcaaccagtgcgcacagcagtgttataatatcctggggagttttatttgccagtgtaatcaagggtatgagctgagcagtgataggttgaattgcgaggacatcgacgaatgccgtacttcgagctacctgtgccagtatcagtgtgtaaacgagccaggaaaatttagttgcatgtgtccacagggttatcaggtggttaggtctaggacctgtcaggacatcaacgaatgcgagacaaccaatgagtgccgagaggatgagatgtgttggaattatcatgggggctttagatgctacccccggaacccctgccaggatccctacatcctgaccccagaaaatcgttgtgtgtgccctgtctctaatgccatgtgccgagagctgccccagtccatcgtgtacaaatacatgtcaattcgcagcgacaggtccgtgccctccgacattttccagattcaggccaccactatctacgccaatacgataaacacatttcgcattaagtccggcaatgaaaacggagagttttaccttagacaaacctcacccgtttcggcaatgttggttctggtgaagagtctgtcagggccaagggaacatatcgtcgacctggagatgctgaccgtaagttccatcggcaccttccggacttcttcggtgttaagattaacaattatagttggtcccttcagtttttag

SEQ ID NO: 115556 - DNA, 1482 bp, Artificial Sequence
  Description of Artificial Sequence: Synthetic coding sequence
atgctgaaggctctgttcctgacaatgctcaccttggcgctagtgaagagccaggataccgaggagacgattacttacacccagtgtaccgatggatacgaatgggatcccgtccgacagcagtgcaaggacatcgatgagtgtgatatcgtgcccgatgcatgtaaaggcggaatgaagtgtgtgaaccattacggtggctatctatgtcttcccaagactgctcagatcatcgttaacaacgagcagccccagcaggaaacccaaccagccgagggaacctctggcgctactacaggagtcgtggctgccagctctatggcgacttcaggcgtccttcccggaggcggcttcgttgcaagcgctgctgctgtggctggccctgagatgcagactggccggaataactttgtaattcggagaaatcccgccgatccccaacggattccgtccaaccccagccatcggatccagtgcgccgccgggtacgagcagtccgaacacaatgtttgccaggatatcgatgaatgcacagccggcactcacaattgcagggctgaccaggtgtgcataaacctcagaggatcatttgcttgccagtgcccacccggttatcaaaagaggggcgaacaatgtgtggatatcgacgagtgcaccatacctccttattgccaccagagatgcgtaaacacccctggctccttctactgtcagtgctctcccggcttccagctggcagcaaataactatacgtgcgttgatatcaacgaatgtgatgccagtaatcaatgcgcacaacaatgctataatattctcgggtccttcatctgccaatgtaatcaggggtatgagttatcttctgatcggttgaactgtgaagatattgacgaatgcaggacttcatcatatttgtgtcagtatcagtgtgttaacgagcctggcaagttctcttgcatgtgtccacagggatatcaagtggttcgttcacgcacatgccaggatatcaacgagtgcgaaacaaccaacgaatgcagggaggatgaaatgtgttggaattaccacggagggtttcgatgttaccccaggaatccatgtcaggacccttatatactaacccctgagaaccgctgcgtgtgccccgtttcgaacgctatgtgtcgggagcttccacaatctatcgtctataagtatatgtctatccggtctgatcgctcagtcccttccgacatctttcagatccaggccacaactatctacgccaacaccatcaacactttccgaatcaaaagcggaaacgaaaatggtgagttctacctccgtcagacctctcccgtgagtgcaatgcttgtgctggtgaagtctttgtcaggacctagggaacacatcgtagatctcgaaatgctcactgtgagctctatcggtacatttagaacctcatcagtcctgcgcctgaccatcattgtcggacccttcagtttctag

SEQ ID NO: 115557 - DNA, 1050 bp, Artificial Sequence
  Description of Artificial Sequence: Synthetic coding sequence
atggaggacacgagtgcttttcggaagcagccccgactgttgagcataatgaatagtttgtcctcagaacacaacgtgtgtcaggacattgacgagtgcaccgccgggacgcataactgcagggcagatcaggtttgtataaatctgcgtgggtccttcgcctgtcaatgccctcccggctaccagaaacgcggagagcagtgcgtggacatcgacgaatgtaccatacctccttactgccaccaacgctgcgtgaatacaccaggcagtttctactgccaatgtagtccagggttccagctggccgcaaataactacacttgtgtcgacattaacgagtgcgacgcttctaatcagtgtgcccagcagtgttataatatactcgggagttttatctgtcagtgtaaccagggttacgaactgtcctctgaccgattaaattgtgaggacattgacgagtgcagaacatccagttacttatgtcagtaccagtgtgtcaatgagccggggaagttttcttgtatgtgtccgcagggctaccaggttgtacgcagtagaacctgtcaggatatcaacgagtgtgaaaccactaacgagtgcagggaggatgaaatgtgttggaattaccacggggggttcaggtgttacccgcgcaacccatgtcaggatccatacatcttgactcctgaaaatcggtgcgtgtgccctgtctcgaacgccatgtgtcgggagctacctcagtctatcgtgtacaaatatatgagtatccggtctgaccggtcagtaccaagcgacatcttccaaatccaggccacaacaatatacgcaaataccatcaatacctttagaataaaaagcggtaacgagaacggcgagttttatctgcgacagacatcccctgtgtctgccatgctggtgcttgtaaagtcactgtccgggccacgagaacacattgttgatctggagatgctgactgttagctccatcggtacctttcgcacgtcttctgtgttgcgcttgaccatcatcgtagggcctttctctttttag

SEQ ID NO: 115558 - DNA, 159 bp, Artificial Sequence
  Description of Artificial Sequence: Synthetic coding sequence
atgctgaaagccctgttccttaccatgctgacgctcgccctggtcaaatcacaggatacagaagaaaccatcacgtatacccagtgtaccgacggttatgagtgggaccctgtccgacaacagtgcaaggacatcgatgagtgcgatattgtaccctag

SEQ ID NO: 115559 - DNA, 84 bp, Artificial Sequence
  Description of Artificial Sequence: Synthetic coding sequence
atgctcaaggccctgttccttactatgttaacccttgccctggtgaaatctcaggatacggaggagaccatcacatacacctag

SEQ ID NO: 115560 - DNA, 1068 bp, Artificial Sequence
  Description of Artificial Sequence: Synthetic coding sequence
atgaagtgtgtgaaccactatggcggatatctgtgcttaccaaaaacggctcagattatagtaaacaatgaacagccccagcaggagacacagcccgctgaaggcacatccggcgctactacaggagtggtggctgcctctagtatggctacaagcggcgtcctgccagggggagggttcgtggcctctgcggccgccgtggctgggcccgagatgcagactgggcgtaataactttgtcatcaggagaaacccagccgacccgcagcggataccctctaacccatcccaccggatccagtgtgccgcggggtatgaacagagtgagcacaatgtatgtcaggatattgatgagtgcaccgccggtacccataattgcagagcagaccaagtttgcattaatctaaggggttcatttgcttgtcagtgcccacccggataccaaaagagaggcgaacagtgtgtggatatcgatgaatgtcgaacttcatcttacctctgccagtaccagtgcgtgaacgagccaggaaagttttcttgcatgtgtccccagggatatcaggtcgtgagaagtaggacgtgtcaggatatcaatgaatgcgaaacaacaaatgagtgccgtgaagacgaaatgtgctggaattatcacgggggcttccgctgctaccctaggaacccttgtcaggatccatacatcttaacccctgagaatcggtgcgtttgcccagtgtcgaacgccatgtgtcgggagttgccccagtctatagtatataaatacatgtcaatccggagtgaccgtagcgtgccctcagacatttttcagatccaggccaccacaatctatgcaaatacaatcaataccttcagaattaaatccggaaacgaaaacggcgagttctacctgcggcagacctcaccggtgtctgccatgctcgttctggtgaagtctctcagcggaccaagggaacacatagtcgatttggaaatgctgacagtgtcctccattggaaccttcagaacatcctccgtcttgcggttgacaataattgtcggacctttctccttttag

SEQ ID NO: 115561 - DNA, 264 bp, Artificial Sequence
  Description of Artificial Sequence: Synthetic coding sequence
atgcttaaggcgttgttcctcacgatgctgacactcgccttggtgaagtcacaggacaccgaggaaactatcacttatacacagtgcaccgatggttatgaatgggatccggttcggcaacagtgtaaagacatcgatgagtgcgacattgtgccagacgcatgcaaaggcggcatgaagtgcgttaatcactacggcggatatctttgtctgcccaaaaccgcgcagattattgtgaataacgagcagcctcagcaggagtag

SEQ ID NO: 115562 - DNA, 519 bp, Artificial Sequence
  Description of Artificial Sequence: Synthetic coding sequence
atgcttaaagcattatttctaacaatgcttaccctcgcgctcgtaaaaagccaggacacagaggagactattacgtatacccagtgtactgacggttacgagtgggaccctgtgagacagcaatgcaaggacatcgacgaatgcgatattgtgcccgacgcttgtaaagggggcatgaaatgcgttaaccactacggagggtatctatgcttacccaagaccgcgcagattatcgtgaataatgaacagcctcagcaggagacacagcccgctgagggcacctccggagcaacaacaggggtagttgccgcatctagcatggcaactagtggcgtcctcccaggcggtggctttgtggctagcgctgccgccgtggcagggccagagatgcagaccggtagaaacaattttgtgatccggcggaaccccgccgatccccaaaggatccccagcaacccttctcatcggattcagtgtgcggctgggtacgaacagtctgaacacaacgtgtgtcagtag

SEQ ID NO: 115563 - DNA, 360 bp, Artificial Sequence
  Description of Artificial Sequence: Synthetic coding sequence
atgctgaaggcacttttcctcactatgttgactctggccctggtcaagtcccaggacacagaggaaacgataacatacacccagtgcactgacgggtatgagtgggatcccgtgcgccagcagtgtaaagatatcgacgaatgcgatatcgtgccagacgcctgcaaaggggggatgaagtgcgtgaatcattatggtggctacctctgcctcccaaagaccgctcagatcatagtgaataatgagcagccacagcaggaaactcagcctgcggaaggcacctcgggggctactacaggggttgtggcggcatctagcatggcaacatcaggagttctaccaggaggcgggtttgtttag

SEQ ID NO: 115564 - DNA, 321 bp, Artificial Sequence
  Description of Artificial Sequence: Synthetic coding sequence
atgctcaaggcactcttcttaaccatgctgactctcgcgctggtgaagtcacaggataccgaggagacgataacatatacccagtgcaccgatgggtatgagtgggatcctgtgcgccagcagtgtaaggatatcgacgagtgcgatattgtgcctgacgcgtgtaaagggggcatgaagtgcgtcaatcattatggcggatacctgtgcctgccaaagaccgcccagattatcgtgaataatgaacaaccacagcaggaaactcagcctgccgaggggacaagcggagcgaccactggcgtagtagcagcctccagttag

SEQ ID NO: 115565 - DNA, 189 bp, Artificial Sequence
  Description of Artificial Sequence: Synthetic coding sequence
atgctcaaggccctttttctgacaatgttaactctcgcactggtgaagtctcaggacaccgaggaaaccattacttacacccagtgtacagatggttatgagtgggatccagtcagacaacagtgcaaagacatcgatgagtgcgacatcgtgcccgatgcatgtaaaggaggaatgaagtgtgtatag

SEQ ID NO: 115566 - DNA, 1332 bp, Artificial Sequence
  Description of Artificial Sequence: Synthetic coding sequence
atgttgccatgtgcctcttgcctcccaggcagtttactactgtgggcgctcttgctgctgttgctgggctctgccagccctcaggatagtgaggagccagattcttacaccgaatgcaccgatggctacgagtgggaccccgactctcagcattgcagggacgtgaacgagtgcttgactatccccgaggcatgtaagggcgaaatgaaatgcattaatcactacgggggctatctgtgcctgccacggtcagccgccgttatcaatgacctgcacggagaggggcccccgccccccgtgcccccggcccagcaccctaacccttgtccacccggctatgaacctgacgatcaggattcatgcgtggatgtggatgagtgcgcacaggctctgcatgactgccgaccaagtcaagactgccataacctccccggatcttaccagtgtacatgtcctgatggatatcggaaaataggaccggaatgtgtcgacatcgacgaatgccgataccggtactgccagcataggtgcgtcaacctgccaggctcttttcggtgtcagtgtgaaccagggttccagctcggacccaataacaggtcctgcgtcgacgtcaatgagtgtgatatgggcgccccatgtgaacaaagatgtttcaactcgtatggaacctttctctgtcgctgtcaccagggatacgagttacaccgggacgggtttagctgcagtgacattgatgagtgcagctactcatcctatctctgccaataccggtgtatcaatgaaccgggccgattcagctgccattgcccccagggctatcaattgcttgccactcggctatgccaggacattgacgagtgcgaatcaggagctcaccagtgcagcgaggctcaaacctgcgtgaacttccacggtggctacaggtgtgttgacacgaatagatgtgtggagccctacatccaagtttccgagaaccgatgcctgtgtcccgccagtaacccactatgtcgtgaacaacctagctctatcgtacatagatatatgactataaccagcgaacgtagcgtacccgctgacgtgtttcagattcaggccaccagtgtgtatcccggggcctataatgcgttccagatcagggccgggaactcccagggagatttttatatccgacagatcaacaacgtgtccgctatgttagtactcgctcgaccagttactggtccgagagaatatgtcctggacttagagatggtcaccatgaacagtcttatgtcctacagggcctcaagtgtcctacgactcaccgtttttgtcggcgcctacaccttctag

SEQ ID NO: 115567 - DNA, 609 bp, Artificial Sequence
  Description of Artificial Sequence: Synthetic coding sequence
atgctgccgtgcgcttcatgcctgcctgggtctctcctcctttgggctctgctgctgctcctcctaggtagtgcttctccccaagattctgaagaaccagactcttataccgaatgtacagacgggtatgaatgggatccagatagccagcattgtcgagacgtgaacgagtgcttgactattcctgaagcctgtaaaggtgagatgaagtgtatcaaccattacggtgggtatctctgtttgccgcgctctgctgcggtcataaacgatctgcacggcgagggccctccccccccagtgccgcctgcccagcatcccaatccctgtccacctggctacgaacccgacgatcaggatagttgcgtagacgtggatgaatgtgcacaggccctgcacgactgtcgtccttcacaggactgccataatctccccggtagctatcaatgtacatgcccagacgggtatcggaaaatcggccccgagtgtgtcgacatcgacgagtgcaggtacagatactgccaacatagatgtgttaatctccctggttccttccggtgtcaatgtgagcccggctttcagctcggacctaacaatagatcctgtgtgtag

SEQ ID NO: 115568 - DNA, 552 bp, Artificial Sequence
  Description of Artificial Sequence: Synthetic coding sequence
atgctgccgtgtgcctcgtgcctgccaggctccctcttactgtgggcccttttgttacttttgctgggctctgcaagcccccaagattctgaagaacctgacagctacacagagtgtaccgacgggtatgagtgggacccagactcacagcattgtagggatgtgaacgaatgcctgactatcccggaagcatgcaagggcgagatgaagtgtattaatcactatggaggttacttgtgtctcccgaggtcagccgctgtcatcaatgaccttcatggcgagggacctcctccaccagtacctccagctcaacatcctaatccgtgcccgccaggttatgagcccgacgaccaggacagctgtgttgatgttgacgaatgcgctcaggcgctgcacgactgcagaccaagccaggattgccataacctcccagggtcttatcaatgcacctgtcctgacggctacaggaaaattgggccggagtgcgtcgacatagacgagtgtcggtaccggtattgtcagcaccgctgtgtgaacctccctggaagttag

SEQ ID NO: 115569 - DNA, 1332 bp, Artificial Sequence
  Description of Artificial Sequence: Synthetic coding sequence
atgctgccctgtgctagctgcctgccaggatccctgctgctatgggctttgctgctgttgctcctagggtctgccagcccccaagacagcgaggaaccagattcctacactgaatgtacggacggctacgagtgggacccagattcccagcactgtcgggatgtaaacgagtgcctgacaattcccgaagcgtgtaaaggggagatgaagtgcattaatcattacggcggctacctgtgccttccacggtcagctgcagttattaatgaccttcacggagagggcccaccaccaccagtccccccagcgcagcacccaaatccctgcccccccggttatgaacccgacgaccaggacagttgtgtcgatgtagacgagtgtgcacaggccctgcacgattgccggccatcccaggactgccataacctgcctgggagttaccagtgtacttgtccggatggataccgcaagatcgggcctgaatgcgtggatattgacgaatgtagataccgttattgtcagcatcggtgtgttaatctgcccggatcctttcgctgccagtgcgaaccaggtttccagctcggacctaacaacagaagctgtgtagacgtgaacgaatgtgacatgggagctccatgtgaacagagatgtttcaattcctatgggacatttttgtgtcgatgccatcagggatacgaactgcacagagatgggttttcctgttcagacatcgacgagtgtagctactcgtcatacctttgtcagtataggtgcatcaacgagcccggtaggttttcttgccactgtccacagggctaccagctgctggcaacccgactgtgtcaggacatcgacgagtgtgagagcggagcacaccagtgtagcgaagctcagacctgcgtcaacttccacgggggttatagatgcgttgacacaaacaggtgcgttgaaccttatattcaggtgtcagaaaacagatgcctttgccccgctagcaatccactgtgtcgcgaacagcctagctccatcgtccaccgatacatgaccataacatccgagagatccgtgcccgccgacgtgttccagatccaggccacctccgtctatcccggggcctacaacgcattccaaatccgggcaggcaacagccaaggcgatttctatattcgccaaatcaacaacgtgtccgccatgttggtcctagctcgtcctgtgacaggaccacgggagtatgtcctcgatctggagatggttaccatgaattcgctgatgagctatagagcttcttccgtgctccgacttactgtctttgtgggggcttatacattttag

SEQ ID NO: 115570 - DNA, 2466 bp, Artificial Sequence
  Description of Artificial Sequence: Synthetic coding sequence
atgcgaggctttaacctcctgctgttctggggatgctgcgttatgcattcctgggaaggccacatccggccaaccagaaaacccaataccaaggggaacaactgccgcgatagcacgctctgcccagcgtatgccacttgcacaaatacggtggatagctattattgcgcctgcaagcaggggtttctgagttctaatggccagaaccatttcaaggaccccggcgtgcgatgtaaagacattgatgagtgcagccaaagtcctcagccatgcggccccaacagttcctgcaaaaatctgagcggaagatacaagtgctcttgcctagacgggtttagcagcccaacaggaaacgactgggtccccggaaaaccgggaaacttctcatgcaccgatatcaatgaatgccttacctcaagtgtgtgtcccgaacattcagattgtgtgaactcaatgggttcttactcatgctcctgtcaagtgggcttcatatcccgcaacagcacctgcgaggacgtggatgaatgtgccgatcccagagcctgcccagaacatgcaacctgtaacaataccgtcggcaattactcctgcttttgtaatccgggcttcgaatcatccagtggccatctaagttttcagggcctgaaagctagctgcgaagacatcgacgagtgcactgagatgtgccctatcaattctacctgtaccaatacaccaggctcatatttttgcacctgtcaccccggcttcgctccgagtaacgggcagctgaattttaccgatcagggtgtggaatgccgagacattgacgaatgccgacaggatccctcaacttgtgggcctaactccatatgtacaaacgccctaggctcctattcatgtgggtgcatcgcggggtttcacccaaatcccgagggatcacagaaagacggcaacttcagctgccagcgtgtgctattcaagtgtaaagaagacgttatccctgacaataagcagattcagcagtgccaagaaggcaccgccgtcaagcccgcatatgtttcgttctgcgctcagatcaacaacattttctctgtgttagacaaggtgtgtgagaacaagactactgtagttagccttaaaaatacgacggagagctttgtgcctgtcttgaagcaaattagcacatggaccaagttcacaaaggaggaaacatcctcactcgcgacggtttttctggaatccgtagagagcatgacgcttgcaagcttctggaagccttccgcaaatattactccagccgtgcgaactgaatacctcgatattgagtctaaggtgattaataaagagtgcagcgaggaaaatgtgacactggaccttgtcgccaaaggagacaagatgaaaatcggatgctccactatagaagagtcagagtccaccgagaccaccggggtcgccttcgtgtccttcgtgggtatggaaagtgtcctgaatgagaggttctttaaagaccaccaagcaccgctgaccacatccgagatcaaactgaagatgaactccagggttgtcggggggatcatgacaggggagaagaaggacgggttctccgatcctattatctatactttggaaaatattcaacctaagcagaaatttgaaaggcctatatgtgtgtcttggtccaccgacgtgaaggggggcaggtggacctcatttggatgtgttattctggaggcatcagagacctacactatctgttcctgtaatcagatggctaatctggcggttatcatggccagcggtgagctcactatgggttgcgcaataatagctgggttcctgcactatttgtttttagcttgtttcttctggatgctagtagaggccgtaattctgtttttgatggtgaggaatctgaaagtggtgaattacttttccagcaggaacataaagatgttacatatctgcgcgtttggatacgggctgccgatgctggtggtcgtcatttccgcaagtgttcagcctcagggctatggaatgcataaccgctgctggctcaatacggagaccggcttcatatggtcttttctgggccccgtgtgtaccgtaatcgtgattaatagcttgttgctcacttggacgctttggatcctcaggcagcgcctcagcagcgtaaatgccgaggtctcgaccttaaaagatacacgactcctcacattcaaagcattcgcacagttgttcattcttggctgctcttgggtactgggtatctttcagattggacctgtggctggcgtgatggcatacctgttcaccatcatcaactctcttcaaggggcctttatttttttgatccactgtctgctgaacggccaggttcgagaagaatataagagatggattacgggcaagactaaaccaagctcccaaagccagacgtcacggatccttctatccagcatgccttccgcctctaagacgggttag

SEQ ID NO: 115571 - DNA, 2661 bp, Artificial Sequence
  Description of Artificial Sequence: Synthetic coding sequence
atgcgcggattcaacttgctgctgttctggggatgttgtgtgatgcatagttgggagggccacatccgtcccactcgcaagccgaataccaaaggcaacaactgtagagattccacactttgccccgcgtacgccacctgcactaacacagtggattcatactactgtgcttgtaaacagggcttcctgtcctcaaacggtcagaatcactttaaagaccctggggtacgctgtaaagacatagacgaatgctctcaaagtcctcagccctgcgggcccaattcctcatgtaagaatctctccgggcgatacaaatgcagttgcctggatggattctcttcccctactggtaacgactgggtccccggtaagcccggaaactttagctgtaccgacattaatgaatgtctgacctcctctgtttgcccagaacattccgattgtgtgaatagtatggggtcgtactcctgttcatgccaggtgggcttcatcagtagaaactctacctgtgaggacgtcgatgaatgcgctgatcctcgggcttgtcctgagcacgcaacatgtaataacaccgtggggaactactcctgtttctgtaatcccggcttcgagtcaagcagcggacacttgtcgttccagggcctaaaagccagctgcgaagacatcgacgaatgtaccgaaatgtgtccaatcaattccacttgtacaaacacgcccgggtcctatttttgcacatgtcaccctgggttcgcgccttctaatgggcagcttaattttacggatcagggagtggaatgtagggacatcgatgaatgtcggcaggatcccagcacgtgcggccccaacagcatttgcaccaatgccttggggtcctattcttgcggttgtattgccgggtttcaccccaatcctgagggcagccagaaggacggcaactttagttgccagagagtattgttcaaatgtaaggaggacgtgattcctgataataaacagatccagcagtgccaggaaggcacagctgtcaagcctgcatacgtgtccttctgtgctcagattaacaacattttcagcgtgctcgataaagtttgcgaaaataagacaaccgtagtatctctcaagaacacaaccgagtctttcgtccctgtcctcaagcagatctctacatggacaaagtttacaaaagaagaaacctcatcgctggcaactgtgtttttggagagcgttgaaagtatgacactcgcttctttttggaagcccagcgcaaacataacacccgctgtgagaacagaatacctagacattgagtccaaggtaattaacaaagagtgtagtgaggagaatgtaactcttgatctggtcgccaagggcgataaaatgaaaattgggtgttccaccatagaagagagcgagtctacagaaaccacaggcgttgccttcgttagctttgttggaatggaaagtgtgcttaatgagcgcttcttcaaagaccaccaggctcccttgactaccagcgagattaaattgaagatgaactctagagtggtgggaggcattatgaccggagagaagaaggacggtttctctgatccaatcatctacacactcgagaacattcaacctaagcaaaagttcgagagacccatctgtgtaagttggagtaccgatgtgaaaggagggcggtggacttcatttgggtgtgtgatactggaagcttctgaaacatataccatctgttcctgtaaccaaatggcgaacctggctgtgatcatggccagcggtgaactcaccatggacttcagcctgtacattatcagtcacgtcggtatcatcatttccctcgtgtgcctggtcttggccatcgccacatttctattatgccggtcaattcgtaaccataacacctatctgcatctccacctctgtgtgtgtctgctgttggcgaaaacgctgttcctggcaggcatccataagacggacaacaaaatgggctgcgcgataatcgccggttttttgcattacctgtttctggcctgttttttctggatgcttgtcgaggctgtcatcctgtttcttatggtgcgcaatttaaaggtggtaaactatttttcatcaaggaacataaagatgttgcacatttgtgcctttggctacggtctgcccatgttggtggtggtaattagcgcctcagtacagcctcagggctatggcatgcacaatagatgctggttaaatacagagaccggctttatctggtcctttctgggtccagtgtgcaccgtgatcgtaattaactccctgctactcacttggacattgtggatcctacggcagaggctgagttcggtcaacgctgaagtgtcaaccttaaaagacacccggctgttaactttcaaagcttttgcccaattgtttatcctgggctgttcctgggtgcttggtatttttcagattgggccagtggccggcgtgatggcgtatcttttcacgattatcaattcgctacagggggcttttatctttctcatacactgtctgttaaatggccaggtgcgggaagaatataaacgctggatcacagggaagacaaagccaagcagtcaatcccagactagtagaatcctgctgtcttccatgccttcagcatccaaaactggttag

SEQ ID NO: 115572 - DNA, 2604 bp, Artificial Sequence
  Description of Artificial Sequence: Synthetic coding sequence
atgagaggatttaatctccttctgttctgggggtgttgtgtcatgcactcttgggagggccacattcgtccaacccgtaaacctaacacaaaggggaataactgtagagactctacattgtgcccagcctatgccacatgtacgaatacagtcgactcctactactgcgcgtgcaagcagggctttcttagcagcaatgggcagaaccattttaaagatcctggtgttcgttgtaaggatataaacgaatgtctgacatcatctgtatgccccgaacattccgattgcgtcaattcaatgggctcttactcttgtagctgccaggtcggctttatcagcagaaatagcacttgcgaagacgtagacgaatgcgccgatcctcgcgcctgtcctgagcatgcgacatgtaataataccgtcggtaattactcttgcttttgtaacccagggtttgagagttcttctgggcatcttagttttcaaggcctgaaggcttcatgcgaggatattgacgaatgtactgagatgtgtccaataaattctacatgtacgaacacacctggctcctatttctgtacttgtcaccccggtttcgccccaagcaatggtcagctgaactttaccgatcagggagttgagtgccgcgacattgacgaatgcaggcaagatccgagcacgtgtggcccaaattcgatttgcacaaacgccctaggttcctattcgtgcggatgcatagccggctttcatccaaacccggaggggtcacagaaggatggaaacttttcctgccaacgggtgctgtttaagtgcaaagaagatgtgatccccgataataagcaaattcagcagtgccaggaagggaccgccgttaagcctgcatatgtgtctttctgcgctcaaattaacaatatttttagtgttctggataaggtgtgtgagaacaagaccacagttgtgagccttaaaaatactactgagtccttcgtgcctgtattgaaacagatttccacctggaccaaatttacaaaggaggagacctctagccttgctaccgtctttctcgaatctgtggagtcgatgaccctggcttctttttggaagcccagtgctaatattactcccgcggtgaggaccgagtacctggacatcgagtccaaagtaatcaacaaagaatgctccgaggaaaacgtgacattagacctcgttgccaaaggcgacaagatgaaaatcgggtgcagtactattgaagagagcgagagcaccgagacaacgggagtagcgttcgtcagcttcgtggggatggagtcagtgctgaacgagcggttcttcaaagaccaccaggcccctttaacaactagcgaaatcaaactcaagatgaactctagagtggtgggcgggataatgacaggggagaagaaagacggattcagcgacccaatcatctacaccttggagaacattcaacccaagcagaaatttgaaaggcccatatgcgtctcttggagcacagacgtgaagggtgggagatggacatcgtttggttgcgtgattctcgaggcttcagagacctacacaatttgttcatgtaaccagatggccaatcttgccgttattatggccagcggcgagctgacaatggacttcagcctgtacatcatcagccatgtcgggattatcatcagcctggtgtgtctggtgctagcaatcgccacctttctgttgtgtcgtagcatccgtaaccacaatacgtaccttcaccttcatctgtgcgtttgtctgctgttggctaagaccttattcctcgctggcatccacaaaaccgataacaaaatggggtgcgccataatcgccgggtttctgcactacctgttcctcgcctgtttcttttggatgcttgttgaggcggtcatcctgtttctcatggtgaggaatctaaaagtggtgaattatttttcaagtcgcaacatcaaaatgcttcatatatgtgcttttggctacggactgccaatgctggttgtcgttatcagcgcttctgtgcagccgcagggctatggcatgcataacaggtgttggttgaacacagagactggcttcatttggtcgtttctgggccccgtgtgcactgtaatagtcgtgtctaaatactacaactcactggccaaatgtgtcctgaaagaagaacagggggatcttagggatctggagtttcccggaacttgtgctgcggaacggatcaatagcctgctactcacctggactttgtggattctgcgccaaagactctcttccgtaaatgcagaagtgtcaacgcttaaagacacgagactgctgacttttaaagctttcgcacagctcttcatcctgggttgttcctgggttctgggtattttccagattgggcccgtggcaggagtgatggcctatttgtttaccatcataaatagtttgcagggtgcctttatattcctgatccattgtcttctaaatggccaggttcgcgaagagtacaaacggtggattaccggtaagacgaagcccagttcccagtcacagactagccgaatcctacttagttctatgccttcggctagtaagacgggctag

SEQ ID NO: 115573 - DNA, 2238 bp, Artificial Sequence
  Description of Artificial Sequence: Synthetic coding sequence
atgcggggctttaatctgctcctgttttggggttgctgcgtcatgcattcttgggagggccatattcgcccaacccggaagccaaatacaaagggcaataactgcagggacagcactctctgtccagcctatgcgacatgcacaaataccgtcgatagttactactgtgcttgtaagcagggatttctgtcatctaacgggcagaatcatttcaaagaccccggtgtaaggtgcaaggacatcgatgagtgcaccgagatgtgtccaatcaatagcacctgcaccaacacacctggatcctacttctgcacttgtcaccccggatttgcacctagtaatgggcagctaaacttcaccgatcagggcgtggaatgtagggatatagatgagtgccggcaggatccttctacctgcgggcctaacagtatctgtaccaacgcactcggaagctacagttgcggatgcattgcagggtttcaccctaatcctgagggctcacagaaagacgggaacttctcctgtcaaagggttctgttcaaatgcaaggaggacgtcatcccagataacaagcagatccagcaatgtcaggaaggaacagcagtgaagcccgcttatgtgagcttctgcgctcaaattaacaacatctttagcgtgctcgataaagtgtgcgaaaataaaactacggtggtgtcgctgaaaaacacaaccgagagctttgtgcccgtgttgaaacaaatctcaacttggaccaaatttacaaaggaggaaactagttctctggcaaccgtgttcctcgagtccgtcgagtcaatgacccttgcgtccttctggaaaccaagtgcaaatatcacgcctgctgtcaggacagaatacttggacatcgaatctaaagtaataaataaggagtgttccgaggagaatgtgacccttgatctagttgcaaagggcgacaagatgaaaattggctgcagcacaatcgaggaaagtgagtccacagagactactggtgtggcgttcgtcagctttgtcgggatggagagcgttcttaatgaaagattcttcaaagatcaccaggctcccctgactacctcagagatcaaacttaaaatgaatagccgagtagtgggcggaataatgaccggtgagaagaaagatgggttttccgaccctataatttatacactggaaaacatccagcctaagcagaaattcgaaaggcccatctgcgtatcctggtccactgatgtgaaaggaggacgttggaccagtttcggctgcgttatcctcgaagcctctgagacatataccatctgcagttgtaaccagatggctaatcttgctgtgatcatggcatccggcgagctgacgatggatttctccttgtacataatatcacatgtgggaattatcataagcttggtttgtcttgtcctggccatcgcaacgtttctcctctgcaggagcattagaaaccacaacacgtacctacatctccacctttgtgtgtgtctgctgctcgccaaaacgctttttcttgctggaatacacaagacagataataagatgggttgtgccataattgccggatttttgcattaccttttcctggcttgctttttttggatgcttgtagaggccgttatcttatttctgatggttcggaacctgaaagtggtaaattacttttcgtccaggaacatcaagatgctccatatttgtgctttcggatacgggctaccaatgctggtggtggtgatatccgcctccgtccagccacaggggtacggaatgcacaataggtgttggctgaacacagaaaccgggtttatttggagtttcctcggacctgtgtgcaccgtcatcgtgattaattctctcctcctgacatggaccttgtggatattgagacagagacttagcagcgtgaatgcggaagtgagtaccctgaaagatacccggttgcttacctttaaagcttttgcgcagttgttcattctcggttgctcctgggtcctggggatattccagatcggacccgtagccggcgtaatggcttatctgttcacaatcattaactctctgcaaggcgctttcatctttctgattcactgccttctgaacggccaagtgcgtgaggagtacaaacgttggattactggcaaaactaaaccatcctctcagagccagaccagccgtattctgctgagctcaatgccatcagcttctaagacaggatag

SEQ ID NO: 115574 - DNA, 2130 bp, Artificial Sequence
  Description of Artificial Sequence: Synthetic coding sequence
atgcgcggtttcaacttacttcttttttgggggtgttgcgtgatgcacagttgggaaggccacataaggcctacccgaaagcccaataccaaaggcaataactgtagagattctaccttatgcccagcctacgctacctgcacaaacaccgtagacagttactattgcgcttgcaagcaggggttcctgtcgtctaatgggcagaatcactttaaggatcccggtgtcagatgtaaagatatcgatgagtgcagtcagagcccacagccttgtggaccgaactcaagttgcaaaaatctctctgggcgctacaagtgcagctgcttggacggctttagcagccctactggtaatgactgggtccctggcaagcctggcaacttctcatgcacagacatcaacgagtgtctgacaagccgtgtactctttaagtgcaaagaggacgtcatacccgacaacaaacaaatccagcaatgccaggaaggcacggcagttaaaccagcctacgtctcgttctgtgcccagataaacaatatcttctctgtcctggacaaggtctgtgaaaacaagactacggtcgtgagcctgaaaaacactacagagagcttcgtgcccgtactgaagcagatttctacatggacgaagtttactaaagaagaaacctcctcacttgctactgttttcctcgagagtgtggagtctatgacgcttgcatctttttggaaaccctccgctaacattactccagcagtcagaactgaataccttgacattgagagcaaagtgattaataaagaatgttcagaggagaatgtcaccctggatctggtcgccaagggtgacaaaatgaaaattggatgcagtactatagaggagtccgaaagcaccgagaccactggggtcgctttcgtgagtttcgtcggcatggagtccgtgctaaatgagaggttcttcaaggaccaccaggcccctcttacaactagtgagatcaagctcaagatgaatagcagggtcgtgggaggcatcatgactggagaaaagaaggacgggttttctgatcctatcatctataccctagagaatattcagcccaaacagaagttcgaacgccctatctgcgtttcttggtctaccgacgtgaaaggcgggagatggaccagtttcggctgcgtgatcttggaggcatctgaaacgtacaccatttgctcctgtaatcaaatggctaatttggctgtgatcatggctagcggcgagctcaccatggatttctcactgtatattatcagccacgtggggatcattattagtctcgtttgtcttgttttggctattgcgactttcctactgtgccgcagcatccgcaatcacaatacctatctccaccttcacttatgtgtgtgcttactcctcgcaaaaaccctgttcctggcaggcatccacaagaccgataacaagatgggatgtgcgatcatcgctgggttcctgcactacctctttctggcatgctttttctggatgctggtcgaggccgtgatactgttcttgatggtgaggaatcttaaggttgtgaactacttttcttcccgaaatatcaaaatgcttcacatttgcgctttcgggtacggactccccatgctggtggtcgtgatttctgcttcagtgcagccccagggatatggaatgcacaatcgctgttggctgaataccgagacaggcttcatttggtccttcttgggcccagtatgcacggtgatcgtgatcaatagtctgctgctcacctggaccctctggattctgaggcaaagactgagtagcgtcaatgccgaggtctccaccctgaaagacacacggctgttgaccttcaaggctttcgcccagctctttatcttaggctgtagctgggtgctgggcatcttccagataggccctgtcgcaggcgtgatggcgtatctctttactattatcaactcactgcagggcgccttcatattcctcattcattgtctcctgaatggccaggtgcgagaagagtacaagcgttggattactggcaaaactaagccgagcagtcaaagccaaacctccaggatactcctatccagtatgccatctgcgtccaaaaccggatag

SEQ ID NO: 115575 - DNA, 2466 bp, Artificial Sequence
  Description of Artificial Sequence: Synthetic coding sequence
atgagaggtttcaacctcctgctcttttgggggtgttgcgtcatgcactcatgggaagggcacataagaccaactaggaagccaaacaccaaggggaacaattgccgcgattctacgctctgccctgcatatgccacctgcactaacaccgtagattcgtactattgcgcatgtaagcaaggttttctatccagcaatgggcagaaccactttaaggatcccggtgtgagatgcaaagatattgacgaatgcagccagtcaccgcagccatgtggccccaacagcagctgtaaaaatctgtcaggacggtacaaatgctcctgcctggacggatttagctctccaacaggcaatgactgggtgcccgggaagcccggaaatttttcttgcaccgacattaatgaatgcctgacctcttccgtgtgccccgaacactcagactgcgtgaactcaatgggatcttacagttgtagctgccaagtgggttttatctctaggaattccacttgcgaggacgtggacgagtgtgcggatccacgggcatgtccagagcacgctacttgtaataatacagtgggaaactatagttgcttctgtaacccgggatttgagtcttcgtcgggccacttgtcgtttcagggtctgaaagcaagctgtgaagatatagatgaatgcaccgagatgtgtccgattaatagcacatgtacaaatacacctggctcgtacttttgcacctgccatcctggttttgccccttcgaacggccagcttaattttacagaccagggggtggagtgcagggacatcgatgaatgccgccaggacccgtcgacttgtggacccaactctatctgcaccaacgccctcgggtcctattcctgtggatgtatagctggctttcaccccaacccggaaggaagccaaaaagacggcaacttttcttgtcaaagagtcctcttcaaatgtaaagaagatgttatccctgataacaaacagattcagcagtgtcaagaggggaccgccgtcaaaccagcttatgtgtccttctgcgctcagataaataacatcttctctgtcttagataaagtctgtgagaacaagactaccgtagtgagtttgaaaaacaccacagagagcttcgttcccgttctcaagcagatcagtacatggactaaatttacaaaagaggagacctcttcacttgcaaccgtgtttttggagtctgtagagagcatgacactcgcttccttttggaaaccctccgcaaacatcacccccgcggttcggacagaatatttagacatagagagtaaagtaataaataaggaatgtagcgaggaaaatgtaaccctcgaccttgtggccaaaggggacaagatgaagatcggatgtagcaccatcgaggagtccgaatcaactgagacaaccggagtggccttcgtctctttcgtcgggatggagagtgtgctgaacgaacgtttctttaaggaccatcaggcacccctgacgacctccgaaattaagctgaagatgaactctcgcgtggttggcgggattatgaccggtgagaagaaagatggatttagcgaccctataatttacactttagaaaatattcagccgaagcagaagtttgaacgtcccatatgtgtgtcatggagtaccgacgttaagggtggcaggtggacaagcttcggctgtgttatattagaagccagcgaaacttatacaatatgcagctgtaaccagatggccaacctcgctgtcataatggcttccggagagcttaccatgggctgcgccatcatcgctggtttcctgcactacctcttcttagcgtgtttcttttggatgctggtagaagctgttatcctgtttcttatggtccgtaacttaaaggtagtgaactacttttcctctagaaacataaaaatgctgcacatttgtgcatttggctatgggcttcctatgttggtggtggtgatttctgccagtgtgcagcctcagggatacggcatgcacaaccgatgttggttaaatactgaaaccggctttatctggtcattcctgggtccagtttgcaccgttatcgtaatcaactccctattgctgacatggaccctgtggatccttaggcaaagactatctagcgttaacgcagaagtgagtacgttgaaggacaccagactcctcacctttaaggctttcgcacaactgtttatattaggctgtagctgggtcctggggatctttcagattgggcccgtcgctggcgtgatggcctacttgtttactataataaatagtctgcagggcgccttcatttttttaattcactgcctgctgaatggccaggtgcgcgaggagtataaacggtggataactggcaaaactaagccttcatcgcaatctcagacttctcggatcttgctctcgtccatgcccagtgcctctaagacagggtag

SEQ ID NO: 115576 - DNA, 1662 bp, Artificial Sequence
  Description of Artificial Sequence: Synthetic coding sequence
atgccacttccatggagcctggcgctgccactgctgctgtcatgggtggccggcggttttggtaacgccgctagcgctaggcaccacgggctactggcatccgcccggcaacccggggtctgccactacggtactaaactcgcttgctgctatggatggcgccggaacagcaaaggagtgtgcgaggctacgtgcgagcccggctgtaagttcggagaatgtgtaggcccaaacaaatgccggtgcttcccagggtatacggggaagacctgctctcaggacgtcaacgagtgcggcatgaagcctaggccttgccaacacaggtgcgtgaacacccatggcagttataaatgtttttgcctgtcaggtcatatgctaatgcccgacgccacttgcgtgaactcccggacctgtgctatgatcaactgccagtatagctgtgaggacacagaggagggtccccagtgtctgtgcccctcgtctggcctcaggctggcccctaacggaagagattgcttggacattgacgagtgcgcatctggcaaggtgatttgcccctacaatcggaggtgtgtcaatactttcggaagctattattgcaagtgccatatcgggtttgagttgcagtacatttcgggtcgttacgactgtattgacattaatgagtgcaccatggactctcatacctgcagccaccatgccaactgttttaatactcaggggtctttcaagtgtaagtgtaaacagggttacaagggcaatgggctgaggtgcagcgcaatccctgagaattccgtcaaggaagtattgcgcgctccaggcaccattaaggacaggatcaaaaaactcctggcccacaaaaattccatgaagaaaaaggcaaagatcaaaaatgtgacaccagagcccacccgaacacccactcccaaggtaaacttacagcctttcaattatgaagagattgtttccaggggaggaaatagtcatggcggaaagaaagggaacgaagagaaaatgaaagaagggctggaggacgaaaagcgggaagagaaagccctcaaaaacgacattgaggagcgtagtctcaggggagatgtctttttccctaaagttaacgaagctggggagtttgggcttattctggttcagcggaaggccctgacttccaaactggagcataaagacctgaacatatccgtggattgctctttcaaccacggaatttgtgattggaagcaggatagggaagatgattttgattggaaccctgcagatcgggacaacgccatagggttctacatggctgtgcctgcgctcgccggccacaaaaaagacatcggccgattgaaacttctgcttcctgatcttcagccccagtccaatttctgtctgctgtttgattatcgcctcgcaggcgacaaagtgggcaagcttagggttttcgtaaaaaactctaacaacgctctcgcttgggagaagaccacatctgaggatgaaaagtggaagacagggaaaatccagctgtatcaggggaccgacgcgactaaaagcattattttcgaagctgagagagggaagggtaaaacaggggagattgcagtggatggagtacttttggttagtggcctttgccccgatagtctgctctctgtcgacgattag

SEQ ID NO: 115577 - DNA, 1665 bp, Artificial Sequence
  Description of Artificial Sequence: Synthetic coding sequence
atgccgctcccttggtcccttgccttgcccctcctactgagctgggtggcgggggggttcggcaacgccgcttctgccagacatcacggactccttgcaagcgcaagacaacctggtgtatgtcactacgggactaaactggcctgctgctatggttggcgtcggaactctaaaggcgtgtgtgaagcaacgtgtgaaccaggttgcaaattcggtgagtgcgtcggccccaataaatgtcggtgctttccaggctacaccggaaagacttgcagtcaggatgtgaacgagtgcggaatgaaaccaagaccatgtcagcatcgttgtgtgaatacccatggtagctataagtgcttctgtctgagcggccatatgctgatgccagatgctacctgcgtgaatagtcggacctgcgcaatgatcaattgtcagtactcatgcgaggatacggaagaagggcctcagtgcctctgtccgtcatctgggttaagactggcccctaatggcagagactgcttggacattgacgagtgtgctagcggcaaagtcatctgcccatataatagacgatgcgtgaatacttttgggtcttattattgcaagtgccacatcggattcgaactccaatatatctctggccggtatgactgtattgacattaacgagtgtaccatggatagccacacttgttcccaccatgctaactgtttcaacactcagggcagtttcaagtgtaagtgtaagcaggggtacaagggcaatgggctcagatgcagtgcaatccctgagaactccgtgaaggaggtgctacgtgcaccaggcacaatcaaagatcgaattaaaaagttgttggcgcacaagaacagcatgaaaaagaaggccaagattaaaaacgtgaccccagagccaaccaggactccgaccccgaaagtgaacttgcagccctttaattatgaggagatagtctccagagggggaaattctcacggcgggaagaagggtaatgaggagaaaatgaaggagggcctggaggatgagaagagggaagaaaaggcattaaaaaacgacatagaggagcgaagtttgcgcggagacgtgttcttccctaaagtaaatgaggccggagaattcgggctgatactggtgcagagaaaggctctcacctccaaacttgagcacaaggcggatctgaatatcagcgtggattgctctttcaaccacggtatttgcgactggaaacaggatcgggaggatgattttgattggaaccctgccgatcgcgataacgccattggtttctatatggctgtcccagccctcgccgggcacaagaaggatattggccggctgaagctcctgctacccgacttgcagccccagtccaatttttgcctcctgttcgactataggctggctggcgacaaggtgggaaagctgagagtgtttgtcaaaaacagcaacaacgccctggcatgggagaaaacaacctctgaggatgaaaaatggaagacagggaagattcagctataccaaggcaccgatgccactaaatctatcatatttgaagctgaaaggggaaaaggtaagaccggggagatcgccgtggacggtgtcctgctggtttctggtctttgcccggacagcctgttgtccgtagatgattag

SEQ ID NO: 115578 - DNA, 822 bp, Artificial Sequence
  Description of Artificial Sequence: Synthetic coding sequence
atgcgaggctcacaggaagtccttctcatgtggctgctcgtccttgctgtgggtgggaccgagcatgcttataggcctggccgccgtgtttgtgctgtgagggcccacggagaccctgtttctgagtctttcgtccagagggtgtatcagcccttccttactacgtgtgacggccatcgggcttgctctacctataggacgatctaccggaccgcatatcgccgatcccctggactcgcacctgctcggccacgctacgcatgctgccctggctggaaacgaactagtggcctgcccggggcttgtggagccgcaatctgccagccgccttgccggaacggcggaagctgtgttcagccggggcggtgtcgatgcccagcaggctggagaggagatacctgtcagtcagacgtagatgagtgtagtgcacgacgtggagggtgcccccaacgttgtgtcaataccgcaggcagctattggtgtcagtgttgggagggccactccctcagtgcagacgggaccctctgtgtgccaaagggcggcccccctagggtcgcccctaacccaaccggagttgactcagctatgaaggaggaggtccagagactgcagagcagggtggatcttttggaagagaagctgcagctggtgttggctccactgcactcgctggctagtcaggctctcgaacacggtcttcctgaccccggttctctgctggtgcatagctttcagcagttaggcagaatagacagtctttccgaacaaatttcgttcctggaggagcagctaggttcttgctcctgcaagaaggacagttag

SEQ ID NO: 115579 - DNA, 822 bp, Artificial Sequence
  Description of Artificial Sequence: Synthetic coding sequence
atgagggggagccaggaggtgctcctgatgtggctgctggtactcgctgtcggcgggacagaacacgcctatcgccctggccgccgagtctgcgcggtaagggctcacggagatcctgtgagcgaaagttttgtgcagcgggtataccagcctttcctgacaacctgcgacggacatagggcttgctcgacatacaggactatttataggacagcctatcgacgctcccctggccttgcgccagctagaccacgatatgcgtgttgccctggttggaagcgcacttctgggctgcccggagcctgtggcgcagcaatctgccagcccccatgccgcaacggagggagctgtgttcagccaggccgttgtagatgtcccgccggctggaggggagatacctgtcaatccgacgtcgacgaatgctcagccaggaggggagggtgtccacagcggtgcgtgaataccgcgggcagttactggtgtcagtgttgggagggccattctctctccgcagatggaaccctgtgtgtgcctaagggagggccaccacgagtggcacccaatcctactggggtcgatagtgccatgaaagaagaggtgcaacggctgcaaagccgcgtggatttgcttgaagagaaactgcagctggtgttagcacccttacactctctcgccagccaagcactcgagcacgggctgcctgaccccgggagtttgttggtgcactcattccagcaactcggtcggatcgattccctaagcgaacagatttccttccttgaggaacagctcggctcttgttcttgtaagaaggactcctag

SEQ ID NO: 115580 - DNA, 822 bp, Artificial Sequence
  Description of Artificial Sequence: Synthetic coding sequence
atgagggggtcccaggaggtactcctgatgtggttgctcgtacttgccgtgggtggcacggagcacgcctaccgccccggccggcgcgtgtgtgccgtgcgcgctcatggtgaccccgtttccgagagctttgttcaaagggtgtaccagcctttcttgacaacgtgtgatggacacagggcttgctcgacctacaggactatatatcgtacagcatatagacggtctccagggctggcccctgctcgaccacggtatgcgtgctgtcccggctggaagcgcactagcggactgcctggggcatgtggtgcagctatttgccagccaccgtgccgaaatggggggagctgtgtacagccagggagatgccggtgccctgccgggtggcggggtgatacatgccaaagtgatgttgatgaatgctcagcaagacgaggaggatgtccccagcggtgtgtgaatacagcaggttcgtactggtgtcagtgctgggaagggcactcattatcagctgacggaactctctgtgttcctaaaggcggaccgccaagggtggcacctaatcccaccggcgtggattcagctatgaaagaggaggtacaacgcctgcagtcgcgggtcgatctgctggaggaaaagttacaactggtcctcgccccgttgcactctcttgcatctcaagcgctggaacacggtttgccggatcctggctcactccttgtgcatagttttcagcagcttggtaggatcgacagtctctcagaacagatcagctttctcgaggaacagctgggatcatgctcatgtaaaaaggacagctag

SEQ ID NO: 115581 - DNA, 822 bp, Artificial Sequence
  Description of Artificial Sequence: Synthetic coding sequence
atgagaggatcgcaggaagtcttgctgatgtggttgttggtactggctgtagggggaacggagcatgcctatcgccccggcaggagagtctgcgcggtgagggcacacggggaccctgtgtcagagtccttcgtgcagcgggtgtaccaacctttcctcactacgtgcgacggacaccgcgcctgttccacttataggacaatctacaggactgcctatagacgttcccccggtctagcccctgccaggccaagatatgcatgctgtcctgggtggaagcgcacttctggattgcctggggcttgtggtgcagccatttgccagccaccatgccgcaacggaggttcttgtgttcagcccgggcggtgccggtgccccgccggatggcggggcgatacatgtcaatcagatgtggacgagtgcagtgccaggcgggggggatgcccccaacgttgcgtcaataccgccggctcctactggtgccagtgctgggaagggcactccctgagtgcagatgggactttgtgtgtgcctaaggggggcccgccccgtgtagccccaaatcctactggtgtagatagcgccatgaaggaggaagtacagcgtctgcaaagtagagtcgacttgctggaagaaaagcttcagctggttcttgcccctctccactccctggcttcccaagccctggagcatgggctgccagatccgggcagcctgttagtacattcattccaacagctaggtcggatcgatagcttgtctgaacagatttccttcctagaggaacaattgggatcatgctcatgtaaaaaggactcctag

SEQ ID NO: 115582 - DNA, 882 bp, Artificial Sequence
  Description of Artificial Sequence: Synthetic coding sequence
atgggctctcgtgcagaactttgtacgctgctgggcggctttagcttcttgctactgctaattccaggggagggagcgaagggcggctcccttagagagagccaaggcgtgtgtagcaaacagacccttgtcgtcccattgcattacaacgagtcttactctcagcctgtatataagccttacctaacgctgtgtgcaggacgacgcatttgctccacatacagaactatgtacagggttatgtggagggaagtccggcgtgaggtccagcagacccacgccgtttgctgccagggttggaagaagagacaccccggtgctctgacctgtgaagccatttgtgcgaagccttgcctcaacggtggcgtgtgtgtacggccagaccagtgcgaatgcgcgcctggttggggaggcaagcattgccacgtggacgtagatgagtgtagaacgtcaatcacactatgctcccaccattgttttaatacagcgggctcgttcacctgcgggtgcccacatgacttagtgctgggagtcgatggcaggacatgcatggaagggagccctgagcctcccacatcggcctccattttatcagtggcggtcagagaggccgaaaaggatgaacgcgctttaaaacaggagattcatgaactgagggggcgccttgagagattggaacaatgggcagggcaggccggtgcttgggtgagggcggtgttgcctgttcctcccgaagagctacagcccgagcaggtggctgaactctgggggagaggagatcggatcgaaagcctttctgatcaagtgctgctgcttgaggagagactgggagcgtgctcgtgtgaggacaatagcctcggtttgggcgtcaaccacaggtag

SEQ ID NO: 115583 - DNA, 882 bp, Artificial Sequence
  Description of Artificial Sequence: Synthetic coding sequence
atgggatcacgcgccgaactatgtacgttgttaggtgggttctccttcctgttgttactgatcccaggcgagggtgccaagggggggtctttgcgggagtcccagggtgtgtgtagcaagcagacccttgtagtgcctttacactataatgagagctactcgcagcctgtttataagccatatcttacattatgcgccgggaggcgcatttgctcgacttatcgaaccatgtaccgggtaatgtggagagaagtccgccgggaagtgcagcaaacgcatgccgtgtgttgccaaggctggaagaagcggcaccccggcgcgttgacctgtgaggccatatgcgccaagccttgccttaatgggggggtgtgtgtccgacctgaccagtgcgaatgcgcacccggctggggtggaaagcactgtcatgtagatgtggatgaatgccggacgtcaattactctctgcagccaccattgcttcaatactgccggtagcttcacttgcgggtgtcctcatgaccttgtcctgggtgtggatggcaggacttgcatggaaggttctcctgagccccctacaagtgctagtattctctcagtggccgtaagagaggccgagaaagatgagcgcgccctcaagcaggaaatccacgagctgcgcgggcggctggaaagactggaacagtgggccgggcaggctggcgcatgggttagagctgtgctgccggtgcctccggaagaattgcagccggaacaggttgctgaactgtgggggcgcggagaccgaattgagtctctgtctgatcaggtgttgctgctggaggagcgtctcggcgcttgtagttgtgaggataattctctgggattgggggtgaaccatcgctag

SEQ ID NO: 115584 - DNA, 882 bp, Artificial Sequence
  Description of Artificial Sequence: Synthetic coding sequence
atgggatcccgggctgagctctgcacactcctaggggggttttcatttctgctgctgctgattccgggggagggggccaaagggggctccctgcgggagtctcagggagtgtgcagcaaacagacactcgtggttccactgcactataatgaaagctacagccagccggtctataaaccttacctgactctctgcgcaggtcgccgaatttgcagtacttacagaaccatgtatcgcgtgatgtggagggaggttaagagagaagttcagcagacacacgctgtttgctgccagggatggaagaagaggcacccaggagccctcacgtgcgaagccatatgtgcaaagccatgcctgaatggcggggtctgcgtcaggcccgatcaatgtgaatgcgccccgggctggggcggaaagcattgccacgtggatgtggatgagtgccgcacctccattaccctttgctcccaccactgcttcaatacagccggaagctttacctgcggctgtccccacgacctggtactgggagtggatgggcgaacatgcatggagggatcacctgagcccccaacaagcgcctccatcctttccgtcgctgttcgcgaggccgagaaggacgaaagagcactgaagcaggaaatccacgaactgaggggcaggctcgagcgtctggaacagtgggccggtcaggctggagcatgggtgcgcgcggtcctgcccgtgccacctgaagagctgcagcctgagcaggtggctgagctgtggggccgtggtgaccgcatcgagtccctgtcagaccaagtcctgctgttagaagagcgcctgggagcatgctcctgcgaagacaattcactcggcttgggagtgaaccacagatag

SEQ ID NO: 115585 - DNA, 777 bp, Artificial Sequence
  Description of Artificial Sequence: Synthetic coding sequence
atgggatctcgagctgagttatgtaccttgctggggggtttttctttcctgctgctgttaatcccaggcgaaggagccaagggcggaagtcttagagaaagccagggtgtctgctcaaaacagacactggttgttcccctgcactataacgagagctattctcagccggtttacaaaccctatttaacactgtgtgctggacggcggatttgcagcacctatcggaccatgtatagggtgatgtggcgcgaggtgagacgggaggtccagcagacccacgcagtttgttgccagggatggaaaaagcgccatccaggagctctgacctgcgaagccatctgcgctaagccatgcttgaacggcggagtgtgcgtgcgcccagaccagtgcgagtgcgcgcctggctggggaggcaagcactgtcatgtaggcagtttcacctgtggatgcccgcatgatctcgtactcggagtagatgggcggacatgcatggaaggtagtccagaacccccgaccagcgcctccattctgagtgtggccgtgagagaagctgagaaagacgagagggctttaaaacaggagatacacgagctgaggggacgactcgaaagattagagcagtgggcagggcaggcgggcgcatgggtgagggccgtgcttccagttcctcccgaggaattgcagcctgaacaagttgcagagttgtggggaagaggggatcgcatagagagtttaagcgatcaggtgctcctcctggaagagcgtttaggcgcttag

SEQ ID NO: 115586 - DNA, 882 bp, Artificial Sequence
  Description of Artificial Sequence: Synthetic coding sequence
atgggatctcgggcagagctgtgtaccctgctggggggcttctccttcctcctgttgctgatcccgggggaaggagccaagggtggctccttacgggagtctcagggggtatgctctaagcagacactcgttgttcccctgcactataatgagagctatagccagcctgtctacaagccatatttgaccctctgcgccgggcgccggatctgtagtacatatagaaccatgtacagggtgatgtggcgagaggtgagaagagaggtgcagcagacccacgccgtatgctgtcagggatggaaaaagagacacccaggtgccctcacctgcgaagccatatgtgcgaagccatgcctgaacggcggggtttgcgttcgccccgaccagtgtgagtgcgcccctggatggggtggaaaacattgccacgtcgacgtcgatgaatgcaggactagtatcaccttgtgttcacatcattgcttcaataccgcggggtccttcacatgtgggtgccctcatgacctggtgctgggggttgatggtcggacctgcatggagggaagcccggagccacctaccagtgcttcaatcttaagcgtggccgttcgggaggccgagaaggatgagcgggctctgaaacaggagatccacgagctacgcggtcgattggagaggctggagcagtgggcagggcaggcgggcgcttgggtcagggctgtactgcctgtaccgccagaggagcttcagcctgagcaagtcgccgaactgtggggtcggggggataggatagagtcgctgagtgaccaggtgctcttattagaagagagactgggcgcctgctcctgtgaggataacagtttggggctgggcgtgaatcatcgctag

SEQ ID NO: 115587 - DNA, 882 bp, Artificial Sequence
  Description of Artificial Sequence: Synthetic coding sequence
atgggatcacgtgccgaactgtgcaccctgcttgggggcttctcatttctgcttctactgattccaggagagggagctaaaggaggcagcctgagggaatcacagggagtttgtagcaaacagaccttggttgtgccactccactataatgaatcttatagccagccggtgtacaagccataccttacactgtgtgccggacggagaatatgctcgacctataggactatgtatcgcgtgatgtggcgagaggtacggcgagaggtccaacaaacccatgctgtttgctgccaaggatggaagaagagacaccccggcgccttaacttgtgaggctatctgcgcaaaaccatgccttaatggtggcgtttgtgtacgacccgatcagtgtgaatgcgctcccggatgggggggcaaacattgccatgtggacgtcgatgagtgtagaacatctattaccctgtgtagccaccactgtttcaacacagcaggaagcttcacctgcgggtgccctcacgacctagtgctgggcgtggacgggagaacatgtatggagggctcacccgagcctccaacgagcgcgagcatcctgagcgtggctgttagggaggcagaaaaagacgagagagctctgaagcaggagatacacgaactgagaggccgccttgaacgcctcgaacagtgggcgggtcaagccggcgcatgggtacgagcggtcctgccggtgccgccagaagaattgcagcctgaacaggtcgctgagttatggggccggggtgatcggatcgaaagtctatctgatcaagtgttgctactcgaagagcgtctgggagcatgtagctgcgaggataactcactgggcctgggcgtgaatcatcgctag

SEQ ID NO: 115588 - DNA, 882 bp, Artificial Sequence
  Description of Artificial Sequence: Synthetic coding sequence
atgggatcccgggccgaattgtgcactcttttaggcgggttttcattcctgttacttctaatcccaggcgaaggcgcaaagggaggatcactaagagaatcccagggggtgtgttctaagcagacacttgtcgtacccctgcattacaacgaatcctactctcagccagtgtacaagccttacctgacactctgtgctggaaggcgaatctgcagcacctaccggactatgtacagagtcatgtggcgcgaggtgcggagggaggtacagcaaacccatgcggtgtgctgccagggctggaagaagcgacacccaggagcgcttacgtgtgaagctatatgtgcaaagccatgcttgaatggaggagtgtgcgtcagacctgatcagtgcgaatgcgctcctgggtggggcgggaagcactgtcacgtcgacgtcgatgagtgcaggacctctattaccctgtgctcccaccactgtttcaacacagcagggtccttcacatgcggatgcccacatgacctggtattgggcgtcgatggccggacatgtatggagggatctccagagccaccaacatctgcctccatcctgtcagtggcagtgagagaagccgagaaagacgagcgggcattgaaacaggagatccacgagctgagaggtcgactggagcggctggagcaatgggccggtcaggcaggtgcatgggtgcgcgctgtgcttcctgtgcctcccgaggagctccagcccgagcaggtggccgagctatgggggcgtggggatcgcatcgaatcgttgtcagatcaagtgctgcttctggaggagaggcttggcgcctgtagttgcgaagataatagcctcggcctgggggtcaatcacaggtag

SEQ ID NO: 115589 - DNA, 777 bp, Artificial Sequence
  Description of Artificial Sequence: Synthetic coding sequence
atgggtagccgggcggaactgtgcacacttctgggcggattttcttttctgttactcctcattcccggggaaggcgctaaggggggaagcttgcgcgaatcacagggggtgtgctctaagcaaaccctggtggttcctctgcattataatgaatcctacagccagccagtgtataaaccttacttgaccctgtgtgccggtcggagaatctgttctacctacagaactatgtacagagttatgtggcgggaggtccggagagaagtccagcagacacacgccgtttgttgtcagggttggaaaaagcgccacccgggggccctaacctgcgaagccatttgtgctaagccgtgtctgaatgggggggtgtgtgtgcgtccagaccagtgcgaatgcgccccgggatggggcggtaagcactgtcacgtgggttcctttacctgtggctgccctcatgatctcgtgctcggagtagatgggcggacatgtatggaggggtcgcccgaaccccccacttccgcatctatactgagtgtggcagtgagagaggcagagaaggacgaacgggctcttaaacaagagattcatgagcttagaggcagattagagagacttgagcagtgggccgggcaggcaggagcctgggtaagggccgtgcttcccgtgcctccagaggagctgcaacccgagcaagtcgccgagctgtggggccggggggaccgcatagagtccctgagcgaccaggtgctcctgctggaagaacggctcggtgcttag

SEQ ID NO: 115590 - DNA, 777 bp, Artificial Sequence
  Description of Artificial Sequence: Synthetic coding sequence
atgggaagccgcgctgagttgtgcacgctgttagggggattttccttcctgttgctcctgattcccggcgagggagcgaagggtggcagtctcagagaaagccagggagtttgcagcaaacagaccctggtcgttccactccattacaatgaatcttactcacagcctgtttataaaccatatctcacactgtgcgcggggcgccgaatttgctctacctatcgcacaatgtatcgagtgatgtggagagaggtgagaagggaagttcagcagacacatgccgtttgctgccagggctggaaaaagagacatcccggggcactgacttgcgaggccatctgcgctaagccatgtctcaatggcggtgtttgcgtgcgccctgatcagtgtgagtgtgcgcccggttggggggggaaacactgccacgtgggctccttcacctgtggctgtccccatgacctggtgctcggcgtagatggccgcacttgcatggaaggatcacctgaaccaccgacctccgcttccattctgtctgtcgccgtacgtgaggctgagaaggatgaacgagccctaaagcaggaaatccatgagttgcggggccggctggagcgcctggagcagtgggctggacaagcgggagcttgggtgcgggctgtgctcccagtgccaccggaggaattgcagccagagcaggtggccgagctgtggggccgcggcgatcgcatcgagagcttgagcgaccaggtcctcttgttggaagaacgtctaggagcctag

SEQ ID NO: 115591 - DNA, 777 bp, Artificial Sequence
  Description of Artificial Sequence: Synthetic coding sequence
atggggtcacgggctgagttgtgcaccctgctgggggggttttccttcttgctcctactgataccgggagagggggctaagggagggtccttaagagagtctcaaggagtttgcagcaagcaaactctggttgtccccctccactacaatgagtcctacagccaacccgtgtacaagccttatctcaccctctgcgctggccgcagaatatgtagcacatacagaacgatgtacagagtcatgtggcgggaggtgaagcgggaggtgcaacagacccacgccgtatgttgtcagggatggaaaaagagacacccaggagcactcacatgtgaagccatttgcgcaaaaccgtgcctgaacggtggagtatgtgtccgaccagatcagtgcgaatgtgcccctggatggggagggaagcattgtcacgtgggaagctttacatgcggctgcccccatgacctggtgctgggggtcgacggccggacatgcatggaagggtcccccgagcccccgacgagcgcttccatcctgagcgtggctgtgcgggaggctgagaaggatgagcgagccctcaaacaggagatacacgagctgaggggacgactcgagcgattagagcagtgggccggccaggccggagcatgggtgagagcagtgctgcccgttcccccagaggagctacagcccgagcaggtggcagagctgtggggccgcggagaccggattgagagcctcagcgatcaggtgctactgttggaggagaggttgggggcgtag

SEQ ID NO: 115592 - DNA, 882 bp, Artificial Sequence
  Description of Artificial Sequence: Synthetic coding sequence
atgggcagtcgcgcagagctctgtacccttctgggaggcttcagttttctcctgctcctcataccgggcgagggcgccaagggaggctccctgcgtgaatctcaaggtgtgtgctcaaagcagaccctcgttgtgcctctgcactacaacgagtcatattctcagcccgtatataagccttacttgacgctgtgtgcaggaaggcgcatatgctccacttatagaacaatgtacagagttatgtggcgtgaggtccgccgagaggtacagcagactcatgctgtgtgctgccaggggtggaagaagcgtcaccctggggctctcacatgtgaggccatttgcgcgaagccgtgccttaacgggggagtgtgcgtgagacctgaccagtgtgaatgtgctcccggttgggggggcaagcactgccatgtggacgtagacgaatgccgaacctccatcaccctttgctcccatcactgctttaacactgccggtagcttcacgtgcggatgcccgcacgatttggtgctgggggttgatgggcggacctgcatggaggggtcacctgaacctcctacttcagcctcaatcctttctgttgctgttcgggaggccgaaaaggacgagagagcgcttaaacaggaaattcatgagctccgcggccgcctggagcggctggagcagtgggccggccaggccggcgcatgggtccgtgcggtcctccctgtgcccccagaggaactgcagcctgaacaggtggcagaactttggggcagaggtgatcgcattgagtcactgagcgatcaagtcctgctgttggaagagagactgggagcttgttcatgcgaggacaattctctcggattaggagtcaatcataggtag

SEQ ID NO: 115593 - DNA, 882 bp, Artificial Sequence
  Description of Artificial Sequence: Synthetic coding sequence
atgggttctagggctgaactgtgcacactcttgggcgggttttccttcttgctgctgctcattcctggtgagggcgcaaaggggggatccctccgggagtctcagggcgtgtgcagcaagcaaacactggtggtccccctgcattacaatgaaagttacagccagccagtctacaaaccctacctgaccttatgcgccgggagacggatttgctcaacgtaccgaaccatgtaccgagtcatgtggagggaggtgaggcgtgaggtgcagcaaacgcacgccgtctgttgtcaaggctggaagaagcgacatcccggagccttgacctgcgaggctatatgcgcaaagccatgcctgaatggtggagtgtgtgtgcgcccggaccagtgcgagtgcgcccctggctggggcggcaagcactgccatgttgacgttgacgagtgcagaacatctattaccttgtgttcccatcactgcttcaacaccgccggtagcttcacctgtggctgtcctcatgatctcgttctaggcgttgatggtcgcacatgtatggagggaagtcccgagccacccacctccgcatccatcctcagtgttgcagtacgcgaagctgaaaaagatgaacgagccctgaaacaggagatccatgaacttaggggccgcctggagagactggaacagtgggctggccaagcgggcgcatgggtgcgggccgtgttgcccgtgcctcctgaggaattgcaaccggagcaggtggctgagctctgggggcgcggggatcgaatagagagcctgtccgaccaggtgctccttctcgaggaaagactgggggcctgtagctgtgaagataacagcctggggttgggtgttaaccaccgctag

SEQ ID NO: 115594 - DNA, 882 bp, Artificial Sequence
  Description of Artificial Sequence: Synthetic coding sequence
atgggcagcagggccgagctctgtacacttctggggggcttctcatttttacttctccttatacctggagaaggagccaagggtggatccctgagggagtcacagggcgtttgctcaaagcagacactggtggtgcccctccattataatgagtcctatagccagcccgtgtataagccatacttaacactgtgcgcaggcaggcgcatctgtagcacatatagaacaatgtatcgcgttatgtggagagaggtacgccgcgaggtgcagcagacccatgcagtttgctgccaaggctggaagaagcgccatcccggggcacttacctgtgaagccatctgtgccaagccatgcctgaacggcggggtgtgtgtgcgacctgaccagtgtgaatgtgctcccgggtggggcggcaaacactgccatgtggatgtcgatgagtgccgtacgagcatcacactctgcagccaccactgcttcaacactgccgggtccttcacatgtggctgccctcacgacctggtgttaggagtggatggccggacatgcatggaaggcagcccggaaccacctacctctgcctccatacttagcgtggccgtgagagaagctgaaaaggacgagcgcgcccttaagcaagaaatccacgaactgagaggccggcttgaacgcctagagcagtgggccggtcaggcaggggcatgggtacgagccgtgctacccgttccaccagaggagctccagcccgagcaagtcgcagaactttggggccggggagaccgcatagagtcattatccgaccaggtcctgctgttagaggaacgtttaggggcgtgctcttgtgaggacaacagccttggccttggtgtaaaccatagatag

SEQ ID NO: 115595 - DNA, 882 bp, Artificial Sequence
  Description of Artificial Sequence: Synthetic coding sequence
atgggctcgcgtgcggagttgtgcacccttcttgggggctttagtttcctgctgctgctcatccccggggaaggagcaaagggggggtctctccgggagagccaaggagtgtgtagcaagcaaaccctcgtcgttcccctgcactacaacgaatcttactctcagccggtgtataaaccttaccttaccttatgtgctgggcgcagaatatgttcgacctatagaactatgtacagagtcatgtggcgagaagtgaaacgcgaggtgcaacagacgcatgccgtgtgttgtcagggctggaagaaacgccacccaggcgctcttacttgcgaagcaatttgtgcaaaaccatgcctgaatggcggtgtctgcgtgagaccagatcagtgcgagtgcgcccctgggtgggggggtaaacactgccatgtcgatgtggatgaatgtcgtaccagcattactctgtgttctcatcattgcttcaatactgcaggcagctttacatgcggatgtcctcatgatttagtcctgggagttgacggacggacctgcatggaaggttcccccgagcctcctacttcagcaagcatcctgtcagtagccgtaagggaagctgaaaaggatgaacgcgcacttaaacaggaaattcacgagctgcgcggccggcttgagagactcgaacaatgggctggacaggcaggcgcatgggtgagagctgtcttgcctgtgccaccagaagagctgcagccggagcaggttgcagaactatggggaaggggcgaccgcattgagagcttgtctgaccaggtcctccttttggaggaacggctgggagcatgttcctgcgaggacaactcccttggccttggcgtgaatcatcgttag

SEQ ID NO: 115596 - DNA, 882 bp, Artificial Sequence
  Description of Artificial Sequence: Synthetic coding sequence
atgggatccagagctgagctgtgtacccttctgggtggcttctcatttttgctgcttctcatcccaggcgaaggggccaagggcggaagcctgcgcgagtctcagggcgtgtgcagtaagcagactctggtggtccctctgcactacaacgaaagctacagccaacctgtctacaagccctatctgactctctgcgctggccgtcgcatttgtagcacataccgcacaatgtaccgagttatgtggagagaggtaaggcgcgaggtccagcagacacacgcagtgtgctgtcagggctggaagaagcgtcatcccggcgcccttacctgtgaagccatctgcgccaaaccatgtctgaacgggggtgtctgtgtaaggcctgaccagtgtgagtgtgcaccgggatggggcggaaagcactgtcatgtggacgttgacgagtgccggacctccatcaccctgtgctcccaccactgcttcaacaccgccggatcctttacatgtggctgtccacatgacttggtcctgggcgtggacggtcggacgtgtatggagggctctccagaacccccgactagcgcctctatccttagtgtcgctgtccgtgaggccgagaaagacgagagagcactgaagcaggagatccatgagcttaggggacggcttgaacggcttgaacagtgggctggtcaggctggagcttgggttcgtgctgtactgcccgtacctcccgaagaactccaacccgaacaagtggcagagttgtggggaaggggcgaccgtattgagagcctcagtgaccaggtgctcctgctggaagagagactgggcgcttgctcttgcgaggataactcattaggtctgggcgtcaaccacagatag

SEQ ID NO: 115597 - DNA, 882 bp, Artificial Sequence
  Description of Artificial Sequence: Synthetic coding sequence
atggggagcagagccgaattgtgcacactcctgggaggcttctcttttctcttgcttttgatcccaggagaaggcgccaaaggagggagcttacgagagtcacaaggcgtgtgcagcaaacagactctggtcgttcctctgcactataacgagtcctactcccagcctgtgtacaagccttatctcactctttgtgcaggccggagaatatgttccacctaccggacgatgtatagagtgatgtggagggaagtccggagagaggtgcagcaaacacatgctgtatgctgccaagggtggaagaagcgccatccaggagcccttacatgcgaggctatctgcgctaaaccatgtctcaacggcggcgtgtgcgttagacctgatcagtgcgaatgcgctcctgggtggggcggaaaacattgccatgtcgacgtggatgaatgccgcacttccataacattatgctctcaccactgctttaatactgccggttcttttacatgcggatgtccgcatgatctcgttcttggagtcgacgggcgcacctgtatggagggatcccctgagcccccaacttctgcatctatcctttccgtggctgtcagggaagcagagaaggacgagagggcactgaagcaagaaattcatgagctcagaggccgactggagcggttggagcagtgggctggccaggcgggggcctgggtcagagcagttcttcctgtaccccctgaggaacttcagcctgagcaggtcgccgagctctggggtcgaggagatcgaattgaatctttgagtgatcaggtgcttttgctagaagaacggcttggggcttgcagctgtgaggacaattccctgggactaggagttaatcaccgatag

SEQ ID NO: 115598 - DNA, 882 bp, Artificial Sequence
  Description of Artificial Sequence: Synthetic coding sequence
atggggtctagagccgagctgtgcacattgttgggaggattttcgttcctgctgctgctgattcctggggagggagccaagggggggagtctgagagagagccagggagtgtgctcaaaacagacacttgtggtgccgctccattacaacgagtcatatagtcaaccagtttataagccataccttactctatgtgctggtaggcgaatctgctctacttacaggacaatgtacagagtgatgtggagggaagtccgtcgggaggtacagcagacgcacgctgtctgttgccagggctggaagaagagacatcccggggccctcacatgtgaggcaatttgtgctaaaccatgcctcaacggcggggtgtgtgttcgccctgaccaatgcgaatgcgcacctgggtggggcgggaagcattgccacgtggacgtcgacgaatgcaggaccagcataactttatgttcacaccattgtttcaacactgccggctcatttacttgcggctgtccccatgatttggtgctgggtgtggatgggaggacctgtatggagggctcaccggaacctccgacctctgcctcaattctgtccgtcgccgtaagggaggctgagaaagatgaacgggccctcaagcaggagattcacgagctgaggggtcgactggagagactggagcagtgggcaggccaagctggagcttgggtgagagcagttctgcccgtgccacccgaggaattgcagcccgagcaagtggccgagctatggggccggggagaccgcattgagtccctgtccgatcaagtgctgctgttggaggaacgtttgggcgcgtgcagctgtgaggacaattccctgggcctcggagtgaaccaccgctag

SEQ ID NO: 115599 - DNA, 777 bp, Artificial Sequence
  Description of Artificial Sequence: Synthetic coding sequence
atggggtcccgggcagagctgtgcactctgctgggggggttttcattcctgctactgctcattcccggggaaggcgctaaaggtgggagcctgcgcgaaagtcagggggtgtgctcaaagcagacacttgtcgtgccactgcactacaacgagagctatagccaacctgtttacaagccctacctcacactgtgcgccggaagaagaatctgtagtacataccgcaccatgtaccgggtgatgtggcgcgaagtgaggcgggaagtgcagcagacgcacgctgtgtgttgccagggatggaagaagagacaccccggggcactgacctgtgaagcaatctgcgctaagccctgcctgaacgggggggtctgcgtgcgacccgatcaatgtgaatgtgcacctggatggggcggaaagcactgtcatgtggggtccttcacctgtgggtgtcctcacgacctggtgctgggagtggacggccgcacttgtatggaaggatctcctgaaccccctacgagcgcgagtatcctgagcgtagcagtcagggaggccgaaaaggacgaacgagcactgaagcaggagattcacgaactgcgaggtaggctagagcgactcgaacaatgggctggacaggcgggggcgtgggtaagggccgtgcttccggtccctccggaggaattacagcccgaacaggtggccgaactgtggggtcgcggcgacagaatagaatccctttccgaccaagtgctactactggaggagcggcttggggcctag

SEQ ID NO: 115600 - DNA, 882 bp, Artificial Sequence
  Description of Artificial Sequence: Synthetic coding sequence
atggggagccgggccgagttgtgtacacttctcggaggcttcagtttcctgctgctcctgataccgggcgaaggggccaaaggaggatctttgagagagtctcagggcgtgtgttctaaacagactctcgtggtgcctctgcattacaacgagtcttactcacaacctgtgtacaaaccctatctcacactatgcgcaggcagacgcatttgcagcacctacaggacaatgtaccgcgtgatgtggcgggaagtgcgcagagaggtgcagcagacccacgccgtttgctgccaagggtggaaaaaaaggcatccaggtgcattaacgtgcgaagccatctgcgcaaagccctgccttaatgggggcgtctgtgtgcggcctgaccaatgcgagtgtgcacccgggtggggaggaaaacactgtcatgtcgacgtggatgaatgccgaacaagcatcacactttgcagccaccattgctttaacactgcagggagctttacttgtggatgtccgcatgatctcgtgcttggggtcgatggtcgaacctgtatggaaggcagcccggaaccgccgacttcagcaagtattctctccgtcgcagtgagagaagccgagaaagacgagcgggccctgaagcaagaaattcatgaactgcggggacgactggagcggctggaacaatgggcagggcaggcaggagcgtgggtgagggccgtcttgcccgtccccccagaagagctgcaacctgaacaggttgccgagttatggggtcgcggcgaccgtatagaatccctgagtgaccaagtcttactgctggaagagaggttgggagcctgcagctgcgaagacaattcactgggattgggggttaatcatcggtag

SEQ ID NO: 115601 - DNA, 1281 bp, Artificial Sequence
  Description of Artificial Sequence: Synthetic coding sequence
atggcaaatgactctgggggacccggagggccaagcccttctgagagggaccgccagtactgtgaattatgcggtaaaatggaaaacctcttgcggtgtagccgctgtcgctcatctttctactgttgcaaagaacatcaaagacaagattggaagaaacataaactggtgtgtcagggcagtgagggggcgctcgggcatggagttggccctcaccaacattcaggaccggctcctccagccgctgtccccccaccaagagccggggcaagagagccccgaaaggctgcagcacgtcgcgacaatgcatcaggagatgctgcgaaaggcaaggtgaaggcgaaaccccccgccgaccccgccgcagccgcctcaccttgtagggcggccgcaggagggcagggttcggccgtggctgccgaagctgagccaggcaaggaggagccacccgcgcgtagttctctgtttcaggaaaaggctaacctatatccgccctccaacactccgggcgacgccttatctccagggggaggcctgcgtcccaatggtcagaccaaacccttgcccgccctaaagttggcactcgagtatatcgtcccctgtatgaataagcatgggatctgtgtggtggatgacttcctaggcaaagagacaggacagcaaattggagatgaggtgcgcgcattgcacgataccggaaagttcaccgacggacagctggtgagccagaagtctgattcaagtaaggatatacgtggagacaaaataacctggattgagggcaaggaaccaggctgtgaaaccatcggactgctgatgagcagcatggacgacctcattcgacactgcaacgggaagctgggatcttacaagatcaatggtcggaccaaggctatggtagcgtgctacccaggcaacggtacaggttatgtgcggcatgtggacaaccccaatggtgatgggcgttgtgtaacgtgcatttactacctaaataaagattgggacgctaaggttagcggaggaatacttaggatctttcccgaaggcaaagcacagtttgctgatattgagccgaaattcgaccggcttttgtttttttggagtgaccgtaggaatccccacgaagttcaaccagcctatgccacacgttatgccatcaccgtctggtacttcgatgctgacgagcgagctcgtgctaaagttaagtatctaaccggcgagaaaggagtccgcgtggagcttaacaaaccatctgattccgtaggaaaggatgtcttctag

SEQ ID NO: 115602 - DNA, 216 bp, Artificial Sequence
  Description of Artificial Sequence: Synthetic coding sequence
atgaacaaacacggcatatgcgttgtggacgatttcttgggcaaagagactggacaacagatcggtgacgaagttcgcgcactgcacgacaccggaaagttcacggatggctcatggtccgctcgccgagtcacaaggccgcggacgagtgaggctattaggtcacccggaagtcgggcaagatccccagcggccaaacctctcggatgttcttag

SEQ ID NO: 115603 - DNA, 1224 bp, Artificial Sequence
  Description of Artificial Sequence: Synthetic coding sequence
atggattctccttgtcagccccagcctttatcccaggctctcccgcagctgccaggaagttctagcgagccgttagagccagagcctggcagagctcgcatgggcgtcgagagttacctaccttgccctctcctcccctcttatcattgtccaggggttccttctgaggcctcagcaggcagtggcactcctagagcgacagctacaagcacaaccgcatcaccactgagggacgggttcggcggacaggacggaggagaattgaggcccctgcaatccgagggcgccgccgccttagtgacaaaaggatgtcagagactcgcggcgcagggtgcccgacccgaggcacccaaaagaaaatgggcggaagacggcggggatgcacccagccctagtaaacgtccttgggcgaggcaagagaaccaagaagctgaaagggagggaggaatgtcctgtagctgtagttcaggaagtggagaggctagcgctgggctgatggaggaggcccttccaagcgctccagagcgactcgctctcgactacatagtgccctgcatgcgctattatggcatctgtgtaaaggattctttcttaggagctgcactgggaggaagggtactggcggaggtcgaggctctgaagcgggggggccgtctgcgcgatggacaactagtcagccagagggccatccccccacgatcaattaggggggaccaaatcgcttgggttgagggccacgaacccggctgcaggtccattggggcactcatggctcatgtggatgcggtaattcgtcattgtgccgggagattaggcagctacgtcatcaacggccgaacgaaagctatggtggcgtgctatccgggcaacggtctgggttacgttcggcatgttgacaatccccacggcgatgggcgatgcattacttgcatctactatctcaatcagaactgggacgtcaaggtgcacggtggcctgctgcagatcttccccgaaggtcgaccagtggttgcaaacatagaacccctattcgacagattgctcatcttctggagcgaccgacgtaacccacacgaagtaaagccagcatatgctacaagatacgccataaccgtttggtacttcgacgccaaggagcgcgctgctgccaaagataaataccagctggcaagcggacagaagggagttcaggtgcctgtttcgcaacccccgacccccacctag

SEQ ID NO: 115604 - DNA, 1224 bp, Artificial Sequence
  Description of Artificial Sequence: Synthetic coding sequence
atggactccccgtgtcagccgcagcccttatcacaggctcttccccagcttcccggctcaagctccgagcccctggagcccgagccagggagagctcggatgggtgtggaaagctaccttccttgccctctgctcccaagctaccactgccccggggtgccctccgaggcgtccgctggtagtggcactcctcgagccacggctaccagcaccaccgcctcccccctgagagatggattcggaggtcaggacggaggagaactccggccacttcagtcagagggtgcggcagctttggtgactaaagggtgtcagaggcttgccgcccagggcgcccggcccgaagcacccaagcgaaagtgggccgaggatgggggcgacgcaccctccccaagcaagagaccgtgggcgcggcaggaaaaccaagaggcagaaagggaggggggaatgtcttgtagctgctccagtggctcaggcgaagcatcagcaggactcatggaggaggcactgccttcagcacccgagcgattggctctggactacatagttccttgcatgagatattacggtatctgtgtgaaggactcattcctgggtgccgcactcgggggccgcgtgctcgctgaggttgaggccctaaaaaggggtggaagattacgagacgggcagctggtgagccagcgcgccataccaccaagatctattaggggggaccagattgcttgggtcgagggtcacgagcccggctgtcgttcgattggtgcgcttatggcacatgttgatgcagtaataagacactgcgcaggacggctgggatcctacgtcatcaatggacgcaccaaggccatggtggcttgctacccagggaacgggttaggctacgtccgccacgtcgataacccccacggcgacgggcggtgcattacttgtatctattaccttaaccagaattgggacgtaaaggtacacggcggactactccagattttcccagaagggagaccagtggtcgctaatatagaaccgttattcgaccggctgttgatcttctggtccgacagacgcaacccacacgaggtaaaaccagcttacgcaacccgctacgccattacagtgtggtacttcgatgccaaggagcgcgcagcggcaaaggataaatatcagctggccagcgggcagaaaggtgtgcaggtcccagtctctcagccccccactccgacatag

SEQ ID NO: 115605 - DNA, 720 bp, Artificial Sequence
  Description of Artificial Sequence: Synthetic coding sequence
atgcccttgggacacataatgaggctggacttggagaagatcgctctcgagtatattgtgccctgcctgcacgaggtgggattctgttacttggacaacttcctgggcgaggtggtaggggattgtgtgctggagcgtgttaagcaactccactgtactggagcactgagggatggtcagctggccggaccgcgcgcaggtgtgtctaagcggcacctgcgcggagatcagatcacatggattggcggcaacgaggaggggtgcgaagccataagcttcctgctgtcccttatcgaccggctcgtgctgtattgcggcagcaggctgggaaaatactacgtgaaagagcggtctaaggctatggtggcctgctaccccggcaatgggactgggtatgtacgccatgtggacaaccccaacggtgatggacgctgtattacatgtatctattatttgaacaaaaactgggacgcgaaattgcacgggggaatcctgcgtatattcccggaagggaagtccttcatcgcggatgtagagcctatcttcgaccgactcttgtttttttggtccgacaggagaaaccctcatgaagttcagcccagttacgcgacaagatacgctatgacagtatggtactttgacgcagaggaacgggcggaggccaaaaagaagtttcgtaatctgacacggaagactgagagtgcgctgaccgaggactag

SEQ ID NO: 115606 - DNA, 720 bp, Artificial Sequence
  Description of Artificial Sequence: Synthetic coding sequence
atgcccctgggccacataatgcgtcttgacctggaaaagatcgctttggaatacatcgttccgtgtctgcatgaggtgggattttgttacctggataacttcctgggcgaagtggtcggcgactgtgttcttgagcgggtgaaacagctgcactgcaccggcgcactgagggatgggcaactggctggcccaagagcaggcgtgtcgaagagacacctgcggggtgaccagatcacttggatcgggggaaacgaagagggttgtgaggctatatcctttctgctttcactgatcgaccgcctggtgctttattgcggtagtcgacttggaaaatactacgtgaaagagagaagcaaagccatggttgcctgttaccccgggaacggaactggatatgtccgtcatgttgataatcccaatggcgacggaaggtgcatcacctgcatttactatctcaataagaactgggatgcaaaactccacgggggcatcctgaggatcttcccggaggggaaaagtttcattgcagacgttgagcccatattcgaccgcctgcttttcttttggtcagaccggaggaatccccacgaagtgcagccctcttatgctacgagatatgctatgaccgtgtggtacttcgacgccgaggagagggcagaggctaaaaagaaattccgaaatctcaccaggaaaacggagtccgcactcaccgaagattag

SEQ ID NO: 115607 - DNA, 1605 bp, Artificial Sequence
  Description of Artificial Sequence: Synthetic coding sequence
atgtttagctgggtgagtaaagatgctcgaagaaaaaaggagcccgagttattccaaaccgtggctgaaggtctgcggcagctttatgcacaaaaactgctacccctggaagagcattacagatttcacgagttccactcccccgctctggaggacgccgactttgacaataagccaatggtgctgctggtggggcaatattccactggaaagactacttttattaggcatctcatcgagcaggattttcctggcatgaggatcggacctgagcccaccacagactccttcattgccgtgatgcatgggcctactgaaggcgttgttcccggtaacgctctcgttgtggacccccgtagaccctttcggaagctaaacgcgttcggcaacgcatttttgaaccggttcatgtgtgcgcaactgcctaaccctgtcctggactctattagtataatagatacacccggcatcctatcaggagagaagcaacgcataagcaggggttacgacttcgcagcagtgttggagtggttcgccgagcgagtagatcgcataatactcttgttcgacgcccataagcttgacatttctgacgaattctccgaggtgataaaagcgctaaaaaatcacgaagacaagattcgggtcgtcttaaataaggcggaccagatcgaaacccagcaattgatgagagtgtatggtgccctcatgtggagtctgggtaaaatcatcaacacaccagaggtggtgagggtttatattggctctttctggtctcatcccctcctgatccctgacaatagaaaactgttcgaggccgaagaacaggacttgttcaaggatatacagtctcttcccaggaatgctgccctgagaaaactgaatgacctcattaaacgagcaagacttgctaaagtacatgcgtacattatatcttccttgaagaaggaaatgcctaacgtgtttggaaaggagtcgaagaaaaaagaacttgtcaacaatctgggtgagatataccagaagattgagcgcgagcatcagatctctccaggggactttccttcactccgcaaaatgcaggagttactgcagactcaggatttcagtaaattccaagcactaaagccaaaactgctggacaccgtcgatgacatgttggctaatgacattgccaggttaatggtgatggtgcgccaggaggaatctctgatgcctagtcaggtcgtgaagggaggtgcatttgatggtaccatgaatggtcccttcggacacggttatggcgagggcgcgggcgagggaattgacgatgtggaatgggtggtgggaaaagataagcctacatacgacgaaatcttttataccctgagcccagtgaacggaaagatcacaggggctaatgccaagaaggaaatggtgaaatccaagctacctaacacagttcttggtaaaatctggaagctcgctgatgtcgacaaagacggactcctcgacgacgaagagtttgctctggctaaccatttgattaaggtcaaactggaaggccatgaattaccggctgaccttccaccccatctggtaccaccttccaagcgccgccacgagtag

SEQ ID NO: 115608 - DNA, 1605 bp, Artificial Sequence
  Description of Artificial Sequence: Synthetic coding sequence
atgttttcttgggtgagtaaagacgctcgccgcaaaaaagagcctgagctgttccagacagttgccgaggggctcaggcagctgtatgcgcagaagctcctcccactggaagagcattacaggtttcacgagttccactccccagctctcgaggatgccgatttcgacaataagccaatggtgctcctggtgggacaatactctacagggaaaaccacgttcattagacatctgattgagcaggattttccaggcatgaggatcggtcctgagccaactaccgattcttttatagcggtgatgcatggacccacagaaggggtggtgcctggcaatgctctcgtcgtggatccgcgacgaccatttcggaagttgaatgcctttggaaacgccttcctgaacagatttatgtgtgctcagctccctaaccccgtgctggactcgatcagcattatcgatactcctggtatcctgagcggggagaaacaaaggatcagccgcggatatgactttgccgccgtgctcgagtggttcgctgagcgagtggaccgcatcatcctgctgttcgacgctcacaagctggacatttctgatgaattctcggaagtgatcaaggccctgaaaaatcacgaagacaagatcagggtggtactgaataaggctgatcagattgagacacagcagctgatgagagtgtacggagccttgatgtggagcctgggcaaaatcatcaataccccggaggtggttagagtgtatattggctcattctggtcccatccactgcttatccctgacaaccgtaaactgtttgaggcagaagaacaggacctcttcaaggatatccagagcctccccaggaatgcagcactccgcaaactgaatgatttaatcaaacgagccagattggccaaggtccacgcatacatcatatcttctttgaaaaaagagatgcctaacgtatttggtaaggaatccaagaaaaaggaactagtgaataacctaggggagatatatcaaaaaatcgaaagggaacatcagatctctccaggtgactttcccagcttgagaaaaatgcaggagctcctccaaacccaggatttctctaagttccaggccctaaaacctaaactactggacaccgtcgacgacatgctggccaatgacatcgctcgtcttatggtaatggtcaggcaagaggaaagtctcatgccaagccaggtggtgaagggtggcgctttcgacggaaccatgaacggcccctttgggcacggatatggagagggggccggcgagggcatcgacgatgtcgagtgggtcgttggaaaagataaacccacctatgacgaaattttctacaccctgtcccctgtgaacgggaaaattactggtgctaacgcaaagaaggagatggtaaaaagcaaattgccaaacacagtactgggcaaaatctggaagctggctgacgttgacaaggacgggctattagacgacgaagagtttgcactggctaaccatttgattaaagtgaagctggaaggacacgaattacctgctgacctgcctccccacctcgtcccccccagcaagagaagacacgaatag

SEQ ID NO: 115609 - DNA, 438 bp, Artificial Sequence
  Description of Artificial Sequence: Synthetic coding sequence
atgttctcctgggtgtcaaaggacgcgagacgcaagaaagaaccagaactctttcagactgttgccgagggactgaggcagctttatgcacagaagctcctgcctttggaggaacattatcgcttccatgagttccacagccctgcccttgaggacgcggatttcgacaacaaacctatggtgctattggtgggacagtatagcacagggaagactaccttcatccggcacctcattgagcaggactttccaggtatgaggatcggcccagagcccaccacagactctttcattgccgtgatgcatggcccgacggagggggtggtgcccggcaatgccctagttgtggacccccgccggccatttaggaaattgaacgctttcggcaacgccttcctcaatcgatttatgtgcgcacaactgccgaacccagtatag

SEQ ID NO: 115610 - DNA, 1296 bp, Artificial Sequence
  Description of Artificial Sequence: Synthetic coding sequence
atggagcagcccggcaccgccgcgagtcccgttagcggtagtatgttttcctgggtgagtaaggacgccagacggaaaaaggagccagaattgttccagaccgtagccgagggtctccgacagctttacgcccagaaattgctcccactggaggaacattatcgattccacgaatttcactccccagccctggaggatgccgatttcgacaataagcccatggtgctgctggtaggacagtactctaccggtaagacaaccttcatcagacatttgatagagcaggacttcccagggatgagaatcggccctgaacccaccaccgactcattcatcgccgtcatgcatgggcccactgaaggagtggtcccgggcaatgccttagtggtcgacccccggaggccatttcgaaaactgaacgcgtttggcaacgcctttctcaaccgttttatgtgcgcccagctgcctaatcccgtcctggatagtatcagtattattgatactcctggaatcctgagcggggaaaagcagagaatctcaaggggctatgattttgcagctgttctcgagtggtttgccgagagagtggatcgcattatactgcttttcgatgcccacaagctggacatatctgatgagtttagcgaagtgatcaaggcattgaagaaccacgaagataagatcagagtggtgttaaataaggccgatcagattgaaacccagcagttgatgcgagtgtacggcgccctgatgtggagcttgggcaaaatcattaatactcccgaggttgtccgagtgtatattgggagcttctggtcgcacccactgttaatcccagataacaggaaactgttcgaagcagaggagcaggacctttttaaggacattcagagccttccccgaaacgcagccctgcggaaacttaatgacttgataaagagagcccggttggcaaaggtacacgcctacatcataagctctctgaaaaaggagatgcctaatgtattcggcaaggaatctaagaagaaggaattggtgaacaacctcggagagatttaccaaaagatcgaacgcgaacaccagatctccccgggtgatttcccaagcttgcgtaagatgcaagaattgttgcagacacaggatttttcaaagttccaagctctgaagcctaagctcctcgatgacgaggagttcgccctcgcgaatcacctgattaaagtcaagttggagggccacgagctccctgcagacctgccccctcatttagtccccccatcaaaacgaagacacgagtag

SEQ ID NO: 115611 - DNA, 447 bp, Artificial Sequence
  Description of Artificial Sequence: Synthetic coding sequence
atgttttcctgggtgagtaaggacgcccgccgcaagaaagagccagagttattccagaccgtggctgagggcttgaggcagctatacgctcagaagctgttgccactggaagagcactaccggtttcacgaattccacagccctgccttggaggatgctgatttcgataacaaaccaatggtgctcctcgtgggtcagtacagtaccggcaagaccaccttcattcggcacctgattgagcaggactttcccggcatgagaatcggtcctgagcctactacggatagcttcatagcagtcatgcacggaccgactgaaggagtggtaccaggaaacgccctggttgtcgacccccgcaggccatttcggaagctcaacgcctttggcaacgccttcctgaatagattcatgtgtgcccagctgcctaacccagtgttagacagttag

SEQ ID NO: 115612 - DNA, 1533 bp, Artificial Sequence
  Description of Artificial Sequence: Synthetic coding sequence
atgttcagctgggtgtctaaagatgctcgccgtaagaaggaacactataggtttcacgaattccatagcccagccctcgaggacgccgatttcgataataagcctatggtcctcttggtgggacagtattctactgggaagaccacctttatcaggcacctgatcgaacaggacttcccaggaatgaggatcggacctgaacctaccacagactcatttattgcagtgatgcacggcccaacggagggcgtggtgcctgggaatgccctcgtggttgacccgcggcggccttttaggaagctgaatgcttttggaaacgcattccttaaccgattcatgtgcgcacagctaccaaacccagtactcgatagtatctctataattgacacgcccggcatcctctccggtgaaaagcagcgcattagccgaggttatgattttgcagccgtgctggagtggttcgctgaaagggtggatcgaatcatactgctgttcgacgctcacaaactcgacatctccgacgagtttagcgaagtgattaaggctctcaagaatcacgaggataagatccgcgtcgtgctcaataaggctgaccagattgagacccaacagctgatgcgtgtgtatggcgcgctgatgtggtctctcggtaagattatcaatacgcccgaagtggttagagtatatatcggctccttttggtcacaccctctgctcatcccggacaaccgcaagctttttgaggcagaagaacaggacctgtttaaggatattcagtcgctcccaaggaacgcggctctgagaaaattaaatgaccttatcaaacgagcacgtctggccaaagtacacgcatatatcatctcttcattgaagaaggaaatgccgaatgtgttcgggaaggaatccaaaaaaaaagagctggtcaacaatttaggggagatctatcagaaaatcgagagggaacaccagataagccctggggattttccaagcttgcgcaaaatgcaggaactgttgcagacacaggacttctcgaagttccaggccctcaagccaaagctcctggacacagtggacgacatgttggcaaatgatattgctcggctcatggtgatggtgcgacaggaggagtccctcatgccttctcaggtagtgaagggcggcgcattcgacggtacaatgaacgggccattcgggcacggatacggggagggcgcgggcgagggaatcgatgacgtcgaatgggtcgtggggaaagataaacccacgtacgacgaaattttttacaccctatcccccgtcaacgggaagattacaggcgcaaacgctaaaaaggaaatggtcaaatccaagcttcccaatacggtgctgggtaaaatctggaaactagcagatgtcgataaggacggcctactggatgatgaggaattcgctttggccaaccaccttattaaggtgaagctggagggtcatgaacttccagccgacttacctccacacctagtgcctccttctaagcgacgacatgaatag

SEQ ID NO: 115613 - DNA, 1632 bp, Artificial Sequence
  Description of Artificial Sequence: Synthetic coding sequence
atgttctcatggctgaaacggggcggagctcgtggccagcaacccgaggccattcgcacggtgaccagcgcactgaaggagctctacagaaccaaactgctgccgctcgaagagcactacaggttcggggcctttcactcccccgcgctggaagatgcggactttgatggcaaacctatggtccttgttgcgggacaatacagcaccgggaaaaccagttttattcaatacttgcttgagcaagaggtccctgggtcgcgtgtggggccggagcctaccactgactgtttcgttgccgtgatgcatggagacaccgagggcactgtgcctggcaacgctcttgtggttgatccagacaagccttttcggaagttgaacccattcggaaacaccttcctgaatcgcttcatgtgcgcacagctccccaaccaagtgctagaatctatctctatcattgacactccaggtatcctttccggggccaagcagcgcgtgagcagaggctacgactttccagcagtcctacgttggttcgctgagcgcgttgatctgattatcctgctctttgacgcccataaattggagatttctgatgaattcagcgaagctattggcgctctgagaggccacgaagataagattagagtcgtgctaaataaggccgatatggtggaaactcaacagctgatgagagtgtatggcgctttgatgtgggccctcggaaaggttgtggggacacctgaggtgctcagagtgtacatcggatccttttggagccaacctctcctcgttcccgacaatcgcagattgttcgagttggaggagcaagatcttttcagggacatccagggcctcccccggcatgcagcactgagaaagctcaacgatttagtcaagagagcccggctagtccgggtgcacgcttatatcatttcttacctgaagaaagagatgccgtccgtttttggaaaggagaataagaagaagcaattgatcctcaagttgcctgtgatatttgcaaagattcagctcgaacatcatatctcgccaggcgacttcccagactgtcagaaaatgcaagaactgctgatggcccacgactttaccaagtttcacagtctcaagccaaaacttctcgaggctcttgacgaaatgctaacgcacgacatcgccaaactgatgccgctcctgaggcaggaggaactggagtccaccgaagtgggggtccaggggggtgctttcgagggcactcatatggggcccttcgtcgagagaggaccagatgaagcaatggaggacggagaggagggaagtgacgatgaagccgagtgggtggtcacaaaggataagtccaaatatgacgaaatcttctataacctggcccccgccgatggtaaactgagcgggagcaaggcaaaaacttggatggtgggaacgaagctccccaattccgttctggggaggatctggaaacttagcgatgttgatcgtgatggtatgctcgacgacgaagagttcgcactggccagtcacctcatcgaagcaaaactggagggtcacgggctgccggccaacctgccacgacgcctcgttccgccaagtaaaagaagacacaaaggaagcgcagagtag

SEQ ID NO: 115614 - DNA, 516 bp, Artificial Sequence
  Description of Artificial Sequence: Synthetic coding sequence
atgccttcggtctttggcaaagagaataagaagaagcaactcattctcaagctccctgtcatcttcgccaagattcaacttgagcatcacatttctcctggcgatttcccagactgtcagaaaatgcaggaactgctcatggcccacgattttaccaagttccactctctgaagcccaaacttctcgaagccctagatgagatgctgactcatgatatcgccaaactgatgcccttactgcggcaggaggaactcgaatccaccgaggtcggcgtgcaaggaggggcctttgaaggcacacatatgggcccttttgtcgagcggggaccagatgaggccatggaagaccagggccaggtgcagatccgtcgcgacctgttacagccaggtgcatgcagacgccaggcggaaaggctgcaagggcaggacttggatggaggggaccaggctccccagttatccgccggtgctcacttggaggcccagcgctgcggcccaaggcgtcatgcagggtag

SEQ ID NO: 115615 - DNA, 1224 bp, Artificial Sequence
  Description of Artificial Sequence: Synthetic coding sequence
atgtgcgctcaactgccgaaccaggtgctggagtctattagtatcattgatacacccggcatcctgtctggagccaagcagcgcgtcagccggggatatgattttcctgcggttctcagatggttcgccgaacgtgttgacctcatcatcctcctgtttgacgcccataaactcgaaatcagcgatgaatttagcgaagccattggcgccttgagggggcacgaggacaaaatccgggttgttctaaacaaagccgacatggtggaaactcagcaactcatgagagtgtatggcgccttgatgtgggccctgggaaaagtagtcggaacgcccgaggtgctgcgggtatatatcggctccttttggagtcagccgttactcgtcccagacaacagacggctgttcgagttggaagagcaggacctctttagagatattcaggggctcccacgacacgctgccctgaggaagctgaatgaccttgtaaaaagagcccggctggtgagagtacacgcttacattatttcgtatttgaaaaaagagatgccctcggtgtttggtaaggagaacaaaaaaaagcagcttatcctgaaactgcccgtgattttcgccaaaatccaattagagcatcatataagccctggcgacttccccgactgccagaaaatgcaggagctgctgatggcccacgacttcactaagtttcatagccttaaaccaaagctgctggaggccctcgacgaaatgcttacgcacgacatcgccaagttaatgccactacttagacaggaagagttggagtccacagaggttggcgtgcaaggtggtgcttttgaggggacacacatgggcccttttgtagaaagggggcccgacgaggctatggaggacggggaagaggggagcgatgacgaggccgaatgggtcgtgaccaaggataaaagcaagtatgacgagattttttataacctggctcctgccgacgggaagctttccggttctaaggcaaaaacatggatggtcggcacgaagctgccgaattccgttcttgggcgcatttggaagctgagcgacgtcgatagagatggtatgttagacgatgaagaatttgctctggcttcgcaccttatcgaggctaaactggagggacatggtttgcctgctaacctgcccagaagactcgtgcccccatccaaacggagacacaagggatcagccgagtag

SEQ ID NO: 115616 - DNA, 1242 bp, Artificial Sequence
  Description of Artificial Sequence: Synthetic coding sequence
atgttcagttggctgaaacgcgggggcgctcggggtcagcagccagaggcaattcgaacagtcacaagcgccctaaaggagctttaccgcactaagctgctgcccctagaggagcactaccgattcggcgcgtttcattctccagcactggaggacgccgactttgatggaaaaccaatggtcctggtggccggtcagtactctacagggaagacctcattcatccaatacttactggaacaagaggtaccgggaagcagagtgggacctgaaccaactaccgactgctttgtggctgtgatgcacggcgacaccgaaggtaccgttccaggcaacgctttggtcgtagatcccgacaagcctttccgcaagctgaacccctttggtaataccttcctcaaccgattcatgtgcgcccagctgcctaaccaagtattagaaagcatcagcattattgatactccaggtattctgtctggggccaagcagagagtgagccgtggatacgacttcccagccgtcctgaggtggtttgcggagcgtgtggacctgattatactgctgtttgacgctcataagttggagatctcggacgagttctccgaagcaatcggggcattgagaggtcatgaggataagatcagggtcgtgctaaataaagcagacatggtggaaactcaacaactgatgagagtctacggtgcactgatgtgggctctgggcaaggttgtggggacacctgaagttctgagagtttatattggcagtttctggagccaaccactgctagtgcccgacaatagaaggttattcgaactggaagaacaggatctgttcagagatatccagggcctgccccggcatgcagcgctgagaaaactgaacgatctggtgaaacgcgccagactggttagggtgcatgcttatataatttcatacctgaagaaggagatgccttccgtgtttggaaaggaaaacaagaagaagcagctaatcctcaagctacctgtgattttcgccaaaattcagcttgagcaccatatttctcccggggacttccctgactgtcagaagatgcaggaactgttaatggcccacgacttcactaaatttcacagcctcaaacctaaactcttagaagcgttagacgaaatgttaacacacgatatcgccaagttaatgccattactacggcaagaagaactggaaagcagcccagtcgccgagatgacatcccgttag

SEQ ID NO: 115617 - DNA, 1602 bp, Artificial Sequence
  Description of Artificial Sequence: Synthetic coding sequence
atgttctcttggcttaagagaggcggcgctcgcggacaacagccagaggcaatccggacagttacctcagccctcaaggagctgtatagaaccaaacttctgcctctggaggaacactacagattcggagcttttcatagccctgcactggaggacgccgattttgacggtaaacccatggtactagtggcagggcagtacagcactggtaaaacctcttttattcagtacctgttggaacaggaagttccggggagcagagtcgccgttatgcacggagataccgaggggactgttcctggtaacgctctggtggtggaccctgataaaccatttaggaaattaaacccctttggtaacactttccttaaccgcttcatgtgcgctcagctgcctaatcaggtactagaatctatctccatcatcgacaccccgggaattctatccggcgcgaaacagagggtttctcgtggctacgattttcccgctgtgctgaggtggtttgccgaacgcgtggacctgattatacttcttttcgacgctcacaaactagaaatttcagacgagttttcagaggccattggcgcactgcgcgggcatgaagataaaatccgcgtagttctgaataaagcagatatggttgagacccagcagctgatgcgggtgtatggagctctcatgtgggctctcgggaaggtcgtggggacgccagaagtgctgagagtgtacatcggatctttctggtctcagcctctcctcgtgccagataaccgccggctgttcgagctagaggaacaggatctattcagggacattcaaggccttccacggcatgccgcgcttagaaaactgaacgatcttgtcaagagagcccgcctggtgagagtccatgcctacatcatcagctatctgaagaaggagatgccatcggtctttggaaaagagaacaagaaaaaacagttgattctgaagctccccgttatctttgccaaaattcagttggagcatcatattagtcccggtgacttcccagattgtcaaaaaatgcaggaactgctcatggctcatgacttcactaagtttcacagcttaaaacctaaacttctggaagctcttgacgaaatgttgacccatgacatagcaaagctgatgccacttctacgccaagaggagctcgagtcaaccgaggtaggggtgcaggggggcgcgtttgagggcacccatatggggccttttgttgaaaggggacccgatgaggctatggaggacggcgaggaggggagcgacgacgaggccgaatgggtcgtgaccaaggacaagagtaagtacgacgagattttttataatctggccccggccgacggaaagctcagcgggagtaaggcaaaaacctggatggtaggaacaaaactgccaaatagcgtgcttggtcggatttggaaacttagtgacgtggaccgggacgggatgctggatgatgaggagtttgcgctcgcctcacacctgatagaagcaaagctggagggccacggcctgcccgccaatttgccgcgaaggctggtccccccatcaaagcggcgacataagggttccgctgaatag

SEQ ID NO: 115618 - DNA, 681 bp, Artificial Sequence
  Description of Artificial Sequence: Synthetic coding sequence
atgccaagcgtctttgggaaggaaaataagaaaaagcagctcatcctgaagctacctgtgatatttgccaaaattcaactggaacatcacatctctcctggtgatttccccgactgtcagaaaatgcaggaattgctgatggctcatgatttcaccaaatttcacagcctgaagcccaagttgttggaagcactcgacgaaatgctgacccatgacatcgcgaaactgatgccgttgctgcgccaggaggaattagagtcgacagaagtcggagtgcaggggggtgcctttgagggcacacacatgggaccttttgtagaaagaggaccagatgaggccatggaggatggggaggaggggtcagacgatgaagctgaatgggtggtaacgaaagacaaatctaaatacgatgagatcttttacaaccttgcaccagctgacggaaagctgagcggatcgaaggccaagacttggatggtggggacaaagctgccaaattcagtcctaggccgaatatggaaattgagcgacgtcgacagggacggcatgctagatgatgaagagtttgcccttgcatcacatttgattgaagctaagcttgaaggccacggcctacctgctaatctgccgagacgcctcgtacctccatctaaacgccgacacaaaggcagtgcagaatag

SEQ ID NO: 115619 - DNA, 1608 bp, Artificial Sequence
  Description of Artificial Sequence: Synthetic coding sequence
atgttctcctggttaggtactgacgatcggcgcaggaaagacccagaggtatttcagactgttagtgaagggctcaaaaaattatataagtccaaactgttaccactggaggaacactataggttccacgagtttcacagccccgctttagaagacgccgattttgacaataagccaatggtcttgctggttggccaatactctacaggcaaaacgacctttatcaggtacctgctggagcaagacttccccggcatgagaatcggccccgagcccaccacggatagctttattgctgtaatgcagggcgatatggagggcataataccgggtaacgctctagtggtcgacccgaagaagcccttcagaaaacttaatgcctttgggaacgcctttttaaaccgattcgtgtgcgcccaattgcctaacccagtactggagtctatcagcgtgattgacactcctgggatcctgtctggggagaaacagcgaatttcacgcggctatgattttgcagccgtgctcgagtggtttgctgaacgcgtagacagaattatcctgctcttcgatgcccataagctcgacatctcagatgaattcagtgaagtgataaaggcccttaagaaccacgaggataaaatgagagttgtgctaaacaaagccgatcagatcgaaacccaacagctgatgcgcgtgtacggggcacttatgtggagcctcggcaagattgttaacactccagaggtgattcgcgtgtacataggaagtttctggtcacacccactgctgattccagacaacaggaagctcttcgaggcagaagagcaggacctattcagggacatacagtccctacctcggaatgccgccttgcggaagcttaatgaccttatcaagcgtgctcggctggccaaagttcatgcgtacattatcagttccctgaagaaggaaatgccttctgtctttgggaaggataataagaaaaaggagttggttaacaatttggccgaaatctatggccgcatcgagcgggaacatcagataagcccaggcgatttccctaacctgaaacgcatgcaagatcagctgcaagcgcaggactttagcaagttccagcccttgaaaagcaaactgctcgaggtcgtggatgacatgttggcacacgatatcgctcagcttatggtgctcgtcagacaagaagaatctcagagaccaatccaaatggtgaagggcggggcattcgaaggcaccctacacgggccttttggacacggttatggcgaaggagcaggtgaagggatcgatgatgccgagtgggttgttgctcgggacaaaccaatgtacgacgagattttctatacccttagcccggtggacggaaagatcacaggggccaacgccaagaaagaaatggtccgctcaaagctgccaaacagcgtcctggggaagatttggaaactggccgatattgacaaggacgggatgttggacgatgacgaatttgctcttgccaaccatctcattaaggttaagttggagggccatgaacttcctaacgagctgccagcccatttacttcccccatccaagcggaaagtcgccgagtag

SEQ ID NO: 115620 - DNA, 528 bp, Artificial Sequence
  Description of Artificial Sequence: Synthetic coding sequence
atgttcagttggctcgggactgacgaccgccgcagaaaagaccccgaggtatttcagaccgtttctgagggattaaaaaaattgtataagagcaaattgctgccgctcgaagaacattaccgcttccacgaatttcattctcccgccttagaggacgcagactttgacaataagcctatggttctgttggtgggacagtactccacgggcaagacaacattcatccgctacctgctcgaacaagattttcccggtatgcgcatcggaccagaacctaccactgattcgtttatcgcagttatgcagggggatatggagggtataatccctgggaatgctctggttgttgaccccaaaaaaccatttaggaagctgaacgcgtttggtaacgcattcctcaatcggtttgtctgtgctcagttgccaaatcccgttctagaatcgatatccgttatcgacacccccggaatcctaagtggtgagaagcagcggatctcaagaggccctgctgccgggccgggtctgtag

SEQ ID NO: 115621 - DNA, 4086 bp, Artificial Sequence
  Description of Artificial Sequence: Synthetic coding sequence
atgggtgcggccggtagacaggattttctgtttaaggccatgctcacaatctcatggcttactctgacttgtttccctggagcaacatcgaccgtagcggcaggttgcccagatcaaagcccagagcttcagccttggaaccctgggcacgatcaggaccatcacgtgcacattgggcaggggaaaactcttctgctcacctctagcgctactgtgtattctatccacatttctgagggcgggaaattagtcatcaaggatcatgacgagcccatcgtcctgcgcactaggcacatccttatcgacaatggaggagagctgcacgctggatcagccctttgtccattccagggtaattttaccatcattctgtatggacgcgctgacgagggtattcaaccagatccctactatggtctaaagtatattggcgtagggaaaggtggagcgttggagctgcacggtcagaagaaactgagctggacgtttctgaataagacactgcaccctggggggatggccgaaggaggatacttctttgagcgctcctggggtcaccggggagtgatcgtgcacgttatcgacccaaaatcaggaacagtgattcattcagacagattcgacacatatcgaagtaaaaaagagtccgagcggctggtgcaatacttaaacgccgtccctgacgggcgcatcttgagcgtcgcagttaatgacgagggatcaaggaaccttgatgacatggcgaggaaggcaatgacgaaactcggtagcaaacacttcctacacttgggcttccggcacccatggagctttctgacagtgaaaggaaatcctagctcgagtgtagaggaccacatagaatatcacggacaccggggaagcgccgccgcccgagtctttaaactgtttcagactgaacatggcgaatattttaacgtgtcgctgagctctgagtgggtgcaggacgtggagtggaccgaatggttcgatcacgataaggtctcccaaacgaagggaggggaaaaaataagcgatctttggaaggcacatccaggtaagatttgtaaccggcctattgatatacaagccactaccatggacggtgtaaacctgtccacagaggtggtgtacaaaaagggacaagactatcgattcgcctgttacgatcgaggacgcgcttgtcgcagctacagagtgagatttctgtgcggcaagcctgtgaggccgaagctcaccgtgacgattgacactaatgtgaattccacgatcttgaatctggaagataatgtgcagagttggaagcctggagacaccctggtgatcgcttctactgattacagtatgtaccaagctgaagagttccaggtcctgccttgccgcagttgcgcgccgaatcaggtgaaggtggctgggaagcctatgtacttgcatataggcgaagagatcgacggtgtcgacatgagagccgaagtgggcttactgtcacggaacattattgtgatgggtgagatggaggacaaatgctacccataccgaaatcatatttgcaattttttcgatttcgacactttcggtggacacatcaaatttgcccttgggttcaaagccgcacacctagagggaacagagctgaagcacatggggcaacagcttgttgggcaatacccgattcacttccacctcgcaggagatgttgatgagagaggtggctacgaccccccaacttacattagagacctctccatccaccacaccttttccaggtgtgtgaccgtgcatggcagtaacgggctcctgatcaaagacgtggtggggtacaatagtttaggccattgcttctttaccgaagatggtcctgaagagcgcaacaccttcgatcattgtcttggactgctggtgaaatcgggcacgttgctgccttccgaccgtgactcaaagatgtgtaagatgatcacagaagacagttatccgggctacatcccaaagcctagacaggattgtaatgctgttagtacattctggatggcgaaccccaacaataacctgattaactgcgctgcagcgggcagtgaggagaccggcttctggtttatcttccaccatgttccaacaggtcctagcgtggggatgtactcccccggctactcagaacacatccccctcggcaagttttacaataatcgcgcacactctaactatcgggccggcatgattattgacaacggagtgaagacaaccgaagcgtctgctaaagataagcgcccgtttcttagcatcatctcagcccggtactccccccatcaggatgccgatcccctcaagcctcgggaacctgctattataaggcattttatcgcatacaaaaaccaagatcatggagcatggctccggggcggcgacgtgtggctagactcctgtcgtttcgcagataacggaattgggctgacgctcgccagcggcggaacattcccgtacgatgatgggtccaaacaggagattaaaaactcattattcgtcggagaatctggaaatgtggggactgaaatgatggacaaccggatttggggacctggcggcctggatcactccggcagaacccttcctataggacagaacttccctatccgaggaatccagctgtacgatgggcctatcaatattcagaactgtactttccgaaagttcgtggccttagaagggagacatacttccgcactggcttttcgactgaataacgcctggcaatcttgtccccataataacgtgacggggatcgccttcgaagacgtccccattactagcagggtgttttttggcgaacccgggccctggtttaatcagttggacatggacggagacaaaaccagcgtgtttcacgatgtggatggtagcgtaagtgaatatcccggatcatatctcacaaaaaacgataattggctggtgcgtcatcctgactgcattaacgtgcccgactggagaggggcaatctgctctggctgctatgcccagatgtatatccaggcctacaagacttcaaatctccggatgaagatcattaagaatgatttccctagccatcccctttacctggaaggtgctctgacccgatctactcactatcaacagtatcaacccgtggttacactgcagaaggggtataccatccactgggatcagacggcccctgcagaactggccatatggctcataaactttaataagggcgactggatcagagtaggcctgtgttatcccaggggaaccacgttttctatcctgagtgacgttcataatcggctcctgaagcagacttcaaaaacaggtgtttttgtgagaacattgcagatggacaaggtcgagcaatcctacccgggtaggtcccattactattgggatgaagatagtggattgctcttcctgaagcttaaggctcaaaatgaacgcgaaaagttcgccttttgtagcatgaaaggttgtgagaggatcaagatcaaggcactgatccccaaaaacgccggagtgtctgattgcactgctacggcctatcctaagtttaccgaacgtgccgtggtggacgtcccaatgccaaagaagctttttggcagccagttgaagacaaaagatcactttctggaggtcaagatggaatcctcaaaacagcactttttccacttgtggaatgactttgcgtatattgaggtcgatggcaaaaagtacccctcctccgaagatggcattcaggtagtcgtaatcgacggtaaccagggcagagtggtcagccatacatctttccggaactctattctgcagggaattccctggcagttattcaattatgtggctacgatcccagacaatagcatcgtcctaatggcctcaaagggcagatatgtatcaagaggcccgtggacaagagtgctggaaaagctcggcgcggacaggggtcttaaactgaaggagcagatggccttcgtgggcttcaagggcagctttcgaccaatatgggtaacactcgataccgaggatcacaaggccaaaatatttcaagtcgttcccattcctgtcgttaagaagaaaaagctctag

SEQ ID NO: 115622 - DNA, 1092 bp, Artificial Sequence
  Description of Artificial Sequence: Synthetic coding sequence
atgagtatggacgtaacgtttctcggaaccggagcagcatacccctcacctactcggggggcctccgccgtagttttgcgatgcgaaggtgaatgttggcttttcgattgtggagaagggacacagacccaactgatgaaaagtcagcttaaggcaggccgtattacaaaaatctttataacccaccttcacggcgaccattttttcgggctccctggcttgctatgcaccatcagcttgcaaagtggatcaatggtctctaaacaacctatagagatttacggcccagttggcctacgagacttcatctggcggacgatggaacttagccatacagagctcgtgtttcattatgtggtgcatgaattggttcccactgcagaccaatgccctgccgaagagctcaaagagttcgcccacgttaacagagccgacagtccacccaaagaagagcaggggcgcaccatcctgttggactccgaagagaattcttatctcctttttgatgatgaacagtttgtagttaaagctttccgcttgtttcatcgcattccatctttcggattcagcgtggtggagaaaaagcggccagggaagctgaacgcacagaagcttaaagatttgggcgtgccacctgggccagcctacggcaaattaaagaatggcatctctgtggttcttgaaaatggcgttactattagcccccaggacgtgctcaaaaaaccgattgtaggaagaaagatctgtatactgggcgactgttcaggtgttgtaggcgatggcggggtcaaactctgtttcgaagctgacctcctgattcatgaagccaccctggatgacgcacaaatggacaaggcgaaggaacatggtcactccacgcctcagatggccgccaccttcgccaaactttgcagagcaaagcggctggtcctcactcacttctctcagagatacaaacctgttgcactcgccagagagggagagacagacggaatagctgagctgaaaaagcaagctgagtctgtgctggatctccaggaggtaaccttggctgaggacttcatggtgatctcgatccccattaagaagtag

SEQ ID NO: 115623 - DNA, 2481 bp, Artificial Sequence
  Description of Artificial Sequence: Synthetic coding sequence
atgtgggcattgtgcagcctgctgagatcagcggccgggaggactatgtcacagggccggaccatatcacaggcccctgctcggagggagcggccccggaaagaccccctcagacacctacggacacgagaaaagagagggccaagcgggtgcagcgggggaccgaacacagtttatctgcaagtggttgccgctgggagccgggactctggcgccgccttgtacgtatttagtgaatttaatagatacctttttaattgtggagaaggtgtgcaacgattgatgcaggaacacaagctgaaggtggcgcggctcgataacattttcctcacacgcatgcactggagcaacgtaggtggcctgtcaggaatgattttgacacttaaagaaaccgggctgcctaagtgtgtgctgtcagggcctccccagctggaaaaatacctggaggctattaaaatcttttcaggaccgttgaaggggatcgaactggccgtccgcccgcactctgccccagagtacgaagacgaaacaatgactgtgtatcaaattccaatccattcagaacagagacggggtaagcaccagccctggcagtcaccagaacgtcctttgtcaaggctaagccctgaaagatcgagcgactccgaatctaacgaaaatgaaccacacctgccccatggggtcagtcagcggcggggagttcgggactcttccctggtggtggcgttcatctgcaagctgcacctcaaacgagggaacttcttagtgctaaaggccaaggagatgggactgccagtcggcaccgccgctatcgcgccgatcattgccgctgtgaaggatggaaaatctattacacacgagggcagggagattcttgcggaagagttgtgtaccccccccgatcctggagcagcctttgttgtagttgagtgccctgatgaatccttcatccagcccatttgcgagaatgctactttccagcgatatcagggcaaggccgacgctccagtagcacttgtggtccatatggccccggcctctgtcctggttgattcgcggtaccaacagtggatggaaaggttcgggccggatacccagcaccttgtcctgaacgaaaactgtgcttccgttcataatctgcggagccacaagatccagacccagctgaacctgattcaccctgacatctttccgctcctgactagcttccgatgcaagaaggaggggcctactctgtcggtgccaatggtgcagggagaatgcctcctcaaatatcagctcagaccccgtcgtgaatggcaaagggatgccatcatcacgtgtaaccccgaagaattcatcgtcgaagctctgcagctgcccaatttccagcaatccgtgcaggaatataggcgcagtgctcaggacggcccagctcccgccgaaaaaagatcccaatatcccgaaataattttccttggtaccgggtctgcaatccctatgaagattaggaacgtaagtgccaccctcgtcaacatttcccctgacacctctctcctccttgactgtggggagggcacattcgggcaactgtgtcgtcattacggtgaccaggttgatcgggtattaggcaccttggcagcagtgtttgtgagccacctgcatgcggaccaccacacgggcctgccgagcatactcctccaaagagaaagggcccttgcaagcttggggaagcctttgcatcctctgctcgtggtggctcccaatcaactgaaagcttggttacagcaatatcataaccagtgccaggaggtgctgcatcacatatcaatgatcccagccaagtgcttacaggagggggctgagatatcctccccagccgtcgaaaggttgatctcctccctccttcggacatgcgacctggaggaattccagacgtgccttgtgagacactgcaagcacgcctttggctgtgcactcgtgcatacaagtgggtggaaggtcgtgtatagcggtgacaccatgccatgcgaagccctggtgaggatgggaaaagacgcaactctccttatccatgaagcgactcttgaggatggtcttgaagaagaagctgttgagaaaacgcactcgacaacctctcaggcaattagcgtcggcatgagaatgaatgcagagtttataatgttgaaccatttttcgcagaggtatgcaaaagttcctctgttttcgcccaacttttccgagaaagtcggcgtggccttcgatcacatgaaagtctgcttcggagatttccctactatgccgaagttgattccccctctgaaagctctctttgcgggcgacattgaggaaatggaggaacgcagggagaagcgggagttgcgacaggtgagagccgctttgctgtccagagaactcgcaggtggcctggaagatggcgagccccaacagaaacgagcacacacagaagagccccaggcaaaaaaagtgcgcgcccagtag

SEQ ID NO: 115624 - DNA, 2424 bp, Artificial Sequence
  Description of Artificial Sequence: Synthetic coding sequence
atgtgggccctctgttcactcctgcgatctgccgccgggaggactatgagccagggccgcacgataagccaggcgccagctcgacgcgaacggcccagaaaagacccactgcggcatcttcgcacaagggaaaaacgcggcccttccggctgctccggcggccccaacacggtgtacttacaggtggttgctgccggctcccgggactccggtgttcagcggttaatgcaggagcataaattgaaagttgcccggttggacaacatatttttgacgcgcatgcattggagcaacgtgggcggcctctcaggaatgatacttacgctgaaagagactggtctaccaaaatgcgtgctctctggtcccccacaactggaaaaataccttgaggccataaagattttttctggcccattaaaaggcatcgagctggcagtcagaccacacagtgcacccgagtatgaagatgaaacgatgacagtatatcagatccctattcattccgagcagcggcgcggaaagcaccaaccttggcagagccctgaacgcccactgagccggctctcccccgagaggagcagtgatagcgaatcgaacgaaaacgagccccatctgccgcatggggtatctcagagacggggcgtgcgggactcctccctcgtggtggcctttatatgcaagctgcatctgaagcgaggcaatttcttggtgttgaaggcaaaggaaatggggctgcctgtcggaaccgctgccattgccccaataattgccgcggtgaaggatggcaaaagcatcacacatgaaggtagggagattctggcggaagaactttgtacacctccagaccctggggccgctttcgtcgtcgtcgagtgccctgacgagagctttatccagccaatttgtgaaaatgccacttttcagcgataccaggggaaagccgacgctcctgtagcattggtggtacatatggcacccgcaagtgtcctggtggactctcgctatcagcagtggatggaaaggttcggccctgacacacagcacctggttctgaatgagaactgtgctagcgttcacaaccttagaagccacaaaatacaaacccagctcaacctgatacaccctgatattttccctctgcttacaagctttcggtgtaaaaaagagggccctaccctgagtgtgccaatggtgcagggggaatgcctactgaagtatcagcttagaccccgccgggagtggcagcgcgacgcaattataacgtgcaaccccgaagagtttatagtcgaggctttgcaacttccgaatttccagcagagcgttcaggaatacagacgcagtgcacaggacgggcccgcccctgccgagaaacggtctcagtaccccgagatcatcttcctcggaactgggagcgcgatccctatgaagattagaaatgtctccgccaccctagtgaatatatcaccagacactagcttgctgctggactgtggtgaggggacttttgggcagctatgcagacattacggtgatcaagttgaccgcgttcttgggaccctggccgcagtgtttgtgtctcacctacacgccgaccaccacaccggactcccatccattctattacagcgggagagagcactggcttctctcggaaaaccactgcatccactgttggtcgtcgcaccgaaccaactgaaggcctggctgcagcagtaccacaaccagtgccaggaagttctgcatcatatctctatgattcccgccaagtgcttgcaggaaggagcagagatctcttcaccagccgtggagagattgattagtagcctcctgaggacttgcgacctcgaagaattccagacgtgtctagttcgccactgtaagcacgcctttggttgcgcacttgtccacaccagcggctggaaggttgtttactctggcgataccatgccgtgcgaagccttagtgcggatgggcaaagacgcaacattgctgattcacgaagcaactcttgaagacggacttgaagaagaggcagtcgagaagacccatagtactacaagtcaggccatttctgtggggatgcggatgaatgctgaattcattatgctcaatcactttagtcaaaggtatgcaaaagtaccgcttttcagccccaatttctctgaaaaggttggggtcgccttcgatcacatgaaagtttgtttcggcgacttccccacaatgcctaagcttattccccccttgaaggcattgttcgcaggcgacattgaggagatggaagagcggcgggagaaaagagagctcagacaggtgagggctgccttgctctctagggagctggctgggggattggaagatggggagccccagcagaaaagagcacatactgaggagcctcaagccaaaaaggttcgggcccagtag

SEQ ID NO: 115625 - DNA, 2361 bp, Artificial Sequence
  Description of Artificial Sequence: Synthetic coding sequence
atgtgggcactctgttcactgctgcgctcagccgccggcagaacaatgtcacagggacggacgatctcacaagcccccgctcgacgggagagacctcgcaaagatcccttaaggcatctgaggactcgggaaaaaagaggacctagtggctgctcaggaggccctaatactgtttacttgcaggtggtagcagctggcagccgcgattcaggagccgccctgtatgttttctccgagtttaatcggtatcttttcaactgcggtgagggcgttcaaaggctcatgcaggaacacaagctcaaagtagcaaggcttgacaatatttttttgacgcgcatgcattggtctaatgtgggaggtctaagtggcatgatcctgacactcaaggagacggggctacccaaatgtgtcctttccggaccaccacaactcgagaagtacctagaagccatcaaaatattttcgggtccactcaagggaattgaacttgccgtaagaccgcacagtgcccctgagtacgaggacgagacgatgactgtgtaccaaattccaatccactcagtgtcccagcgcagaggggtgcgggactcctctctggtcgtggcttttatctgcaagctacatcttaaacgggggaatttcctagtgcttaaggcaaaagaaatgggactgccggtgggcacagctgctattgctcctatcatcgccgccgtaaaagatggaaagagcatcacacacgaaggaagagagattctggcagaagagttatgcacccctcccgatcctggtgccgcgtttgttgtcgtggagtgccctgacgagagttttatccaaccgatctgtgaaaatgcaacatttcaaaggtatcagggaaaggccgacgcgccggtggccctggtggtgcacatggctccagccagcgttctcgtcgatagcaggtatcagcagtggatggagcgttttggccctgatacccagcacttagtcctgaacgagaattgtgcctcggttcacaacctgaggagccacaagatccagacacagcttaatctgatccaccctgatatcttcccacttctgacctccttccgttgtaaaaaggaaggacccactctgtctgtgcctatggttcagggcgagtgccttctaaaataccagctccggccgcgcagggagtggcagcgggacgctatcatcacctgtaatcccgaggaattcattgttgaagcactccagctccccaatttccagcagagcgtccaggaatatagaagaagcgcacaagatggccctgccccagcagagaagcgatcccagtaccccgaaattatctttttaggaacaggaagtgcaattcccatgaaaatcaggaatgtatccgccactctggtgaacatttctcccgacacctccctcctgctcgactgcggtgaggggacattcggtcagctgtgtcggcattacggcgatcaggtggatcgggttttaggtaccctcgccgcagtattcgtgagtcacctacatgctgaccaccatactggactgccatctatacttttacagcgcgaacgggccctagcaagcttgggcaaaccgctgcatccgctattggtcgtagcacccaaccagctgaaggcatggctgcagcagtatcataaccagtgtcaggaagtgttgcaccacatcagcatgatcccagccaagtgtctgcaggagggagcggagatatcttcgccagctgtggagcgcctcattagcagtctcctccgcacctgtgacctagaggaattccagacttgtttggtgcgccattgcaaacacgcattcggctgcgctctcgtccacacgagcggatggaaggtggtgtactcaggcgatacgatgccttgcgaagctctcgtgagaatgggaaaggacgcgacgctgctcattcacgaggctacgcttgaggatgggcttgaagaagaagctgtagagaagactcattccactaccagccaggcgatctccgtcggaatgcgcatgaacgccgaatttattatgttgaatcatttcagtcagcggtacgcaaaagttccactgttctccccaaacttctccgagaaggtgggagtggcattcgatcacatgaaggtgtgttttggagatttccctacaatgccaaagttgataccccctcttaaagccttatttgcaggggacatagaggagatggaggagcggagagagaagcgcgaactacggcaggtccgggccgccctgctcagccgagagttagcgggtggtctagaagacggggaaccacagcaaaagagagcacatactgaggagccccaggccaagaaggtgcgagctcagtag

SEQ ID NO: 115626 - DNA, 861 bp, Artificial Sequence
  Description of Artificial Sequence: Synthetic coding sequence
tgacctcacggagttagccagcgccgaggagtgagagattcctctctggtggtggccttcatctgcaaactgcatctgaaacgtggaaacttcctggtgctgaaagccaaggagatggggctgcccgtaggaaccgctgccatagcccccattatcgctgccgtgaaagatggaaaatccattactcacgagggtcgggaggtgctccagattctagccgaggagttgtgtaccccccccgaccctggcgcagccttcgtggtggtggaatgccccgacgagtcgttcatccagcccatctgcgaaaacgcaacctttcagcgataccaaggcaaggccgatgcccctgtcgccctggtggtgcatatggcacccgcctcggtgctggtcgatagccgataccagcagtggatggaacggtttggtcccgatacgcagcaccttgtcctaaatgaaaactgtgcctcggtgcataatcttcgaagtcataaaatccaaactcagcttaacctaatccatcccgatatctttcccctcctcaccagttttcgatgcaagaaagagggtcctactctcagcgtgcctatggtgcagggcgagtgccttcttaagtaccagctccggcctcgcagggaatggcagagagacgcaattataacatgtaaccccgaggagttcatagtggaggcactgcagctgcctaattttcagcaatcagtgcaggaataccggcggtccgcccaagacggcccagctcctgctgaaaaaaggagccagtatccagagattattttcctgggaaccggttctgccatcccaatgaaaatcaggaacgtctcagccaccctggttaatatttag

SEQ ID NO: 115627 - DNA, 837 bp, Artificial Sequence
  Description of Artificial Sequence: Synthetic coding sequence
atactggccgaagagctctgcaccccccctgatcctggggcggctttcgttgtagtagagtgccctgacgagagctttattcagcccatatgtgagaacgccacctttcaaagatttgggcctgacacccagcatctcgtcctcaatgagaactgcgcgtctgttcataacctgaggtcccacaaaatccagacacagttaaatctcatccaccctgatatcttccccctgctgaccagcttcaggtgtaagaaggaaggacccaccttgagtgtgccaatggtgcaaggtgaatgcttactgaagtatcagctcagaccacgccgagagtggcaaagggatgcgataatcacgtgcaatccagaagaattcatcgtggaagctctccagttgcctaactttcagcagtccgtgcaggagtaccggcgttcagcccaggacggtcctgcaccagccgagaagaggtctcagtatccagaaatcatattccttggcacaggctcagccatccccatgaaaataagaaatgtgtccgctacgctggtcaacatctccccggatacctctctgctcctggactgcggagaggggacctttggacagctgtgtaggcactatggagaccaggtcgaccgagtcctcgggacactggccgcggtctttgtgagccacttgcatgcggaccaccatacaggactgccatctatactcctgcagcgtgagcgcgctctggcctcacttggtaaacctctgcatccactgctcgtggttgcccctaaccagcttaaggcctggttgcaacaatatcacaatcagtgccaagaggtccttcactag

SEQ ID NO: 115628 - DNA, 804 bp, Artificial Sequence
  Description of Artificial Sequence: Synthetic coding sequence
atgaccctcggccggcgcctggcttgcctgttccttgcctgcgtgttacccgctttgctgttgggaggaacagccttggcctcagagattgttggcggtcggcgcgctcggccccacgcatggccatttatggtgtcgctacaactacgcgggggccatttttgcggagcaaccctgatcgctcccaactttgtgatgagcgccgcacattgtgtagccaatgtcaatgttcgcgcggtgagagtcgttctcggcgcacataacctgagtcgcagagaacctactcgccaagtcttcgccgtccagaggattttcgagaatggatatgatccggtcaacctcctcaatgatattgtgatcttgcaattgaacggatctgctaccattaatgccaatgtgcaggttgcacagctgccagcccagggccgccgcctgggaaatggtgtgcaatgtctggctatgggatgggggttactggggcgcaacaggggtatcgccagtgtgttgcaggagctaaatgtaaccgttgtaactagcctgtgccgaaggtcaaatgtgtgtacgttagtgcgcggcagacaggccggtgtgtgttttggggattctgggagcccgctagtctgcaatggcctgattcacggtattgcctccttcgtgcgaggcgggtgcgcaagtggcctgtatcctgacgcttttgcacctgtagcccagttcgtgaactggatcgacagtatcatccagcgaagtgaggataacccatgtccacacccgagagatccagacccagctagcagaacacattag

SEQ ID NO: 115629 - DNA, 804 bp, Artificial Sequence
  Description of Artificial Sequence: Synthetic coding sequence
atgaccctcggacgtcggcttgcctgcctgtttctggcgtgtgtcctgccagctttgctactcggggggacagccctggcctccgagatagtgggcgggaggcgcgcccgtccccacgcctggccctttatggtgtccttgcagctacgcggcggccatttttgcggtgccaccctgatcgccccgaattttgttatgtctgccgcccactgtgttgctaatgtgaatgtgcgtgctgtcagagtggtgctgggagcacataacctgtcgcgcagagaaccaacgcgccaggtgtttgccgtgcaacgaatcttcgagaatggatacgatcccgtgaatctgctgaacgacattgtcatcttgcagttgaatgggagtgccactattaatgctaacgtgcaggtcgcacagctcccagcgcaaggccggaggctgggtaacggtgtgcagtgtttggccatgggttggggattgcttgggcgtaacagaggaatagcatcggtcctgcaggagctgaatgtgaccgtagtcacaagcctgtgccgccggtcgaacgtttgtacgctggtgagagggaggcaggcgggcgtgtgcttcggggactcggggtcccccctggtctgcaacggattaatccacggaatcgcaagtttcgttcgtgggggatgcgcctccggattgtaccctgatgcctttgctcctgtggcccagtttgtcaattggatcgacagcatcattcagaggtcagaagataatccgtgcccccatccaagggatccagaccccgcctccagaactcattag

SEQ ID NO: 115630 - DNA, 3051 bp, Artificial Sequence
  Description of Artificial Sequence: Synthetic coding sequence
atggccccgaggacgctgtggtcctgttacctgtgttgtctgctgaccgctgcggctggcgctgcatcctatccgccccgcggattcagcctatataccggaagctcaggcgccttgtccccaggagggcctcaggcacagatagcaccgcggcccgctagcaggcaccgcaactggtgtgcatacgtggtcacgcggaccgtctcttgcgtgctggaggacggggtggagacttacgtcaagtaccaaccgtgtgcttggggacaaccccagtgcccacagtctatcatgtaccggcgatttctgcgacctcggtatagagtggcctacaaaacagttacagatatggaatggcggtgttgtcagggctatgggggggacgactgtgcagagagccccgccccagccttgggtcccgcttctagcactccacggcctctggcccaacccgccaggcccaatctgagcgggagttcagcaggtagcccgttgtcggggctaggtggggagggacccggagagagcgaaaaggtgcaacagctggaggagcaagtgcagtctctgacgaaggaactccagggtctgaggggggttctgcaggggctgtctgggagactggctgaggacgtgcagcgggcggtggaaacagcgtttaacggacgacagcagccggccgatgccgccgctcgtcctggtgtgcacgaaaccttaaacgagattcaacaccagctgcagttgctcgacactcgagtatcaacccacgatcaggagctgggccatctgaacaaccatcatggtggatcctccagcagcggcggtagtcgagcacctgctcctgcttccgccccaccaggccccagtgaagaactgctgcggcagttggagcaacgattgcaggaatcttgctccgtgtgcctagctggactcgatggatttcgcaggcagcagcaggaagatagggaacgtctgcgggcgatggagaagctactagccagcgtcgaggagaggcaaagacatctcgccggccttgctgtgggaagacgtcctccacaggagtgctgttccccagaactgggccggaggttggccgagctcgagcgaagattagacgtggttgctgggtctgtgaccgtactatccggtcgacgaggtactgagctaggcggcgcggcagggcaaggaggacacccacccggatatacgtcacttgcctctcgcctttctcgattggaggatcggttcaattccacgctgggaccatctgaagaacaagaggagagctggcctggcgcccctggaggcttgtcacattggctcccggccgctcgtggccgcctggaacaactgggcggcctgcttgcaaacgtcagcggggaacttggagggcgactggacctgttggaagagcaggttgctggcgcaatgcaggcttgtgggcagctgtgctccggggcccccggagaacaggattcccaggtgagtgaaattctttctgccctggaaagacgggtgcttgactctgaggggcagcttcgcctggtcgggtcaggtttgcatacagtggaggcagccggagaggctaggcaggctactctagaaggtcttcaagaggtcgtggggcggctgcaagaccgggtggatgcccaagacgagactgccgccgaattcacactccgcctcaatctaactgccgcacggttaggacagctggaggggttgcttcaggcccatggagatgagggctgcggcgcctgcggcggtgtgcaggaggagttggggcggcttagggacggggtggaacgatgcagctgccccctgctgccaccaagaggcccgggcgcaggtcctggtgtgggtggtccttcgcgtggccccctggatgggttcagcgtcttcggagggagtagcggcagcgctctgcaggctctgcagggagaactgagcgaggtcatcctttcattctcgtctttaaatgacagtttgaatgagctgcaaaccactgtggagggccagggagcagacctcgcagacctgggtgccaccaaagatcgcattatcagcgaaataaaccgcctccaacaagaggcaacagagcacgccacagagagcgaggagagatttagaggactggaggagggccaggcccaggcaggccaatgccccagcctggaaggcaggttgggtcgcttagagggggtgtgcgaaaggctggataccgtggcaggcggcctccagggtctccgcgaaggactgagccggcatgtcgccggcctgtgggctggcttgcgagaaacgaatacaactagtcagatgcaggcagccctcttggagaaactagtaggaggtcaggccggacttggaagaaggctgggcgcccttaactcctccttgcagttgctggaagaccgtttacatcaactgtccttaaaagacctaactgggcccgctggcgaagctggtcctccaggcccaccagggctccaaggcccacccggcccagccggcccccccgggtcccctggcaaggacggacaggagggccctattggcccaccgggccctcagggcgaacagggggtagagggggcccctgcagcgcccgtgcctcaggtggcattttctgccgccctgtcactgcccagatctgaacccggtactgtccccttcgatcgagtgttgctgaacgatggcggatactacgaccccgagaccggcgtctttacagcgccgttagctggacgctacttgctcagcgctgttctgaccggccaccggcacgaaaaagtggaggctgtcctcagccgctctaatcagggagtagctagagtggactccggaggatatgaacctgagggcctggaaaataaacccgtggccgagtctcagccatcccccggaacccttggcgtcttcagccttatcctgccactgcaggccggggatacagtctgcgttgatctagtcatgggccagctggcccattcagaagagcccctgactattttctcaggtgctctgctgtacggagacccagaactcgagcacgcctag

SEQ ID NO: 115631 - DNA, 1044 bp, Artificial Sequence
  Description of Artificial Sequence: Synthetic coding sequence
atggccgacttgggggccacaaaagatcggattatctcagagattaaccgtttgcagcaggaagccacagagcacgccacagaaagtgaagagcggttcagaggcctggaagagggacaagcacaggccgggcaatgccctagcctcgagggaaggttggggcggctggaaggggtctgcgaaagattggatacagtggctggagggcttcagggtctccgtgagggtctaagcagacacgtcgcaggcctttgggccggattgagagagacaaatactacaagccagatgcaggcagccttactggaaaagctcgtggggggccaagcgggccttgggagacggctgggcgctctaaattcatctctgcaattactcgaagacaggctgcaccaactgtccctcaaggacctcacaggtgaaggaacaaaagggccagccggcgaggccggccctccgggtccacctggattgcagggcccccccgggcccgcaggccctccgggaagccccggtaaagatggacaggagggacccatcggaccgcccggccctcagggagagcagggtgtggagggagcgcctgccgcgccagttccacaggtagccttctcagccgcactgtcccttcccaggagcgaaccaggcacagtacctttcgaccgggtcctgttaaacgacggagggtactacgatccagagactggagtcttcaccgcacccttggcgggcaggtatcttttgagcgccgttctcactggacatcgtcacgagaaggtcgaggctgtgctgagtcgtagtaatcagggtgttgctcgggtggactctggtggatacgagccagaagggctggagaacaagcccgtcgccgagtcccaaccctctcctggtacactgggggtatttagccttatcttgcccctccaagctggtgatacagtttgtgtcgatttagtgatgggccagctagcccattctgaggagccactcacgatctttagtggcgccctgctgtacggcgaccccgagcttgaacatgcctag

SEQ ID NO: 115632 - DNA, 1062 bp, Artificial Sequence
  Description of Artificial Sequence: Synthetic coding sequence
atgggaagtgggggccgctcagcccaggtgtcgacagggcagcgcgcctggctgttaccctgcaggtttttaaagaatactatgtcaaacgggtacgaggatcatatggcagaggattgtcggggggatatagggcggactaatctgattgtaaactacttgcctcaaaatatgactcaggacgaattgcggtcactgttttcttccataggggaagtcgagtctgctaagctgattagagacaaggtcgccggccactctctaggatatggctttgtcaattatgtcactgcaaaagatgccgagcgcgcaatcaatactctgaatggactcagactccagtcaaagactatcaaagtgagttacgcccgaccgagcagtgaagttatcaaagacgcaaacttgtacatttcaggactccccagaacgatgacacaaaaagacgtggaagacatgtttagccgcttcggcagaatcatcaacagcagggtgctcgtagatcaaacaaccggcctaagcagaggcgtggcctttatacggttcgacaagcgatccgaggctgaagaggcaattacatctttcaacgggcataaaccacctggtagctctgagcctatcacagtaaagttcgccgcaaaccctaaccagaataagaatgtggcattgttgtcacagctttaccactcacctgcgaggaggtttggcggccccgtgcaccatcaagctcagagattccgcttctctcctatgggcgtggatcacatgtctggtctttcgggcgtgaatgtgccgggcaatgcctcctctggatggtgcatcttcatctacaatctcggccaagacgcggacgagggaatattgtggcaaatgttcggaccctttggcgccgtcaccaacgttaaggtgattcgagactttaacactaacaagtgtaaaggatttggattcgtgaccatgacaaactatgaggaggccgccatggccatcgcctctttgaacgggtacaggctcggggacaagatccttcaagtctccttcaaaacgaacaagtctcacaaatag

SEQ ID NO: 115633 - DNA, 981 bp, Artificial Sequence
  Description of Artificial Sequence: Synthetic coding sequence
atgagtaatggctatgaggaccatatggccgaagactgtcggggggatatcggccggacaaatttaatcgtgaactatctgccacagaacatgactcaggatgagctacggagcttattctccagtatcggcgaggtggagtcagccaagttaatccgcgacaaagtggctggacatagtttaggttacggctttgtgaattacgtgaccgcaaaagatgccgaaagagctattaatactttgaatggcctaaggctacagtccaagactattaaggtctcctacgctagacccagttcagaggtcattaaggacgccaacctgtatatctccggcctacccagaaccatgactcagaaagatgtcgaggatatgtttagtaggttcggtcggatcattaattccagagttctggtagatcaaaccaccggcctctcaagaggcgttgcattcatccgcttcgacaaaagatccgaggccgaggaggccattactagttttaacggacacaagccgcctggatcttctgagcccattaccgtcaagtttgctgcaaatcccaatcagaataagaacgtggccctgttgtctcagctctaccacagccctgcccgtagatttggcgggccagtgcaccaccaggctcaaagattcagattctctcccatgggggtggaccacatgagtgggctgagcggagtaaacgtccccgggaatgcctcatccggctggtgtattttcatttataaccttgggcaagatgccgatgaaggaattctctggcagatgtttggccccttcggggccgtaactaacgtgaaggtgataagggattttaacactaacaagtgcaagggatttggattcgtaacaatgactaactacgaagaagccgccatggcaattgcgtcattgaatgggtatcgcctgggggataaaattttgcaggtgtcgttcaagactaacaagtctcacaagtag

SEQ ID NO: 115634 - DNA, 828 bp, Artificial Sequence
  Description of Artificial Sequence: Synthetic coding sequence
atgtcgtcccttcataaatcccgcatagctgatttccaggacgtgctgaaagagcctagtatagcactggagaaattgcgggagctttcgtttagcggaataccatgcgagggaggactccgatgtttatgttggaagatactgcttaattatctgcccctcgagcgcgcgtcctggaccagcatcctagccaaacagcgagaactgtacgcgcagtttttgagggaaatgatcatacagcccggcatcgctaaagctaacatgggagtttcgagggaggacgtcacattcgaagatcatccgctcaaccccaatcccgattcaagatggaacacttactttaaagataatgaggtgttgctccagatagacaaggatgtccgaaggttgtgcccagatatctctttctttcaaagggccaccgattacccttgcctgcttattttggatccgcagaatgagtttgagaccttgagaaagagagttgagcagactaccctaaagtcgcagaccgtcgcaagaaacaggagcggtgtgactaaccaggaacagaatattaaaccccagttctttgcctttaggtggcttacattgttgctcagtcaggagttcttgctgccggacgttatacggatctgggattctttgttcgctgatgacaatcgtttcgatttccttctgcttgtgtgttgtgctatgctcatgctgattagagaacagcttctagaaggagactttaccgtcaacatgcgtttgctgcaggattaccccatcacagacgtgtgtcagatcctccaaaaggccaaggagctgcaggacagcaagtag

SEQ ID NO: 115635 - DNA, 1164 bp, Artificial Sequence
  Description of Artificial Sequence: Synthetic coding sequence
atggctgtgcggctgtgtgacgtcgcttctctcctccgttccggctcttgggccgcagaaccttggaccggagtcattgcagcgatggaaacacaactgtcaaatggcccaacctgtaacaatacagctaatggtccaaccaccataaataacaactgttcctcacccgtagactcggggaacaccgaggactcaaagaccaatctgattgtcaattatttgccacagaatatgacacaggaagagctcaagtccttattcggctccatcggcgagatcgaatcctgcaagctcgtgagggacaaaatcacaggacagagtctggggtacggctttgtcaattacatagatcccaaggatgctgagaaagcgatcaacacgttaaacggcctgcgcctacaaacaaaaacaatcaaggtatcatacgcccgaccttcctctgctagtattcgagacgctaacctctatgtgtcaggactgcccaagacaatgacacagaaagagctggagcagctgtttagccagtacggaaggattattacctcacgtattctggttgatcaggtgacaggaatctcccgcggtgtgggttttatccgctttgacaagcggatcgaagccgaagaagctattaaagggctgaacgggcaaaagcccccaggcgctacagaacctatcactgttaaattcgcaaataacccatctcagaaaaccaaccaggctatcctgtcccagctgtaccagtccccaaacaggcgctacccggggcctcttgcgcaacaggctcagcggtttagattggataacttacttaacatggcgtatggtgtgaaacgttttagtcccatgactatagacgggatgaccagcctagccgggattaacatccccggccatccaggaacgggctggtgcatcttcgtgtataacctggcgccagacgccgatgagtccatcctgtggcagatgtttggaccgtttggagccgtcactaatgtgaaagtgatcagggattttaatacgaataaatgtaaagggttcggatttgttaccatgacaaattatgatgaggcagcaatggcaatcgcctctctcaatggatacagactgggcgacagagtcctgcaggttagttttaaaacaaacaaaacgcataaagcttag

SEQ ID NO: 115636 - DNA, 1041 bp, Artificial Sequence
  Description of Artificial Sequence: Synthetic coding sequence
atggaaacccaactgtccaacggcccgacgtgtaataataccgctaatggacccacgaccatcaacaataattgttcttccccggtggattctggcaacacagaagactctaaaactaatctgattgttaattatctgccgcagaatatgactcaggaggagctgaaatctctgtttggttctataggcgagatcgaatcatgcaaactggtgcgcgacaaaatcacaggccagtcactcggatacggattcgttaactatattgaccccaaggatgccgagaaagcaattaacacactcaacggcctccggctccaaacaaaaaccatcaaggtatcctatgctcgcccttcctctgcgagtattagggacgccaatctgtatgtcagcggactccccaagactatgacccagaaggagcttgagcagctgttctctcagtatggtcgcatcatcacaagcagaatcctagtggaccaagtgacagggatctccaggggagtcggttttattagattcgacaaacggatagaggccgaggaagctatcaaaggtctgaacggccagaagccccccggtgctacagagcctatcaccgtgaagtttgcaaacaaccctagccaaaaaaccaaccaggcgatcctttctcaactttatcaaagtccaaatcgccggtatcctggacctctcgcccagcaggcccagcggtttcggttcagccccatgactatcgatgggatgactagcctcgcgggcataaacatacctggacacccaggcaccggctggtgtatctttgtgtataacctggcgccggatgccgatgagtcgatactctggcagatgtttggccctttcggtgcggtaacaaatgtgaaagtcatcagggatttcaacacgaacaaatgtaagggcttcggtttcgtgactatgaccaactacgacgaggcggcgatggcgatcgctagcctcaacggttatagactgggtgaccgagtgcttcaggtgtcgttcaagactaacaaaacacataaggcatag

SEQ ID NO: 115637 - DNA, 1080 bp, Artificial Sequence
  Description of Artificial Sequence: Synthetic coding sequence
atggagacccagctgtccaacggccctacttgtaacaacacagcaaacgggcccactactataaacaacaattgtagctctccagtggacagcgggaacactgaggactccaaaactaatctgattgttaactatctaccccaaaacatgacacaggaagagctcaagtccctgtttggcagtattggcgaaatcgagagctgtaagttggttcgcgataaaatcactgggcagagcctcggatacggctttgtcaattacattgatcctaaagatgcggaaaaagctattaacactctgaatgggctccgtctacaaactaagactatcaaggtctcttacgccaggcccagttcagcctctatacgggacgcgaacctgtacgtctctgggttacccaagactatgacacagaaagagttggagcagctgttctcacagtacggtcgcataattacctcccgtattcttgttgatcaagtgacagggattagtcggggagttggctttattaggtttgataagcggattgaggcagaggaagctatcaaaggccttaacggccagaaaccgccaggcgcaaccgagcctatcactgtcaaatttgccaataatcccagccagaagacgaatcaggccattctgtcccaattataccagtctcccaaccgtcggtaccccggccctctggcacagcaagcccagcggtttcggcttgacaatctgctgaacatggcgtacggcgtaaaacgcttttctccaatgaccatcgatggcatgacttccctcgccggaatcaacataccaggccacccaggcaccggatggtgcatcttcgtttataatctcgcgcctgatgccgacgagtcgattttgtggcagatgttcggaccctttggggcagtcaccaacgtcaaggtgatccgggacttcaatactaacaagtgtaaaggcttcggctttgtcactatgacgaactacgacgaagccgccatggctattgcaagccttaacggataccgtttgggcgaccgcgtgttacaggtgtcctttaagaccaataagacacacaaggcttag

SEQ ID NO: 115638 - DNA, 1080 bp, Artificial Sequence
  Description of Artificial Sequence: Synthetic coding sequence
atggaaactcaactgtctaacggccctacctgtaataacacagctaacggccctaccaccatcaataacaattgctcttctcccgtagactctggtaacactgaggattccaagaccaatctgattgtgaattatcttcctcagaacatgacccaggaagagttgaagagcttgttcggttccattggggagatcgagtcatgcaagctggttagggacaagattaccggtcaatcacttggctacggctttgtaaattatatcgatccgaaagatgcggagaaagccataaatacgctcaacggactgagattacagactaaaacaatcaaagtcagttatgctcggccaagctcggccagcattcgggacgctaatctatatgtgtcagggctgcccaaaaccatgactcagaaagaactggagcagctctttagccagtacggtcggatcataacttctagaatcttggtggaccaagtcacaggcattagtaggggtgtggggttcattaggtttgacaagcgcatcgaggctgaggaggcaatcaagggcctcaacggacagaaaccaccaggggctactgagccaataaccgtcaaatttgctaataaccctagtcaaaagactaatcaagcaattctttcacagctctaccagtcccccaatcgaaggtatcccggccctctggcccagcaagcccagcgattcagattggacaacctgctgaacatggcttatggggtcaaacgcttctcccccatgaccatagacggcatgaccagcttagcaggcataaacataccaggccacccaggaacagggtggtgcattttcgtgtacaatctggcacctgatgccgacgagtccatactgtggcaaatgtttggaccttttggagccgtgaccaatgtgaaggtgataagggatttcaacacaaacaagtgtaagggcttcggctttgtgacaatgacaaactatgatgaggcggctatggccatcgctagtctaaacggatatagactgggtgatagagttctacaggtgagtttcaagactaataaaacacacaaggcctag

SEQ ID NO: 115639 - DNA, 273 bp, Artificial Sequence
  Description of Artificial Sequence: Synthetic coding sequence
atgactcagaaggagctggagcagctgtttagtcaatacggccggattattacttctcgaatcctcgtggaccaggttaccggaatttcccgcggcgtaggattcatccgattcgacaagaggatcgaggcagaggaggcaattaaaggattgaacggacagaaaccacccggggccacagagccaataactgtaaaatttgccaataatcccagtcagaagactaaccaggccatcctcagccagttataccagtcccctaaccgaaggtag

SEQ ID NO: 115640 - DNA, 570 bp, Artificial Sequence
  Description of Artificial Sequence: Synthetic coding sequence
atggagacccagctgtctaacggtcccacttgtaataatacagcaaacggtccaaccacaattaataacaattgctcttctcccgtggattccggaaacaccgaggactcgaaaacaaatctgattgtgaactacctcccgcagaatatgacccaagaagagctgaagagcttattcgggtctatcggagagattgagagctgtaagctggttcgagataagattaccgggcagtcactcggctatggattcgtcaattatattgaccctaaggacgctgagaaggcgatcaacaccctaaacggcctaaggttacaaaccaagactattaaggtgagttatgctaggccatcttccgcaagtatccgggacgctaacctgtacgtgagcggcctcccaaaaactatgacacagaaagaactcgaacagctcttctcccaatatggtaggataattacatccaggatcttagtggaccaagttacaggaatcagtcgaggggttggatttatcaggttcgacaagcgaatagaggccgaagaggccatcaaagggctcaacggacagtag

SEQ ID NO: 115641 - DNA, 1080 bp, Artificial Sequence
  Description of Artificial Sequence: Synthetic coding sequence
atggaaacccagctgtcaaatggcccgacctgcaacaacaccgccaacgggccgaccactattaacaacaattgctcatcccctgtcgattcgggcaacaccgaagacagcaagactaaccttattgtgaattacctgccccagaatatgactcaggaagaactgaagtcccttttcggcagtataggggagatcgaatcctgtaaactggtgcgcgacaagattaccggacagtcattgggatatggattcgttaattatatcgatccaaaagatgccgagaaggctattaacaccctcaacggtctgcgtctgcaaaccaagaccatcaaagtatcttacgcgagaccgtcaagtgcatctataagggacgcaaacctgtacgtttcaggcttgcccaagactatgacacaaaaggagctcgagcaactttttagccaatacgggcggataattactagccgtattctagttgaccaggttacagggataagccgcggcgtaggctttattcgattcgataagcgcattgaagcagaagaggctattaagggcctcaatggccaaaagcctcccggagccaccgaaccaattacagtcaaatttgcgaacaaccccagccagaaaacaaaccaggctattctctcccagctatatcaatcccccaacaggcgctatccaggccctctggcacagcaggctcagcgatttagacttgacaacctgctgaatatggcatacggcgtgaagagatttagtcccatgacaattgacggcatgacctctctcgcaggcatcaacattcctggtcatcccgggaccggctggtgcatcttcgtatacaacctggcccctgacgccgatgaatctatcctgtggcaaatgtttggccctttcggcgccgtgaccaatgttaaagtcatccgagactttaatacgaacaaatgtaaagggtttggattcgtgaccatgactaactacgacgaagccgccatggccatcgcctcactaaatggctataggttgggggatagagtgttgcaggtttcgttcaaaaccaataaaacccataaagcctag

SEQ ID NO: 115642 - DNA, 1104 bp, Artificial Sequence
  Description of Artificial Sequence: Synthetic coding sequence
atggtcacgcagattttgggtgccatggagtctcaggtcggcggaggccctgccggcccagcactgccgaatgggccgctgctgggtacgaacggagcaacagacgactccaaaacaaacctcattgtcaattaccttccccagaacatgacccaggatgagttcaaatcccttttcggctcgattggtgacattgagtcatgcaagcttgtccgcgataaaattaccggacagtccctggggtatggattcgtgaattactctgatccgaacgacgcagacaaggccattaacactctaaacggtctaaaattacagacaaaaacaataaaggtgagttacgctcgaccttctagtgcctctatcagggacgccaacctgtacgtttcgggcctgcctaaaacaatgtctcaaaaggagatggaacagttgttctcacagtacggtcggatcattacaagtaggattctggtggatcaagtgaccggggtgagcaggggtgtcgggttcatccgttttgacaagcgcatcgaggccgaagaagcgattaagggactgaacggtcagaagccgctcggtgccgcagagccaattacagtgaaattcgctaacaatccttcccagaagactggacaagccctgcttactcacctttaccagagttcggctcgccggtacgccggaccccttcatcaccaaactcaacgattccgactcgacaacctgctgaatatggcatacggtgtcaaaagtccactctccctgatcgcccgttttagtccgattgctatcgacggaatgtccggactcgcgggcgtcggactgtcaggcggagcagctggtgccggatggtgtatttttgtttacaatctgagcccagaggccgatgaaagcgtcctctggcagctttttggcccatttggagccgttacaaacgtcaaggtcatcagagatttcactacaaataagtgcaaggggtttggctttgtcaccatgacgaactacgatgaggctgcaatggctatagccagcctgaacggttatcgattgggcgaaagagtgctgcaggtgtcctttaagacctcaaaacagcacaaggcctag

SEQ ID NO: 115643 - DNA, 1083 bp, Artificial Sequence
  Description of Artificial Sequence: Synthetic coding sequence
atggtcactcagatccttggggctatggagtcacaagtgggtgggggccccgctggtcctgctctgccaaacggccctttactgggaacaaatggcgctaccgatgattcaaagacaaatctcatcgtgaactatctgccacagaacatgacacaggacgagttcaaatccctcttcggtagtatcggcgatatcgagtcatgcaaactagtgcgcgacaagattaccgggcaatctctcggatacggctttgttaattactcagaccctaatgatgctgacaaggccatcaacaccctgaatggacttaagctgcagaccaagaccataaaagtttcttatgctcgccctagcagcgcatccatcagagacgctaatctctacgtcagcggactgcccaagaccatgtctcagaaggaaatggaacaactcttctctcagtatggacgtataatcacgtcccgtatactagttgatcaggtgactggtgtctcacgaggcgtgggcttcataaggttcgacaagagaatcgaggcagaggaagcaatcaaagggttaaacggtcaaaaaccactgggcgccgcagagccaatcaccgtcaaattcgcaaacaatccaagtcaaaaaaccggccaggcactgctcactcacctatatcagagctcagccaggcgatacgcaggtcctttacaccaccaaacccaacggttccggcttgataacctgcttaacatggcctatggcgtcaaacgcttctcccctattgcgatcgacggcatgtctgggctcgctggcgtcggcctctcaggtggggctgccggtgccgggtggtgcatcttcgtgtacaatctctcgcctgaagctgacgagagtgttctgtggcagctttttgggccattcggcgccgtgaccaacgtcaaagtgattcgagatttcacgaccaacaaatgcaaagggttcggctttgtcacaatgactaattatgatgaggctgcaatggctattgcctccctgaacggctacagattaggtgaacgggtgctccaggtaagcttcaaaacatcaaaacagcacaaggcgtag

SEQ ID NO: 115644 - DNA, 1152 bp, Artificial Sequence
  Description of Artificial Sequence: Synthetic coding sequence
atgagactcttgcttctgagagaaatagttataaacgagagtaggaactgcagttttatgattattagtacaatggagcctcaggtcagcaacggccctacctctaatacatccaacgggccctctagtaacaaccggaattgcccgtctcccatgcaaacaggggccaccactgatgactctaaaaccaacttgattgttaactatctcccccagaacatgactcaagaagagtttcggagtcttttcggctctatcggggaaattgagagttgcaagctggtccgcgacaaaatcaccgggcagagcctcggctacgggtttgtgaactatatcgaccccaaggatgcagagaaagcgatcaacacgctgaacggcttgaggctccaaaccaagacgatcaaagtgtcatacgctcgccctagctccgcatccattcgagatgctaatctgtacgtaagcgggttaccaaaaaccatgactcagaaggagctggagcaactctttagtcagtacggccgaatcattacgtcccgaattctagttgaccaggtgacaggagtgtcccggggggtcggctttatacgctttgacaagcggatcgaggcggaggaggccatcaagggacttaacggccagaaaccttcaggggcaactgagcccataacagtgaaatttgcaaacaaccccagtcagaagtcttcacaagccctcttgagtcaactgtatcagtccccaaacaggcggtaccctggacccctgcaccaccaggctcagcgattccggctcgataatctgctgaatatggcttatggagtgaagagattttccccaattaccattgacgggatgacctctttggtgggcatgaacattcctgggcatacaggcaccgggtggtgtatcttcgtttacaacctctcaccggacagcgatgagagcgtgctatggcaactatttggaccatttggcgccgtgaacaatgtcaaggtgataagggattttaacacgaataaatgcaaaggcttcggcttcgtgactatgactaactacgacgaagctgcgatggcaattgctagcctgaacggctaccgcctgggagacagggtgttgcaggttagcttcaagaccaacaaggctcacaaatcctag

SEQ ID NO: 115645 - DNA, 1116 bp, Artificial Sequence
  Description of Artificial Sequence: Synthetic coding sequence
atggaatggaacggcttgaagatgattattagcactatggagccccaggtgtccaatgggcccacctcaaatacaagtaatggcccctcctcgaacaaccgtaattgcccaagtccaatgcagacgggcgcaaccaccgatgactccaaaacgaacttgattgtgaactacttacctcaaaacatgacacaggaagaatttaggtcgttatttggatccataggggaaattgaaagttgtaaacttgttagggataaaatcactggtcagagtctgggttacggcttcgtgaattacattgatcccaaagatgcagaaaaggccatcaatacattaaatgggctccggcttcagaccaaaactattaaggtctcttatgcccggccctcttccgcctctatcagagatgcgaacttgtacgtgtcagggctgcctaaaaccatgactcagaaggagctggaacagttattctcgcagtatggcagaatcatcactagtagaatcctggtcgatcaagtaacgggcgttagtcgaggcgtcggatttattaggttcgacaaaaggatcgaggcagaagaagccatcaaaggactcaacggccaaaagccctcaggagcaacagagcctatcaccgtgaagtttgccaacaatcctagtcaaaagtcctcacaggctctgcttagccagctctatcagtcccccaatagaagatatcctgggccattgcatcatcaagcccagaggttccggttggataatcttcttaatatggcttacggtgtgaagcggttctcacccataacaatcgacggaatgacttcccttgttggtatgaacatccccggccacacaggtacaggatggtgtattttcgtgtataacctgtcacctgacagtgatgagtctgtactctggcagctttttggacccttcggagccgtgaataacgtcaaagtcattagggatttcaacacaaataagtgtaaggggttcggatttgtgactatgaccaattatgatgaggccgctatggccatcgcatctcttaatggctatcgtctgggagaccgcgttctgcaggtctctttcaaaaccaataaggcccacaagtcctag

SEQ ID NO: 115646 - DNA, 1158 bp, Artificial Sequence
  Description of Artificial Sequence: Synthetic coding sequence
atggaatggaacggactcaaaatgatcatatccaccatggagccacaagtctcaaatggccctacatccaatacctcgaacgggccttccagtaacaataggaactgcccatctcctatgcaaactggtgccacaaccgacgactctaaaactaacctcattgtgaattacctgccacagaacatgacacaagaagagtttcgctcactgtttggctctataggcgaaattgagtcttgcaagctcgtcagagataaaattactggacagtctttgggttacggtttcgtaaactacatagatccaaaggatgcggaaaaggcgattaataccttaaacggtttgaggctgcaaaccaaaactattaaggtctcttatgctcgcccatcctctgccagcattcgagacgctaatctctacgtgtccggacttcctaaaactatgacccagaaggagctagaacagttattcagccagtatggacgcatcataactagtcggattctggtcgatcaggtgacaggcgtgtctagaggcgtgggctttatccggtttgacaaaagaatagaggccgaggaggcaatcaagggactgaatggacagaagccttctggcgccaccgagccgatcactgtcaagttcgcgaacaatccatcacaaaagtcctcccaagcgctcttgtcccagctgtatcagagtcctaatcgacgataccccggccccttgcaccatcaagcccaacgattccggctggataatctgctgaacatggcatacggggttaagagattaatgtccggtcctgtccccccctccgcctgtccccccaggtttagtcccattacaatcgacggtatgacttcactggtgggcatgaacatccccggacatactgggaccggatggtgcatatttgtgtacaacctctcacccgactctgacgaaagtgtcttgtggcagctttttgggccctttggcgcagtaaacaacgtgaaagttatccgggactttaacaccaacaaatgtaaggggtttggattcgtaaccatgactaattacgatgaggctgccatggctattgccagcctcaacggttaccgcttgggtgatcgcgtgcttcaggtaagtttcaagactaataaagctcacaagagttag

SEQ ID NO: 115647 - DNA, 1143 bp, Artificial Sequence
  Description of Artificial Sequence: Synthetic coding sequence
atggtgatgatcatcagtaccatggagccacaagtctctaatggacctaccagtaacacctcaaacggccctagctctaacaatagaaactgtccatcccctatgcagacgggggccaccacggacgatagcaaaactaatcttatcgtgaattatctaccacagaatatgacacaagaagaattcagaagcttgtttggaagcattggcgagatcgagagctgtaagctggtcagggataaaataaccggtcagtccctgggctacgggttcgttaactacatcgacccgaaggacgctgagaaagccattaacacgctaaatggcttgcgactgcaaactaaaacgattaaggtatcttatgcacggccctctagcgcatcgatccgtgatgcaaacctctacgtgtcaggcctcccaaaaacaatgacccagaaagagctcgaacaactgttctctcagtatggccgcattattacgtcccggatactagtggatcaagtgacaggtgtctctaggggtgtcggcttcattagatttgataagcgcattgaggcggaagaggcaattaagggactaaacggacagaagcccagtggcgcaacagagcctatcacggtgaaatttgcaaataatccttcacagaagtcatcgcaagccctgctatctcagctgtatcagagtcccaacaggaggtacccaggccctctgcatcatcaagctcaaaggtttcgactggataatcttcttaatatggcctacggagtgaagagattaatgagcgggccagtgccaccatctgcctgtccaccacgcttttctcctatcactatcgacggcatgacgagcctcgtgggcatgaacataccagggcacaccgggaccggttggtgcatctttgtatacaacctatcaccagattccgatgagtccgtcctgtggcagctgttcggtcccttcggtgccgtaaacaatgtgaaggtgattagggactttaataccaacaaatgcaagggatttggatttgtcacgatgactaactatgatgaagccgcaatggccatcgcttcactcaatggttaccggctcggcgatagagtgctgcaagtatcttttaaaaccaacaaagcccacaaatcctag

SEQ ID NO: 115648 - DNA, 1101 bp, Artificial Sequence
  Description of Artificial Sequence: Synthetic coding sequence
atggtgatgatcatttccaccatggagccacaggtttcaaatggacctacatccaacaccagcaatggacccagcagtaacaatagaaactgcccctcacccatgcagactggagcaactaccgacgacagcaaaactaacttaatcgtgaactacttgcctcagaacatgacgcaggaagagttccgctccttatttggaagcatcggggagattgaatcctgcaagctggtccgggataagatcaccggccagtctctgggctacggtttcgtgaactacatcgatccgaaggacgcagaaaaagccattaacacattaaacggcttgcgcctgcagacaaagactatcaaagtatcatatgccaggcctagcagcgcctctatccgcgacgcgaacctgtacgtgagcggcctcccaaaaactatgacacagaaggaactggagcagctttttagtcaatatggacggatcatcacgtctagaattctggtggatcaagttacgggcgtgtctcggggcgtggggtttatcagattcgacaaacggatcgaggctgaggaggcaattaaaggcctgaatggccagaagccaagtggtgcaacagagccgattactgtgaaattcgccaataatccatcccagaagagcagccaggcactcctgtcacagctgtaccagagtccaaaccggaggtacccagggcccctacaccatcaggcacagcgattcagactggacaacttgctgaatatggcctacggagtgaaacgattttcacctattacgatcgacggcatgactagtctagtgggcatgaatattcctggacatacggggaccggctggtgtattttcgtctacaatttgtcccccgactcagacgaatccgtgctgtggcagttgttcggaccttttggggcagtaaacaatgtcaaagtcatccgcgacttcaatactaacaagtgcaaagggttcggattcgtcaccatgacaaactacgacgaagccgccatggcaatcgcaagcctcaacggttatcgacttggggatagggtgctgcaagtgtccttcaagaccaataaggcccacaaatcctag

SEQ ID NO: 115649 - DNA, 1101 bp, Artificial Sequence
  Description of Artificial Sequence: Synthetic coding sequence
atggagcagattatttctacaatggagcctcaggtcagtaacggccctacaagcaacacgtctaatgggcccagctcaaacaaccgcaactgcccgtcaccgatgcagacaggcgctacgacggacgattccaagaccaacctcattgtcaattatctgcctcagaacatgactcaggaagaatttaggtctctctttggctcaataggagagattgagtcttgtaagcttgtgagagacaaaatcaccggacagtccctcggatacggattcgtgaattatattgatcctaaggatgctgagaaggctattaacacactcaatgggctgcgcttgcaaaccaagactatcaaagtctcatatgcccgacctagtagcgcctcaataagggatgctaacttgtacgtaagcggtctgcctaaaactatgacacagaaggaacttgaacagctgttttcccagtacggaaggataatcacatctcgaatcctcgtagaccaggtgactggcgtgtcccgcggggttggtttcatccgattcgataagcgaatcgaggccgaagaagcgattaaggggctgaacggtcagaagccatccggcgccacagaacctataacagtgaaattcgccaacaaccctagccagaaaagctctcaggcgctcctttctcagctgtatcagtctcctaatcgccggtatccaggccctctccaccaccaggctcagcgctttaggctcgacaatttgcttaatatggcctatggagtgaagcgcttcagccctatcaccattgacggtatgaccagcttggttggcatgaacatccctggacacaccggcacaggatggtgcatctttgtttacaatctcagcccagattcagacgagagcgttctgtggcagctgttcgggccgtttggtgccgttaacaacgtcaaagtcatcagagattttaacacaaacaagtgcaaaggcttcggcttcgtgaccatgaccaattatgacgaggctgccatggccatcgcgagcctgaacggctacaggctgggtgatcgggtgttgcaagtctcttttaaaaccaataaggcacacaaaagctag

SEQ ID NO: 115650 - DNA, 1110 bp, Artificial Sequence
  Description of Artificial Sequence: Synthetic coding sequence
atgagactcaaaaatcagataataagtaccatggagccccaagtaagtaacggacctacaagtaacacctctaatggtccctccagcaacaacaggaattgcccttccccaatgcaaacaggagctaccactgacgattcaaagacaaacctgatagtgaattacctgcctcagaacatgacccaggaagaattccgcagtctgttcggctccataggtgaaattgaatcatgcaaactagtacgagacaagattacagggcagtctctgggctatgggttcgtgaactacatcgacccaaaggatgcagagaaagccattaataccctgaacgggcttcgacttcagaccaagaccattaaggtgtcgtacgcccgccctagctccgccagcatccgtgatgcaaatctgtacgtgtctggcctgccaaaaacgatgacccagaaggaactcgagcaactgttttctcagtacggaaggattattacgtcgcgcatcctggttgatcaggtcactggagtgagcagaggagttgggttcatcagatttgacaagagaatagaggcggaagaggccattaagggcctgaacgggcagaagcccagtggcgcaaccgagccgataactgtaaagttcgcaaataatcctagccagaagagttcccaagccctgctgtcccagctgtaccagagcccaaatcgcaggtacccaggaccattacatcaccaggcacagcgctttcgcttggataatcttcttaacatggcttatggggtcaagaggtttagcccaatcaccatagatgggatgacttccttggtggggatgaatattcctggccataccgggacaggatggtgtatctttgtctataatctgagcccggatagtgatgaatcagtcctttggcaattgttcggcccattcggtgctgttaacaatgtgaaggtaattcgggattttaacaccaataaatgcaagggatttggcttcgtgacaatgactaattatgacgaggccgcaatggcaatcgcttctctgaacgggtaccgactgggcgatagggtccttcaggtttctttcaaaacaaataaagcccacaagagctag

SEQ ID NO: 115651 - DNA, 855 bp, Artificial Sequence
  Description of Artificial Sequence: Synthetic coding sequence
atgttccgggctgccgcgccaggtcagctcagacgcgcggtggctcaggatctgtgtaaggtcgcaggtatcgcaaaagtgttggtcgcgcagcatgacgtgtataaaggtcttttgcccgaggagctcactccattgatcctggcaacccagaagcaattcaactatacccatatttgtgccggcgcaagtgctttcggaaagaatctgttgccacgcgtggcggctaaactggaggtggcacctatctctgatattattgctattaaatcgccagatacattcgtcaggaccatctacgctggaaacgccctttgcaccgtcaaatgcgatgaaaaggtgaaggtgttctcagtacggggaacctcatttgatgcagccgccaccagtggtggctctgccagcagcgaaaaagcctcctcaacctctcctgtggagatctctgagtggttggaccagaaactcactaagagcgatcgacctgagctcaccggggccaaggtggttgtgtcaggcgggaggggcttaaaaagtggggaaaactttaaactgctgtacgacttagccgatcaactgcacgccgctgttggagcgtccagggccgcagtcgacgccggctttgtccctaacgacatgcaagttggacagacaggaaagatcgtggccccagagctctacatcgctgtgggcatcagcggcgcaatccagcacctcgctggcatgaaagattcaaagactattgttgccatcaacaaagaccccgaggctccaatctttcaagtggctgactatggaattgtggccgatctctttaaggtggtaccagaaatgacggagattcttaagaagaagtag

SEQ ID NO: 115652 - DNA, 1002 bp, Artificial Sequence
  Description of Artificial Sequence: Synthetic coding sequence
atgttccgcgcagcggcaccaggccagcttcgcagagccgccagcttgctgcgttttcagtctactttagtgatcgcagagcatgctaacgattccctggcccctattacactgaacacaataacggcggccactcgacttgggggtgaagttagctgtcttgtcgcgggcaccaaatgtgacaaggtcgcccaagatctgtgtaaagtggccggaatcgctaaagtgctagtggcccaacatgatgtgtacaagggacttctcccagaagagctgacacccttaatccttgcaacccagaaacagtttaactatactcatatttgtgcaggagctagcgctttcggcaaaaacctgctccctagggtagcagctaagctggaggtggcaccaatttccgatatcatcgcaatcaaatctcccgacacattcgtcagaaccatctatgctggaaatgcgctgtgcactgtgaaatgcgatgaaaaagtcaaagtgttcagcgtccgcgggacaagctttgacgccgctgccacaagtgggggcagtgcaagttctgaaaaagcttcctccacctctccagttgaaatctccgaatggttggatcaaaagctaaccaaaagcgacaggcccgagctgactggggcaaaagttgtggtgagcgggggccggggactcaaatcaggagagaatttcaagctactgtatgatctagcggaccagcttcacgcagctgtgggggcctcaagagccgcagtggatgccgggttcgtgccgaacgatatgcaagtgggtcagaccggcaagattgtggcccccgaactttatatagcagtgggtatcagcggcgctatacagcacctcgctggcatgaaggacagcaagaccatcgtggctatcaataaagacccagaggcaccgattttccaggtggcagactacggcatcgtggctgacctgttcaaggtggtgccggagatgaccgaaatcttgaaaaagaaatag

SEQ ID NO: 115653 - DNA, 768 bp, Artificial Sequence
  Description of Artificial Sequence: Synthetic coding sequence
atggccgagctgagggtgctggtggccgtcaagcgtgtgattgattatgcagtgaagatcagagtgaaacctgacagaacaggagtcgttactgacggggtcaagcattccatgaatcccttctgcgagattgccgttgaggaagctgtacgccttaaggagaagaagctcgttaaggaggtgatcgcagttagttgcgggcctgcccagtgccaggagacgattcggaccgccctggccatgggcgcggatagggggatccacgtagaggtgccgcctgccgaagctgagaggctaggtcccctccaggtggcacgagtgctggctaagctggccgagaaggagaaggtggatctggtgttactcggaaagcaggccatcgatgacgattgtaatcagacaggacagatgacggctggtttcttggattggccacaggggaccttcgccagccaagtaacattagagggggataagttgaaggtggaacgcgaaattgacggagggcttgagacactccggttaaagctcccggctgtggtcaccgcagacctgcgattgaacgaaccccggtacgcaacgctcccgaacatcatgaaggcgaaaaagaaaaagatagaggtgatcaaaccaggtgacctcggagttgacctgacttctaagttgtcagtcattagtgtggaggaccccccgcagaggactgcaggggttaaggtagaaacaacggaggatctggtggccaagctgaaagagatcggtagaatatag

SEQ ID NO: 115654 - DNA, 1041 bp, Artificial Sequence
  Description of Artificial Sequence: Synthetic coding sequence
atgtacctcagtttgtgggtcactatcaacaccgtgaacctccgcaacactctgagcggactccggggagccgtcaccactgtgggcatgattaagtccgatgttcctggcacccaggaatggctggacgagcggaggcgccaaggagacctcccactcccgaccaattcaaatccagtcctgagtttggagctgtgtgaccctgggcaggggccagccccattccaggccgtagtggtgctgatccagcccggccgtggcttagcccttcgaccaccccctagttgcctctttcctccggatccaacaccctcccctcctgctggtcagattagagtgaaacctgaccgaacgggcgtggtaaccgatggggtaaaacatagcatgaaccctttctgcgaaatcgccgtagaggaggccgtccgcctcaaggagaagaagctggtcaaggaggtgatagctgtctcatgtggtcccgcccagtgccaagaaacaatccgaaccgcattggcaatgggagcagacagagggatacatgtggaagtgccacccgccgaagccgagagactgggacccctgcaggtggcccgggtattagccaaactggctgaaaaagagaaggtcgatctggttctgctcgggaaacaggccatagacgatgattgcaatcagactggtcagatgaccgccggcttccttgattggccacagggcacattcgcctctcaggtaacactggagggcgataagctgaaggtggaacgtgaaatcgacgggggcctggagacattgcgactgaaattacctgctgtagtgactgcggatttgcggctcaatgagccacgttacgcaacactgccaaatataatgaaagcaaagaagaaaaagatcgaagtgattaaacctggtgacctcggggtggatttgacatccaagttgtcagttatctctgtggaggatcccccccagaggacagcaggcgtgaaggttgagacgactgaagatctggtggcaaagctcaaggaaatagggagaatttag

SEQ ID NO: 115655 - DNA, 1713 bp, Artificial Sequence
  Description of Artificial Sequence: Synthetic coding sequence
atgctggtgcccctggccaagctgagttgtttgggagttaatatggaacgcttcgctgaggaagctgatgtagtgattgtcggcgccgggcccgccggtctgtccgctgcggtgcgcttgaaacagctggccgtcgcacacgaaaaggatatccgggtgtgtttagtcgagaaggccgcccagatcggcgctcatactctgtctggggcttgcctggaccctggagccttcaaagaactcttccccgactggaaagagaagggcgctccactgaacacacccgtcaccgaggatcgcttcgggatactcacagagaaataccgtatcccggtccctattctaccgggcttgcccatgaataatcacggcaattacattgtaagactgggccacttggtgtcctggatgggggaacaggcagaggcgcttggggttgaagtatacccagggtacgcagctgctgaggtcctgttccatgatgatgggtctgtgaagggaattgccactaatgatgttggtatccagaaggacggcgctccaaaagccacttttgaacgtggactggaactgcacgcgaaggtgacaatttttgctgagggctgccacggtcatctcgccaaacagctatacaaaaagttcgatctacgggctaattgtgaacctcagacatatgggatcggactgaaggagttgtgggtgatcgatgagaagaactggaaacccggccgggtcgatcacaccgtgggatggcctctcgaccgccacacctacggtggttcttttttgtatcatctgaacgagggtgaacccttggttgcactcggcctagtggtcggtttggactatcagaatccctatctgagcccttttcgagagttccagcgatggaaacaccacccatcaatccggcctactctggaggggggaaaacggatagcctacggtgctagggccctcaacgaaggaggctttcagagtatcccaaagctaacgtttccaggcggccttttaattgggtgctctcccggcttcatgaatgtgccaaagattaagggtactcatactgcgatgaaaagcggcattctggccgcagagtctatttttaaccaactgacttccgagaacctgcagagtaagacgataggcttacatgttacagagtacgaggataatctgaaaaactcttgggtatggaaagaactgtattccgttcggaacattaggccctcctgtcacggtgtgctgggcgtgtatggcgggatgatctataccggcatcttttattggatcctgaggggaatggagccatggacactgaaacacaaagggagtgacttcgagaggttgaagcctgcaaaagactgcacaccaatagagtatccgaagccggatggccaaatctcttttgacctactgtcatcggtcgctctttcaggtaccaaccacgagcatgatcagcctgctcatctcacattgcgtgatgattcaatccctgtgaaccgaaacctctccatctatgacggcccagagcagaggttctgtccagctggcgtgtatgagttcgtccctgtcgagcagggggatggctttaggttgcagatcaacgcacagaattgcgtgcactgtaaaacatgtgatattaaggatccctcacaaaacattaactgggttgttcctgaggggggtggtggcccggcatataacggcatgtag

SEQ ID NO: 115656 - DNA, 1854 bp, Artificial Sequence
  Description of Artificial Sequence: Synthetic coding sequence
atgctggtgccactggccaagctgagctgcctcgcctaccagtgcttccacgctctaaagattaagaaaaattacctccctttatgcgctactaggtggtcttcgacctcgaccgttccaaggattactacccactatactatttaccctcgggacaaagacaagcgctgggagggagtgaacatggagaggtttgccgaggaagccgatgtcgtcatcgtgggagcgggccctgccggtctttccgccgcagtgcgactcaagcagctggccgtcgcccacgagaaagacataagagtgtgccttgtggaaaaggctgcccagatcggggctcatacattatccggggcctgcctggatcccggcgcttttaaggagctctttcccgattggaaggagaagggtgcacccctgaacacaccagtcactgaagatcgtttcggcatcctgaccgaaaaatatcgcatccccgtgcctattttacccggccttcccatgaacaaccatggcaactacatagtacgccttggccatctagtatcctggatgggcgaacaggccgaggccttgggagttgaagtgtatccgggttacgcagccgcagaagtcctgtttcatgatgatggcagtgttaaaggcatcgccactaatgacgtcggaatacagaaggacggagcgcctaaggctaccttcgaacgtggtctagagctgcatgctaaggtgactatttttgccgaaggctgtcatgggcacttggcaaaacagctatataaaaaattcgatctgcgcgccaactgtgagccccagacatacggtataggcttaaaagaactttgggtgatagatgaaaagaactggaaacccggccgagtggaccacactgttggatggcccctggataggcacacctacgggggatcattcctgtaccatctgaacgaaggagaaccgctcgtagcgctggggctcgtggtcggtttagactaccaaaacccatacctcagcccatttcgagaattccagcggtggaaacatcacccatctatccggccaacccttgagggggggaaacggatcgcatatggtgcccgggctctgaacgaaggggggtttcaatccattcccaagctaacgtttcctggcggcctcctcatcggctgctctcctggctttatgaacgtgccgaagatcaagggcactcacaccgctatgaagagcggcatcctggcagccgagagcatattcaatcaactgacttccgaaaatctccagagcaaaactatcgggctccacgtgaccgagtacgaggataacctcaaaaattcctgggtgtggaaagagctctacagcgtcaggaacattcggccaagctgccacggagtgctgggcgtttacgggggcatgatatatactggtattttttattggatactacgggggatggagccctggaccctcaagcacaaaggctctgatttcgaaagactcaagcctgctaaagactgcacccctatagagtacccaaagcctgacggacagatttcctttgacctgctgtcctcagttgccctctccggcactaaccatgaacatgaccagcccgcccatctgactcttcgtgatgattctatccctgtgaaccggaacctgagcatctatgacggacccgaacaaagattttgtccggcaggagtatatgagttcgtgcctgtggagcaaggtgatgggttccggctgcagatcaatgctcaaaactgcgtgcactgtaaaacctgtgacatcaaggatccatcacaaaacataaattgggtagtcccagaagggggggggggccctgcctataacgggatgtag

SEQ ID NO: 115657 - DNA, 1287 bp, Artificial Sequence
  Description of Artificial Sequence: Synthetic coding sequence
atggacccctcagtgacgctatggcaatttctgttgcagctgcttcgagaacagggaaacggacacattatatcatggacgtccagagacggaggggagttcaaactcgtcgacgccgaagaggtcgcacgcctgtggggcctgaggaaaaacaaaaccaatatgaattacgacaaattaagcagagcgctgcgttactattacgataaaaatataatccggaaggtgtcgggccaaaagtttgtttacaaattcgtcagttaccctgaggtggccggttgtagcaccgaggattgccccccccagcctgaagtgtccgtcacttctaccatgcctaacgtggctccggcagcaatacatgctgcccccggggacaccgtaagcggaaagccgggcactcccaaaggggctggaatggcgggacccggaggcctcgcgcgatcttcgagaaacgagtatatgcgatccgggctctattctaccttcacaattcagagcctgcagccccagccacccccacatcctcggcccgcagttgttcttccctccgcggctccagcaggagcagcagctcccccttcgggatccaggagtacttctccatccccactcgaagcctgcttggaggcagaagaagcgggtttgccactgcaagtgattttaactcctccagaagcgccaaatctgaaaagcgaggagctgaacgtggagccaggacttggcagggcactgccgccggaagtgaaagtggagggccctaaggaggagctggaagtggcaggcgagcgcggctttgtaccagaaacaacgaaggccgagccagaggttcccccccaggagggggttccagcaaggctgcctgccgttgtgatggacacagctggacaagcagggggccatgctgcgtcgtcaccggagatatcacaaccccaaaaaggaaggaagcctagggatctggagctgcctctcagcccgagtttactgggaggtcccggtcctgaaagaacgccaggctctggatctggctctggcctgcaagctcctggccctgccctcactcctagtcttctgccaacccacaccctgactcctgtcctgctgaccccttccagtctgcccccatctatacacttctggtccacccttagcccaatcgctcccagatcacctgcaaagctgtcattccagtttccttcatctggatctgcccaggttcatattccgagtattagcgtggatggactgtccactcctgtggtgctgtctccagggcctcagaaaccatag

SEQ ID NO: 115658 - DNA, 1836 bp, Artificial Sequence
  Description of Artificial Sequence: Synthetic coding sequence
atgcccgagattgtggatacgtgctcgttggcctcaccggctagcgtgtgccggacgaagcaccttcatcttagatgtagtgtcgacttcactcgacggaccctgacggggactgctgcacttaccgtacagtctcaagaagacaacctaaggtccctggtgcttgatacaaaggatctgaccatcgaaaaggtggtgattaacggccaggaggtgaagtatgccttaggagagcggcagtcttataaaggcagcccgatggagatctctctacctattgctctttcaaagaatcaggagatagtaattgagataagcttcgagacttcgcctaagtccagcgccctccagtggttaaccccagagcagacttctggtaaggaacacccctacctattttcccagtgtcaagcgatccattgccgtgccatcctgccctgtcaggataccccatccgtgaagctgacgtatacggcagaggtcagcgtccccaaggagcttgtcgccctgatgtcagccatccgcgacggtgaaacaccagaccctgaggaccctagcaggaaaatatataaatttatccagaaggtgccaatcccttgttacctgattgctctggtggtaggagctctcgagtccaggcagatcggcccaaggactttagtctggagcgaaaaggagcaggtggagaaatctgcttatgagttttcagagacagagtctatgctgaagatagccgaagatttggggggtccctacgtctggggacagtatgatctcctggttcttccacctagctttccctatggtgggatggagaacccctgcctgacgttcgtgacgcctacactgctggccggcgataagtccctctccaatgtaattgcccacgaaatctcacacagctggacaggcaacctggttacaaacaagacgtgggaccacttctggctcaatgagggacacacggtttacttagaaagacacatctgcggcagacttttcggagagaagttcagacacttcaatgccctcggtggatggggagaactgcagaattccgttaaaaccttcggagagacacacccatttacgaagctcgtggtcgatctcacggatatcgatcccgatgtcgcttactcaagcgtaccatacgaaaagggatttgcgttgctcttctatctggagcagcttctgggcggtcctgagatctttcttgggttcctgaaagcatacgttgaaaaattttcttataagtctattaccactgacgactggaaggatttcctgtactcttatttcaaagataaggttgacgtgctgaatcaagttgactggaatgcgtggttgtacagcccggggctgccgccgatcaaacccaactatgacatgactctgaccaatgcatgcatcgccttatcacagagatggatcactgccaaggaggacgatctcaatagtttcaatgctactgatttgaaagatttgtcctctcatcagctcaacgagttcctggcccagaccctccagagagcgcccctccccctaggccatatcaaaagaatgcaggaggtctataacttcaatgccataaataacagcgaaatacggttcaggtggcttagactgtgtatacagtcaaagtgggaagatgcaatcccactggcattaaaaatggctacggagcagggtaggatgaagttcacaagaccgctgttcaaagaccttgcagcattcgataaatctcacgaccaagccgtcagaacctatcaggaacataaagccagtatgcatcccgtgactgccatgctggttggaaaggacctgaaggtggattag

SEQ ID NO: 115659 - DNA, 117 bp, Artificial Sequence
  Description of Artificial Sequence: Synthetic coding sequence
atggaatccgctatcaccctctggcagtttttgcttcaactgctcttggaccagaaacacgagcatttgatttgctggacctctaacgacggagagttcaaattgctgaaggcctag

SEQ ID NO: 115660 - DNA, 483 bp, Artificial Sequence
  Description of Artificial Sequence: Synthetic coding sequence
atggaaagtgcgattacactgtggcagtttctgctgcagctgttattggaccagaaacatgagcatctcatttgctggacctccaacgacggagagttcaagctgttaaaggctgaggaggtcgctaagctgtggggtttacgaaagaataagaccaatatgaactacgacaagctctctcgtgcattgcgttactattacgataagaatatcattaagaaagtgataggccagaagttcgtttacaagttcgtgagtttccctgagattctgaagatggatccgcatgcggttgagatctctcgggagtcactgctgttgcaagattctgactgcaaggcaagcccagaaggccgagaagcgcacaaacatggcttagccgctttgagaagcaccagccgaaacgagtacatacacagtggtctgtactcctccttcaccattaatagtctgcagaaccctcctgacgcattcaaggcatag

SEQ ID NO: 115661 - DNA, 1218 bp, Artificial Sequence
  Description of Artificial Sequence: Synthetic coding sequence
atggactcagcgataactctgtggcaatttcttctacagctgcttcagaagccccagaataaacatatgatttgttggaccagcaatgatggacagttcaagcttctgcaggctgaagaagtggcccgactctggggtattcgcaagaacaagcccaatatgaattacgacaaactcagtagggctctgaggtactactacgtcaaaaatattattaaaaaagtgaacggccagaagtttgtctacaaattcgtgagttaccccgaaatccttaacatggatcccatgactgtcggaagaatagagggagactgcgagtctctaaattttagcgaggtttcttcctccagtaaggatgtcgagaacggaggaaaagacaaacccccccaacccggagccaagactagcagcagaaatgattacatccattctggactgtactcgtctttcaccctgaactctctgaatagttctaatgtcaaactatttaagttaatcaaaactgagaaccctgccgagaagctcgctgaaaagaagagcccgcaggagcccaccccttcagtcatcaaatttgttacaacacccagtaagaaaccccccgtggagcctgtggccgctactatatccattggaccctctatttctccctcttctgaagaaaccatccaagcactggagactttggtaagtcccaaactgccatcacttgaggcccccacttctgcaagtaatgtcatgacagcatttgccaccacccctccaatcagctcgattcctcctctgcaggagcctcctcgcacccccagcccccccctgtccagccatccagacatcgacacggatattgactccgttgcctctcagcctatggagctgcctgaaaacctgagcctggaaccaaaagaccaggattctgtgctcctggagaaagataaggtgaacaattcctccagatcgaagaaaccaaaagggctagaactcgcccctacattggtgatcacctcatcggatccctcccccctggggatactatctccgtctttaccaactgcaagcctgacacccgcctttttcagtcaggttgcttgttctctgtttatggtgtctcccctactgtcctttatatgtcctttcaaacagattcagaacctgtacacccaagtttgtttccttcttctgaggttcgtgttggaaagactgtgtgtgaccgtgatgtag

SEQ ID NO: 115662 - DNA, 1296 bp, Artificial Sequence
  Description of Artificial Sequence: Synthetic coding sequence
atggatagtgccatcaccctgtggcaattcctgctccagctgctgcaaaagcctcaaaacaagcacatgatttgctggacgtctaatgacgggcagttcaagctgctgcaggcggaagaggtcgcccgactctggggcattagaaagaacaagccaaacatgaactacgacaaactgagcagggccctccgttattattatgtgaagaacatcatcaagaaagtaaacgggcagaaatttgtgtataaattcgtgagttatccagagattcttaatatggaccctatgaccgtcgggcgtatcgaaggagactgtgaaagcctgaacttttcagaggtatctagctcaagcaaggacgtggagaatgggggtaaggataaacccccccagccaggtgcaaagacctcttctcgcaacgactacatccattctggactgtacagctctttcacgcttaattctctgaacagtagcaacgttaagctgtttaagctcataaaaactgagaacccagctgagaagctagctgagaagaagagtcctcaggaaccgacccccagtgtgatcaaatttgtcaccacccctagcaagaagcctcctgtagagccagtggcagccaccatttcaattggaccaagtatctccccaagcagcgaagagactatacaggctctcgagacgcttgttagtcccaagctccccagtctggaagcaccaacttctgctagtaatgtaatgacagcatttgcaaccactccacccattagctccattccccctctccaagagccccctcgcacgccatctccacccttgagctcccacccagatattgatacagacatcgattcagtcgccagccagcctatggaactgccggaaaatctttctctggagccaaaagaccaggactctgtcttactcgagaaggataaagtgaataactcgagccgtagcaagaagcccaaaggattggagctcgctcccacgcttgttatcaccagctccgacccttctccgttggggattctaagcccaagtctgccgacggcttccttgacccctgccttcttctctcagactcccattatccttacccctagtcctttactctcctctatacatttctggtcaactctcagcccagtggcacccttgagtccagcaaggctacagggcgcgaataccttgttccagttcccatcagtgctgaactcccatggtccattcacactgtctggtctcgatgggcccagcactccgggaccatttagtcctgacctacagaagacctag

SEQ ID NO: 115663 - DNA, 1566 bp, Artificial Sequence
  Description of Artificial Sequence: Synthetic coding sequence
cgaccacaggacccaagaagaagatgtcgggtgcggggcagaggagggaggggagcccggtcacgcggcggtggacggtgcggcaggttgcgggccccgggcgggcttgggctggccgcagcagctttctacgggtctgcagccggagtcgcagcagctgctgccccctcatcttcatttcaaagagaggaagaggccgagggtggtgaggcccaccgtgttcggggaggcgatcggggaggggcaccaagagccgcctctctgatagctatggactctgcaataaccctctggcagtttctcctgcagcttctgcagaaaccacagaacaaacatatgatatgttggacctctaacgacggccagttcaagcttcttcaagccgaggaggtcgctcggctttggggtattcgaaagaataagccgaatatgaactatgataaattgtcaagggcccttaggtactactatgtaaaaaacatcattaagaaggttaacggccaaaaattcgtctacaaattcgtgtcataccctgagatcctcaatatggatcccatgacagtcggtcgcattgagggcgattgcgagtccctgaatttcagcgaggtgagtagttcctccaaggacgtggagaacggtggaaaggacaaaccacctcagccgggagctaagacttcttcgcgtaacgattatatccactcaggcttgtactcaagctttactttaaatagtttgaacagctctaacgtaaagttgttcaagttaattaaaacagagaaccccgcggagaagttggcggagaaaaagagtccgcaggaaccaacaccgagcgttatcaagtttgtgaccaccccgtctaaaaaaccccctgtggagcccgtcgccgctacaatcagcatcggacctagtatctctcccagctccgaggagacaattcaggctttagagacactggttagtccaaagctcccttcactcgaggcaccaacatcagcttccaacgtgatgacagcatttgctaccactccccccatctcctcgatcccccctctgcaggagcccccgaggactccatcccctcccctgagttcccaccctgacatcgatactgacatcgatagcgtggcatcccagcctatggaactccccgaaaacctgtcactggaaccgaaggatcaggatagtgttctcctggaaaaggacaaggtgaacaactcttcaagaagcaagaaacctaaagggttggaactggcccccaccttggtaataacttcttccgacccgtctccacttgggatcctcagcccttctctgcccactgcctctctgacgccagcgttcttttcacaaacccccattatcctgaccccatctcccctactcagttctattcatttctggagcaccctctcgcccgtggctcctctgagccctgcccgcctgcagggggccaatacactcttccagttccctagtgttcttaattcccacggcccttttaccttgtcaggcttggatggtccgagtaccccaggaccattttcaccagacctacagaagacgtag

SEQ ID NO: 115664 - DNA, 807 bp, Artificial Sequence
  Description of Artificial Sequence: Synthetic coding sequence
atgaatggcactgccaatcctttgctggatagggaagagcattgtttgcgcctgggtgagagctttgagaagcggcctcgcgcctcttttcataccattaggtacgactttaaacctgcaagcattgatacttcatgcgagggcgagcttcaagtaggcaagggcgacgaggttactataactcttccacatatccccggctcgacaccaccaatgaccgtcttcaaagggaacaagagaccatatcagaaagattgtgtgctcatcatcaaccacgacactggcgagtatgtgctcgagaagctctcttcatcaatccaagtaaagaagactagagccgagggaagcagcaagatacaggcccgaatggagcagcagcctacacgaccgcctcaaactagccagcctccaccccctccgcctcccatgccattcagagcaccgaccaaaccccccgtgggtccgaaaacctcccctctcaaggacaatccaagcccggagcctcagttggatgacataaaaagagaactccgcgccgaagtggatattattgaacagatgtcatcgtccagcggatccagtagttctgactccgagtccagttcaggctctgacgatgactcttcaagtagtggcggagaagacaacggaccagcctcaccgcctcagccctcacatcagcagccctacaattcaagaccagccgtggccaatgggaccagccgtccacaagggtctaaccagctgatgaacaccctcagaaatgacctgcagctgtccgaaagtgggtctgactcagacgattag

SEQ ID NO: 115665 - DNA, 504 bp, Artificial Sequence
  Description of Artificial Sequence: Synthetic coding sequence
atgaagtcccagctacattgtcacatctcactggccgaggggtcatcgaagatccaagcacgaatggaacagcagcccaccaggcccccccagacctcacaaccccccccaccaccaccgccaatgccattcagggcaccaaccaagcctcctgtgggtcctaaaacgtcccctctgaaagacaatccttcacctgaacctcaactcgacgatatcaagcgcgagctcagagcggaggtagatatcatagagcagatgtcatcctcctctggatcgtcatcatcagactcagagagctcttcggggagcgatgacgactcctccagctcaggtggcgaggacaacggaccagctagccccccacaaccttctcaccagcaaccatacaacagcagaccagccgttgcgaacggcacatcacggccccaggggtcaaaccagcttatgaacactcttcggaatgacctgcagctttcagagtccgggagtgacagtgacgattag

SEQ ID NO: 115666 - DNA, 2979 bp, Artificial Sequence
  Description of Artificial Sequence: Synthetic coding sequence
atggcacgggggggcgcagcatgtaaatcagacgctcgtttactgctcgggagggatgccctgcggcccgcgccagctctgctggctccagctgtcctgctgggcgccgctctgggcttgggcctggggctatggctagggtgtagagccggtagacagcgcacgcgccaccagaaagatgatacgcagaatttactcaagaacttagaatcgaatgcccagaccccaagcgagacgggatcaccatcacgtcggaggaaacgcgaagtccagatgtctaaggacaaggaggctgtagacgaatgcgaaccacctagtaactccaacataacagcgttcgctctgaaagcaaaggtgatctaccctattaatcaaaaatttcgtccgttagccgacggaagttcgaatccatcccttcacgagaatttaaagcaagcagtgcttccacatcagcccgtggaggcttcgccttcatcctctcttgggtcgctgtcacaaggcgaaaaggatgattgcagctcttcctccagtgttcactctgctacgtcagatgatcgcttcctcagccgcactttcttgcgcgtgaacgcattcccagaagtcctcgcatgcgagtctgtagacgtagatctttgtatttacagcctccacctcaaggatctgctgcacctcgacaccgccctgagacaggaaaagcatatgatgttcatccagatctttaagatgtgtctcctcgatctgctgccaaagaaaaagtcagatgatgagctctatcagaaaatcttgagcaagcaggaaaaagacttggaagaactcgaaaaggggcttcaggtgaagctttccaacacagaaatgagcggcgccggcgactctgaatacatcaccttggctgatgtagaaaagaaagaaagggagtactcagaacaactcattgacaacatggaggcattctggaaacagatggctaacattcagcacttcctggtggatcaattcaaatgtagctcttccaaagctaggcagctgatgatgacccttactgaaaggatgatagcagccgaaggcctcttgtgcgactcacaggaactgcaagccctcgacgccctggagaggaccatgggacgagctcacatggccaaggtgatcgagtttttgaagttgcaagtgcaagaagagaccaggtgccgtttagccgcaatcagtcacggtttggagctcctcgctggtgaaggaaaactaagcggtagacaaaaagaagagctgctgacccagcagcataaggccttttggcaggaggctgaacgtttctcacgtgaattcgtgcaaagagggaaagatctggtcacagcctctctggcccaccaggttgaaggaactgctaagctgacactggcacaggaagaggagcagcggagctttctggctgaagcacaacccacagccgacccggagaaattcctggaggcttttcatgaggtgctggaaagacaacgtctgatgcagtgtgatctggaagaggaggaaaacgtgcgtgcgacagaagctgtggtggctctgtgccaagaactctatttttcaacagtggacacttttcagaaatttgtagacgccttatttctgcagacgctccccggcatgacgggccttccccccgaggaatgcgactatcttcgccaggaagtccaagaaaatgccgcctggcaactcgggaagtcaaataggtttcggaggcaacagtggaagctgtttcaggagctgctcgaacaggaccagcaagtttggatggaggagtgtgcactgagcagcgtactgcaaacgcatctgagagaagaccacgaagggacgataaggggagtgttggggcggctgggcgggctcactgaggaatctacacggtgtgtgctgcagggccacgacctgctgttgcgcagcgctctccgcaggctggccttacgcggcaacgcactggccactctaactcaaatgaggctgtctggtaagaagcacctgttgcaggaattacgagagcagagggccttagaacagggatcctcacagtgcctggacgaacaccagtggcagctcctgagggcactggaggctagagttctcgaggaagccagccgacttgaggaggaggctcagcagactcgcttgcagttgcagcaacgcctgctggcggaggcacaagaggttggccagctcctccaacagcacatggagtgcgctatcgggcaggccctgttggtgcacgccagaaacgcagccaccaaatcccgggccaaggaccgcgatgacttcaaaaggactttgatggaagctgctgtcgagtcagtctacgtcacctcagccggggtatcaaggctggtgcaggcctattaccagcagatagggaggattatggaagaccatgaagagcgaaagctgcaacacctgaaaacgttacagggagagcggatggagaactacaaactccggaagaagcaggagctttctaatccgtcctcaggatcccggacagcaggtggcgcacacgaaacctcccaggcggtgcatcaacgcatgctttcacagcagaaacgattcttagcacagtttcctgttcaccagcaaatgcggttacatgcgcagcagcagcaggccggagtcatggacctcctagaggcccagttagagacgcagcttcaagaggccgaacaaaacttcatctcagaactggccgctctggcgagggtgcccctggcggaatcaaaattactgcctgccaagcgaggactgctcgaaaaaccactccgcactaagcgaaaaaagccgcttccacaggaaagaggggatctcggcgtcccgaacaatgaggacctggccagcggggaccagacctccgggtccctttcctcaaagcgcctctcacagcaggagagcgaggctggtgattccggaaactctaagaaaatgctgaagagacggtcaaatttatag

SEQ ID NO: 115667 - DNA, 2979 bp, Artificial Sequence
  Description of Artificial Sequence: Synthetic coding sequence
atggccagaggaggcgccgcttgcaagagtgatgcgcgtctgctgctggggcgcgacgccttgagacccgctccagccttgctagcccctgcagttctgttaggcgctgcactcggactcggactcggcctttggctcggctgtcgcgcagggcgtcagcgcacccgccatcagaaagatgatactcagaacttgctgaaaaatctggaatcaaatgcccagactccatccgaaactggctctccctccaggcgacggaaacgagaggttcaaatgtcgaaagataaggaggccgtagatgagtgcgagcccccctccaactctaacataaccgcattcgccctgaaagccaaggtgatctatccgattaaccagaagtttcgcccattggctgacggcagctctaacccgtcactacatgaaaacctgaagcaggcagtcctccctcatcagcctgtggaagcatctccatcttccagcttggggagcctctcacaaggtgaaaaggacgattgtagttcctcttcaagcgtgcactccgccaccagcgatgaccggttcctttcacgaacattcctgagggtcaacgccttcccagaagtgctcgcctgcgaatctgtagacgttgacctttgtatttactcattgcacctcaaggatctgctgcatctcgataccgcattgaggcaggaaaaacacatgatgttcatccagatttttaaaatgtgcctcctggacctgcttccaaagaagaagagcgacgacgagttgtatcagaagattttaagcaagcaggagaaagaccttgaggagctcgagaaagggctccaggtgaagctctcaaacactgagatgtcaggggccggcgattccgagtacataactctcgcggacgtcgaaaaaaaagaacgggaatattccgagcaacttatcgataacatggaagctttctggaaacagatggctaacatccagcacttcttggtcgaccagtttaagtgttcgtcttccaaggcgaggcagctgatgatgacgctaacagaacgtatgattgccgccgaaggtcttctctgcgactcgcaggagcttcaggcactcgatgccctcgaaagaactatgggccgggcccacatggccaaggttatcgaatttctcaagctgcaggtccaagaggaaacaagatgtagattagccgccatctcgcacggcttggagctgctcgcgggggagggtaagttgagtggcaggcagaaggaggagctccttacacagcagcataaagcgttctggcaggaggctgagcggttctctagagaatttgtacagagagggaaagatctggtcaccgctagcctggcgcaccaggtagaagggactgccaagctgactttggcacaggaagaggaacagcgttcatttttggcggaggcccagcccaccgcagacccggagaaatttctcgaagccttccacgaagttctggagagacaacgactcatgcaatgcgatctcgaggaggaggagaatgttagagcgactgaggccgtggtagcgctgtgccaggagctgtatttcagtacagtcgacactttccaaaaattcgtagatgctctgttccttcagactctgccaggaatgaccggactccctcccgaagagtgcgactatctccgccaagaagtgcaggaaaatgcagcctggcagttggggaagtctaatagatttcggcggcagcaatggaagctgtttcaggagttgctcgaacaggatcagcaagtctggatggaagagtgcgccttgtcaagcgtgttgcagacacatttgcgagaggatcacgaaggaacaatccgcggggtcttaggccgactggggggcctgactgaggaatctacgagatgtgtgcttcaggggcacgacctgctgctgaggtctgccctccgccgcttagccttaagggggaatgcactggccaccttgacacaaatgaggttgagtggcaagaagcacctgctccaggaacttagggagcaacgagctttggaacagggctcatctcagtgcctcgacgagcatcaatggcagctgctgcgggccctggaggcgagggtactggaggaagcgagtcggctagaggaagaagcccaacagactagactccagctgcagcagcgcctgttggctgaagcccaggaagtcggtcagctgctccagcagcatatggaatgtgctattgggcaggcattgctcgtccatgcccgcaatgccgctactaaaagcagagccaaggaccgagatgattttaaacggacactgatggaagccgctgtagagagcgtgtatgtgacaagtgcaggggtgagcaggctcgtgcaggcgtattatcagcagatcgggcgcatcatggaggatcacgaggaaaggaagctgcagcacctgaaaaccctgcagggcgaaaggatggagaattataagttgagaaagaagcaagaactgtccaatccaagcagcggcagcagaaccgctggaggggctcacgagacttcccaggctgtacaccagagaatgttgtcgcagcagaaacgttttctcgcacaattcccagtgcatcagcagatgcgactgcacgcccagcagcaacaggcaggtgtaatggacctgcttgaggctcaactggagacccagctccaggaggcagagcagaacttcatcagtgagctggccgcgctggcacgtgtgcctctcgctgagagcaagctcctgcccgcgaaaaggggcctactcgagaagcctctccggacaaagcgcaagaagcctctcccccaagagcggggcgatctcggagtgcctaacaacgaagatctggcatccggagatcagacaagtggctctctttccagcaagcggctgtcccagcaggagagcgaagctggcgactcaggaaatagtaagaaaatgctgaaaagacgttcgaacctgtag

SEQ ID NO: 115668 - DNA, 3687 bp, Artificial Sequence
  Description of Artificial Sequence: Synthetic coding sequence
atgatatggccgaaagttgagtgctgtcatttcaaaaccgctgttgaggctccactcgggatgaagcttgacaagaagatggaggtctttattcctctgtccacctccgccgctagttccggcccttgggcccacagcttgttcgccttcattccgtcttggcctaagaagaacctcttcaaacgagagtctcccattacccatcggctctatggagatatcagccgcgaagtgcagggcaccagtgaaaacggagtgattttccagaagtgcgctctggtaagcggtagcagcgaggcccagaccgcaagaatttggttgctagtgaacaatactaaaacaacctcatcagcgaatctgtcggagctgctgctcctggactccatcgccggtcttacaatttgggactctgttgggaaccgcacttccgaaggattccaggcattctcaaaaaagtttctacaggttggggacgcgtttgcagtcagctacgccgcaaccctccaggcgggcgacctgggcaacggtgagagtctgaaactgcctgcccagttgacctttcagagctcttcccggaatcgaacgcagctgaaagttcttttcagcatcacggccgaagagaacgtgactgtcctgcctcaccacgggctacatgccgccgggttttttatcgccttccttctaagtcttgtgctcacctgggccgcactgtttctcatggtgcgctatcaatgcctgaagggaaatatgctgacaaggcatcgcgtgtggcaatacgaaagtaaactcgagcctctaccatttacctcagcggacggggtgaatgaagacctttctctgaacgaccaaatgatcgacatactgtccagcgaggacccaggctctatgctgcaggccctggaggaacttgaaattgccactctcaacagggcagatgccgaccttgaggcctgtagaacccagatcagcaaggatatcatagccctacttctgaaaaacttgacttcatctgggcacctgtcgcctcaagtggaaaggaaaatgtcggctgtgttcaagaaacagttcctgctgctggagaatgagattcaggaggagtacgaccgtaagatggtggctctaacggcagaatgcgatctggaaactcgcaaaaagatggagaaccagtatcaacgggaaatgatggccatggaagaagcagaggaactcctcaagagagccggtgaacgtagcgccgtggagtgctcaaatttgcttaggacactgcatgggctggaacaggagcacctacgcaagtctttggccctgcagcaggaggaggatttcgctaaagctcaccggcagcttgccgtattccaacggaatgagctgcactcaatcttctttactcaaattaaatctgccattttcaaaggagagttaaagcctgaagctgctaaaatgctgttacaaaactacagcaaaattcaagagaatgtcgaggagctaatggacttctttcaagctagtaagaggtatcacctgtccaagagattcgggcaccgggaatatctggtgcagaatctgcagtcctccgaaactcgagtgcagggactgcttagtactgctgctgctcaacttacccacttgatacaaaaacacgagcgggccggctaccttgatgaggaccagatggagatgctactcgagagggcccagacagaggtcttcagcatcaaacagaagcttgacaacgacctgaagcaggagaaaaaaaagttacatcagaaactgatcactaagagacgaagagaactcttgcagaaacatcgagagcagcggcgtgagcaggcctcagtcggcgaggccttccggaccgtggaggacgcaggtcagtacctgcatcagaaacgtagtctgatggaagaacatggcgcaacactggaagaactgcaggagaggttggaccaggccgccctcgacgatctcaggaccctcacactctccctattcgagaaagctactgatgaactgcgcagactccagaactcagctatgactcaggaacttctcaaaaggggtgtgccctggctcttcctccagcagattttggaggagcacggcaaagaaatggcagccagagctgagcagctcgaaggcgaggagcgggaccgagaccaggaaggggtccagagcgtgagacagcggctgaaggatgacgctcctgaggctgttacagaggaacaggctgaactgaggagatgggagcacctaattttcatgaagttatgttcttccgtgtttagcctaagcgaagaggagctgttgcgcatgaggcaggaggtgcacgggtgcttcgcacagatggataggtcattggctctgcctaagattcgcgcccgcgtgctcctgcagcagtttcaaaccgcgtggagggaggcggagttcgtgaaactggatcaggctgtagcagcacctgaacttcagcaacaaagcaaggtgagaaaatctcgtagcaagagtaagtctaagggcgaattgttaaagaagtgtatcgaagacaagatacacctatgcgaagagcaggcttcagaggacctggtggagaaggtgagaggcgagctgcttagagagcgcgttcaacgcatggaagcacaggaggggggattcgcacagagcctggtcgcgttgcaattccagaaagcctcaagagttaccgaaacactgtctgcgtacaccgcccttctttcaatccaagacctcttactggaggagttgagcgccagcgagatgctgactaagtccgcctgcacgcagatcctcgaaagccactcgcgcgagctgcaggagctcgagaggaaactggaggaccagttagtgcagcaagaggctgcacagcagcaacaggctctcgcgagctggcaacaatgggtcgctgatggtccgggcatattgaatgagcccggggaggtcgatagtgagcgacaggtatctacggtgcttcatcaggctcttagcaagagccagacattgctggagcagcatcagcagtgcctgcgcgaggagcagcagaactccgtggtgctcgaggatttacttgagaacatggaagcggacacattcgcaactttatgcagtcaggagctgcgcctcgcatcctacctcgcccggatggctatggttcctggagcaacacttcgccgcttgttgtccgtagtgctcccgacagccagtcagcctcagctccttgcacttttagactctgcaacggagagacatgtggaccatgccgccgagagcgatgggggagccgaacaggccgatgtgggacgacgcaggaagcatcagtcgtggtggcaagctctggatggcaaactgaggggtgaccttattagcagaggcctggagaagatgttgtgggcccggaaaagaaagcagagtatacttaagaagacatgcctgccgcttagggagcgaatgattttctccggtaaaggttcgtggcctcatctgtccctggagcctatcggcgagcttgcgcctgtgcccattgtaggagctgagactattgacttactcaacacgggggaaaagctattcatcttccggaatcccaaagagcctgagatctctctgcacgtaccacctaggaaaaaaaaaaattttctgaacgctaaaaaagccatgagggcgctaggtatggattag

SEQ ID NO: 115669 - DNA, 3927 bp, Artificial Sequence
  Description of Artificial Sequence: Synthetic coding sequence
atggatccctctgggtcgaggggtcgtccaacttgggtactggctgggggccttttagctgttgctcttgcactgggcggccgcggttgtttgggggctagtagcagaccacgctggcgccctctcggggctcagcctccccgggatccccaggttgctcctaggtccggccccgggctgagaatcccgcctggaaggtcaggggccgggcctgagtcatccacccaggacttgccctgcatgatttggcccaaggtcgagtgctgccactttaagactgcagtcgaggccccacttggcatgaagctagacaagaaaatggaggtgtttatccctcttagtacttctgctgcctccagcggtccatgggcacatagcctcttcgcctttatacccagctggcccaagaagaatttgttcaagcgcgaaagcccgatcacgcataggctttacggggatatctcccgggaggttcagggtacgagtgagaacggagtcatcttccagaagtgcgctctggtgagtggctcatctgaggctcagaccgccaggatttggcttttagtgaacaacactaagacaactagctccgccaacctgtcagagctgctgcttctggatagcatcgcgggactaacaatatgggatagcgttggcaaccggacgtccgagggtttccaggcgttctcaaaaaagtttttacaagtgggtgatgccttcgccgtgtcctacgctgctacattgcaagcgggggatcttggaaatggcgaatctcttaagctccctgctcagctgactttccagtcttcttcccggaatcgaacccagctcaaggtgcttttctcaattactgcagaagaaaatgtgactgtgctgccccatcatggcttgcacgctgccgggttcttcattgcgtttcttctgtctctggtactgacatgggccgccctttttctaatggtacgatatcagtgcttgaagggcaatatgcttacacgccacagagtttggcagtatgagtctaaactggagcccttgcccttcacgtcggccgatggagtgaacgaggacttgagtctgaatgatcaaatgatagatatcctgagctcagaagaccctggctctatgctccaggctctggaagaacttgaaatcgctacactgaatcgtgccgacgccgacttggaggcttgtaggacccagatcagcaaagatatcatcgctctgctgctgaagaatctgacttcttccggacacctaagcccccaggtggagcgaaaaatgagtgctgtttttaagaagcagtttctgcttcttgagaacgagattcaagaggaatatgaccgaaaaatggtcgccttaacagcagagtgcgacctggagacgcggaagaaaatggagaatcagtaccagcgtgaaatgatggctatggaggaggccgaggaacttctgaaaagggcaggcgaacgaagtgctgtcgagtgtagcaatctcttgagaaccctgcacgggctggaacaagaacacctccgcaagtcgctcgctctccagcaggaagaagactttgctaaggcgcataggcagctggcagtgttccaacgaaacgaacttcattcaatcttcttcacgcagataaagtctgctatatttaagggtgaattgaaacctgaggctgctaaaatgctgttgcaaaattactctaagattcaggagaatgtggaagagctgatggacttctttcaggctagcaagcggtaccacctttcaaagagatttggacacagagaataccttgtccagaatctacagagctcagagacacgagtgcagggcctgctgtctaccgcagccgcgcagctgacacatctgatccaaaagcacgaacgagccggctacctcgatgaagaccaaatggagatgctcctggaaagggcacaaacggaagtcttttcaatcaaacagaaacttgacaacgatcttaaacaagaaaagaagaaactacaccagaaattaattactaagaggcgtcgcgaacttttgcaaaagcatagagagcaacgcagagaacaggcttccgtcggtgaagcattcaggacagtcgaagacgccggccagtacctgcatcagaagaggagcttaatggaggaacacggcgccaccctggaggagctgcaggaaagactggaccaggccgctctcgacgatcttaggactcttaccttgagcttgttcgaaaaagctacggacgagctgaggagactgcagaactctgcaatgactcaggagcttttgaagaggggggtgccatggcttttcttgcaacaaatactggaagagcacggtaaggagatggccgctcgggcggagcagctggaaggggaggaacgggacagggaccaggaaggagtgcaatctgtgaggcaacgcctgaaagacgacgctcctgaggccgtgactgaagagcaagccgaactccgcagatgggagcatctgatctttatgaagctgtgttccagcgtattctctctgtccgaggaagagctgctcagaatgcgacaggaggtgcatggctgtttcgctcagatggaccgaagccttgccctcccgaagatccgggcacgtgttcttctgcagcagttccagaccgcctggcgggaagcggagtttgtaaagctggaccaggccgtggccgctcccgaactccagcaacagtcaaaagtgaggaagagcaggtcgaaaagcaaatccaaaggcgaacttctaaagaagtgcatcgaggataaaatccacctttgtgaggagcaggcttcggaagaccttgtggagaaggtcaggggggaactccttcgggagagggtgcagcggatggaagctcaggagggcggtttcgcccagagtctggttgcattgcagttccagaaggcttccagagtgacagagacactctccgcttacacagccctgctgtcaattcaggacctgctattagaggagcttagcgcttctgagatgctgaccaaatcagcttgtacccaaatcctggaatcccattcaagagagctccaggaactagaacggaaactggaagaccagctcgtgcaacaggaagccgcacagcagcagcaggcgctggcttcttggcagcaatgggtggcagatggccccgggattttgaatgaaccaggcgaggttgacagcgagcgccaggtctccaccgtgcttcaccaagccctgtccaagtctcaaacattacttgagcagcaccaacagtgcctgcgggaggagcaacagaactccgtggtgcttgaagaccttctggaaaatatggaagccgacacattcgctacattgtgcagtcaggaactgagattggctagttacctggccaggatggcaatggttcctggtgctaccctgaggcgtttgttgtctgtggtgttacctactgcctctcagccacaactcctggctctcctcgatagcgcaactgagcggcatgtggatcacgcagccgaatccgatggtggcgctgagcaggctgacgtcggccggcgccgtaagcaccagtcctggtggcaggcgttggacggtaaactgcgtggcgatctgatctcccgcggactggaaaaaatgctctgggcccgaaagcgcaagcagtctattttaaaaaaaacgtgtctacccctccgggagagaatgatcttcagtgggaaaggctcttggccgcacctaagtctggaacccataggcgaattggcccccgttccgattgtgggagctgaaactatcgacctgctgaacaccggggagaagctgtttatcttcaggaacccaaaggagcccgaaatcagtttgcacgtcccgcctcgaaagaagaagaacttcctgaatgccaaaaaggcaatgcgagcactgggcatggattag

SEQ ID NO: 115670 - DNA, 3741 bp, Artificial Sequence
  Description of Artificial Sequence: Synthetic coding sequence
atggacccgagcggaagccgtggaaggccaacatgggtactggcgggcggacttttggccgtggccctagctctcggcggacgcggctgtctgggggcctcttcgcgaccccgttggcgcccattaggggcacagccgcctcgagatccccaagtggctccaagatccggccctgggctacgtataccgcctggcagaagtggggccggcccagaatcctccactcaagacctcccgtgcatgatctggcccaaggttgaatgttgtcattttaagacagctgtcgaggcacctctggggatgaagctggataaaaagatggaggttttcattccactgtctacctccgccgcctctagtggtccttgggcccacagcttgttcgcattcattcccagttggccaaagaagaacctgtttaagcgagagtcccctatcacacaccgcctgtacggcgatatctctcgagaggtgcagggcacgagcgaaaacggtgtgatcttccagaagtgtgcgctcgtgtcaggctcctccgaggcgcagactgctcgaatttggctgctggtaaacaatacaaagacaacatcctcagccaatctctccgagctcctcctgctggactcaatagccggcctcactatatgggatagtgtgggcaacagaaccagcgaaggctttcaggccttttccaagaagtttcttcaagtgggggacgcttttgccgtgagttatgctgctacactccaggccggtgacctaggaaatggggagtcacttaagctgcccgcgcagctaacctttcagtcttcttcgagaaatcggacacagctcaaggtgctattttccattaccgcagaagaaaacgtgactgtgttgccacaccacggactgcatgccgcaggctttttcatcgcctttctgctgagcctggtactcacttgggccgctctcttcctcatggtgagataccagtgtctgaaaggaaatatgctgaccagacacagggtgtggcagtacgagtcaaaactggagccactgcctttcacctccgccgacggagtgaacgaggatctgtcactgaatgaccagatgattgacatactaagtagtgaggatccaggttcgatgctgcaggcactggaagagctggaaatagccacactgaatagggcagatgcagacctcgaagcctgtcggacacaaatctccaaagacatcattgctctcctgctgaaaaatctcacaagtagcggacatctttccccccaggtggagaggaagatgtccgccgtatttaagaaacagtttttgttgttggaaaacgaaattcaggaggagtacgatagaaagatggtcgccttgacggctgagtgcgatctggagaccaggaagaagatggagaaccagtaccagcgtgaaatgatggccatggaggaagccgaggaattactgaagagggccggcgagagatcagccgtcgagtgctccaaccttctccgcacccttcatggcctggaacaggaacatctgaggaagagccttgcgttgcaacaggaggaggattttgcaaaggcccacaggcagctggccgtttttcagagaaatgagcttcattcaattttttttacgcagatcaagagtgcgatttttaagggggagctcaaaccagaagccgccaagatgctgctccagaattattctaaaattcaggagaatgttgaagagcttatggacttcttccaagcttccaagaggtatcacttgtccaaacggtttggccatagggaatatctcgtacagaatctacaaagcagcgaaactagagtacaaggtctactgagcacggcagcagcccagctcacgcacttgatccagaagcacgagcgcgcaggttacctggacgaggaccagatggagatgctcctagagcgagcacagacagaggtcttcagcatcaagcagaagctcgataacgacttaaagcaggaaaaaaagaaactgcaccagaagctgattaccaaaaggaggcgcgagctgttacagaaacatcgtgagcagcggcgcgagcaagcttcagtgggtgaagcatttagaacagtggaagacgccggtcagtacctgcaccagaaacgcagcctcatggaagagcatggtgccaccctcgaagagttgcaggagaggctggaccaggctgctcttgacgatttgcgcaccttgactctaagtctcttcgagaaggcaaccgacgagttgcgaagacttcagaattccgccatgacccaggagctccttaagcgcggcgtgccatggttgttccttcagcagatcctggaggagcacggaaaagagatggccgctagggccgaacaactggaaggcgaggaacgggaccgggaccaggaaggcgtccagtctgtgagacagcggctgaaggacgatgctcccgaggctgttacagaggagcaggccgagctccgccgctgggagcatctaattttcatgaagctgtgcagcagcgtattctccttgtcagaagaagaactgctgcgtatgcgacaggaagttcacggatgtttcgctcagatggatagatccctggctctgcccaagattagagcgagggtcttgctgcagcagtttcagacagcctggcgagaagctgagttcgtaaagttggaccaggcagtagccgcaccagagctgcagcagcagtccaaagtcaggaagtctcggtctaaaagcaagagcaagggcgagctgctcaagaaatgtatcgaagacaaaattcatctctgcgaagaacaggccagcgaagatttggtggagaaagtcaggggagagttattaagagaacgggtgcaacgcatggaggcgcaagagggaggtttcgctcagtcacttgtggccctgcagttccagaaggcctctagagtgaccgagaccctgagcgcttacacggcactgctgtctattcaggacttactgctggaggaattgtcagcgtccgagatgcttaccaagtccgcctgcacccagattctggaatcacactctagggagctgcaggaattagagcgcaagttagaggaccagctggtacagcaggaggcggcccagcagcagcaggctctagcaagctggcagcagtgggtggcagacggcccaggcatcctgaacgaacctggagaggttgatagtgagaggcaggtctccaccgttttgcaccaagctctgagtaaatcacaaacactgttggagcagcatcagcagtgtctgagagaagagcaacagaatagcgtagtactggaagacctgctcgagaatatggaagccgacacattcgctacgctctgttcccaagaactgcgcctagccagctatttggccagaatggcgatggtgccaggggcaacattgcgcagactactctctgtggtgttacccacagccagccagcctcagttactggccctgctggacagcgctaccgagcggcatgtggatcatgctgccgagtccgacggcggagcggaacaggcagacgtcggcaggcgccgaaagcatcagagctggtggcaggcgctggatgggaagcttcggggtgatctcatctcacgaggactagagaagatgctttgggcgaggaagaggaaacagcgatccggtaaccaggaaagcttctggcagtacctggtggggacccccgaaatcggtcttattgaatggatgtcagagaaatag

SEQ ID NO: 115671 - DNA, 882 bp, Artificial Sequence
  Description of Artificial Sequence: Synthetic coding sequence
atgttcatttctctctgggagtttttttatggacacttctttcgtttttggatgaaatggcttttacgccagatgacagggaaatgcgagctgcagaggatctttgacacttatgtgggggcacagcgcacccatcggatagagaattctcttacctattccaaaaataaggtcctccagaaggctacccatgtggtccaatctgaagtggacaagtacgttgacgatattatgaaagagaaaaacataaacccggagaaggatgccagcttcaagatctgcatgaagatgtgtctgctacagattaccggttacaagcagctgtatctcgacgttgagtctgtgcgtaaaaggccttacgattccgataatctgcagcacgaggagctgcttatgaaactgtggaaccttttgatgccgacaaaaaagctgaatgcacgcatctcaaaacagtgggccgagattgggtttcaaggggacgacccaaagacagatttccgcggaatggggattttgggattaattaatctggtctacttttctgagaactacacaagcgaggcgcaccaaattttgtcccggtctaaccaccccaagttgggctacagctacgctatcgtaggcatcaatttgactgagatggcctatagcttacttaaatcagaggccttgaaatttcacctttataatctggtgccaggaatcccaaccatggagcattttcaccaattctactgctacttggtctacgagtttgacaagttctggtttgaggaagagcccgaatcaattatgtattttaatctctaccgagaaaagttccacgaaaaaatcaagggactgttgctggattgcaatgtggccctcacactgaaggtgtag

SEQ ID NO: 115672 - DNA, 507 bp, Artificial Sequence
  Description of Artificial Sequence: Synthetic coding sequence
atgtttatctccctgtgggaatttttttatggccatttcttcaggttctggatgaagtggctgctgagacagatgaccggtaaatgcgaactgcagaggatattcgacacttacgtgggcgcccaacgaacgcatagaattgagaactctctcacatacagcaagaacaaggttcttcagaaagccacccacgtcgtgcaaagcgaggtcgacaagtatgtcgatgacataatgaaagagaaaaacataaatcctgagaaggatgcctcgttcaaaatatgcatgaagatgtgtctgctgcagattacaggttacaaacagctgtacttggacgtcgaatctgtccgtaaaagaccctacgattcagataaccttcagcacgaggagttgttgatgaaactgtggaatctgctcatgcccaccaagaagttgaatgcgagaatttccaagcagtgggcggaaatcggttttcaaggggatgaccccaaaacagacttccgtgggtag

SEQ ID NO: 115673 - DNA, 108 bp, Artificial Sequence
  Description of Artificial Sequence: Synthetic coding sequence
atgtttatctctctgtgggagttcttctacggccacttctttagattttggatgaaatggcttctaagacaaatgaccgggaaatgcgagctacaacgaatcttttag

SEQ ID NO: 115674 - DNA, 1866 bp, Artificial Sequence
  Description of Artificial Sequence: Synthetic coding sequence
atggctgcgttaaaggaagaccgctcatacggtctcagctgcggacgggtgagcgatggtagtaaagtgtcagtgttccatgtgaagctgaccgattccgccctgagggcgttcgagtcctatcgtgctcggcaggacagcgtcagcctcaggccctctatccggtttcaagggagtcaaggtcacataagtatcccccagccggactgtcccgctgaagcaaggaccttcagcttctacctctccaacatagggcgcgacaacccccagggttccttcgattgtatccagcagtatgtttcgagccatggcgaggtccacttagactgcctcggctccatacaggataagatcaccgtttgcgcaaccgatgatagttatcagaaagcaagacagagcatggcccaggccgaagaggaaactcgttcccgctccgccatagtgattaaggcaggtggaagatacctaggtaaaaaggtccagtttaggaagccagctccaggcgctaccgatgctgtcccatctcggaagagagctaccccaattaatctggcctctgccattagaaaatccggcgcaagcgccgtctcaggtgggtcaggggtatcacagagaccatttcgcgacagggtgctgcacctgctggcactgagaccttacaggaaggccgagctgctgctgcgcttgcagaaagatggcctgacccaggctgacaaggatgcgttagacggcctgttacagcaagtagcgaacatgagcgcaaaggatggcacttgcaccctccaagattgcatgtataaagatgtacaaaaggactggccaggatacagtgaaggggaccagcagttgttaaagcgcgttctggttcggaagctgtgccagcctcaaagtacgggttcactgcttggggaccctgcggcctcttctccccccggagagcgcggacgctctgcatcccctcctcagaaacgcctccagcctcctgactttattgatcctttagcaaacaagaaacctcgcattagccatttcacccagcgagcccaacctgccgtgaacggcaagctgggagtccccaatggtagagaggccctgcttccaacacctgggccacctgcctccaccgataccctgtccagcagcactcacttacctccaaggcttgagccaccgcgcgctcatgaccccctggccgacgtctcaaacgacctgggacattcaggccgggattgcgaacacggggaggccgctgcgccagccccaaccgtgcgtctcggactgccgctgctcacagattgtgcccagccaagcaggccccatggatcccctagccggtctaaaccgaagaaaaagtctaaaaagcacaaagataaagaacgggcggccgaagataagcccagagcccagttgccagactgcgctccagccacccacgcaactcccggtgctcctgccgacacgcccggcttgaatggaacctgctccgtgtcctctgtacccacttcaacctccgagacgccagattacctactgaagtacgctgctatcagttctagtgagcaacggcagtcttataaaaacgacttcaacgcagaatacagcgaatacagggacttacacgctcgcatcgagagaatcacacgacggttcacccagctggacgcacagctgcggcagctctctcagggtagtgaagagtatgagacaacccgcgggcaaatcctgcaagaatatcgcaaaatcaagaaaacaaacaccaactacagccaggaaaaacaccgctgtgaatacctgcattcaaagctggctcacattaagcgcctgattgcagaatacgatcagaggcaactccaggcatggccatag

SEQ ID NO: 115675 - DNA, 90 bp, Artificial Sequence
  Description of Artificial Sequence: Synthetic coding sequence
attcatcggttggtggtcgcatttcaggacagtgtcagtctgcggccaagtatccggttccagggctcccagggtgaaatgtctctgtag

SEQ ID NO: 115676 - DNA, 1194 bp, Artificial Sequence
  Description of Artificial Sequence: Synthetic coding sequence
atggaggagctgcaagaaccacttcgcggccagctgcggctgtgcttcacccaagcagctcggacgtcattattgctattgcggctcaatgatgcagcgcttagagcacttcaggagtgtcagagacagcaagtgaggcccgtcatagcctttcaggggcacaggggctatttgcggttgccaggccccggctggtcatgcctctttagttttatagtgagccagtgttgtcaggagggagctggaggctcccttgacctcgtttgtcagaggtttcttcgctctggccctaacagcttgcactgtcttggatccttgagagagcggttgatcatctgggcagcaatggatagcattcctgcaccctcatctgtccaggggcataatctgacagaagacgcccgacatccagaatcctggcagaataccgggggctatagcgagggggatgccgtgtcgcagccccagatggcactagaggaggtgagtgtatcagatcctcttgcaagtaaccaaggtcaaagcctgcccggtagcagtagagaacatatggcccaatgggaggtgcggagccagacccacgtcccaaacagagaacccgtacaggccttgccttcatctgccagtagaaagcgtctcgacaagaagcgaagcgtgcccgtcgccactgtggagttagaggagaagagattcagaactctgccacttgtgccatctcccctgcagggtctcaccaaccaggatctgcaagagggggaggattgggagcaggaggacgaggacatggatccccggctggaacacagcagctctgtccaagaagactccgagagcccttcgcccgaagatatccctgattacctgcttcagtacagagcgattcattccgccgaacagcaacacgcgtacgagcaggacttcgagacagactatgctgagtacaggatacttcacgcacgagtgggcactgcgtctcagaggtttatcgaacttggcgctgaaataaagcgggtcaggcgcggaaccccagaatacaaggtgttggaagataaaataattcaggaatacaagaagttccggaagcaatacccgtcctaccgggaagaaaaaagacgttgtgaatatctgcaccaaaagctttcccacattaagggtctgattttggagttcgaagaaaagaacaggggctcatag

SEQ ID NO: 115677 - DNA, 2889 bp, Artificial Sequence
  Description of Artificial Sequence: Synthetic coding sequence
atggacacagacctgtatgacgaattcggtaattacataggtcctgagctcgactctgatgaagatgacgatgagctggggagagaaacaaaggacctggatgagatggacgatgatgacgacgatgacgatgtgggagaccatgatgatgatcatcccggtatggaggtggtcctccatgaagtgtatggtcccgaagtggagacaatcgtccaggaagaggatacgcagccattaaccgagcccataatcaagcctgttaaaacgaaaaagtttaccttaatggagcaaactcttcctgttacagtgtatgagatggatttcctggccgatctaatggacaactccgaactgatcagaaacgtcacactgtgcggccatttgcatcatgggaagacttgcttcgtagactgcctcatagaacagactcaccctgagatcagaaaaagatacgaccaagacctgtgttataccgacatcttattcaccgaacaggaaaggggcgtcggaatcaaatccactcccgtaaccgtggttctgcccgataccaaggggaagtcatatctcttcaatattatggacaccccagggcacgtcaatttttccgacgaggtgactgctgggctccggattagcgatggcgtggtgctcttcattgatgctgcagaaggggtgatgctaaacactgagaggctgatcaagcatgctgtccaggagcgcctcgccgtcacagtgtgcattaacaagatcgatcggcttatcttagagctgaaactgccccctacagatgcttattacaagctcagacatattgtagacgaggtaaacgggctgatctccatgtattcaacagacgaaaacctgattctgtctcccttgctgggcaacgtgtgcttcagttcctcacagtattctatctgttttacgctgggttcattcgccaaaatctacgccgatactttcggcgacattaattaccaggaattcgccaaacgcctctggggagatatctactttaacccaaaaacccggaaattcacaaaaaaggcaccgacctcctcttcccaaagaagctttgttgagttcatcttggaacccctatataagattttagcacaagtggtcggcgatgtcgacacatccctgcctcgtacattggatgagctcggaatccaccttacaaaagaggaattgaagctgaatattcgcccgttgctgagactcgtgtgtaagaagttctttggagaatttacagggttcgtggatatgtgcgtccagcacatcccgtctcccaaagtgggagccaaacccaaaatcgagcatacatacactgggggagttgattccgacctcggggaggccatgagcgactgtgatccagacggtcccctgatgtgtcacacaaccaaaatgtattcgaccgatgacggggtgcagttccatgcttttggccgagtgttgtccggaacaatccacgccggacaaccagtgaaggtattgggcgaaaattatactctggaggacgaagaagactctcaaatatgtactgtggggcgtctgtggatttccgttgccaggtatcacatcgaagtaaaccgagtccccgccggcaactgggtgctgattgagggcgtagaccagccaattgttaaaactgccactatcaccgagccccggggcaacgaggaagcgcagatcttcagacccctcaaattcaacaccacttcagtgataaaaattgcagtggaacctgtgaaccccagcgagctccctaagatgctggatgggctgcgtaaagtgaacaaatcctacccttctctcaccaccaaagttgaggagtcaggcgagcacgttattctgggcacaggtgaactatacctcgactgcgtgatgcacgacctgagaaagatgtattccgagattgacataaaagtcgcagaccctgtagtgactttctgcgagacagtggtggagacatctagcctgaagtgctttgccgagacccctaacaaaaaaaacaagatcacaatgatcgccgagccacttgaaaaaggactggcagaagacatcgaaaacgaagtcgtccaaatcacctggaaccggaagaaacttggagagttctttcaaacaaagtatgattgggatctcctggccgccagaagtatttgggcttttgggccagatgcaacaggaccgaacatactggtggatgacactttgccctcggaggtagataaggccctgctgggcagtgtcaaggatagtattgttcagggctttcagtggggtacaagagaggggccgttatgcgatgaactgatacggaatgtgaaattcaaaatcctggatgcggtcgtggcccaggagccattgcatcgcggtggcgggcagataattcccaccgctaggcgtgttgtgtacagcgcttttctcatggcaaccccaagactgatggagccctactacttcgtcgaggtgcaggctcccgctgattgtgtctcggcagtttacactgtgcttgcccgtagacgtggccatgttacgcaagatgcccctattccaggctctccgctctacacaattaaggcctttatcccagccattgattccttcggcttcgagactgaccttagaacccatactcaggggcaggcctttagtttgagcgttttccaccattggcaaattgtccccggcgatcccctggacaagagcattgtgataaggcccctggaaccccagcctgccccacacctggccagggaatttatgatcaagactcggcggagaaagggactatctgaggatgtttccatctcaaaattcttcgatgatcccatgttattggagctcgctaaacaagatgtggtgctaaactaccccatgtag

SEQ ID NO: 115678 - DNA, 2814 bp, Artificial Sequence
  Description of Artificial Sequence: Synthetic coding sequence
atggacgacgacgacgacgatgacgacgtgggcgatcatgatgatgaccaccccgggatggaggtggtcctgcacgaggacaaaaagtattatccaactgccgaggaggtgtacggtcctgaggttgagaccatcgttcaggaagaagacactcagccattaactgaacctatcattaagccggtgaaaacgaaaaagtttaccctcatggaacaaactcttcccgtcacagtgtacgagatggactttctggctgacttgatggacaattctgagttgatccggaacgtcacactatgtggccacctgcatcacggtaagacctgctttgtagactgtttgatcgaacagacccacccagagattcggaaacgctacgaccaggacctttgctataccgatatcttatttaccgagcaggaaaggggcgtcgggatcaaaagcacaccagtgactgttgtgctcccagacacaaaagggaaatcttacctgtttaatattatggatacacccgggcatgtcaattttagtgatgaggtgacggccggattgagaatttctgatggagtagtgttattcatcgacgccgcagaaggggtgatgcttaatacggagcgtttaatcaaacatgccgttcaggagcggctcgccgtgactgtttgcataaacaagattgatcgattaatcctggagctgaagctgccgcccactgatgcctattataagctgagacacatagtggacgaggtgaacggcctgatctccatgtactccacagatgaaaacctcatactgagccccctgcttgggaatgtgtgcttctctagcagccagtactctatttgttttacactcgggtccttcgcaaaaatctatgcagatacttttggcgacattaactaccaggagtttgcaaagagactctggggggacatttacttcaatccgaagactaggaagttcaccaaaaaggcacccacttcttcatcgcaacggagctttgtagagttcattctggagccgctctacaaaatactggcccaggtcgtcggagacgtggatacgagcctgccgcggactcttgatgagctcggcatccacctcacaaaggaggagctaaagctgaatatccgaccactgctccgcctggtctgcaaaaaattttttggggaattcacaggttttgttgacatgtgtgtgcaacacataccatccccaaaggtcggcgctaagcctaaaatcgagcatacgtatacaggcggagtggactcagatctgggggaggctatgagcgattgtgaccctgacggacccctaatgtgccatacaacaaaaatgtattccactgacgacggggtgcagtttcacgctttcggacgcgtgctgtctggcaccattcacgccggccagcctgttaaagtgttgggagaaaactatacactcgaggatgaggaggactctcagatctgtaccgtgggtagattgtggatctcggtggctcgttaccacattgaagtaaaccgggtccccgccggaaactgggttcttatcgaaggagtggatcagccaatagtgaagacagcaacgataaccgaacctcgagggaacgaggaggcacagatattccgccccctgaaattcaataccacatccgtcattaaaatcgctgtcgagccggtgaacccaagcgaacttcccaagatgctcgacgggttgcggaaagtgaacaagagctacccatcactaacaactaaggtggaggaaagtggggagcatgttatactgggcaccggggagttatatctggattgtgtcatgcacgatctgagaaagatgtactccgagattgatatcaaggtggctgatcccgtggtcacattttgcgaaaccgtggtggaaacctcttcgcttaagtgcttcgctgagaccccaaataaaaaaaataaaatcacaatgatagccgagcctttagagaagggactggctgaagacatcgagaacgaggtggtgcagattacgtggaacagaaagaagctcggcgaattcttccagaccaagtatgattgggatctgttggcagccagatcaatctgggcttttggcccagatgccaccggcccgaatattctggtggacgacacgctgccatccgaggtggacaaggccctactcggcagcgtgaaagattccattgttcaaggattccagtgggggacccgagagggtccgttgtgtgacgagctaatacgcaacgtcaagttcaaaattctcgacgctgtggtggcgcaagaaccacttcacagaggaggcggccaaatcattccgacagcgaggcgcgtcgtatacagcgcctttcttatggcgaccccccgtctaatggaaccctactacttcgttgaagttcaggccccggctgactgtgtgtctgccgtgtataccgtgttggcccgcagaaggggccatgtgactcaggacgcccctatccctggctcccctttatataccattaaagcttttatccccgccatagactctttcggctttgagactgatctccgcacacacacgcaaggccaggcattcagcctgagcgtgtttcatcactggcagatcgtgcccggagaccctcttgataaatccatcgtaattcgaccactagagccgcagccagccccccacctggctcgggaatttatgatcaagactagacgccgcaaaggtctgagcgaggacgtgtccatctcaaagttcttcgatgatcctatgctgctcgagttagccaagcaggacgtcgttctgaattaccccatgtag

SEQ ID NO: 115679 - DNA, 2919 bp, Artificial Sequence
  Description of Artificial Sequence: Synthetic coding sequence
atggacaccgatctgtatgacgaatttggaaattacatcggtccagagctggatagcgacgaggacgacgacgagctcggacgcgagacaaaagatctggatgaaatggatgatgacgacgacgatgacgatgttggagaccacgacgacgatcatcccggcatggaggtcgtcctgcacgaggacaaaaagtactaccccaccgcagaggaggtttacggtcctgaggtagagaccattgttcaggaggaggacactcagccgctcactgaacccatcatcaagcctgtcaaaacaaaaaaattcacattaatggaacagaccctccctgtcaccgtttacgagatggattttctggccgacctgatggacaactcagaactcattaggaacgtgaccctctgcggacatctgcatcatggaaagacatgtttcgtcgattgcctgatagaacagactcaccccgagatcaggaaacgatatgatcaggacctttgttatactgacattctgtttactgagcaagagcgaggcgttggcattaaaagcacccccgtgaccgtcgtgctgcccgataccaagggaaagagttatctgttcaacataatggataccccgggacacgtgaacttttctgacgaagtaacagctggcctccgcataagcgacggcgtcgtgctcttcatcgatgccgccgagggagtcatgcttaacacagagcgcctgatcaagcatgctgtacaggaaaggctcgctgtcacagtttgcatcaataaaattgatcgcctgatcctggaactgaaactcccccccactgatgcctactacaagctcaggcacatcgtagacgaagtgaatggacttatctctatgtacagcacagatgagaatttgatcttgagcccattactggggaacgtgtgtttttcctccagccaatattctatatgcttcaccctaggctcctttgctaagatttatgccgacaccttcggggacatcaactaccaggaattcgcaaagagactctggggtgacatttacttcaacccaaaaacccgcaagtttaccaagaaggcccctacaagttcctctcagagaagtttcgtagagtttatattagagcctctctataaaattctcgcacaggttgtaggtgacgtggacacaagccttccacgcacccttgatgagctcgggatccatctcacaaaggaggagctcaaactgaacattagaccactgttgcgccttgtgtgcaaaaagttcttcggcgagttcacaggctttgttgatatgtgcgtgcagcacatccccagccctaaggtaggggcaaagccgaagatagaacacacctacaccggaggcgtcgactccgacttgggcgaggccatgagcgactgcgaccccgacggtccactaatgtgtcacaccaccaagatgtacagtacagacgacggggttcagtttcatgctttcggcagggttctcagcggcaccatccacgccgggcagccggtcaaagtactgggcgaaaactatactctggaagatgaagaggactcgcagatctgcactgtgggtcgtctgtggatttcagtggccaggtaccatatcgaagtgaatagagtccctgccggaaactgggtacttattgagggtgtggatcagccaatcgttaagactgctactattactgagcccaggggcaacgaagaggctcagatttttcggcccttgaagttcaacactacaagtgtgattaagattgcggtagagcccgtgaacccaagtgagcttcccaagatgttggacggactgagaaaagttaataaatcatatccctctctgacaaccaaggtggaggagtccggcgaacacgttatacttggcacaggggaactgtacctagattgtgtgatgcacgacctccgcaagatgtactctgaaattgacattaaggtggcagacccagtcgtgactttttgtgaaacggtcgtagagacatcatcactcaagtgttttgccgaaaccccaaataaaaagaacaagatcacaatgatcgccgaacccctggagaaaggactagcggaagacattgaaaacgaggtagtccagattacatggaatcggaaaaagctcggggagtttttccaaacaaagtacgactgggacctcctagcagctagaagtatctgggcctttggcccagatgccacaggcccaaatatcctggtggatgatacgctgccctccgaagtggacaaggctctgctgggttctgtcaaagattcaatagtgcaggggttccaatgggggactcgggaagggcccctctgtgatgaactgattcgtaatgtgaaattcaagatcctggacgccgtcgtggctcaagaacctctgcatagaggtggcggtcaaatcatccctaccgctcgcagagtggtatattcagcctttctgatggctacgcccagactaatggaaccttattacttcgtggaagtgcaggccccagcagactgtgtcagtgccgtgtacaccgtactggcccggcggagaggccacgtgacacaggatgccccgatccccgggtctccgttatacaccatcaaagcattcataccagcgatcgattctttcgggtttgagaccgatctccggactcacacacaggggcaggcattcagcctctccgtgtttcaccactggcaaatagtaccaggggatcctcttgataaatccatagtgattagacccctggagccccaacctgcacctcaccttgcccgcgagtttatgattaagacacgccggagaaagggtctaagtgaggacgtcagcatcagtaagttctttgacgaccccatgctcttggaactcgccaaacaggatgtcgtcctgaactatcctatgtag

SEQ ID NO: 115680 - DNA, 1923 bp, Artificial Sequence
  Description of Artificial Sequence: Synthetic coding sequence
atggccgcaggtggtacgggcggcctgcgggaggaacagcgatacggcctttcgtgcggcagactgggccaggacaatatcactgtattacatgtcaaactcacagagacagctatccgtgcactcgagacataccagagccacaaaaacttaattccattcaggccctccatccaattccagggactccatgggttggtcaaaatccctaagaatgatcccttgaacgaagtgcataacttcaacttttacttgtcgaatgttgggaaggacaacccacaagggtcattcgactgcatccaacaaacattcagtagcagcggggcatcccagctgaattgtctgggattcatccaggacaaaattaccgtatgcgccacaaacgattcataccagatgactcgggaaagaatgacacaggccgaggaagagagcaggaacaggtcaaccaaagtcattaaacccggtggaccctatgtggggaaacgtgtccagatacgcaaagcaccacaggcagtctcagatacggttcccgagaggaaaagatcgacaccaatgaaccccgctaataccatcaggaaaacccacagttcttcaactatttcacagcgcccctacagagatcgcgtgatccacctgctggccttgaaggcctacaagaagccagaactcctcgccaggctacagaaagatggagtgaatcagaaggacaagaatagcctgggcgctatactgcaacaggtagccaatctgaatagcaaggacttgtcctacacattgaaggactacgtgttcaaagagctgcaaagagattggcccggatactctgagatagatagaaggagcctcgaaagtgtgctgtcacggaagctaaatccaagtcaaaatgccgccgggacaagtagaagcgaaagtcccgtgtgttcttcacgagatgcggtctccagtcctcagaaaagactgctcgattccgagtttatagatcccctgatgaacaagaaggctaggattagccacctgactaatagggtgcccccgactcttaacggtcacttaaatccgacctcagaaaaatccgccgcagggctcccactgcccccagctgccgcggccatccccacaccgcctccacttcccagtacatacctccccataagccaccctcctcaaatagtgaattcaaactctaatagtccttcaactcctgagggccgcggtacccaagacctccccgtagattcatttagccagaacgactctatttacgaagatcagcaggataagtataccagcagaacctcgctagaaaccctgccgcccggcagcgtactgctgaaatgcccaaaacctatggaggagaatcattccatgagccataaaaagtccaagaagaaatccaagaagcacaaagaaaaagatcagatcaaaaaacatgatatcgagactattgaggaaaaagaagaggacctaaagcgtgaggaggaaattgcaaagctgaataattcatctcccaattcatctggcggagtgaaagaggactgtactgcatcgatggaaccttccgctatcgagctgccggactaccttattaagtatatcgctattgtgagttatgaacagagacagaattataaggatgatttcaatgctgagtacgacgaatacagagctctgcatgcccgaatggaaaccgtggccagacggttcatcaaactcgacgcccagcggaagaggctgtcaccagggtccaaagagtaccagaatgtacacgaggaggtgttacaggaataccagaagattaagcaaagctcccccaactaccatgaggagaagtaccgctgcgaataccttcacaacaagctcgcccacataaaacggctgatcggcgaatttgatcagcagcaggctgagagctggtcttag

SEQ ID NO: 115681 - DNA, 1173 bp, Artificial Sequence
  Description of Artificial Sequence: Synthetic coding sequence
atggccgcggggggcaccggggggctgagagaagagcagaggtatgggttgtcctgcggccggctgggacaggataacatcacagtcctccacgtgaaactgacagagacagcgatacgtgctctcgagacctatcagtcccataagaatctaatccctttcaggccctcgattcagttccaggggctgcacgggctggtcaaaatcccaaaaaacgaccctctgaacgaagtccacaacttcaatttctatctgtcaaacgtcggcaaagacaatccacaggggagctttgactgcattcaacaaacattctcaagctccggcgcatcgcaactgaactgtctcggcttcatccaggacaaaatcaccgtgtgtgccacaaacgattcctaccagatgacccgggagcgcatgacacaaatagtgaattctaatagtaattctccatcaaccccagagggccgagggacacaggatttgcccgttgacagtttcagtcaaaatgactccatttacgaagatcagcaggacaaatacacgagtcggacctcattggagactctcccaccgggaagtgttctgctgaagtgcccaaaacctatggaagagaatcatagtatgagtcataaaaaatccaagaagaagtcaaaaaaacacaaggaaaaggatcagatcaagaagcacgacatagagactatcgaagaaaaggaggaggatttgaaacgcgaggaggagatcgcaaaattgaataactcttccccaaacagtagcggaggcgtcaaagaagactgcaccgcgagcatggagccttcggctatcgaactgcccgactatctgatcaagtacatcgctatcgtgagctatgagcagcgccagaactacaaggacgactttaacgctgagtatgacgaataccgcgctctccacgctcggatggagacggtggctcgtcgctttataaagcttgacgcacagaggaaaaggctttccccaggctcaaaggagtaccaaaatgtccatgaggaagtcctgcaggaatatcagaagataaaacagagctcccccaattaccatgaggaaaagtatcggtgtgaatatctccataacaagctagctcacatcaagaggctcatcggagagtttgaccagcagcaagcagaatcctggtcctag

SEQ ID NO: 115682 - DNA, 1644 bp, Artificial Sequence
  Description of Artificial Sequence: Synthetic coding sequence
atgaggcaaaaacgcaaaggagacttgtctccggccgaattgatgatgttgacgatcggcgatgttatcaagcagctaatcgaggcccacgaacagggaaaggacatagatttaaataaggttaagacaaaaacagccgccaagtacggtttgagcgcccaaccaagactggttgacatcatcgccgcagtgcccccccagtatcgcaaggtcttaatgcctaagcttaaggccaagccaattcggacagctagtgggattgccgtggtggccgtgatgtgcaagcctcacagatgcccccatattagtttcacaggcaacatctgcgtgtactgtcccggaggtcctgactcagactttgaatattcaacccaatcttacaccggctatgaacccacatctatgcgcgccatacgagcccggtacgacccatttctgcagacccggcatcggatagaacagctcaaacagcttggacacagcgtagacaaagtggaatttattgtgatgggaggtacgtttatggccctacccgaggaatatagggattatttcattcgcaacctgcacgacgccctttcaggccatacgtccaacaatatatatgaggcagtgaagtattctgagcgctctctgacaaagtgcataggcatcacaatcgaaaccagacctgattactgcatgaagcgtcatttgagcgacatgctaacttacggctgcactcggctcgaaattggcgtccagtctgtgtatgaggacgtggccagggatactaaccgaggacacacagtgaaggccgtgtgcgagtccttccatctcgccaaggactccggattcaaggttgtggcacacatgatgcccgacctgcctaatgtgggcttggaacgggatatcgaacagttcaccgaatttttcgagaatcccgcttttcggcccgatggtctgaaattataccccacattggtgatccggggcacagggttatacgaattgtggaaatcgggccgctataagtcctacagccctagcgacttagtggaactggtggcacggatcctggccttagttcctccttggacccgtgtgtatcgggtccaaagggacatacccatgccattggtcagttctggcgtggagcatggcaacctccgggagttggccttggctcggatgaaagatctgggcatccaatgtagggacgtgagaacccgtgaggtgggcatacaggagatacaccataaggtgcgcccttaccaagtagaactggtgcgccgggattacgttgccaacggggggtgggagacctttctgtcgtatgaagatccagatcaggatatcctgatcgggttgctacgtcttcggaaatgtagcgaggaaacctttaggttcgaactcggcggaggcgtcagcatcgtgagggagctgcacgtgtacggctccgtcgtgcccgtttccagcagggaccctactaaatttcagcaccagggattcggtatgctcctcatggaagaggcggagcgcatcgctagggaggagcatggtagtgggaaaattgccgtaattagtggggtggggaccaggaactactatcgaaagattggttacaggctacaggggccttatatggtaaaaatgctgaaatag

SEQ ID NO: 115683 - DNA, 1368 bp, Artificial Sequence
  Description of Artificial Sequence: Synthetic coding sequence
atgtgcaagccccacaggtgcccccacatatccttcactgggaatatttgtgtgtattgtcctggcggacccgattctgatttcgagtacagtacgcaaagctacactggatacgagccaacaagcatgcgcgcaattcgcgccagatacgacccctttctgcaaaccagacatcgcatagaacagctgaagcagttgggccactctgtcgataaggtggagtttattgtgatgggaggtacatttatggccctgccagaggagtacagggattacttcatcaggaacttgcacgatgctctgagcggacatacatcaaacaacatatacgaggctgtgaaatacagcgagcggagcctgactaaatgtatcggcattactatcgaaactcgcccagattactgcatgaagaggcatctgtccgatatgctcacctacgggtgcacaagactcgaaataggcgttcagagtgtctacgaggacgttgcccgggacacaaaccgagggcacacagtcaaagccgtctgtgaaagtttccatctggcaaaagattctggttttaaggttgtggcccatatgatgccagatctaccaaacgtggggctggaaagagatattgagcaattcaccgagtttttcgagaacccagcttttcggccggatgggctgaagctgtatccaacactagttatcagaggtaccgggttgtacgagctctggaagtcgggtcggtataaaagctattcccccagcgatctggtggagttagtagcgagaattctggcactggtgccaccctggaccagagtttacagagtacaacgcgatatcccgatgcccctggtctctagcggcgtggagcacggaaacctgcgtgaactggcactggcccgaatgaaggatctgggaattcagtgccgcgatgtcaggacgcgagaagttggcattcaggagattcaccataaggtgagaccttatcaggtagaactcgtgcgacgggactatgtggcaaatggcggatgggaaacgttccttagctatgaagaccccgaccaggacatcctcattggacttctccggctgcgaaaatgtagcgaagaaacttttcgtttcgaactggggggcggagttagtattgtgcgggagctgcacgtctacggttccgtcgtaccagtctcttcaagagacccgacaaaatttcagcaccagggctttgggatgctgctgatggaagaggccgagcggatcgcccgtgaggaacacggttcaggaaagatcgctgtgatctccggggtgggcacacggaactactatcgcaaaattggctatcggctgcagggcccatatatggtgaaaatgctaaagtag

SEQ ID NO: 115684 - DNA, 342 bp, Artificial Sequence
  Description of Artificial Sequence: Synthetic coding sequence
atgatgctgaccatcggagacgtgataaagcaactgatcgaggctcatgagcagggtaaagatattgacctcaacaaggttaaaacgaagaccgccgccaagtatggcttgagcgcacagccaaggctggtcgatatcattgcggcagtcccccctcagtaccgcaaagtcctcatgcctaagttaaaagccaagccaatacgcaccgcatcagggatcgccgtcgtggccgtgatgtgtaagcctcacagatgcccccacatatcctttacaggaaacatttgcgtgtactgccctggcggaccagattctgatttcgaatattccacacagagctactag

SEQ ID NO: 115685 - DNA, 1602 bp, Artificial Sequence
  Description of Artificial Sequence: Synthetic coding sequence
atgatgctgacaattggagacgtgatcaagcagctaattgaagcccatgaacagggaaaagacatagacctcaataaagtaaaaaccaaaacggccgccaagtatggcctgtccgcccaaccccggctggtcgacattatagccgccgtccctccacagtatagaaaggtgctcatgcctaagctcaaggccaagccgatccgtacagcgagtggcatcgcagtggtcgctgtcatgtgtaaaccgcacaggtgtccacacattagctttaccggtaacatttgcgtgtactgccccggcgggcctgatagtgatttcgagtacagcacgcaaagctatacaggatacgaacctacaagcatgcgggccatccgcgctaggtacgatcccttcttacagaccagacacagaattgagcagctcaagcagctgggtcattctgttgacaaagtggaatttatagtaatgggcgggacatttatggccttgcctgaagaataccgcgactacttcatccgaaatctgcatgatgccctttcgggacatactagtaataacatatatgaggctgtaaagtactctgagcggtctcttactaagtgtattggcatcaccattgagacacggcccgattattgcatgaagcgccacctgtcagatatgcttacctacggatgcacacgcctggagattggggtccagagcgtatacgaagatgttgcccgagatactaacaggggccatacagtgaaggcagtatgtgagagcttccatcttgccaaggatagtgggttcaaggtggtggcccacatgatgccagacttgccgaacgtggggctggaacgcgacatcgaacaatttacagagttcttcgaaaatcctgccttcaggcccgacggactcaagctatacccgactctcgtgatacggggaacagggctgtatgaactgtggaagagtggcaggtataaaagttatagccccagcgatctggtggagttggtggcacgtatcctagcactcgtccccccctggacgcgtgtttacagggtacaaagggatatacctatgcccctggttagtagtggtgttgaacatgggaatctcagagaactcgctctggcccgcatgaaggacctaggaatccaatgtcgggatgtgcggaccagggaggtcggcatccaggagattcaccataaagttcgcccttaccaggtggagctggtgagacgcgattatgtggccaatggcggctgggaaaccttcttgagttatgaagatcctgatcaagatatactgatcggcctgctgagactgcggaaatgcagtgaagaaaccttccgctttgaactgggaggtggagtgagcattgtgcgggaactccacgtatacggcagcgtcgtacccgtgtctagccgcgatccgacgaaatttcagcatcagggatttggcatgctgctgatggaagaggctgagagaatcgcgagggaggagcacgggtccggaaagatcgccgtcatctctggagtcggtactcgaaactactatcgaaaaattgggtacagattgcagggaccatacatggtcaaaatgctcaaatag

SEQ ID NO: 115686 - DNA, 576 bp, Artificial Sequence
  Description of Artificial Sequence: Synthetic coding sequence
atgatgctcaccatcggggatgtgataaagcagctcatcgaggctcatgagcaggggaaggatatagacttgaacaaagtgaaaacgaaaaccgctgctaaatacggcttgagcgcgcagccgagactggtggatatcatagcagcagtcccacctcagtacaggaaggtccttatgcccaaactcaaagctaagcccattaggaccgccagcggcatagcggtcgtggcagtaatgtgcaagccccaccgttgcccacacatctcattcacagggaacatctgcgtgtactgtccaggcggccctgactctgactttgaatactccacacagtcatacaccggatatgagccaacaagcatgagagccattagggcgcgctatgatcctttcctgcagaccaggcaccgcattgagcaactgaaacagctgggccattccgtagacaaggtagagtttatcgtgatgggcgggacctttatggcgcttcccgaggagtatagggattatttcatccgtaacttgcacgatgcgctgagtgggcacactagcaataatatctatgaagcggtttag

SEQ ID NO: 115687 - DNA, 1287 bp, Artificial Sequence
  Description of Artificial Sequence: Synthetic coding sequence
atgagtacacatcaattctatcgcaaatatatgtgccccacaagcatgagagccatcagagccagatatgatccctttcttcagacaaggcacaggattgagcagctcaagcaactgggccattccgtagataaagtggaatttatcgtgatgggcggcacttttatggctctacctgaagagtaccgagattattttatacgcaacttacacgacgccctgagtggccatacttcaaacaacatctatgaggcagtgaaatatagtgagcggtctctgactaaatgtatagggattaccattgaaacaaggcctgattactgcatgaagcgacacctctcagatatgcttacttatggttgtacccgtctggaaattggtgtccaaagcgtatacgaagacgtggctcgggacacaaatcgcggccacaccgtgaaggccgtctgcgagagctttcatctggccaaggattccgggttcaaagttgttgctcatatgatgccagacctgcccaacgtcgggctcgaacgcgatatagaacaattcacagagttctttgagaatccggccttccgccccgatgggctgaagctgtatccaaccctggtgattaggggcactggtctttacgaactgtggaagtcaggtaggtacaagtcttactcaccctctgacctggtggaactggtggcaagaatattggctttagtccccccttggacacgcgtgtatcgtgtacagcgcgacataccaatgccactggtttcttccggggtggaacacggcaacctgcgggagctcgccctcgccagaatgaaggatcttgggattcagtgtcgggatgtgcgcacgcgcgaggtgggaattcaggagatccaccacaaagtccgaccataccaggttgagctggtcaggagagattacgtcgcaaatggaggctgggagaccttcttatcctatgaagatcctgaccaggatattctcatcggcttgctgcgcctacggaaatgttcagaagagaccttccgcttcgaacttggcgggggggtgagtattgtgcgcgagctacacgtatatgggagcgtggttcctgtcagctcacgtgaccccaccaagtttcagcatcagggattcggaatgttactgatggaagaagcggagaggatagctagggaggaacacggcagcggcaaaatcgctgtcataagtggcgttggcacgcgcaactactatcgcaagataggctaccgcttacaggggccttatatggtgaaaatgctgaaatag

SEQ ID NO: 115688 - DNA, 1257 bp, Artificial Sequence
  Description of Artificial Sequence: Synthetic coding sequence
atgtgtcctacttcaatgagagcaatcagggccaggtacgatcccttcttacagactagacatagaatcgagcagcttaagcagttgggacactcagtcgataaagtcgagtttatagtcatgggcggcaccttcatggctcttcctgaggagtaccgtgactacttcatcaggaacctacatgatgcgctgagcgggcatacctcaaataatatctacgaggctgtgaagtactcagaaagaagcctcaccaaatgcatcgggatcactatagagacacgccctgactactgtatgaagagacacctgtccgacatgctgacttacggttgtacccggctagagattggcgtgcagtccgtgtacgaggatgttgcgcgagatacaaaccgggggcacacagtgaaagcagtgtgtgaaagcttccacttagctaaagacagtgggtttaaagtcgtcgcccatatgatgcccgacctgcctaatgtagggctggagcgggatatcgagcagttcacggagtttttcgagaaccccgccttcagacctgatgggctcaagctgtatccaactttagttattcgcgggacaggactctacgagttatggaagtctggaagatataagtcctactccccttctgatttagtggagctagtggccagaatcctcgccctagtcccaccctggactagggtctatagagtgcaaagagacattcctatgcctctggtatcctctggggttgaacacggcaacctccgagagctggctctagccagaatgaaggacctgggaatccagtgtcgcgacgttagaaccagagaggtgggcatccaagagattcaccataaagttcgtccctatcaggtcgagctggtccggcgagactatgtggccaatggtggctgggagaccttcctctcgtatgaggatcccgaccaagatatacttatcggccttttacgactgaggaagtgctccgaagagactttcaggttcgaattgggagggggggtgagcattgtgcgggagttgcatgtttacggctcagttgtgcccgtcagctctagagaccctactaagtttcagcaccaaggttttggaatgcttctgatggaagaggcagaacggatagcaagagaggagcatggcagcggcaagattgcagtgatatccggcgtgggcacccggaactactaccggaaaattggttacagactgcagggcccatacatggtgaaaatgcttaaatag

SEQ ID NO: 115689 - DNA, 1275 bp, Artificial Sequence
  Description of Artificial Sequence: Synthetic coding sequence
atggccgccgtagcgacctgcggtagtgtggccgcatccaccggcagcgctgtggctacggccagtaagtctaatgtcactagtttccagcgcaggggtccccgggccagcgtaaccaacgacagtggcccccgactagtgagtatcgccggaaccagaccgtctgttcgtaacggtcagctgctagtatcaaccggactgccagctttggaccaactgcttgggggcggcctcgccgtgggaacagtactgctgattgaggaggataagtacaacatctatagcccgctgttgttcaaatactttctcgcagagggcatagtcaacggacatacactgctggttgcctctgccaaagaagacccagccaatattttgcaggaacttcctgcccctttgctggacgacaagtgcaaaaaggagtttgacgaagatgtttataatcacaagactcccgagtcaaatattaaaatgaaaatcgcctggcgctaccagctgttgcccaaaatggagattggacctgtctcttccagcaggtttggacattattatgacgcaagtaaaaggatgccccaggaactgatagaagcctccaactggcatggcttcttcctgcccgaaaagattagcagcaccttaaaagtcgaaccttgctcacttacaccagggtatacgaagttgctgcagttcatacagaacatcatctatgaagaaggcttcgacggctcaaacccccagaagaagcagcgcaacattctgaggatcgggattcagaacctgggttcaccactgtggggggatgatatttgctgtgctgagaacggtggaaattctcattctttgaccaaattcctatacgtcctccgcggactcctccgcaccagcctctcagcctgtatcatcaccatgccaacacaccttattcaaaacaaggcgatcattgctcgtgttacaacgctgagcgacgtggtagtcggactggagagtttcattggttcagagcgggaaaccaatccactgtacaaagattatcacggtctgatccacatacgacagataccccgacttaataacctcatctgcgatgaaagcgatgtgaaagatttagcgtttaagctgaaaagaaaactgtttaccatcgaacgtctgcatctgccaccggatttaagcgataccgtctccagatccagcaaaatggacctcgccgagtctgcaaaaaggctgggccctggctgtggcatgatggccggcggcaaaaaacatctggacttctag

SEQ ID NO: 115690 - DNA, 1431 bp, Artificial Sequence
  Description of Artificial Sequence: Synthetic coding sequence
atggcagccgtggctacttgcgggagcgtggctgcaagtaccggctccgcggtggctacagcatccaaatcaaatgtgacatcgtttcagcgcagaggcccaagggcatcagtcactaatgactcaggacccagattggtatcaatcgcgggaacacgcccttcggttcgcaacggccagctgttggtgagcactggtcttcccgccttagaccagctgctcggcggcggcctggctgttgggacagtgctgctgatcgaggaggacaagtacaatatctattcgcctttattgttcaagtactttcttgcagagggcattgtcaacgggcacacgctgctggtagcatccgctaaggaagatccggcaaatatattgcaggaactgcctgctcctctcctggacgataagtgtaaaaaggagtttgatgaagatgtctacaatcacaagactcctgagtcaaacataaaaatgaagattgcatggagataccagctcctgcccaagatggaacagattggccccgtgtcctcttcaagatttgggcactactacgacgctagtaagcgcatgcctcaggagttgatcgaagcgtctaactggcacggatttttcttacctgaaaaaattagctctaccctaaaggtggaaccttgcagtcttacacctgggtatacaaaactgcttcagtttattcaaaacatcatttacgaagaggggttcgacgggagcaatcctcaaaaaaaacagcgcaacattcttagaattggcatccagaacttggggagcccattgtggggggacgatatttgttgtgcagaaaacggagggaactctcattcacttactaagttcttgtatgtgctgagaggactcctaagaacctccctgagcgcctgtataataacaatgcctactcatctgattcaaaataaagcaatcatcgccagagtgactaccctgtctgacgtggtggtaggtcttgagagctttatcggctcagaacgagagacaaatcctctgtacaaggactaccacgggctgatccatattcggcagatcccccggctgaacaacctgatatgtgatgaatccgacgtcaaggatctagcctttaagctgaagcggaagctgtttacgatcgagtgggttcaagataactatctccgacaggaacgaaatatctatccccccgggttttcctaccttctgaaacagaaagattctgcatggggagaaggctctttgcagcatagtacctttctcatgtccttcctagcaaaagcaactgctttcgcaagccgcctggttagacattccgaacccttaaaacaaaatgggtctgggaggattcggcaggcggctggaccccgactatggcatgacggccggcggcaggaagcccccgggctcttaggaattccaccctag

SEQ ID NO: 115691 - DNA, 1608 bp, Artificial Sequence
  Description of Artificial Sequence: Synthetic coding sequence
atggccgccgtggcaacctgcggtagtgtggctgcctctacagggtctgcagtagcaaccgcaagcaaatctaacgttacgtcttttcagcggcgcggaccacgagccagtgtgacaaatgattccggcccccggcttgtctcgatcgctggaaccagaccatccgtgaggaacggccagctgctggtgtctacaggactcccagctctggaccaactccttggcggcggcttagccgtgggcaccgtgctcctcattgaggaagacaaatacaatatttacagccctctactctttaagtatttcttggccgagggtatcgttaatggccacacactgctggtggcaagcgctaaggaagatcccgctaacatcctccaagaactgccagcgcctctgctggatgacaaatgcaaaaaggaattcgacgaagatgtatacaatcacaaaacgccagaatcaaatataaaaatgaagatagcgtggcgttaccaactgttgccgaagatggagattggaccagtgagttcttcacgcttcgggcactactacgatgctagtaaacggatgcctcaggaactgattgaggcttctaattggcatgggtttttcctgccagagaaaatcagctccacgcttaaggtcgagccctgcagtctaactcccggctatactaagctgcttcagtttatccaaaacataatctacgaggagggatttgacggaagtaaccctcagaaaaaacaaagaaatattctgaggatcgggatacagaacctgggaagtcccttgtggggagacgacatttgttgcgcggagaacgggggtaactcacacagtctaaccaagttcctgtacgtactgcgtgggctgctgaggacatctctgtccgcctgtattatcaccatgcccacacacctaatccaaaacaaggccattatcgcaagagttacaaccctctccgacgtggtcgtgggcctcgagtcctttataggtagtgagagggagactaacccactctataaggactaccacggactaatccatatacggcagattccgcggctgaataacttgatctgtgacgaaagcgacgtcaaagatctggctttcaaactaaagagaaaactgtttactatcgaggccggggtacaatggcacgatctggggtcccggcaacctcggctgttgggttcctcgaacagccccgccagtgctagcctggtggcggggatcactggtgctcaccaccatacccagctgatcttcgtgtttctggtcgagatgggatttcaccacgtagggcaggccggcctcgagctgttgacatcgggggacagcagtgcatcggcctcccagagcgccggaataaccgggatgtcctacagagcacggccacgcgcactgtatttcaaagaaaataagtccaaggtgggcgctcgtcagctgctggaaacacgtgaggagcacctttcatcgcggctcctcatcctgacacaagctgaaaggctgtgcatgggacgcagattctttaccgcttttcacattttcaacgagctcccttgtaaaggcgattgcatatgcctgcagacatgccagacacagtag

SEQ ID NO: 115692 - DNA, 840 bp, Artificial Sequence
  Description of Artificial Sequence: Synthetic coding sequence
atggaagctgtggtaaacctctatcaggaggtaatgaagcatgccgaccctagaatacagggctaccctttgatgggaagccccttactgatgacaagtatcctcctgacctacgtgtactttgtgttatcactggggccgagaattatggcaaacaggaagccattccagctgcgagggtttatgatcgtgtacaatttctcactcgtggcgctcagcctatacatcgtgtacgagttcctcatgtccggatggcttagtacctatacctggcggtgtgaccctgtagactactcaaatagccctgaggctctccggatggtccgagtggcatggttatttctcttttctaagtttatagaactgatggacaccgtaattttcattctgaggaaaaaagacggacaggtgactttcctgcacgtcttccaccattctgtacttccttggtcctggtggtggggcgtgaaaatagcccccggaggaatgggcagcttccatgcgatgatcaattcttcagtgcacgtcatcatgtacctgtactatggcctctctgctttcggtccagtagcccagccctacctctggtggaaaaagcacatgactgctattcagctgattcagtttgtgctcgtcagtctccatataagccaatactattttatgtcgtcttgcaattatcagtatccagtgataattcacctgatctggatgtacgggactatcttcttcatgctcttctccaatttctggtaccatagctacactaaagggaagcgccttccaagagccctccagcagaatggcgcaccaggcatagccaaggttaaggccaattag

SEQ ID NO: 115693 - DNA, 759 bp, Artificial Sequence
  Description of Artificial Sequence: Synthetic coding sequence
atggaagcagttgttaacctgtaccaggaggtgatgaaacacgccgatccacgcatccagggatacccactgatgggatcccccctccttatgacgtcgatactcctgacctatgtgtatttcgttctgagtttaggcccaaggattatggctaacaggaaaccgttccaacttagaggattcatgattgtctacaacttctccttagtggctctcagcctctatatcgtgtacgaaatggtgagggttgcttggctgttccttttctccaagtttatcgagctgatggacaccgtgatatttatcctgaggaagaaagatgggcaggtgacatttctccatgtgtttcaccattcagtgctgccgtggagctggtggtggggcgtcaagatcgcccccggcgggatggggagctttcatgccatgatcaattcgagtgtccacgtcattatgtacctttactatggcctgtcggcattcgggcctgtcgcacagccatatctgtggtggaagaaacatatgaccgccatacagcttatacagtttgtactcgtgtccctgcacatatcacagtattacttcatgagtagctgcaattatcagtatcctgttattattcatttgatctggatgtatggaacaatcttctttatgctattctcaaacttctggtatcactcctacaccaagggtaagcgcctacctcgagccctgcagcaaaacggggctccaggcattgcaaaggttaaggccaattag

SEQ ID NO: 115694 - DNA, 891 bp, Artificial Sequence
  Description of Artificial Sequence: Synthetic coding sequence
atggagcaccttaaggccttcgacgacgagatcaatgcctttctggataatatgtttggtccgcgagatagccgcgtgagaggatggtttatgctcgactcctacctgcctacctttttcttaaccgtgatgtacctcctttcgatttggctgggcaacaagtacatgaagaacaggcccgcgctgtccctcagaggaattttaactctgtataatctggggatcacccttctctcagcctacatgttggctgagctaattctcagtacttgggagggcggctacaatttgcagtgccaggaccttacaagcgcaggcgaagccgatattagggtcgccaaagtactgtggtggtattatttctctaaatcggtggagtttctcgacacaatcttcttcgtgttgagaaaaaaaacctcacagatcacctttctgcatgtttaccatcatgccagcatgttcaatatttggtggtgcgtgctgaattggataccctgtgggcaatccttctttggccctaccctgaatagctttatccacattcttatgtatagttactatggcctgtctgtgtttccctccatgcacaagtatttatggtggaaaaaatatctaacccaggcccagctggtgcagttcgtacttaccattacccacacgatgtcagccgtcgtaaaaccatgcggatttccatttggctgtctgatcttccagtccagttacatgctcacactcgtcattctgtttctgaatttttatgtccaaacctataggaagaaaccaatgaagaaggatatgcaggaaccaccagcgggcaaagaggtcaagaacggctttagcaaggcctactttacggctgctaacggagtgatgaacaagaaggcgcagtag

SEQ ID NO: 115695 - DNA, 813 bp, Artificial Sequence
  Description of Artificial Sequence: Synthetic coding sequence
atggttactgctatgaacgtgtcacatgaggtgaatcagctgtttcaaccctacaatttcgagctatccaaagatatgaggccgttttttgaggagtactgggccacctcctttccgatagccctcatctatttagtgctcattgccgtaggccaaaactatatgaaggagagaaaaggctttaacctgcagggtccgctaatattatggagcttttgcctcgccattttcagtattctcggtgctgtccggatgtggggtattatgggtactgtcctcctgaccggaggactgaaacaaaccgtttgctttattaacttcatcgataactccacagtgaagttttggtcctgggttttcctgctgagtaaggttattgagctcggcgacactgcattcatcatcctgagaaagagacccctgattttcattcattggtatcatcacagtaccgtcttggtttacacatcatttggctacaaaaataaggtccccgccggggggtggttcgttactatgaactttggggtacacgccatcatgtacacatactacacactgaaggccgctaacgtgaagcctcccaagatgctgcccatgctcattactagtttacagatcctgcaaatgtttgtgggagccatcgttagtatcttgacctacatctggaggcaggatcaaggctgccatacaactatggagcacctcttctggagctttatcctgtacatgacttactttatcctgttcgcgcattttttctgccagacttatatacgaccaaaggtgaaagctaaaacgaagagccagtag

SEQ ID NO: 115696 - DNA, 945 bp, Artificial Sequence
  Description of Artificial Sequence: Synthetic coding sequence
atggggcttctcgattctgagcctggcagtgttctgaatgtggtatctacagcactgaacgataccgtggagttttatcgctggacctggagtatagccgataagcgggtcgagaattggccactgatgcaaagtccttggcctactctgagcattagtaccctttacttgctgttcgtgtggcttggacctaaatggatgaaggacagggagccttttcaaatgaggctcgtgctgattatttacaactttgggatggtcctgttgaatctattcatttttagagaactcttcatgggctcctacaacgccgggtacagctacatatgccaatccgtcgactattccaataatgtgcacgaggtgcgaattgcggctgccctgtggtggtattttgtaagcaagggagtggagtacctagatacagtgttctttatcctcagaaagaagaacaatcaggtaagtttcctccacgtctatcaccattgcacaatgttcaccctctggtggattggaatcaagtgggtcgcagggggacaggcattcttcggagctcagttgaactccttcatacacgtgatcatgtatagctactatggactgactgcctttgggccttggattcagaaatacctctggtggaagcgatatctgactatgctgcagctgatccagtttcacgtgacgattggtcacaccgctctgagcctgtacaccgattgcccattccccaaatggatgcactgggcgcttatcgcatacgccatctcttttatctttctgtttctcaacttctatattaggacctataaggagcccaaaaagccaaaggctggcaagaccgcaatgaacgggatttctgctaacggagtctcaaagtctgagaagcagctgatgatcgagaacggcaagaagcaaaaaaatggcaaggccaaaggtgattag

SEQ ID NO: 115697 - DNA, 900 bp, Artificial Sequence
  Description of Artificial Sequence: Synthetic coding sequence
atggaacacttcgatgctagcctgtccacctattttaaagctcttttggggccccgcgatacccgggtaaaaggttggtttctgttggacaactatatacccaccttcatttgctctgtcatttatctcttaatcgtgtggcttggaccaaaatacatgcgcaataagcagccattttcttgccggggcattctggttgtttacaatctcggcctcactctgctgtccctttacatgttttgtgagttagtgaccggggtttgggaaggaaagtacaactttttttgccaagggacccgaacagccggggagagcgatatgaaaattatccgggtactctggtggtattacttttctaagctcatcgagttcatggacaccttctttttcatcctccgaaagaataaccaccagattaccgtgttgcatgtctaccaccacgcatctatgttaaacatttggtggttcgtaatgaattgggtgccatgtggccactcctactttggagctaccctgaattcatttatccacgttctgatgtactcatattatggtctgagctccgtcccatcaatgcgaccttatctttggtggaagaagtacataactcagggccagttgctccagttcgtgctaaccatcatccagacatcttgcggggtgatttggccgtgcaccttcccgctcggatggctgtatttccagattggctatatgatttcactcatcgcgctgttcactaatttttacattcagacgtataataagaaaggtgcgtcccgccgcaaagatcatctcaaggaccatcagaacggttccatggccgctgtaaacgggcacaccaactccttctcccctttggagaataacgttaagcctcggaaactccggaaggactag

SEQ ID NO: 115698 - DNA, 267 bp, Artificial Sequence
  Description of Artificial Sequence: Synthetic coding sequence
atggaacactttgacgcctcactgtccacttatttcaaggcactgctgggaccgagaggaatcagcagtagtgtgttaaggatgggacctcctcttcacaccgttgtcgggtggcttcagcagctccaggcagcccatagcgaggaggaagaaaaaatgttccacctgtgtggctttaagcataaagaagtggtgtcccagagctcgcttccagccgtgatcccacagaactccctggcaactatcgcatctcacgcacctgcttag

SEQ ID NO: 115699 - DNA, 870 bp, Artificial Sequence
  Description of Artificial Sequence: Synthetic coding sequence
atggagcattttgatgcctctctcagcacctactttaaagcgctgctaggacccagggataccagggtgaaggggtggtttctgctcgataattatataccaacatttatatgctccgttatataccttctgatcgtgtggctgggaccgaagtacatgagaaataaacagccattttcgtgtaggggcatattagtggtctacaaattttgtgagcttgtgaccggcgtgtgggaggggaaatataattttttttgccaagggactcgcaccgctggggaaagcgatatgaaaatcattagagtactgtggtggtactatttctcgaaattgatagaatttatggacacgttcttcttcattttgcggaaaaataaccatcagatcactgtcttgcacgtataccaccatgcctctatgctgaatatctggtggttcgtcatgaattgggttccttgcggccattcctacttcggagccaccctgaacagcttcatccatgttctcatgtactcatattatggactcagcagcgtaccatcaatgcgtccctatctttggtggaagaaatatatcacccaaggacagctcttacagttcgtgctgactatcatacagacaagctgcggcgttatctggccctgtacctttcctctcgggtggctgtattttcagattggatacatgataagtttgattgcgctctttaccaacttctacatccaaacctacaacaaaaagggcgcgtcacgccgaaaggaccaccttaaggatcatcagaacgggtccatggctgctgtgaatggccacactaactccttttcacctctggagaataacgtgaaacccagaaagctgcgcaaagattag

SEQ ID NO: 115700 - DNA, 981 bp, Artificial Sequence
  Description of Artificial Sequence: Synthetic coding sequence
atggagcactttgacgccagtctttcgacttattttaaggccctgctcggtccgagggacactagagttaagggttggttcctgctggataattacatacccacctttatctgcagcgtgatttatcttctcatagtctggctgggccctaagtatatgagaaataaacagccctttagctgtcgcggaatactggtggtgtacaatctgggacttacacttttgagcctctatatgttctgcgagtccaagcgtgagcagccaaggcggagtgcctgtgcctcgcgtacagatcctagcacacagcaacaacttccagaaaatagactggtgacgggggtctgggagggaaaatataacttcttttgtcagggtacaagaacagcaggtgagagcgatatgaaaattattcgggtcctctggtggtactacttttccaagctgatcgaattcatggacacatttttcttcatcttgcgcaagaacaaccatcagatcacagtgctccatgtgtaccaccatgcttccatgctgaacatctggtggtttgtcatgaactgggtgccatgcggtcattcctattttggcgcaacactaaattccttcatccacgtgctgatgtactcatactacggcttgagtagcgtgcccagtatgcgtccctatctttggtggaagaagtatatcacgcaaggccagctgctgcagtttgtgttaacaataattcagacatcttgtggcgttatttggccctgtacatttcctctgggctggctttactttcagataggctatatgatctcactgatagccctgtttaccaacttttatatacagacttataacaaaaaaggggctagccgcaggaaggatcatctcaaagatcaccagaacggctcaatggctgctgtgaatggccatacaaacagcttctctcccctagagaacaatgtgaagccccggaagcttcgtaaagactag

SEQ ID NO: 115701 - DNA, 900 bp, Artificial Sequence
  Description of Artificial Sequence: Synthetic coding sequence
atggagcacttcgacgcaagcctatctacatatttcaaagcgctgctcggaccaagagacacccgcgttaaggggtggtttctgctcgataactacatcccgactttcatttgttccgtcatatacctcttaattgtctggctgggcccaaagtatatgagaaataagcaacccttctcatgccggggaatcctggtcgtgtataacctcggtctcaccctcctttccctttatatgttttgcgaattggtgacaggtgtatgggaaggtaagtataactttttctgtcagggtactcgaactgccggagagagtgacatgaagatcattcgtgtgttatggtggtattacttctccaaattaatagagttcatggatacatttttcttcatattacggaaaaataatcatcagatcacggtgcttcacgtttatcatcacgcctccatgttgaacatatggtggttcgtgatgaactgggtgccatgcggccacagctatttcggtgcaacacttaacagttttattcatgttctcatgtattcctactatggactcagcagtgtcccctcaatgcgcccgtacctttggtggaagaaatacatcacacaggggcagctcctccagtttgttcttaccattattcagacatcatgtggtgtgatatggccttgtacgttccccttgggctggctgtactttcagatcggatatatgatttctttgattgccctattcacaaatttctatatccaaacatataacaaaaagggggcctccaggaggaaggaccaccttaaagatcaccaaaatggatcaatggcagcggtgaatgggcatacaaacagcttcagtccactggagaacaacgtgaaacctcgaaagctgcggaaagactag

SEQ ID NO: 115702 - DNA, 798 bp, Artificial Sequence
  Description of Artificial Sequence: Synthetic coding sequence
atgaatatgagtgtcctgacccttcaagaatacgaattcgaaaaacagtttaacgaaaatgaggcgatccagtggatgcaggaaaattggaaaaagagcttcctgtttagtgccctctacgccgctttcatattcggcgggcggcacctgatgaacaaaagagccaagtttgagctgaggaagcctctggtcctgtggtctctgacacttgccgttttttccatcttcggtgcactaagaaccggagcctatatggtatatatcctcatgaccaagggccttaaacagtctgtgtgtgatcaagggttttataatgggcccgttagcaaattctgggcatacgcatttgtgctttcgaaggctcctgaattgggagacaccatcttcattatccttaggaaacaaaagcttattttccttcactggtatcatcacatcaccgtactgctctactcctggtacagttacaaagacatggtcgcagggggggggtggttcatgaccatgaactacggcgtccacgcagtcatgtactcatattatgcactgagagcagctggctttcgggtgtctagaaagtttgccatgttcattacactgagccagattacccagatgctgatgggttgtgtagtaaactaccttgtcttctgttggatgcaacatgatcagtgccactctcacttccagaatatcttctggtcatctctgatgtacctgtcctacctggtgttattttgccacttcttttttgaggcatatattggcaagatgagaaagaccacaaaggccgagtag

SEQ ID NO: 115703 - DNA, 798 bp, Artificial Sequence
  Description of Artificial Sequence: Synthetic coding sequence
atgaatatgtccgtgctgacgctacaggagtatgagttcgagaagcagtttaacgagaacgaggccatccagtggatgcaggagaattggaaaaaaagttttctgttcagcgcactgtacgccgctttcatatttgggggtcggcatctgatgaataaaagggctaagttcgagctcagaaaacctctggtcttgtggtctctaaccctagccgtgttttctatcttcggggcccttcgtacaggggcctatatggtctacatacttatgacaaagggtcttaaacagagcgtgtgcgaccagggcttctacaacgggcccgtgagtaaattttgggcttatgcatttgttctgtcaaaggctcctgagttaggtgatacaatcttcattatcttgcgcaaacagaaactcatttttctgcactggtaccatcacattactgttctgctgtatagttggtacagttataaggacatggttgccggcggcggctggttcatgacgatgaactacggcgtccacgcagtcatgtacagttactatgccttgcgcgcagcaggctttagggtctctagaaagtttgccatgttcatcaccttgtcccagattacacaaatgctgatgggatgtgtagtgaactatctggtgttttgctggatgcagcacgaccagtgtcactcccattttcagaatatcttctggagttctctgatgtacctcagttatctggtgctgttctgccatttcttcttcgaggcatatattggtaaaatgaggaagacaaccaaagccgaatag

SEQ ID NO: 115704 - DNA, 327 bp, Artificial Sequence
  Description of Artificial Sequence: Synthetic coding sequence
atgaacatgagtgtactaactctgcaggaatacgagttcgagaagcagtttaatgagaacgaagccatccagtggatgcaggagaactggaaaaagtctttcctgttttctgccttgtacgccgctttcatcttcgggggcaggcacttgatgaataagcgggccaagttcgagttacggaaaccacttgttctttggtctctcaccctggctgtgttcagtattttcggagctcttcggacgggagcgtacatggtgtacattctgatgacaaaaggtcttaagcagtctgtttgcgatcaggggttttacaacggccccgtatag

SEQ ID NO: 115705 - DNA, 414 bp, Artificial Sequence
  Description of Artificial Sequence: Synthetic coding sequence
atgaacatgtccgttttgaccttacaggagtacgagttcgagaagcagttcaacgaaaacgaagcgatccagtggatgcaagagaactggaaaaaatccttcctgttcagtgcattatacgctgcttttatctttggaggtcgtcacctcatgaacaagagggcaaaatttgaactgagaaagcccctagtgctgtggtcgctcacactggccgtgttctctatttttggagccctacgaaccggcgcatatatggtgtatattctgatgaccaaaggtctgaagcagagcgtgtgtgatcagggcttctacaacgggcctgtgagcaagttttgggcttatgctttcgttctgagtaaagcccctgaattaggagacactatattcatcatccttcggaaacagaaactgtag

SEQ ID NO: 115706 - DNA, 846 bp, Artificial Sequence
  Description of Artificial Sequence: Synthetic coding sequence
atggctttctcggacctaacttctcggaccgtgcacctgtacgacaattggatcaaggatgccgatccccgagtggaggattggctactaatgagcagccctctgccacaaactatcctgctcggcttttacgtgtactttgttacaagtctcgggccaaagctgatggagaaccgtaagcctttcgaactgaagaaagctatgattacatacaacttcttcattgttctgttctccgtatatatgtgttatgaatttgtgatgagtggatggggcatcggctactcattcaggtgcgatatcgtggactactctcgcagccccacagccttgcgcatggccagaacatgctggctttactacttttcaaagttcatcgaactgctggatacgatcttctttgtgctccggaaaaaaaacagccaggtgacatttctgcatgtgttccatcacacaattatgccctggacgtggtggttcggggttaagtttgccgcggggggactcggtacctttcacgcgttactgaatacagcagtgcatgtcgtcatgtatagctactacggactgagcgccctaggccccgcgtaccagaagtacctctggtggaaaaagtacttaacatctttgcagctggttcagtttgtgatcgtggctattcacattagccaatttttcttcatggaggactgcaagtatcaattcccagtttttgcttgtattataatgtcttacagctttatgttcctcctgctgttccttcacttctggtatagggcttatacgaaaggtcagcgtcttcctaaaacagtcaaaaatggcacttgtaagaacaaggacaactag

SEQ ID NO: 115707 - DNA, 846 bp, Artificial Sequence
  Description of Artificial Sequence: Synthetic coding sequence
atggccttcagcgatctgactagcagaactgtccacctgtatgacaattggattaaggacgccgatccccgtgttgaggactggctgctgatgagctcccctctgcctcagaccattctcttaggattctacgtgtattttgtcacatctctgggtccaaagcttatggaaaaccgaaagcctttcgagctcaaaaaagctatgattacctacaatttttttattgtcctgttctcagtgtacatgtgctacgagtttgtcatgagcggatggggaatcggatatagtttcaggtgtgatattgtcgactatagccggagtcccacagcactccgcatggctcggacctgttggctttactatttctcaaaattcatcgaactgctcgatactattttctttgtgcttcgcaaaaagaattcacaagtgacattcctccacgtgtttcaccatacaatcatgccttggacgtggtggtttggcgtcaagttcgctgctggtggcctcggaaccttccacgccttgctcaataccgccgtacacgtggtgatgtacagctattacggacttagcgcactgggacctgcataccagaaatatctgtggtggaaaaagtatttgacaagcctccagttggtacagttcgtcattgtggccatccatatctcccagttctttttcatggaagattgtaagtaccagtttccagtattcgcctgcatcatcatgtcctattcgttcatgtttcttttactgttcctgcatttttggtatcgggcgtataccaaaggacagcgcctgcctaagacagtgaaaaatggcacatgtaaaaacaaggacaactag

SEQ ID NO: 115708 - DNA, 498 bp, Artificial Sequence
  Description of Artificial Sequence: Synthetic coding sequence
atggcgttttcagatctgacgtcacggactgtgcacctgtacgataactggattaaggatgcagacccccgcgtggaagattggcttttgatgagctcacctttgccacagacgattcttctgggattctatgtgtatttcgtcacatccctcggaccaaaacttatggagaatcgaaaaccgtttgaactcaagaaagccatgattacctacaacttcttcatcgtgctcttcagcgtgtatatgtgctacgagttcgtaatgagcggctgggggattgggtacagcttccgctgcgatatagtggattactccaggtcacccaccgcgcttcgtatggcacggacctgctggctctactatttttccaaattcatcgagctgctcgacactatcttcttcgtcctacgcaaaaaaaattcacaggtgacgttcttgcacgtgttccaccacacgattatgccctggacttggtggtttggggtgaaattcgcttag

SEQ ID NO: 115709 - DNA, 846 bp, Artificial Sequence
  Description of Artificial Sequence: Synthetic coding sequence
atggcgttttccgacctgacaagccgcactgttcacctgtacgataactggatcaaggatgccgatccgcgggtagaagactggctcctgatgtcttccccactgccacagactattctcctaggcttctacgtgtactttgtgaccagcctcggccccaagttgatggaaaaccgtaaaccgttcgagctgaagaaggccatgatcacatacaatttcttcattgtccttttctcagtctatatgtgttatgaatttgttatgtcagggtggggaatcgggtactcctttcgttgcgacatcgttgactactcaagaagccccactgctctgaggatggccagaacatgctggctgtactacttttctaaatttatcgagctgttggacacaattttcttcgttttgcggaagaaaaactctcaggttaccttcctgcacgtctttcatcacacaatcatgccgtggacatggtggtttggtgtgaagttcgctgccggtggacttggtactttccacgccctcctgaacacggcagtgcatgtggtcatgtattcttactacggcctttccgccctcgggccagcctaccaaaagtacttgtggtggaagaagtacctcacaagcttacagctagtgcaatttgtgatcgtggcaattcatatctcgcagttctttttcatggaggactgtaaatatcagtttcccgtgtttgcctgcatcattatgtcatactcttttatgtttctcctgctgttcctacacttctggtaccgggcctatacaaaagggcagcgtctgccaaagacggtgaaaaacggtacctgcaaaaacaaggataactag

SEQ ID NO: 115710 - DNA, 498 bp, Artificial Sequence
  Description of Artificial Sequence: Synthetic coding sequence
atggcgttcagcgacttgacctcaaggacagtgcatctgtacgacaattggataaaggatgcggatcctcgagtggaggactggctgctgatgtcttcccccctgccccagacaatactcctgggtttctatgtctacttcgtcaccagtctaggccccaagttaatggagaatcgcaaaccctttgagctcaagaaggccatgattacgtacaatttcttcattgtgctcttctcagtctatatgtgctacgagtttgtgatgtcaggctggggcatcggatattcattcagatgtgacattgttgattacagtcggtctcccacagctctccgcatggctaggacatgctggctatattacttttccaagttcatagagctgctcgacaccattttttttgttcttaggaagaagaactcgcaagtcacattcctgcatgttttccaccacaccattatgccctggacttggtggttcggggtgaaattcgcttag

SEQ ID NO: 115711 - DNA, 921 bp, Artificial Sequence
  Description of Artificial Sequence: Synthetic coding sequence
atggccgcggctgctgccgccgcggccgctgcaggagccgcaggtggtagagggtcaggaccaggccggcggcgacatcttgtcccaggtgctggaggagaggccggcgagggtgcccctggtggggccggagattatggcaacggcttagagtccgaggagttggaacctgaagagctgctgctggaacccgagccagagcccgaaccagaggaggaaccgccacgtccacgggcacctcccggagcacctggacccggacctggtagcggcgcgcccggatcccaggaagaggaagaagaacccggactcgttgaaggcgacccgggagacggcgcgatcgaagatcccgagctcgaggcaatcaaagctcgagttagagaaatggaggaagaggctgagaagttaaaagagctccaaaatgaggtagagaagcaaatgaatatgagtcctccccctgggaatgctggtcccgtgatcatgagcattgaggaaaagatggaggccgacgcgcggagcatttacgtgggcaatgtcgactatggcgcaacagcagaggagttggaggctcattttcacgggtgtggatcagtcaatagagtcaccatactctgtgacaaattttccggccatccaaaagggttcgcttatattgaattctcagataaagagagcgtgaggaccagcctggcgttagacgagtccctgttccgaggccggcagatcaaagtcatcccaaagagaaccaaccggccaggaatttccacaacagatagaggcttcccacgagcacggtaccgcgcaaggacgacaaactataacagcagtcggagtcgtttctacagcggatttaatagcagaccacgaggacgggtgtacaggggtcgagcgagagccacatcatggtacagtccttactag

SEQ ID NO: 115712 - DNA, 1407 bp, Artificial Sequence
  Description of Artificial Sequence: Synthetic coding sequence
atggcaattgctacgagtgtctatgtagtgccaccccccgcgaggccctgccccactagcggacctcctgctggcccctgccctcccagccctgatcttatatacaagataccacgggcctctggcacacaactcgccgctcctcgcgatgcactagaggtgtacgacgtgccccccaccgccctacgggttccatcttcaggaccgtatgactgccccgcttcatttagtcaccctctgacaagagtggcgccacaaccccccggcgaagacgatgctccttacgacgtccctctcacccctaagcctcccgccgagctcgagcctgacctggagtgggaagggggccgtgaaccgggaccacctatttatgcagccccatccaacctgaagagggcgagcgcactcctcaacctgtacgaagctccagaagaactgctcgcagacggagaaggaggaggcaccgacgaaggcatttacgatgtgcccctgttgggtccagaggcaccaccatccccggaacctccgggcgcactcgcatctcacgaccaggacacgctggcacaactgctagctaggtcacctccaccaccacatagacccaggttgcccagtgcagagagcctgagtcgcaggcccctgcccgcgctgccggtgcctgaggcccccagcccaagtcccgtgcctagcccagcccctggcaggaaaggaagcatccaagaccggccactaccgccccctcctcctcggctccccggttacggcgggcctaaagttgagggcgaccccgagggaagagaaatggaggatgaccctgctgggcatcacaatgaatatgaaggcatcccaatggcagaggagtacgactacgtacaccttaagggcatggacaaagcacaagggagtcgtcctcctgaccaggcctgcacaggggacccagaactgccagaaagagggatgccagcaccgcaggaagcactgagccctggtgagccattggtcgtaagcacaggggatctgcagctgctttatttctatgccggacagtgccagtcccattactcagcccttcaagctgctgtggccgccctcatgagctctacccaggccaaccagcctccacggctgttcgtgcctcattctaagagggtggttgtagccgcccacaggcttgtattcgtaggggatacactagggcgcttggctgcctccgcaccactacgtgctcaggtcagagccgcaggcaccgccctaggtcaagccttacgggcaacagtgctagcggtcaaaggagccgcgctgggatacccttcctccccggcgattcaggagatggtccagtgtgtgaccgaattggcgggccaggcgctacaatttactactttgctgacctccctagccccctag

SEQ ID NO: 115713 - DNA, 1179 bp, Artificial Sequence
  Description of Artificial Sequence: Synthetic coding sequence
atggctatcgctacctctgtttatgttgtcccaccacccgcccgaccatgtcccacttcaggcccgcccgctggcccttgcccgccctcacccgatctaatttataagatcccaagggcatccggtacacagcttgctgcgcctcgcgacgcactggaagtttatgacgtgccgcccactgccttacgggtaccctccagtgggccctacgattgtcctgcttcgttctctcatcctctgacaagagtcgccccacagcctccaggtgaggacgatgccccacccagccctgagcctcctggcgcactcgcttcccatgatcaggacacactggctcagctgctggccagatcgccaccacctccccacaggccccggctgccctcagcggaatccctgagtaggaggcccctaccggctctgccagtgcccgaggcacctagccccagcccagtaccaagcccggctcctggccgaaaggggtccatccaagacagacccctcccacctccaccgccaagacttcccgggtacgggggtccgaaggttgagggggatcccgagggaagggaaatggaagatgacccagccggtcaccacaacgaatatgaaggaatcccaatggccgaggagtatgactacgtacacctgaagggaatggacaaggcgcagggatctcggccccctgatcaagcctgcacaggcgatcctgagcttcctgaacgtggcatgcctgctccacaggaggccctgagtcctggagaacctctggtggtatcaaccggtgacctgcagctactgtacttttacgcaggccagtgtcaaagtcactactccgcactgcaagcggccgtggcggccctcatgtcatcaacacaggccaatcagcctcctcgcctgttcgtccctcacagcaagcgcgtcgttgtggcggcccacagactggtgttcgtaggtgataccctgggaagactcgcagcttcagccccactgcgagctcaggtgagggcagccgggacggccctaggccaggccctgcgcgcgaccgtgctggctgtaaagggtgccgccttggggtacccctcaagcccagccatccaggagatggtacagtgcgtgacagaactagcggggcaggccctgcagtttacaaccctcctcacctccctggcaccttag

SEQ ID NO: 115714 - DNA, 1326 bp, Artificial Sequence
  Description of Artificial Sequence: Synthetic coding sequence
atgagcgaacgggaggtcagtaccgctccagctggcactgatatgcccgctgccaagaagcagaagctgagtagtgacgaaaacagcaacccggacctaagcggcgacgagaatgatgacgccgtatccattgaatccgggaccaatactgaaaggcctgatactccaacgaacacccctaacgcaccaggcaggaagagctgggggaaagggaaatggaaatccaaaaaatgtaagtatagctttaagtgcgtgaactcactaaaggaagaccataatcagccactgttcggcgtccaatttaattggcattcaaaggaaggggatcccttagtgtttgcaaccgtgggcagcaatcgggtaacattgtacgaatgtcacagtcagggcgaaatccggttgctgcagagctacgtagatgctgacgccgatgagaatttttacacctgtgcttggacatacgattcaaacacttcacacccacttctcgctgttgcaggctccagggggattatccggataatcaacccaattaccatgcagtgcatcaagcactacgtcggccatggcaacgccattaatgaattaaagttccacccacgagatccaaacctgctgctgtctgtttcaaaggaccatgccctgagactgtggaacatacaaacggatacactcgtggccattttcgggggcgtggaaggacaccgcgacgaagtgctgagcgcagattacgatctacttggcgagaagatcatgtcctgtggaatggaccattcgctgaaactttggcggattaattccaaacgcatgatgaacgccatcaaagagtcctatgactacaatcccaacaagacgaaccggccctttatctcgcagaagatccattttcccgacttctccacgcgcgacatccacagaaattacgtggattgcgtgaggtggctcggggaccttatcctgtctaaaagttgcgaaaatgctatcgtctgctggaagcccgggaaaatggaagacgacattgataagattaagccttctgagtcaaacgtcactatactcggacgctttgactactcacagtgcgacatatggtacatgcgcttcagcatggacttctggcagaagatgttagccctcggtaaccaagtgggaaagctgtacgtgtgggaccttgaagttgaagatcctcacaaagctaagtgcactacgctgacacatcataagtgcggagctgcgattcgacaaacaagcttttcgagagactcttctattctgatcgcagtatgtgatgacgcatcaatttggagatgggacagactgaggtag

SEQ ID NO: 115715 - DNA, 1203 bp, Artificial Sequence
  Description of Artificial Sequence: Synthetic coding sequence
atgagtgaacgggaagtcagcacagcccccgctggcaccgatatgccagcagctaagaaacaaaaactctcctcagatgaaaacagtaatccagatttatccggagacgaaaacgatgacgctgtgagcattgagagcggaacaaacacagagcgaccagatacccccaccaacacccccaatgcccctggaaggaaatcttggggaaaaggcaaatggaagtccaagaagtgcaagtacagctttaagtgtgtgaacagtttaaaggaggaccacaatcaacccctctttggcgtgcagtttaattggcacagcaaggagggagaccccttggtttttgccaccgtaggaagcaacagggtgacactttacgagtgtcatagccaaggtgagattcgactccttcaatcatacgtagacgcagacgctgatgagaacttctatacatgcgcgtggacatatgacagcaatactagccatcccctgctcgccgtggccgggagccgaggcattattcggattattaacccaatcacaatgcagtgcatcaagcactacgttggccatggtaatgcgatcaacgagctcaaattccatccacgagatccgaacttgctcctgtctgtatctaaggaccacgctctcaggctgtggaacatccagacagacacattggtggcaatcttcgggggagtcgaggggcacagagacgaggtcctgtcagccgattacgacttattgggcgagaaaatcatgagttgcggcatggatcacagcttgaaactttggcgaatcaatagcaagcgaatgatgaacgcaattaaagagagctacgactacaatccaaacaagaccaataggcccttcattagtcagaaaattcattttcccgacttcagtactcgagacatacatcgcaactatgttgactgcgtcagatggctgggggacctgattctcagcaagtcgtgtgaaaatgctatcgtgtgttggaagcccggaaaaatggaggatgatatcgacaaaatcaagcctagcgagagcaatgtcactatattaggcaggtttgactattcgcagtgcgacatttggtatatgaggttttctatggacttctggcaaaaaatgttggcacttggtaatcaggttgggaaactgtacgtgtgggacctcgaggtcgaagacccgcacaaggccaagtag

SEQ ID NO: 115716 - DNA, 1401 bp, Artificial Sequence
  Description of Artificial Sequence: Synthetic coding sequence
atgagtgagcgggaggtgtccacagcccccgctggtactgatatgccagcagctaagaagcaaaagctcagttccgacgagaacagtaatccggacctgtcaggggatgagaacgatgacgctgtctcaattgagtctggcactaacacggagagaccagacacacctacgaacacccctaatgcgcccggacggaaatcgtgggggaaaggcaagtggaaatccaagaaatgtaagtatagttttaagtgcgtcaactccctcaaggaggatcacaatcaaccgctgtttggagtacaattcaactggcactctaaggagggagatccattggtatttgccactgttgggtcgaatagggtgacactctatgaatgccactcacagggcgagatcaggctgctccagagctatgtggatgccgacgccgacgagaacttctacacgtgcgcatggacctacgacagcaatacatcccacccactgctggcggtcgccggctcccgcggaattatcagaataatcaaccccattactatgcagtgtataaaacactacgtgggccacgggaatgctatcaacgagctgaaatttcaccctagggaccccaatttactgctttctgtcagtaaggatcacgcgctcaggctgtggaacatacagacagacacgttagtcgcgatttttggcggcgtcgagggtcaccgagacgaagtgctgagcgccgactacgacctgcttggggaaaaaattatgtcatgcgggatggaccactccttaaaactgtggcgcattaattccaagcggatgatgaacgccattaaagagtcgtacgattacaatcccaacaagactaaccgaccttttatcagtcaaaagatacatttccccgatttcagcactagggacattcatcggaattatgtagactgcgtgagatggctcggagatctcatactgagcaaaagtggtcgcgccatcctgcactcccaccaacagtgtatgagagatcctgtgtctccaaacctgaggcaacatctgtcgtgcgagaacgccatcgtctgctggaagccaggcaagatggaggacgatatagataagatcaaacccagcgagtccaatgtgacaatcctaggaaggtttgactactcgcagtgcgacatctggtatatgcggttcagtatggatttctggcagaagatgcttgcgctaggaaaccaagttggaaaactctatgtgtgggacctggaagttgaagacccacataaggcaaaatgcacaacactgactcatcacaagtgcggggctgccataagacagacatcgttctcccgcgattctagtatactgatcgctgtgtgcgacgatgccagcatctggagatgggaccggctacgctag

SEQ ID NO: 115717 - DNA, 471 bp, Artificial Sequence
  Description of Artificial Sequence: Synthetic coding sequence
atgtcagagagggaagttagtacggcccctgccggcaccgacatgcctgccgccaagaagcaaaaacttagttccgacgaaaatagcaaccccgatctctccggcgatgagaacgacgacgctgtatcgatcgagtcagggaccaataccgaaagacctgatacgcctaccaatactccgaacgcacccggcaggaaatcatggggaaaaggcaaatggaagagcaagaaatgtaagtatagcttcaagtgcgtgaattccctgaaagaagatcataatcaacccctcttcggggttcagttcaattggcatagtaaagagggggatccactggtttttgccaccgtgggctccaatagggtgactctctacgaatgccacagccagggcgagataagacttctacagagctatgtagacgctgacgctgacgaaaatttctatacatgtgcctggaagtgctatcagtag

SEQ ID NO: 115718 - DNA, 660 bp, Artificial Sequence
  Description of Artificial Sequence: Synthetic coding sequence
atggacaactatgctgatctatctgacacagagttgacaaccttgctgcggcgctataacattcctcacggaccagtggtagacttgaactctactaggggagacgccgatatgtacgacttgcctaagaaggaagacgcgctgctctaccagtccaagggttacaacgacgactattatgaagagtcatattttactacccggacttatggcgaacccgaaagcgcaggtcccagtagagccgttcgacagagcgtgacctcgtttccggacgctgacgcttttcaccatcaggtccatgacgatgacctgctgtcatcttcagaggaggaatgtaaggacagggagagacccatgtatggcagggactcagcttatcaaagtatcacccactatcgtccagttagtgcatctcgcagcagcctggacctgagttactaccccacaagttccagcacatcgtttatgagtagtagcagcagtagctcaagctggctgacgaggcgagctattaggcccgaaaatagagcgcctggggctggcttggggcaagatcgccaagtccctctctggggtcaactgctgctcttcctggtttttgtgattgtcctgttcttcatctaccactttatgcaggccgaagaaggcaaccctttttag

SEQ ID NO: 115719 - DNA, 765 bp, Artificial Sequence
  Description of Artificial Sequence: Synthetic coding sequence
atggataattatgccgaccttagcgatactgaactgacgacgctgcttcgccgctataacattccacatgggccagtggtggggtctacccgaaggctttatgagaaaaagattttcgagtatgagacacaacgtcgacgtctctctccaccgtcatcctccgctgcctccagctactccttcagtgatctgaactctacccgaggcgatgccgatatgtatgacttgcctaaaaaagaggacgcacttttgtaccagagcaagggttacaacgatgattattatgaagaatcttatttcactacacgtacctatggggagcccgaatcggcggggccaagcagggccgtgcggcaatctgtgaccagctttcctgatgccgatgctttccaccatcaggtgcatgacgacgatcttctgtcttcaagtgaggaggagtgcaaagatagggagaggcccatgtacggacgggacagtgcatatcagagcattacgcactaccgacctgtatctgcttctaggtcctcgctcgacctgtcctactacccgacaagttcctccactagctttatgtcaagttcttcatcctcctccagctggctgactaggcgggctattagacctgagaatcgcgcccctggggccggtttgggccaggaccgacaggttccactttggggccagttgcttctttttctggtgttcgttatagtgctgttctttatctaccactttatgcaagccgaggaaggaaacccattctag

SEQ ID NO: 115720 - DNA, 441 bp, Artificial Sequence
  Description of Artificial Sequence: Synthetic coding sequence
atgactacaaacgctggccctctacacccatattggcctcagcatctgcggctggacaatttcgtgcccaacgacaggcccacatggcatattctggcaggactgttttctgttaccggggtgctggtcgttacgacctggctgctcagtggccgcgctgccgttgtcccgctgggcacctggcggaggctctccctttgctggttcgccgtgtgcggctttatccacctcgtgatcgagggatggttcgtgctgtactacgaggacctgttgggcgatcaggcttttctgtcacagctttggaaggaatacgccaaaggtgactctcggtacatcctgggcgataatttcaccgtgtgtatggaaacaatcactgcatgtctttggggtcccctgtcattatgggtcgttattgccttcctgcgacagcatccgctgtag

SEQ ID NO: 115721 - DNA, 483 bp, Artificial Sequence
  Description of Artificial Sequence: Synthetic coding sequence
atgacaactaatgccggcccacttcatccatattggcctcaacacctccgcttggataacttcgtgcccaacgatcgccccacttggcatatcctggcaggtctattttccgtcactggcgtgctggttgtgacaacatggttgttgagcggcagagcggctgtcgttcccctggggacatggagaaggctgtccttatgttggttcgccgtctgtggcttcatccatctcgtgatcgagggatggttcgtgctttactacgaggatctgttaggcgaccaggccttcctctctcaactgtggaaagagtacgccaagggtgactctaggtacattttgggcgacaactttactgtctgcatggaaaccatcactgcatgcctttggggccctctgtcactatgggtggttatcgcttttttgcggcagcatccactccggttcattctgcagttggtagtctctgtcggacagatatactag

SEQ ID NO: 115722 - DNA, 693 bp, Artificial Sequence
  Description of Artificial Sequence: Synthetic coding sequence
atgactaccaacgcaggcccactgcatccctattggccacagcatctgcgactggacaacttcgtgcccaacgacaggcccacttggcacattctggccggccttttctccgttaccggcgttctggtggttaccacctggctgctttccggtcgggccgctgttgtccccttaggaacctggcggaggctgtcattgtgttggtttgccgtctgcgggttcatacacttggttattgaaggctggtttgtgctttactacgaggatctccttggggatcaagcgtttctgagccagctgtggaaagagtatgctaagggggactcaagatacatcctgggagacaattttaccgtgtgtatggagacaataacagcctgtctgtggggccctctttcactctgggtagtgatcgccttcctgcgtcagcacccccttaggtttatcctccagctggtcgtctctgttgggcagatctacggggacgttctctattttctgaccgagcacagggacggctttcagcacggtgagctcggacatccgctatatttttggttctatttcgtctttatgaacgccctgtggctcgtgctgcccggcgttctcgttctggatgctgtaaaacatctaactcacgctcagtccactctcgacgcgaaggcaactaaagccaagagtaaaaagaactag

SEQ ID NO: 115723 - DNA, 873 bp, Artificial Sequence
  Description of Artificial Sequence: Synthetic coding sequence
atgtgtctcgccggttgcactcccagaaaagcggccgcgccaggaaggggggccctgcccagggctcgactcccccgaactgcaccggcagctgcgactatgtttcagcctgcagccaagcgcggctttaccattgagtcacttgtcgccaaagatggagggactggcggcggcaccggtggtggaggcgccgggtcccacctgctggctgcagcagcctccgaagagcctttacgcccaacggcgttaaactacccacacccgtctgctgcggaggcagcttttgtcagtggcttccccgctgcagcagccgctggagccgggagatcactttatggcgggcccgaactggtctttccggaggccatgaatcatccggcattaaccgtgcatcccgcacaccaattaggcgcctctcctctccagcccccccactccttcttcggcgcccagcatagggatccactgcacttctacccctgggtgttaaggaataggttcttcggtcaccggttccaggcaagcgatgtgccccaggacggtctgctgctgcacggaccctttgctcggaaacccaagcgaatcagaacagccttttccccaagccagttactccggctcgaacgggcgttcgagaaaaaccactatgtggtcggcgcagagagaaagcagctcgccgggtccctgtcgctaagcgagacgcaggttaaagtgtggttccagaatcgtcgtactaagtataagcggcagaaactcgaagaggaaggtcccgaatctgagcagaagaaaaagggcagccaccacataaatagatggcgcatcgcaaccaaacaggcaaatggagaggacatcgacgtgacctcaaacgattag

SEQ ID NO: 115724 - DNA, 759 bp, Artificial Sequence
  Description of Artificial Sequence: Synthetic coding sequence
atgttccagccggccccaaaacgatgtttcaccattgagtctttggtcgctaaggatagtcccctcccagcctccagatccgaggatccaatccgccccgccgctttatcctacgccaattcatcccccatcaacccgtttcttaacggtttccatagcgcagccgccgctgcagctggcaggggtgtttactctaatccggacctggtgtttgcagaggccgtatcccatccccctaatccagctgtaccagtgcatccggtgcccccaccccacgccctggctgcccaccccttaccctcctcccactccccacacccattattcgcaagtcagcaacgcgacccatctacattctatccttggctaattcaccgctacagatacctggggcatcgtttccaaggaaacgatacaagtcctgaaagcttcttgcttcataacgcgttggcccgaaaacctaaacgtatacgcacagccttctctcccagccagctcctgcggctcgaacacgccttcgaaaaaaatcactatgtggtgggagccgaaagaaagcaactcgctcacagcctttctctgaccgagacccaggtcaaagtctggttccagaaccgaaggacaaagtttaagaggcagaaattggaggaggagggctcagatagccagcagaagaagaagggcacgcatcatattaatagatggaggatcgcaaccaaacaggctagcccggaggagatagatgtgacttctgatgactag

SEQ ID NO: 115725 - DNA, 510 bp, Artificial Sequence
  Description of Artificial Sequence: Synthetic coding sequence
atgttccagcccgctccaaaacgttgcttcaccattgagtctctggttgcaaaagacagtcccctgcctgcttccaggtcggaggatcctatccggccagcagctctgtcgtacgccaactcatcacctatcaatcccttcctgaacggttttcactctgccgctgctgccgccgcggggcggggagtttattctaaccccgatcttgtgtttgctgaggccgttagtcacccccccaatccggccgttccagtgcatccagttcctcctccacacgccttggccgctcatcccctaccgtcaagccactctccccaccctctgtttgcttcccagcagcgagaccccagcacattttacccctggctgatccatcggtataggtacctcgggcacaggtttcaagggaaatcaatggtaagcgagcccaagaataaagtgcagaaggctgaggctggcggcaggagacttaggttcgctaccaaggagaagcgcgatgccccgtactag

SEQ ID NO: 115726 - DNA, 957 bp, Artificial Sequence
  Description of Artificial Sequence: Synthetic coding sequence
atggcaatcaagtcaatcgcatctaggctgagaggttccagacggttcctttctggatttgtagctggcgccgtcgtgggagcagcaggggccggccttgccgctctgcaattcttcagaagccagggcgctgaaggagccctaaccgggaagcaacccgacggtgatgccgatcgaaaacattgcaaatttaagcccgacccgaacataccacccacctttagtgcttttaacgaggactacgtaggctccggatggagtcggggacacatggcgcccgccggcaacaataagttttcatccaaggccatggctgagacattctacttgagtaatattgttccacaggacttcgacaataatagtggttattggaatcgaatcgagatgtactgtcgggagctgaccgagagatttgaagatgtctgggtggtgtccggaccactcaccctcccccagacgagaggagacggcaagaagatagtgtcgtaccaagttattggagaagataatgttgctgtccccagtcacctgtacaaggtgatcctggcaagacgatcctcagtctcaacagaaccccttgctctgggggcttttgtggtccccaatgaggctattggtttccagccccagctaactgagtttcaggtgtcactgcaggatctcgagaaactgtcaggccttgtgttcttcccacatttagatcgaacaagcgacatccgtaatatttgctccgtcgacacttgtaaactcctggactttcaagaattcaccctctatctttccacccggaagattgaaggggccagatctgtccttcgactagagaagatcatggagaacctgaaaaatgccgagatcgagcctgatgactatttcatgagtcgatacgagaagaagcttgaggaactcaaggccaaagagcagtccggcacgcagattcggaagcccagctag

SEQ ID NO: 115727 - DNA, 1107 bp, Artificial Sequence
  Description of Artificial Sequence: Synthetic coding sequence
atggccattaaaagcattgcctcaaggttaaggggcagccgccgatttttatcaggcttcgtcgcaggcgcggtagtgggcgctgccggggccggacttgctgctttgcaattcttccgctcccaaggggccgagggcgctctgactgggaaacaaccagatggttcggcagagaaagcagtgttagagcagttcgggttcccgttgacaggcactgaagcccgctgttacactaaccatgcactctcctatgatcaggctaagcgggtaccgcgatgggtgcttgagcacatttccaaatcaaagatcatgggagatgctgatagaaaacactgcaagttcaagcctgacccaaacatcccccccacattttccgcgttcaacgaggattacgtgggctccggctggtcccgtggacacatggcgcctgccggcaacaacaaattttcaagcaaagctatggcagaaaccttctacctgagtaatatcgtgccccaagatttcgataataactcgggatattggaataggatcgaaatgtactgcagggagctaacagaacggtttgaggatgtgtgggtagttagcggacctttaaccctgcctcaaaccagaggagacgggaagaagatagtatcttaccaagtgatcggcgaggataatgtggccgtcccctctcatctgtataaggttatcctagctagaaggtcttccgtgagcactgagcccctcgctctcggggctttcgtcgttcccaacgaggccatcggcttccaacctcagttgaccgaatttcaagtgtcgttacaggacctagaaaagttaagcggtctggtgttctttcctcacctcgaccggaccagcgatatccgcaacatttgcagcgtggacacctgcaaactactggacttccaggagtttaccctttacctcagcaccagaaaaatcgagggggctcggagcgtcctccggttagagaaaatcatggagaatctgaagaacgcagagattgagcccgacgattattttatgtcccggtatgagaagaagcttgaagaactcaaagccaaggaacaatccggtacccagatacgtaaacctagctag

SEQ ID NO: 115728 - DNA, 450 bp, Artificial Sequence
  Description of Artificial Sequence: Synthetic coding sequence
atggcacctgcgggcaataacaaattctccagcaaggccatggccgagacattttacctatcaaacatagtgccacaggattttgacaacaacagcggctattggaatagaatcgaaatgtattgccgggagctcaccgagagatttgaagatgtgtgggttgttagtggacctctgacgctgccacagacccggggcgacggaaaaaagattgtgagttaccaggtgatcggggaggataatgttgcagtcccctctcatctgtacaaagaccacgctgggtgctgcgttgaaagccctttgggaacacgaacaagcgaagaagctactgccagaattcaggaaagggatgacggcggctctgaccaaaggtccggactagtggagctaggaatctatttcgagggaagagcaaatcggattagcggcagaataggctgtcgagtgtag

SEQ ID NO: 115729 - DNA, 819 bp, Artificial Sequence
  Description of Artificial Sequence: Synthetic coding sequence
atgggttactttttaaaattgtatgcttatgtcaattcacattccctgtttgtgtgggtgtgcgacagatcttacaagcggagctttcgacccatgatactgaataaaataaaggaactgagtaggaatcagttttctaccatgagtcatctcaggaaagacagccagccttcatctcccggagacgatgccatggatcgctcaggactccctgatttgcagggacgctttgagctcagtggcaagaaccgacagtatccactcgacgcgctggagccccagcctagcattggggatatcaaagacattaagaaagccgccaaatccatgctggatcccgcacataagagtcactttcaccccgtgacaccctccctggtgtttctttgcttcatctttgacgggctccaccaggcacttctctccgtgggggtcagtaagaggtccaacaccgtggtcggcaatgaaaatgaggaacgcggaacaccatatgcctcgcgatttaaggatatgccgaacttcatagcgcttgaaaagagcagtgtcctgcgccactgctgtgatttactgatcgggattgcggccggctctagtgataaaatctgcacgtcgagtttgcaggtgcagagaagatttaaggcaatgatggcctccatcggccggttaagccatggcgaatccgccgacttgctgattagctgtaatgccgaatcagccattggttggatttcgtctcggccctgggttggggaattgatgttcacgctgttgttcggcgactttgaatcacccctgcataaacttagaaaatccagctag

SEQ ID NO: 115730 - DNA, 894 bp, Artificial Sequence
  Description of Artificial Sequence: Synthetic coding sequence
atgcgcgccctgagagccgggctgacattggccagcggagcaggcttgggcgcagtggtcgagggctggcgaagacgtcgagaggacgcacgagcagcccctggattgttgggccggctgcctgtgttacccgtggcggccgctgcagagctccccccggtaccaggtggacctcgtggccccggcgagctggcaaagtacggcctgccaggcctggcacaacttaagtctagggagtcctatgttctctgctacgaccctcgcactagaggcgccctctgggtggttgaacagctgcgacccgaaaggctccgcggagatggtgaccgcagggagtgcgacttcagagaggatgactccgtgcacgcctaccatagggccaccaatgcggattatagaggatccggattcgataggggacatctggccgccgcggctaaccacagatggtctcagaaagctatggacgacaccttctacctttccaatgtagccccccaagtcccccacctgaatcagaacgcttggaacaacctcgaaaagtattcacggagcctgacacgttcttaccagaacgtgtatgtctgtacaggcccgctcttcctgcctcggaccgaagcagatgggaagtcatatgtcaagtatcaggtgatcggcaaaaaccatgtggcggtgcccacccattttttcaaagtccttatccttgaagccgcgggtggacagatagagctaagaacttatgtcatgccgaatgcccccgtggatgaggccatccccctggaaagatttctggtccctattgagagcattgagcgagcttcagggcttttgttcgtgcccaatatccttgcacgcgccggcagtctgaaggccattaccgcaggatcgaaatag

SEQ ID NO: 115731 - DNA, 2847 bp, Artificial Sequence
  Description of Artificial Sequence: Synthetic coding sequence
atggtgtttctgcctctaaaatggagcttggcgactatgagctttctcctgtctagtctcctggcgcttctaacagttagcacgccaagttggtgccagtcgacagaggcgagtcccaaaagatccgatgggactccttttccatggaacaagattaggctcccggaatacgtgatccccgttcactacgaccttttgattcacgccaatctgactaccctgaccttttggggaaccacaaaagtcgagatcacagctagtcaaccgacaagcaccattatcctccatagccaccacctccagataagccgagccaccctgcggaagggcgccggcgagagattgtccgaggagcctctccaggtgctggaacaccctagacaagagcagatcgccctgttggcaccagagcctctgcttgtcgggctgccctacacagtcgttatccactatgcaggcaacttaagcgagacctttcacggattttacaaatccacgtatcggacaaaggaaggagaactgagaatcctagcctctacacaatttgaaccaactgctgctcgtatggcttttccatgtttcgatgagcccgctttcaaggcctcgtttagcatcaagatcagacgcgaaccgagacacctggcaattagtaatatgcctcttgtaaagtccgtaaccgtcgcggaaggcctgatcgaggaccacttcgatgtgacagttaaaatgtccacatacctggttgcattcataatctcagatttcgagtccgtgtcaaaaatcactaagtctggggtgaaagtcagcgtctacgccgtgccagacaagattaaccaagctgattacgcactggacgccgccgtcactcttttggagttttacgaggactatttctctatcccatacccgctgcctaaacaggatctggccgctatccctgatttccaaagcggagcaatggagaactggggactcacaacatacagagaatccgcactgctgttcgatgccgagaagtcttctgcctccagtaagttgggtattacgatgacagtcgcgcatgagctggcgcatcagtggttcggaaacctggtgactatggaatggtggaacgatctgtggctgaatgagggcttcgccaaatttatggagtttgtgtctgtgagcgtcacccacccggaactcaaggtgggtgattactttttcgggaaatgttttgatgcaatggaggtggacgcactgaactcttcccatcccgtgtcaaccccggtcgagaacccagctcagatccgagagatgttcgatgatgtatcttacgataaaggtgcttgtatcctcaacatgcttagagagtacttgagcgctgacgcatttaagagtggaattgttcagtatctgcaaaaacacagctataagaacacaaagaatgaagatttgtgggactccatggcctctatctgtccgacggacggtgtgaagggaatggacggattttgttcccggtcccagcactcaagctccagttctcactggcaccaagagggtgtggatgtaaaaacaatgatgaatacctggacactgcagaagggttttcctctgatcacaataacagtacgggggaggaatgtccacatgaaacaggagcattacatgaaagggtctgacggcgcccccgatacgggttatctttggcacgttcctctcaccttcatcacgagcaagagtgacatggtgcatcggtttctgctcaagaccaaaactgacgtccttatactgcctgaagaggtggagtggatcaagtttaacgtaggaatgaacggatactacattgttcattatgaggatgacggatgggactccctaacaggtctcttgaaagggacgcataccgccgtctcatccaatgatcgagcctccctcataaacaacgcatttcagctcgtgtctatcggaaagctgtccattgaaaaggcactggatctctctctgtacctgaagcatgagactgagataatgccagtgtttcagggcctgaacgagcttatcccaatgtataagctgatggagaagcgagacatgaacgaagttgagacccagtttaaagctttcttgatcaggctccttagggacttgattgacaaacagacgtggactgacgagggttccgtcagtgaacgcatgctgaggagccaactgctcttactggcttgcgtgcacaactatcaaccctgcgtccagcgcgcagagggctattttcggaaatggaaggagtccaatggaaacctatctctcccagtggacgtcaccctcgctgtgtttgctgttggggcccaatcaactgaaggctgggatttcctttactcaaagtaccagttttccctgagttcaaccgagaagtcccagattgagtttgcgctgtgccgaacccaaaataaagaaaaacttcaatggctacttgatgagtcgtttaagggggacaaaatcaagacccaagaatttccacagatattaacactgatagggaggaaccccgttggatacccgcttgcatggcaattcctcagaaagaattggaataaactcgtccagaagtttgaactcggcagttcatcgattgcccatatggtgatggggaccaccaatcagttctccacccggacccgcctggaggaggtgaaaggctttttctcttctttaaaggaaaacggctcacagctacggtgcgttcaacagacaatcgagacgatcgaagagaatataggatggatggacaaaaatttcgacaaaatccgtgtgtggttgcagagtgagaagttggaacacgacccagaggcggacgccaccggttag

SEQ ID NO: 115732 - DNA, 2826 bp, Artificial Sequence
  Description of Artificial Sequence: Synthetic coding sequence
atggtttttttgcccctgaaatggtcactcgccacaatgtctttcctgttgtcctcacttcttgcactcttaaccgtttcaacacccagctggtgccagagcaccgaagcctccccaaagcgcagtgatgggactccgttcccctggaacaaaatcaggttacccgagtatgttattccggttcactacgatcttctgattcatgccaacctcacgaccctgacattctggggaactacaaaggtcgaaatcactgcttcccaaccaacttcaacaatcatcctgcatagccatcacctacagatatccagggccacattgcggaagggtgctggagagcggctttcagaagaaccattgcaggtgctggagcatccccgccaggaacagatcgccttactcgccccagagcccctgctggttgggttaccctataccgtggtcatccactatgctggcaacctgtcagaaactttccacggcttttataagtctacctaccgcacaaaggaaggcgagttgagaatcctggccagcacgcaattcgagcccactgcggcaagaatggctttcccttgtttcgacgagcccgcctttaaagcttcattctctatcaagataaggcgggaaccccggcacctagcaatatcaaatatgccactggtcaagtccgttacagtggcagaaggattgattgaggatcatttcgacgtcacagtgaagatgagcacatatctcgttgctttcattatctccgatttcgaatcagtcagcaagatcaccaagtctggcgtgaaggtatcagtatacgctgtgccagataaaatcaaccaggcagattatgccttagacgccgctgtcaccctcctagaattctatgaagactattttagcatcccgtatcccctgcctaaacaagatcttgctgctattcccgacttccaatcaggggccatggagaattgggggctgacaacttaccgggaatccgcactgctctttgacgcagaaaagagctctgccagcagcaaactcggcataactatgacagtcgctcatgaactagcgcatcagtggttcggaaacctggtcaccatggagtggtggaatgacctatggcttaatgagggctttgcaaaattcatggaattcgtgtccgtctccgtgacacatcctgagttgaaagtgggcgattattttttcgggaagtgctttgatgccatggaagttgacgctcttaactccagtcaccctgtatccactcccgtggaaaatcctgctcagatacgggaaatgtttgacgatgtttcctacgataaaggtgcttgtatattaaacatgctgcgtgagtacctctccgccgatgcattcaaaagcggtattgtacaatatttacagaagcactcgtacaaaaacactaagaacgaggatctgtgggatagtatggccagtatatgtcctacagatggtgtcaagggcatggatggattttgctcaagatctcagcatagcagctctagctctcattggcaccaggagggcgtggatgttaaaacaatgatgaacacatggaccctacagaagggattcccactgatcactattaccgtgcgcgggagaaacgttcatatgaaacaagagcattacatgaaaggaagtgacggagctccggacactggctacctgtggcacgtgcctctgacctttatcaccagcaagtccgacatggtccaccggtttttgctgaaaaccaaaaccgacgtcctaattctccccgaggaagtagagtggataaaatttaatgtcggaatgaacggatattatatcgttcattacgaggatgacggatgggatagcctcactggcctgctcaaggggacacatacggctgtgagctcaaacgacagggcctcacttattaataacgcttttcaattggtgagtatcggaaagctctccattgagaaagccctggatttgagcctgtacttgaaacatgaaaccgagataatgccggtatttcaaggcctgaatgagttaatcccgatgtataagctcatggagaaaagggatatgaacgaggtcgagacccaatttaaggcattcctgatccgtctgttaagggatctgatcgacaagcaaacttggacagacgaaggatccgtcagcgagaggatgctgaggagccagctgttactgctggcctgcgtgcataactaccagccatgcgtgcagagggctgaaggatacttcagaaagtggaaggaatctaatggaaacctgtctctccctgtagacgttacattggcagtgttcgccgttggcgcgcagagcaccgagggttgggatttcctgtacagcaagtatcagttttcactgtccagtaccgagaagtctcagatcgaatttgcattatgcagaacacagaacaaagagaagctgcagtggctgctcgacgaaagcttcaaaggagataagattaagacacaggagttcccacaaattttgactctgattggaaggaaccctgtcggttatcccctcgcgtggcagtttctgaggaagaattggaacaagcttgtccagaaattcgagctggggtcatctagtatcgcacatatggtcatgggtaccactaaccagtttagtacacgtaccagactggaagaagtgaagggcttcttctctagtctgaaagagaacgggagccaacttcggtgtgtgcagcagactattgagacaatcgaggaaaatatagggtggatggataaaaatttcgacaagatcagggtgtggctgcaatctgagaagttagagaggatgtag

SEQ ID NO: 115733 - DNA, 2826 bp, Artificial Sequence
  Description of Artificial Sequence: Synthetic coding sequence
atggtgttcttgcccctgaaatggagtctggctacaatgtcatttcttttgagtagtttgctggctctgctgaccgtcagtacaccttcttggtgtcagagtacggaggcttcccctaaacgctccgatggaactccctttccctggaataagatcaggctgcctgagtacgtaattccagttcattatgatctcctcattcacgcaaatttgactaccttgacattttggggcaccaccaaagttgaaataaccgcatcacagcctacgtctacaatcatcttacacagccaccatctccaaatatcgcgagcaaccctgagaaagggcgcaggagaaagactgtcggaagagcctttacaggtgctggagcacccccgacaagaacagattgccctgctcgccccggaacctttgctggtgggtctgccctataccgtggtcattcattatgcaggcaatctgtccgaaaccttccacggcttttacaagtctacgtatagaactaaagagggcgaactaaggattttggcaagtactcaatttgaacctacggcagcccggatggcatttccttgctttgacgagcccgcgtttaaagcaagttttagtatcaaaatccgaagagaaccacgacacttagctatctctaatatgcccctggtaaaaagcgtgactgtagctgaaggactgattgaagatcatttcgatgttactgtgaaaatgtctacatatctggtggcctttataataagcgactttgaatcagtgagcaaaatcacaaagtcgggcgtaaaagtgtccgtttacgccgtgcctgataagataaatcaggccgattacgccctcgacgccgctgtgaccctgttggagttttatgaggactatttttcgatcccatatccactccccaaacaagatctggctgcaattcccgatttccagagcggcgctatggagaactgggggttaactacttatcgcgagtccgccctgctcttcgacgcagagaaatccagcgctagttcaaagctgggtatcacaatgacagtcgctcatgaactggcccatcaatggtttgggaatctcgtgaccatggaatggtggaacgacttgtggctcaacgagggtttcgctaaatttatggagttcgttagcgtttctgtaacccaccccgagctgaaagtgggagactacttttttgggaagtgtttcgacgcgatggaagtcgacgctctgaacagctcccatcctgtgagcactcccgtagaaaaccctgcacaaatcagggagatgttcgatgacgtgtcttatgacaaaggtgcctgcatcttaaacatgcttcgagagtatctctcagctgacgctttcaagagtggtattgtgcaataccttcagaagcattcctacaagaataccaagaatgaggatttgtgggatagtatggctagcatttgtccaaccgatggagtgaaaggtatggacgggttttgttctagatcccagcacagcagctcttcctctcattggcaccaggaaggggtagatgtgaagacgatgatgaatacttggaccctgcaaaaagggttccctttgatcacaatcaccgttagaggcaggaacgtgcatatgaaacaggagcattatatgaagggaagcgatggcgcccctgataccgggtacctgtggcatgtacctctgacgtttataacgtcgaagtccgacatggtccacagattccttctgaagacaaagaccgacgtgctgatcctgcctgaggaagtcgagtggataaagttcaatgtggggatgaacggctattatattgtgcattacgaggacgatggctgggactctcttactggcctgcttaagggtacgcataccgccgtgtcgagcaacgaccgtgcctccctgattaataatgcatttcaattggtgtcgatagggaagttaagcatcgagaaggctctggatctgtccctataccttaagcacgagacggagattatgccagtgtttcagggcctgaatgagttaatccctatgtataagttgatggaaaaaagggacatgaatgaggtggaaacgcagtttaaggctttcctgattagactcctacgcgacttgattgacaaacagacctggacagatgaagggagcgtgtccgagcggatgcttaggtcgcaactattacttctggcttgtgtacacaattatcagccgtgtgtacagcgtgctgaaggttacttccggaaatggaaagaatctaacgggaacttatccctgccagtcgatgttaccctggctgtctttgcagtaggggcccaatccaccgagggttgggatttcttgtatagcaaatatcagtttagtctgtcgtccacagaaaaatcacagatcgaatttgccctctgtaggacacagaacaaagagaagttgcagtggctgctggatgagtcgtttaagggagataagattaagacccaggagttcccacagatattgactctgatcgggagaaatcctgtgggctatccactcgcttggcagttcctacggaaaaactggaacaagctggttcagaagtttgagcttggtagcagcagcatagctcacatggtaatgggaactactaatcagttcagcacccgtacccgcctggaggaagtcaaggggttctttagttctctgaaggagaatggaagtcagctccgttgtgtgcaacagacaatagaaaccatcgaggaaaacattggatggatggataagaattttgataaaattcgcgtctggctccaatcagagaagctcgagcggatgtag

SEQ ID NO: 115734 - DNA, 390 bp, Artificial Sequence
  Description of Artificial Sequence: Synthetic coding sequence
atggtgttcctacccctgaagtggtccttagctaccatgtcctttctgttatctagcctgctcgccctgttgacggtgagtactcccagttggtgccaaagcaccgaagcctcacccaaacgtagtgacggcactcctttcccttggaacaaaatcaggctccccgaatatgtgatacccgtccattacgacctgctcatccatgctaatcttaccactctgacattttggggtactacgaaggtggagataacagcatcccagcccacatccactattattctgcacagtcatcatctgcagatctccagagcgacattacggaaaggcgccggcgaacggctgtccgaagaacctttgcaggtcttggaacatccccgacaagaatag

SEQ ID NO: 115735 - DNA, 2748 bp, Artificial Sequence
  Description of Artificial Sequence: Synthetic coding sequence
atgtttcacagctcagccatggttaattcacaccgaaagcccatgttcaacattcaccgagggttttactgtctgactgccattttaccacagatctgcatttgctctcagttttctgttccttctagctatcatttcactgaagacccaggagcatttcccgtcgcaacaaacggagaacggtttccttggcaggaactacgcctcccctccgtcgtcatcccactgcactacgacctgtttgtccatcccaatctcacaagtttagatttcgttgcctcagaaaaaatcgaggttctggtttcaaacgctacccaattcatcattttgcactcgaaggacctggagatcactaatgccacacttcaaagcgaagaggactcaaggtatatgaaaccaggaaaggaattaaaggtgctttcataccctgctcatgaacagattgcactactggttcctgaaaaactgacaccacatctgaagtactatgtggccatggattttcaagcaaagctaggcgatggcttcgaaggattttacaagtccacatatcgcaccctggggggagaaacccggatcttggccgtgactgacttcgagccgacgcaggccaggatggcctttccttgcttcgacgagcccctgttcaaggcgaactttagtattaagatcaggcgcgaaagtagacatattgctctgtcaaacatgcctaaggtctccatttacgccagtccagataagcggaaccaaacgcattacgccctgcaggcttcactcaaactgttggacttctatgaaaagtactttgacatctactatcctctatcaaaactcgatctcatcgcgattccagatttcgcacctggtgccatggaaaattgggggctcatcacatatcgggagacatcactgctctttgatccaaagaccagctccgcctccgataaattatgggtgactcgcgtcattgctcatgaactggctcaccaatggttcggtaacctcgtgaccatggagtggtggaatgacatctggcttaaggagggctttgcaaagtacatggagttgattgctgtgaacgcgacctatccggagctccagtttgatgattattttcttaacgtatgtttcgaggtgatcaccaaagatagcctgaacagctcccgaccgatttctaaacccgccgagactccgacacagatccaagagatgttcgatgaggtctcttataataaaggagcttgtatcttgaacatgcttaaggactttctgggagaagagaaatttcagaaaggcatcatccaatatcttaaaaaatttagctatagaaacgccaagaatgacgatctgtggagttcgctcagcaactcttgccttgagagcgactttacgtctggtggcgtctgccactccgaccctaaaatgacatcaaacatgctggccttcctcggtgagaatgcagaagttaaagagatgatgacaacttggactctgcagaaggggattcccctgctcgtggtgaaacaggacggatgtagcctgagattgcaacaggagcggttcctgcagggagtgtttcaggaagatcccgagtggcgtgcactgcaggagaggtacttgtggcacattccacttacatattctacaagcagtagtaatgtaatccatcggcacatcctcaagtctaagacagataccctagatctccctgagaaaacatcatgggtcaagttcaacgtggactccaatggttactatatcgtacactacgaaggccacggttgggatcaactgatcacgcagctgaatcagaatcatactctgcttcggccaaaagatagggtgggcctgatccacgacgtgtttcagctggtcggcgccggtcgcttaaccttggacaaggcgctggatatgacatactacttacaacacgagacctcatcgcctgcgctcctcgaaggcttgagctatctcgaaagcttttatcacatgatggataggcggaatatctccgatatctctgagaacttaaagagatatttgcttcagtacttcaaacctgtgattgatcgccaatcatggagcgacaaggggagcgtatgggaccgtatgctgagaagcgctctcctgaaacttgcatgtgacctcaaccatgcgccttgcatacagaaagcggccgaactctttagtcagtggatggaatcaagcgggaaactgaatatccccaccgatgtgctcaagattgtgtattctgtcggagcacaaactacagcaggatggaattatttgctagaacagtacgagctgtcgatgagtagcgctgaacagaataaaatcttgtacgccctgtcaacatcaaagcatcaggagaaactcttgaagctgattgagctcgggatggaggggaaggtaatcaagacacagaacctggccgcgctgctgcatgctattgcacgtagacccaaaggacagcagctagcctgggacttcgtgagggagaattggactcaccttttgaaaaagtttgatcttggctcctacgatatacgcatgatcatctctggaactacagcccacttctcctctaaggataaactgcaagaggtgaaacttttttttgaatcgctggaggcccagggcagccacctggatatattccagacggtcctggaaacaatcacgaaaaacatcaagtggctggagaagaacttgccaaccctacgaacatggcttatggtaaacacctag

SEQ ID NO: 115736 - DNA, 2883 bp, Artificial Sequence
  Description of Artificial Sequence: Synthetic coding sequence
atgttccacagcagcgcaatggtgaacagtcatcgcaaaccaatgtttaacatacatcgggggttttactgcctcacagctatcctcccgcagatttgcatatgctcgcagttctcagtgccatcttcttaccacttcacagaggatccaggtgctttccctgtggcaaccaatggcgaacggttcccctggcaggaattacgcctgccctcagttgtgatacccctgcactacgacctgttcgtacaccccaaccttacctccttggacttcgtggcctcagagaaaatagaagtgttggtgagcaacgccactcagtttatcattctgcacagtaaggacctggagataactaacgccacgctccagagcgaggaagatagcaggtacatgaagcccggcaaagagttaaaagtgttgagctatcccgcccatgaacagatagccctgcttgtgcccgagaagttaacacctcacctgaagtactacgtggcgatggattttcaggcgaagctgggcgatgggtttgaggggttctataaaagcacctatcgcactctgggcggggaaactagaatattggcagtaacggacttcgagccaacccaggctcgaatggcctttccgtgttttgacgagccactgtttaaggcaaacttcagtataaagatccgccgggagtcacgccatatcgccctttctaatatgcctaaagttaagacaattgaactggagggcggattgcttgaagaccactttgagaccacggttaaaatgagcacttatcttgtggcatacattgtctgtgacttccattccttatccggttttacatcctcaggcgtgaaagtgtccatctacgcgtctcctgacaagcggaaccagacgcactacgcacttcaggcgtccctgaaactcctggatttctatgagaaatacttcgatatttattatcccttgagcaaattagatcttatcgctatccctgatttcgctccgggcgctatggaaaattggggtcttatcacctatcgcgagacatccctgctgttcgaccctaagacatcatcagcatccgataaactctgggtaacccgcgtaatcgcacatgaattggcccatcagtggtttggcaacctcgtcaccatggaatggtggaatgatatatggctgaaagagggattcgctaagtacatggaactgattgccgtcaatgctacttaccccgagctacagttcgacgattactttctgaatgtatgctttgaagtgattacaaaagattctctgaactctagccgtccaattagcaaacccgcagaaacacccacacagatccaggaaatgttcgacgaggttagctacaataagggagcctgcattctgaatatgctaaaggacttcttaggggaagaaaagttccagaaaggcattatccagtacctgaagaagtttagttacagaaacgctaaaaatgatgatttgtggtccagtctgagtaattcctgcttagagtccgatttcacttctggcggagtatgccatagtgaccccaaaatgaccagtaatatgctagcttttcttggggagaacgccgaggtcaaagaaatgatgactacctggacactccaaaagggaattccactgctggtcgtgaagcaggacggatgtagtctccgcctccagcaggaaagattcctacagggggtattccaagaggatcccgagtggcgggctctgcaagagcggtatctgtggcatataccactgacctatagtacatcatcgagcaatgtgattcaccgacatatcctcaaatctaaaactgatacgctggatctgccagagaaaacatcctgggtgaagtttaacgtggattccaacggttactatatcgttcattacgaaggccatggctgggatcagctgattacccagctcaatcaaaaccacacactgctccggcctaaagaccgcgttggccttatccacgatgttttccagctggtaggcgccgggagactgactcttgacaaagctttggacatgacgtactatctccagcatgaaactagcagccccgcactgttggaagggctgtcgtatctggaatccttctatcacatgatggatcgccggaacatttccgacatttccgaaaaccttaaacggtacctgttacagtacttcaaacctgttattgatcgtcagtcctggtccgacaagggctccgtctgggatagaatgctgagatctgccctcttaaagctggcatgtgacctgaatcacgcaccatgcatccagaaagctgcagagttgttttcgcagtggatggagagcagtggcaaactcaacatccccacagacgtacttaaaattgtgtacagcgttggcgcgcaaacgactgccggctggaactacctgctggagcaatacgagttgagcatgtcctccgctgagcagaataaaatcctttacgccctatctaccagtaaacaccaggagaaattattaaagcttatagaacttggaatggagggaaaagtaatcaaaacgcaaaacctggctgccctactgcatgctattgcccggcgtcccaagggacagcagcttgcctgggactttgtccgcgagaactggacacaccttcttaaaaaattcgatctggggagctacgatattagaatgatcatcagtggcacaacggctcatttctctagcaaggacaaactacaggaggtcaaattgttttttgagagtcttgaggcccagggatcccacctcgatatatttcagacagtactggagacaattacgaagaacatcaaatggctggagaaaaatctccctacattacgcacctggctcatggtgaacacttag

SEQ ID NO: 115737 - DNA, 1053 bp, Artificial Sequence
  Description of Artificial Sequence: Synthetic coding sequence
atgttccattcatcagctatggtcaatagtcatcgcaagcctatgttcaatatccatcgaggtttctattgcctgactgccattctaccccagatttgtatctgctcacagttttcagtcccatcatcttatcacttcacagaggatccaggggcctttccagtcgcgaccaacggtgagaggttcccatggcaggaattgagactcccttccgtggtaatccccctgcattacgacttgtttgtgcatccgaatctcacttcgctggactttgtcgcctccgaaaaaattgaagttctcgtcagcaacgctactcagtttatcatactgcattccaaagacctggagatcactaacgcgaccttgcagtcagaagaggacagccgatatatgaaacccggcaaggagctgaaggtgctctcatacccagcacatgaacagatcgctcttttggtaccggagaaactgaccccccacttgaagtactacgtggccatggattttcaggcaaagttgggggatggctttgagggtttctacaaaagcacctacaggacattgggcggggagactcgcatcctggccgtgacggactttgaacctacgcaagcaagaatggccttcccctgtttcgatgagccacttttcaaagccaacttctccatcaagattcgccgtgagagcaggcacattgccttgtctaacatgcctaaggtcaagaccatcgaattggagggcgggctgcttgaagaccacttcgagacgacagtaaaaatgagtacctatttggttgcatatatcgtgtgcgacttccatagcctaagcggtttcacgtcttctggggtaaaggtgtccatctacgcctccccggacaagaggaatcagacacactatgctctgcaagcttctttgaaactactggacttctacgagaagtatttcgacatttattatcctctcagtaaattgggaatgttcaagttccatataatcgtatttatttttgcccacaagacttgcttcgacttatttcccttaagtctcagtatgtag

SEQ ID NO: 115738 - DNA, 2085 bp, Artificial Sequence
  Description of Artificial Sequence: Synthetic coding sequence
atgtttcactccagcgccatggtgaattcgcatcgcaagcccatgtttaatatccacaggggtttctattgtctgaccgccattctcccacaaatttgcatctgttcccagttctcagtcccctcctcctaccatttcaccgaggatcccggtgcttttcctgtcgcgaccaatggcgagagattcccctggcaggaattaagattgcccagtgtggtaatccctctccactacgacctgttcgttcacccaaatctgacatctctcgactttgtcgcttccgagaaaatcgaggtgctagtgagcaatgcaacgcagttcattatcctccacagcaaggacctggaaattacaaacgcaacccttcagtccgaggaagatagcaggtatatgaaacctggaaaggagctcaaagtgctttcttatcctgcacatgaacaaatcgccctcctggtccccgagaaactcactccacacctgaaatactacgtggcgatggattttcaagccaagctcggagatggctttgagggattctataaatccacgtatcgcactttgggaggcgagacccggatcctggccgttacggattttgaacctactcaggctcggatggctttcccatgtttcgatgaaccactttttaaggctaattttagcataaagattcggagggaaagcaggcatattgccctttcaaatatgcccaaggtgaaaactatcgagctggagggcggtctactggaggaccattttgagaccacagttaagatgagtacttatctggtcgcatatatcgtttgcgacttccatagcctgagcggattcacgagtagcggcgtgaaggtcagcatatatgcttccccggataagagaaatcaaacccattatgcactgcaggcctccctgaagctactcgatttttatgagaagtacttcgatatttactatcccctttctaagctggatctgatagctatccctgacttcgctccaggggccatggagaactgggggctgatcacatatcgggagacttcgctgctgttcgaccctaaaacaagttccgccagcgacaaactgtgggtcaccagagtcatcgcccatgaactcgcacaccagtggttcggtaacctcgtgacgatggagtggtggaatgatatatggttaaaggaagggttcgctaaatacatggaacttatagccgtcaatgctacataccctgagctgcagttcgacgactacttccttaatgtgtgcttcgaagtaatcacaaaggatagtctcaattcgtcccgacctatcagcaagcccgccgagacccctacacagatccaggagatgttcgacgaagtgtcgtataacaagggtgcgtgtattctgaatatgcttaaagacttcttgggcgaagaaaagtttcaaaaggggattatacagtacctaaaaaaattcagctatagaaatgcaaaaaatgatgatctttggtctagcttgagtaacagttgtctggagtctgacttcacctccgggggtgtgtgccattcggatccgaagatgacgtctaatatgctggctttcttgggagaaaatgccgaggtgaaagaaatgatgaccacctggacactccagaaaggcatcccacttctggtggtgaagcaagacggctgcagtctccggctccagcaagagaggttcctgcaaggagtgtttcaggaagatcctgagtggagggcactgcaggaacgctacttatggcatatcccactaacatattctacttctagttcgaacgttattcacagacacattctcaagtccaagactgacacattggacctgcctgagaagaccagttgggttaaattcaatgtggattctaatggttactacattgtccattatgaggggcacggatgggatcaattaatcacacagctgaaccagaaccacacacttctgcgcccaaaagatagggtaggcctgattcatgatgtgttccaactggtgggagcaggtcgactcacattagataaagcattggatatgacttactatctgcagcatgaaacctcctccccctag

SEQ ID NO: 115739 - DNA, 1452 bp, Artificial Sequence
  Description of Artificial Sequence: Synthetic coding sequence
atggaagaggggggcggaggggtgagaagcctagtccctggggggcctgtactcctggtcttgtgtggcctcctcgaagcaagtggcggtggaagggccctgccccagctgtcagacgacatcccttttcgggtgaattggccaggaacggaattcagcctgcctaccacgggggtgctgtataaggaagacaattatgttatcatgaccaccgcacataaagaaaaatataagtgtattttgcccttggtgacttcaggggatgaagaggaggagaaagattacaaaggcccaaacccacgggagctcctggaacccctgtttaagcagagctcgtgctcttaccgaattgaatcttactggacatacgaggtatgccacggaaagcacatacggcagtatcacgaggagaaggagaccggacagaagattaatattcacgagtactacctcggcaacatgttggcgaagaatctcctgtttgaaaaggagagagaggctgaggaaaaggagaaatcaaatgagatcccgacaaaaaatatcgaggggcagatgacgccctattatcccgtaggcatgggaaatggaacaccctgcagtctgaagcagaataggccacgctccagcacagttatgtatatttgtcaccctgaaagcaagcatgagatactatccgtggcagaggtcaccacatgtgagtatgaggtcgttatcctgacacctctgctttgctctcaccccaaataccgcttcagggcaagcccagtaaacgatattttctgccaatcacttccaggttctccctttaaacccttgacactcagacagctagaacaacaggaggagattttgagggtccctttcagaaggaacaaagaggaggatctccagagtacaaaggaggaaaggttccctgcaatccacaagtccattgcgatcgggtctcagccggttctaactgtcggtaccacacacatctccaaactgaccgatgatcagctcatcaaggaattcctgtccggttcatactgctttcgggggggggtcggatggtggaagtacgaattctgttacggcaaacacgttcatcagtatcatgaggataaagacagtgggaagacatcggtggtggtggggacctggaaccaagaggagcacatcgaatgggctaagaagaacacggctagagcctaccacctccaagatgacggaacacagaccgtgcggatggtgagccacttctatggcaacggcgatatctgtgacattactgataagcctaggcaagttaccgtgaagctcaagtgtaaggagtccgattcaccgcacgccgtgaccgtttacatgctcgaaccccactcttgccagtatattctgggcgtcgaaagccctgttatttgcaagatactggataccgccgatgagaacggtctgctctctctgccaaattag

SEQ ID NO: 115740 - DNA, 1290 bp, Artificial Sequence
  Description of Artificial Sequence: Synthetic coding sequence
atggaagaaggcggggggggggttcgctcactggttccgggcggaccagtactgctggtcttgtgcggcctattggaggccagcggtggcggtagagccctccctcagttatctgatgatatcccttttagggtgaattggcctgggacagagtttagtttacccactactggggttttatataaagaagacaattacgtcatcatgaccacagcccacaaggagaagtataaatgtatactacccctggtgacctcaggcgacgaggaggaggagaaggattacaaaggccctaacccccgcgaactgctggaacccttattcaagcagtcatcctgtagctatagaattgagtcctactggacttacgaagtgtgtcacggcaaacatataagacagtaccacgaagagaaggaaactggccaaaagattaatatccacgagtactatcttggaaatatgctggccaaaaacttgctatttgagaaagaaagggaggctgaggaaaaggaaaaatccaacgagatcccaaccaaaaacatcgaaggtcagatgactccatattatcccgtgggaatggggaatggtacaccgtgttcactcaaacaaaatcgacctcgatccagcacagtgatgtatatttgccaccccgagtcgaagcatgagattttaagcgtagcggaagtcaccacatgcgagtatgaggttgttatcctaaccccactactgtgctcccacccaaagtatcgatttagggccagcccggtgaatgacatcttctgtcagtctctgcctggatctccatttaagccattgactcttcgccagctcgagcagcaggaggaaatcctgagagtaccgtttagaaggaataaggagggcgtaggctggtggaagtacgaattctgctacggcaagcatgtccaccagtatcacgaggacaaagacagtggaaaaactagcgtggtggtgggcacatggaaccaggaagaacatattgagtgggccaaaaagaacacagctcgtgcttaccatcttcaagacgacgggacgcagactgttcgcatggtctctcacttctacggcaatggtgatatctgcgatatcaccgacaagccacgccaggtgacggtaaagctgaaatgtaaagagagtgattctccgcacgccgtgaccgtttacatgttggaaccacacagctgtcagtatattctcggagtggaaagccccgtgatttgtaaaatcctggacacagccgacgagaatggcctccttagtctgcccaattag

SEQ ID NO: 115741 - DNA, 1374 bp, Artificial Sequence
  Description of Artificial Sequence: Synthetic coding sequence
atggaggaagggggtggcggagtgaggtctctggtccctggtggcccagtgctactggttctctgcggacttttggaggctagtggcggtgggagagccctaccgcagctgagcgacgacatccctttcagggtgaactggccaggcaccgagttttcgctacctacaaccggggtgctctataaggaggataactacgtgatcatgaccaccgctcataaggaaaagtataaatgtatcttgcctctggttacatctggagatgaggaggaggagaaggattacaagggacctaatccacgcgagcttctcgagccattattcaagcagtcatcctgctcttatagaatagagtcctactggacctatgaggtgtgccacgggaagcatatccgacaataccatgaggaaaaggagactggtcagaaaattaacatccatgagtactacctgggcaatatgttggctaagaacctcctgtttgaaaaagagcgcgaagcggaagagaaagaaaaatccaacgagattcccactaagaatatcgaaggccaaatgaccccctactatcctgtcggaatggggaatgggaccccatgttccctcaaacagaatcgacctcgaagctccaccgtgatgtatatttgtcaccctgagagcaagcatgaaattctgtcagtggccgaagtcaccacatgcgagtacgaagttgtgatcctaacccctctgttatgtagccacccaaagtatcgattcagagcctcaccggtcaacgacatcttctgtcagtctctgcctggctcacctttcaaaccattgaccctgagacagctggagcaacaggaagaaatcctccgagttccttttcggagaaataaggaggaggacctccagagtacaaaggaggaaagattccccgccatccacaagtccatcgcaattggctctcagccagtgctgaccgttggcaccacacacatatcgaagcttactgacgaccaactcattaaagagttcctgtccgggtcttattgtttcagagggggagtggggtggtggaaatacgaattctgctatggtaagcacgtgcaccagtaccatgaagacaaggattctggaaagacttcagtggtagtggggacttggaaccaggaggagcacattgagtgggctaagaaaaatacggcgagggcctaccatctgcaggacgacggtacccagactgtccggtgtaaagagtcggactctcctcacgccgtcacagtgtacatgctggagcctcacagctgtcagtacatccttggagtggagagtccggtgatttgcaagatattggacactgcggatgagaacgggctcctgagcctaccgaactag

SEQ ID NO: 115742 - DNA, 2715 bp, Artificial Sequence
  Description of Artificial Sequence: Synthetic coding sequence
atggagtggggttccgagtccgccgcagtaaggcgccatcgcgtgggagtagaacgcagggaaggcgctgcggcagccccaccaccggaacgcgaggcgcgcgcccaggaacccctggtagacggttgctccggcggagggcgaactaggaaaagatctcctggaggaagtgggggcgccagtagaggcgctggcaccggattaagtgaagtgagggccgctctcgggttggctctgtatctaattgcccttcgaaccttggttcagctgagcctgcagcagcttgtgttgagaggcgccgctggccaccgaggggaattcgacgcattacaggctcgcgactatctggagcatatcaccagcatcggcccccgtaccaccggcagtcccgagaacgagattctgacagtacattacctgctggagcagattaaacttatcgaagttcagtctaattccctccataagatcagtgtcgatgtccagcgtcccaccgggtccttttcgatagattttctgggtggattcactagttactatgataacattacgaacgtcgtggtgaagctggagccacgagacggcgcccagcacgctgtcctggctaattgccactttgactctgtggccaattcgcctggcgcatctgacgatgccgtatcttgctccgttatgctcgaggtcttgagggtcctatccacctccagcgaagcattacaccacgccgtcatattccttttcaacggcgccgaagagaacgtgctgcaggcgtctcatggatttatcacccagcatccctgggcgtctctaataagggcttttatcaatttggaggcagccggtgtcggaggaaaggaattagtgtttcagactggtcctgagaatccctggttagttcaggcatatgtgtccgccgcgaagcacccttttgctagcgtggtggcacaggaggtattccagtccgggattataccttctgatactgatttcaggatctaccgagacttcgggaatattccaggaattgacttagcatttattgagaatggttacatatatcatacaaaatatgacaccgctgatcgcatcttgactgatagcatacagagggcgggtgacaatattctagccgtactgaaacacttggcaacttctgacatgcttgcagccgcttccaaatacaggcatggcaacatggtgttctttgatgttctgggtctgttcgtaatcgcctacccctcccgtatagggtctatcataaactatatggtggtaatgggcgtggttctatacctggggaaaaagtttctgcagcccaagcacaagactggtaattataagaaagacttcctatgcggcctcggaattacgctgatttcatggtttactagcctcgtgactgtactgattatagctgtcttcattagcctaattggtcaatctctgtcttggtacaatcatttctacgtgtctgtgtgtctctacggcaccgctactgtggctaaaatcattctcattcatacactggccaagcggttttattatatgaatgctagcgcccagtatctgggagaggtttttttcgacatatctctctttgtccattgctgctttctcgtgacattaacataccaagggttgtgctccgccttcatctctgctgtctgggtggcatttccacttctaacaaaactctgcgttcacaaggactttaagcagcacggggcccaaggtaaattcatcgcattttacctcttggggatgttcatcccctacttgtatgctctttacctgatatgggctgtctttgaaatgttcacacccatcctcggaaggagcggcagcgaaattcctcccgatgtggttcttgcatcaatacttgctggatgcactatgatcctctcatcatacttcatcaacttcatttatctggccaagagtacaaagaagacaatgcttactctgacactcgtttgtgctattacatttctcttggtgtgcagcggcactttcttcccgtactcctccaatccagcgaacccaaaaccaaagcgggtgttccttcaacacatgacccggaccttccatgacctagagggaaatgccgtgaaaagagattctggcatttggatcaacgggtttgactacacaggtatctcccatattactccgcacattccagaaattaatgactcgatacgggcccattgtgaagagaacgcccccttgtgtgggttcccctggtacttgcccgtgcatttcctgatccgcaaaaattggtacctgccagcccccgaggtttccccccgcaatcctcctcacttcaggctcatatcgaaagagcagaccccgtgggacagtattaagcttacctttgaagccactggcccatctcacatgtctttttacgtgcgcgcccataaaggaagcaccttaagccagtggagcctcggcaacggaacccccgtgaccagtaagggaggggactattttgtattctacagccatggcttacaagcgtctgcctggcaattttggatcgaggtgcaggtaagcgaggaacaccctgaggggatggtgaccgtcgcaattgccgcacactacctgtctggcgaggacaagagatccccccagctggacgcattgaaagagaaattccccgattggacgtttccttccgcatgggtttgtacgtacgacttatttgtgttctag

SEQ ID NO: 115743 - DNA, 1056 bp, Artificial Sequence
  Description of Artificial Sequence: Synthetic coding sequence
atgctggaagtgctgcgggtgctgagtactagcagcgaagcccttcatcatgcagtaatatttctctttaacggcgccgaggagaacgtcttacaagcatcccacggctttattacacagcacccgtgggctagtttaattagagccttcatcaatctggaggccgcaggggttggcgggaaggagctggtctttcagacaggcccggaaaatccatggctcgtgcaggcttacgtatccgccgccaaacacccttttgcatctgtcgtggcccaagaagtgttccaatctggtatcatcccctctgatacagacttcaggatatatcgggacttcggaaatatccccggtatcgacctggcgtttatcgagaatggctatatctatcacaccaaatacgacacggcggatcggattctaaccgacagcatccaacgagccggtgataacatcctggccgttttaaagcacttagcgaccagcgatatgcttgctgccgcctctaagtatagacatgggaacatggtgtttttcgacgtcctaggcctttttgtgatcgcctaccctagtcggatcggaagcatcatcaattacatggtcgtcatgggcgtggtcctgtacctgggcaagaagttcttgcagccgaaacacaagaccggcaattataagaaggatttcctgtgcggactgggcattaccctgatttcttggtttacatccctggtaaccgtgctaattattgccgtgtttatcagtctgatcggccaatccctgtcctggtataaccacttctacgtgtcagtgtgtttgtacggaacagcaacggtggctaaaattatccttattcatacgctcgccaagcgattttattatatgaatgcatcagcccagtatcttggcgaggtgttttttgacataagcctgtttgttcactgctgcttcctggtgacacttacctaccaaggcctttgttcggcctttatatccgccgtctgggttgcttttccgcttctgaccaagctatgtgttcacaaagacttcaaacaacacgactag

SEQ ID NO: 115744 - DNA, 2715 bp, Artificial Sequence
  Description of Artificial Sequence: Synthetic coding sequence
atggagtgggggtctgaatccgccgccgttcggagacacagagtcggcgtagagaggagagagggcgctgcggccgcgcctcctccagagcgcgaggccagggctcaggagccactggtcgacggatgttctggcggcgggcgaacgaggaagcgatctcctggcggctcaggaggtgccagtcgcggcgcagggacaggcctgagtgaggtcagagccgctttagggcttgccctgtatttgattgctctgcgaactttagtgcagttgtctctgcagcaattagtcctgcggggagcggccggccacagaggagagtttgatgcactccaggcgcgggactacttagagcatatcactagcatcgggccgcggactacaggctcacctgagaacgaaattctaacagtgcattatctgctggagcagatcaagcttattgaggttcagagtaattctttacataaaattagcgtcgacgtgcagcgccccacgggtagcttctctatagatttcctgggcggcttcacatcctattacgataacataaccaacgtagtcgtgaagctcgagccccgagatggcgcccagcatgccgtgctggccaattgccatttcgatagtgtcgccaacagcccaggcgcttctgacgatgccgtgtcctgcagcgttatgcttgaggtgctgagggtattaagtacgtccagtgaggctctgcatcatgcagtcatcttcctgttcaatggcgccgaggaaaatgtcttacaggcgtcccatggcttcatcacccagcacccctgggcaagtttgatacgggccttcatcaacctcgaagccgccggcgtcggaggtaaggaattggtttttcagactggacccgaaaatccatggctggttcaggcatatgttagtgccgcaaaacatccgtttgcctctgtggtggcacaggaggtgttccagagcggcatcattccatcggataccgattttcggatctatagagactttggtaacatcccaggcattgacctcgcttttatcgaaaatggatacatctaccatacaaagtacgacacagcggacaggatcttaacggatagcatccaacgggctggggataacatcctggccgtgcttaaacacctggcgacaagcgatatgctggcggctgcgagcaagtaccggcacggtaacatggtattttttgatgtactcggactattcgtgatagcctaccccagtagaattggcagcattattaactatatggtggtgatgggcgtcgtactttacctggggaaaaagtttctgcagccaaaacataaaacagggaattataaaaaagattttctctgcggcctgggtattacccttatctcttggttcaccagcctcgttacagtcctcatcattgccgtgtttatctcactgataggacagtccctttcatggtacaatcatttctatgtttccgtgtgcctctacggcaccgccacagttgccaaaataattctgatccacaccctcgcgaaacggttttattacatgaatgctagtgcccagtatcttggcgaagtcttctttgatatcagcctcttcgtgcattgttgtttcctcgtgaccttgacgtaccaagggttatgctccgccttcattagcgcagtctgggtggctttccccttactgaccaaactctgcgtgcacaaggacttcaagcagcacggggcccagggaaaatttattgcattttatctcttgggaatgtttataccttatttgtatgctctatatctcatatgggccgtgtttgagatgttcacacccatcctgggcagatctggcagcgaaatcccgccggacgtcgtcctagcttctatcctggctggatgcactatgattttgtcttcctactttatcaacttcatttacctcgccaagtctacgaaaaaaactatgttaaccctgaccctggtctgcgccatcactttcctcctcgtctgttccgggacattctttccatattcctctaaccccgcaaacccaaaacctaagcgcgtgttcctacagcacatgactcggacctttcacgacctcgagggaaatgccgtcaagagggattcaggtatatggataaacgggtttgattacactgggatttcccatatcacgccacacattcctgagattaacgattcaattcgtgcccactgtgaggaaaacgccccactgtgtggattcccctggtaccttccagttcattttctcatcaggaagaactggtacttacctgcccccgaagtttcaccaaggaacccccctcacttccgcctgatctccaaagagcaaacaccatgggactccatcaaacttacattcgaagcaactgggccatcacacatgagcttttacgtaagagcacataagggctcgacgctgtcccagtggagcctaggcaatggaacacccgtgacttccaagggaggggactattttgttttttattcccatggccttcaggcatcggcttggcagttctggattgaagtgcaggtgtcggaggaacatccggaaggcatggtcacagttgcaatcgctgcacactacctgtccggcgaggacaaaaggtctccacagctcgacgccctgaaggaaaaattccccgactggacctttccatccgcatgggtatgtacatacgacctcttcgttttttag

SEQ ID NO: 115745 - DNA, 1260 bp, Artificial Sequence
  Description of Artificial Sequence: Synthetic coding sequence
atggttgtcatgggtgtcgtcctgtacctgggaaagaaatttctccagcccaagcataaaaccggcaactacaagaaggactttctctgtggtctagggattactttgatcagctggtttacctctttggtgaccgtgctgataatagccgtgttcatatccctgattgggcaatctctaagttggtacaatcacttctatgttagtgtttgtttatatggcacagcaactgtcgcaaagatcattctaatccatactctggcaaagcgattttattacatgaacgcttccgcacagtacctaggtgaggttttcttcgatatctcccttttcgtacattgttgctttttagtcacacttacataccagggcctttgttctgcttttatctccgcagtatgggtcgcgtttccactcctcactaaactttgcgtgcataaggattttaaacaacacggcgcccaggggaagttcattgcattctacctgctggggatgttcattccctacctctacgccctgtatttaatttgggctgtctttgaaatgtttactcctattctcggacggtcggggagcgaaattcctcccgacgtggtcttggcctccatcctggccggctgcaccatgatactatccagttacttcatcaactttatctacttggcaaagagtactaagaagactatgctgacactcacattggtgtgtgctattacctttctgctagtctgcagcggtacgttctttccgtattccagcaaccccgctaaccccaagcctaagcgcgttttcttgcagcacatgactaggacattccacgacctcgaagggaacgcggtaaagcgagactcaggaatctggattaacgggtttgactacacaggaatcagtcacattacaccccacataccggagattaatgactccattcgcgcacactgcgaagaaaacgcacccctatgcggctttccctggtacctgcccgttcattttttgatccggaaaaattggtatctccctgcacctgaagtttcaccccgcaatcctccacatttccgtcttatcagtaaggagcagactccatgggattccataaaactgaccttcgaggcgaccgcatgcttgcccattctccagatcctcgacctgcccgctagcacgattatgactaagccatacgtgctgctatgttcctcccctcagcgggtgaacacgtttagtgtagtctcatggcagtggcaccccagccataaatag

SEQ ID NO: 115746 - DNA, 786 bp, Artificial Sequence
  Description of Artificial Sequence: Synthetic coding sequence
atggcagcagccgtgcccagagctgcttttttatcccctttgttacctctcctattgggatttctactgttgtctgcgccacatgggggaagtggactacatacgaaaggagccttgccacttgatacagtaaccttctacaaggtcattcctaagagcaagtttgtcctggtcaagtttgatacacagtatccttatggcgagaaacaggatgaatttaagagattggccgagaactctgcctctagcgatgatttgcttgtagcagaagtgggcatctccgattacggtgacaaacttaacatggagttatctgaaaagtacaagcttgacaaggagtcataccccgtcttctacctcttcagggatggtgatttcgagaatccggtgccatataccggggcggtaaaagttggagccatccaacgttggctgaaaggccagggagtgtatcttggaatgccaggctgtctgccagtctacgatgctctcgccggtgaatttattcgcgcgtccggcgtggaagcccggcaggccttgctcaagcagggtcaggacaatctgagttctgtcaaagaaacccagaaaaagtgggcagagcaatatctgaagataatggggaaaattctcgatcaaggcgaagatttcccagctagcgagatgacacggattgcaagactaatcgaaaagaacaaaatgagcgacggaaaaaaagaggagttgcagaaatccctgaatattctgaccgcctttcaaaagaagggcgccgaaaaagaagaactctag

SEQ ID NO: 115747 - DNA, 162 bp, Artificial Sequence
  Description of Artificial Sequence: Synthetic coding sequence
atggcagccgccgtgccaagggccgcctttcttagtccactgttgcctcttctactggggttcctcctgttgtccgctccgcatgggggcagcggtctccacaccaaaggagccctacctctggataccgtgaccttttataaaattatggttacctcctag

SEQ ID NO: 115748 - DNA, 2925 bp, Artificial Sequence
  Description of Artificial Sequence: Synthetic coding sequence
atgcgtagagctggaataggcgaagacagccggctgggactgcaagcccagcctggggctgaaccatctccagggcgtgcaggtacagaaaggtccctgggaggaacacaggggcccggtcagccctgttcctgccctggggccatggcctctgcagtgaggggatctagaccgtggccacgactcgggttacagctgcagtttgcagccctcctgctcggtaccttatctccgcaagttcacacactgcgacccgaaaacctgctcctggtgtctaccttagacggctccctgcatgcgctctccaagcagacgggcgacttgaaatggacactcagagatgatccagtgattgaaggcccaatgtatgttacagagatggccttcttaagcgatccagctgacggctctctttacatcctggggacccagaagcaacaggggcttatgaagcttccgtttaccatcccggaactggtgcatgcatcaccatgtcgtagctccgacggtgtgttctacaccggtaggaaacaggatgcatggttcgttgtggaccctgagtcaggggagactcagatgacactgacaacagaaggccccagtaccccgaggctatacattggcaggacccaatataccgtcacaatgcacgatcccagagcccccgcgctgcgctggaataccacatacagaaggtactccgcaccacctatggatgggtcgcctggcaagtacatgagccacttggcgagttgtggtatgggactactgcttaccgtagacccggggagcgggacagttctgtggacccaggaccttggtgtccctgtgatgggggtgtacacctggcaccaagacggtcttagacagctccctcaccttacacttgcacgcgacaccctgcacttcctagcactcagatggggccatatccgccttcccgcttctggacctcgagacacagccacactgttttccactttggacacccagctccttatgacgctctacgtcggtaaggacgaaaccgggttctacgtgtccaaagccctggtgcataccggggtcgcccttgtaccccgagggctgacgctcgctccagccgatgggccaactactgatgaggtgactcttcaagtctccggcgagagggaagggtctcctagcacagcagtgcggtaccccagtggtagcgtagcccttccctctcaatggctccttattggacaccacgagctgccccccgttctgcacacaacgatgctacgagtccaccccactttggggagcggcaccgccgagacccggcctcctgagaatacccaggcgcctgctttttttctggagctcttgtctctgtctcgtgaaaaactgtgggacagcgagctccacccggaagaaaagactccagacagctatctgggcttgggacctcaggatttactcgctgctagcctgactgctgtacttctgggcggctggatcctattcgtcatgagacagcagcagcctcaggtagtcgagaagcagcaggagacaccactggcacccgctgactttgcccatattagtcaggatgctcagagtttacatagcggtgcctcccggcggtcacaaaaaagactgcagtctccctcaaagcaggcacaacctctcgatgatcctgaggccgagcaattgaccgtggttgggaagattagtttcaaccctaaagacgtgctgggacgtggagctggaggcaccttcgtttttcgcggacagtttgagggccgcgctgtcgctgtcaaacggcttcttagagaatgttttggcctggttcggagggaggtgcagctgctgcaggagagcgatagacatcctaatgtgctgcggtatttttgcaccgagcgaggaccccaattccactatattgccttggagctctgccgcgcctcactgcaagagtacgtggagaatcctgatcttgaccgtggtgggctggagccagaagtggtcctgcaacagctaatgtctggtcttgcccacctgcactctctgcacatcgtgcaccgggacttgaagcctgggaacattctgattacgggaccagactcccagggcctgggaagggtagtcctgagtgatttcggcttgtgcaagaagctgccggcgggccggtgcagtttctctctacattctggcattccaggaaccgaagggtggatggccccggaactattgcaactgttaccccctgactcacctacctccgcagtagatatcttctcagctgggtgcgtgttttattatgtgctgtcgggaggatcccatccatttggagatagtctataccggcaggcgaatatattgacgggcgccccatgcctcgcccatctggaggaggaggtgcacgataaggtggtcgcaagagacctggtcggtgcgatgctttcccctctgcctcagccacgtccttcggctcctcaggtgctcgcgcacccattcttctggagccgggccaagcaactgcagtttttccaggacgtatctgactggctggaaaaagaaagcgagcaagaaccactggtgagggccttagaggccggaggttgtgctgtagttcgagataattggcacgagcatatatcaatgcctcttcaaacagatctaaggaagtttcggtcgtacaaaggtacaagcgtcagggatcttctccgtgccgttcgtaataagaagcaccactacagagaattacctgtcgaagtgcgccaggccctgggtcaggtccccgatggctttgtccagtacttcacaaatcggtttccccggctgctcctgcacacgcaccgagccatgagaagttgtgcttccgaatccctgttcctgccttattatcctcctgactcagaagcccgccgaccatgtccgggcgcaacaggccgttag

SEQ ID NO: 115749 - DNA, 2625 bp, Artificial Sequence
  Description of Artificial Sequence: Synthetic coding sequence
atggcctccgccgtgcgggggtcacgaccttggcccagactaggcctgcagttgcagttcgccgctctcctgctgggcactctcagccctcaggtgcacacgctccggcccgagaacctgctcttagtctccactcttgatggcagcctacatgccctgtctaagcagaccggtgatttgaagtggaccctgagagatgacccagtcattgagggacccatgtacgtgactgagatggcatttctcagtgatccggcggacggctcactttatatccttggtacccaaaagcagcagggactgatgaagcttcctttcacaatccccgaattggttcacgccagcccttgccgctcatccgatggagtattctataccggacgaaagcaggacgcttggtttgtggtagacccagaaagtggagagacacagatgactctgaccaccgaggggccctctactccaagactgtacatcggccgcacgcagtatacagtgacaatgcatgatcccagagccccagctctgcggtggaatacgacataccgccgttacagtgctccccctatggacggatctccgggaaaatatatgtcccatctggcttcttgtggaatgggtctactgttaacagtggatcccgggtccgggaccgtgctttggactcaggacctaggggtgcctgttatgggcgtctatacttggcatcaagatggcttgcgccagcttccccacctgacactggcacgtgatacactgcacttcctggctctgcggtgggggcatatccgcttgccagcttcaggaccgagggatactgcaactctgtttagtacactggacacccagcttcttatgactctctatgtgggcaaggacgagacagggttctacgtgtctaaggccctcgtccacacaggggttgctctcgtacccagaggcttgacattggccccagccgacggccctacaaccgacgaggtgaccctgcaagttagtggagagagagaggggtctccaagcacagctgtgaggtatccctcgggcagcgtcgccttgccctcccagtggctgctcatcggacaccatgaacttccccccgttctacatacaactatgctacgcgttcacccaaccctgggatccggcacagcagagacacgccctccggaaaacacacaggccccggcctttttcctcgagcagcagccgcaggtcgtggaaaaacagcaggaaacacccttggccccagccgattttgcacatattagccaggatgcccaatctctccactccggggcctctcggcggtcacagaagaggttgcagagtcccagtaaacaagcccagcccctggacgatcctgaagccgagcagctgaccgtggtggggaagatcagctttaatcctaaggacgtgctcgggcgcggcgccggggggacatttgtttttagaggtcagttcgagggccgagcagttgcggtgaagcggttactgcgtgagtgctttggcttggtgcgacgagaagtgcaactgcttcaagagagcgacagacaccccaacgttcttcgctatttttgcactgagagaggcccccagtttcattatattgccctggaactctgtcgggcctccctgcaagagtatgttgaaaatccagaccttgaccgcggcggacttgagcccgaagttgtgcttcagcaacttatgtcaggtctagctcacctccactctctgcatatcgtgcatcgggacctgaagcctggaaacattttgataacaggccctgacagccagggcctgggtcgagttgtcctcagcgatttcggcctgtgcaaaaagctccctgcgggaaggtgttcattctcactgcatagcggaatccctgggacagaagggtggatggctccagagctgttgcagctcctaccaccagactctcctaccagcgcggtcgatattttctctgccggatgcgtgttttactatgtactctctggcggtagccacccgttcggggacagtctctaccggcaggctaacattcttacaggagctccatgcctggcacatcttgaggaagaagtgcatgacaaagtggtggccagagacctggtcggcgccatgctctccccattaccacagccgcggccttctgcgccgcaggtgctggctcatccatttttctggtctagagcaaaacaactgcagttttttcaagatgtgtctgactggctggagaaagaaagcgaacaggagccgttagtgagagcccttgaggcgggaggctgtgctgttgtccgggacaattggcacgagcacatctccatgcctttgcagacagatttgcgcaagttcagatcatataaaggcacaagcgtcagagatcttctgagggccgtgcgcaacaagaaacaccactatcgggagcttcctgtggaggtgagacaggccttaggacaagtaccggatggcttcgtccaatatttcactaatcggtttcctagacttctgctgcacacccatcgtgcaatgcgctcttgcgctagtgagtcactgtttcttccgtactaccctcccgacagtgaagcacgaagaccctgtcctggggccactgggagatag

SEQ ID NO: 115750 - DNA, 354 bp, Artificial Sequence
  Description of Artificial Sequence: Synthetic coding sequence
atgtctcaaaaacaggaagaagagaatcctgctgaggagacgggagaagaaaagcaggacactcaggagaaggagggtattctgcccgagagggccgaagaagcgaagctgaaggccaagtatccctcacttggtcagaaacctggcggcagtgactttctcatgaaaagactgcaaaaaggccaaaaatatttcgatagcggcgattacaatatggcaaaggctaagatgaaaaataaacagctgccctccgccggaccggacaagaatctggtaactggtgaccacattcctacccctcaggacctgccccagaggaaatcgtctctggtcacatcaaagttggcaggctag

SEQ ID NO: 115751 - DNA, 414 bp, Artificial Sequence
  Description of Artificial Sequence: Synthetic coding sequence
atgtcccagaaacaggaggaggagaaccctgccgaggagactggggaagaaaagcaggacactcaggagaaagaaggaattctccccgagagagctgaagaggccaagctaaaagcgaaatatccttcattgggacagaaacccggtggctcagattttctcatgaagcgattgcagaagggtgactataagtctctgcattggtccgtacttttatgcgctgacgagatgcagaagtacttcgattcaggtgactacaacatggccaaggccaaaatgaagaacaagcaactgccgagcgcaggacccgataagaatttagtcacaggcgatcacatacccaccccccaggacctgcctcagaggaaatcctctttggtcactagcaagcttgctggcggccaggtggaatag

SEQ ID NO: 115752 - DNA, 423 bp, Artificial Sequence
  Description of Artificial Sequence: Synthetic coding sequence
atgtcacagaaacaagaagaagaaaatcctgccgaggaaaccggggaggagaagcaagatacgcaggagaaggagggcattttacccgaacgggctgaggaagccaaattgaaggccaagtatccaagtctcggacagaaacccggtggtagtgatttccttatgaaacgactacaaaaaggcgtatggggcattgtcagttaccccctcagccttgagctgaaagaagtgctgagaatgaaatcagtggaacagaaatattttgactctggggattataatatggctaaggctaaaatgaagaataagcagctaccgtctgctggcccagataaaaacctcgtcacaggtgatcacatcccaacccctcaggacttgcctcaaagaaagtccagcctagttacttccaagctcgctggctag

SEQ ID NO: 115753 - DNA, 354 bp, Artificial Sequence
  Description of Artificial Sequence: Synthetic coding sequence
atggcaggtggcttagggtgtgatgtgtgctactggttcgtcgaagacacccaagaaaaggagggtatcctgcccgagagggccgaagaggccaaactgaaggccaagtacccatccctgggtcagaagcctggaggctctgactttttaatgaaacgcctgcaaaaaggccagaaatatttcgattccggtgattataacatggccaaggcgaagatgaaaaataagcagttgccttcagcgggaccagacaagaacttggtcacaggagatcacattccaacccctcaagacctgccccagcgcaagtcatccttggtcacttctaaacttgctggcggtcaggtagaatag

SEQ ID NO: 115754 - DNA, 402 bp, Artificial Sequence
  Description of Artificial Sequence: Synthetic coding sequence
atggcgggcggactcggatgcgatgtgtgttactggttcgtagaggatacccaggaaaaggaaggcattctgcccgaaagggccgaggaggcaaaactgaaggctaaatacccttccctggggcagaaacccggcggaagcgactttctgatgaagcgtcttcagaagggagactacaagagtctccactggagcgtgctgttgtgtgcagacgaaatgcagaagtatttcgatagtggtgactataacatggccaaggccaaaatgaagaataaacaactgccaagcgcaggacccgataaaaatctggtgacgggtgatcacatacctactcctcaggacctgccccagcgaaaatccagcttggtgacctccaagcttgctggcgggcaggtcgagtag

SEQ ID NO: 115755 - DNA, 318 bp, Artificial Sequence
  Description of Artificial Sequence: Synthetic coding sequence
atgagtcagaagcaggaggaggagaatccagccgaggaaactggggaagagaagcaagatactcaggaaaaagagggcatcctcccagagagagctgaagaagccaaactaaaggccaagtacccgtcactcggccagaagccaggcggcagcgacttcctgatgaaaaggttacagaaaggtgtatggggcattgtgtcttatccgttgtccctcgagctgaaggaagtgttgagaatgaagtcagttgaggtcttgctcgaccccttcctggaagtgttactgctcaataggtcacgtggcgagttcgagatctag

SEQ ID NO: 115756 - DNA, 435 bp, Artificial Sequence
  Description of Artificial Sequence: Synthetic coding sequence
atgtctcagaagcaggaagaggagaaccctgctgaggaaacaggagaagagaaacaggatactcaggagaaagaaggtatcttgcccgaacgggccgaggaggccaaactgaaggctaagtaccctagccttggccagaagcccggtggctctgactttctaatgaagaggctgcagaaaggcgtgtggggcatcgtatcatatcctctgagtcttgagctgaaagaggtactgcggatgaagtccgtggaacaaaagtacttcgacagcggcgactacaatatggcaaaggccaagatgaaaaataagcagctgccgtctgccggccccgacaaaaatctagtgacaggcgaccatatcccaacccctcaggaccttccgcaaaggaagagcagcttagtcacatccaaactggccggaggccaggtggaatag

SEQ ID NO: 115757 - DNA, 366 bp, Artificial Sequence
  Description of Artificial Sequence: Synthetic coding sequence
atgtcccagaaacaggaggaagagaaccccgccgaggaaaccggggaggaaaagcaagacacccaggagaaggaggggatcctgccagagagagctgaagaagcgaagctaaaggctaagtaccccagccttgggcaaaaaccaggaggaagcgactttctgatgaagagactgcaaaagggacagaagtactttgattctggcgactacaatatggcaaaggcaaagatgaagaataagcaacttccaagcgccgggcctgacaagaatctggtcacgggcgatcacatacctacgccacaagacctgccccagaggaagtcatcactggttacctcaaagctggcaggcgggcaagtggagtag

SEQ ID NO: 115758 - DNA, 402 bp, Artificial Sequence
  Description of Artificial Sequence: Synthetic coding sequence
atgagtcagaagcaggaggaggagaatcccgccgaggaaacaggcgaagaaaagcaggatacacaggaaaaggagggaatcttgccagagagggctgaggaagccaagttgaaagcaaaatacccatccctgggacagaaacccggaggatctgatttcctcatgaaacggctacagaagggtgactacaagtccttacattggagcgttctgctctgcgccgacgagatgcagaagtatttcgactccggcgactacaacatggcaaaagccaagatgaaaaacaagcaactaccgtctgcagggcctgataaaaacctggtcacaggcgatcacatccctactccgcaggacctcccccagcgaaaatcctctctggtgacatctaagcttgcagggtag

SEQ ID NO: 115759 - DNA, 318 bp, Artificial Sequence
  Description of Artificial Sequence: Synthetic coding sequence
atgtcacagaagcaggaagaagaaaatccggcggaggaaactggcgaagaaaaacaagacacccaggaaaaagaaggaatcctccccgaacgtgccgaagaggcgaagctgaaggccaaatatccaagccttgggcaaaaaccagggggctctgactttctgatgaaacgcctacagaaaggcgtctggggcattgtgagctatcccctgagcctggaactcaaggaggtgctaaggatgaaatccgtggaggttctgttggatcctttccttgaggtgcttctgcttaatcggtccagaggggaatttgaaatctag

SEQ ID NO: 115760 - DNA, 342 bp, Artificial Sequence
  Description of Artificial Sequence: Synthetic coding sequence
atggctggaggcctggggtgtgacgtctgctactggttcgtcgaggacacgcaagagaaagaaggaatcctgcccgagcgggccgaagaagccaaactgaaagctaaatatccaagcctgggccagaaacctgggggaagcgattttctgatgaaacgactccaaaagggccagaagtattttgactctggcgactacaatatggccaaggctaagatgaagaataagcagctgcccagtgccggccccgataaaaacctcgtgactggggaccatattcctacccctcaagatctcccacagcgcaagagttccctcgttacttctaaattggctgggtag

SEQ ID NO: 115761 - DNA, 1173 bp, Artificial Sequence
  Description of Artificial Sequence: Synthetic coding sequence
atgatcagcttgcctggcccattggtgaccaatcttctgagattcctgttcctggggctctccgccttggccccaccaagccgggcacaactccagctgcacctcccagccaaccggcttcaggccgtggaaggaggggaggtcgtgctgccggcatggtacaccctacacggcgaggtttcatcttcgcagccatgggaggttcccttcgtgatgtggttttttaaacagaaggagaaggaagatcaggtcttgagttacataaatggagtgaccacctctaagccgggcgtttcccttgtctactctatgcccagcagaaatctctccctcaggctggagggtctacaggagaaggacagcgggccctattcctgctcagtaaacgtccaagacaaacagggaaagagcagaggacactccattaaaaccttggagctcaacgtgttggttcctccagcgccaccctcctgcaggcttcagggggtccctcatgtaggagctaatgtcacactctcttgtcagagccccagaagcaaacccgctgtccagtatcagtgggaccgacagcttccatcattccagacttttttcgcacctgcacttgacgtgataaggggttccctttctctaactaacttatcgagctctatggcaggggtgtatgtctgtaaagcacataacgaggtcgggactgctcagtgtaacgtcactctcgaggtgtccacaggcccgggtgccgccgtcgtggccggcgccgttgtgggcactctggttggactcggactgctggctggactcgtccttctgtaccaccgcaggggtaaagctctggaagaacccgccaatgatattaaagaggatgccattgccccaagaacgctcccatggccaaagagttccgatacaatctctaaaaatggtaccctctcttctgttacctcagcccgcgcgctacgtcccccacacggtccacccaggcccggggcgctcacgcctactcccagcctgagtagtcaagcactgccgagcccgcgcttacctaccacagacggggctcatccccagcccatcagtccaattccaggaggtgttagttccagcggactgagccgaatgggagctgtacctgttatggtcccggctcagagtcaggcaggatctttggtgtag

SEQ ID NO: 115762 - DNA, 426 bp, Artificial Sequence
  Description of Artificial Sequence: Synthetic coding sequence
atgatttcccttcccggaccgctcgtgactaacctcctacgcttcctgttcctggggttgtctgcccttgacgtcataagaggctcgctctcactcactaacttgagctcatcgatggccggcgtgtacgtgtgcaaggcccacaatgaagtgggcacagctcagtgcaatgtaacccttgaagtgtctacggggccaggggcggccgtcgtggccggagccgtcgttggcactctggtgggtctcggtttgctggccggcctggtcttgttgtaccacagaagaggcaaggcattagaagaacctgcaaacgatattaaggtgcgctcccccctgggcctatcattcagcgcccccaagatggagtggctgtggaaatggcgagatgcgcatttttaccgagattcgtatctgtccaaatggtag

SEQ ID NO: 115763 - DNA, 2613 bp, Artificial Sequence
  Description of Artificial Sequence: Synthetic coding sequence
atgactgccgacaaggagaaaaagagatcttcttccgaacgccgtaaggaaaaaagtcgtgacgccgcgcggtgtagacgaagtaaggaaaccgaggtgttttatgagttagctcacgagctgcctttgccccactccgtcagctcgcatctggacaaagcttcaatcatgcgacttgccatatcctttttacgcactcacaaactgctgtcatccgtatgctcagagaatgaatcagaggccgaagcagaccaacagatggacaacctgtatttaaaggctcttgaagggtttatcgcagtcgtgacccaggacggtgacatgatattcctctcagagaatatcagcaaattcatgggacttacccaagtggagctgacaggccatagcatttttgactttacccacccttgtgaccacgaggagatccgggaaaatctcagcctgaaaaatgggagtgggttcggtaagaagagcaaagatatgtctaccgagcgagatttttttatgcggatgaagtgtactgtcacaaatagggggaggaccgtcaacctgaaatctgcaacatggaaagtgttgcactgcactggccaggtgaaggtctataacaactgtcctccccacaattcgctctgcggttataaggagcctcttttgagctgcctgatcataatgtgcgagcccatacaacatccaagtcatatggacatcccactagactcgaaaacattcctgagcaggcacagtatggacatgaaatttacatactgtgacgaccgcattacagaactgattggataccacccggaggaactgcttggacgctcggcttacgagttttatcacgccctggactccgaaaacatgaccaaaagtcaccagaatctgtgcactaaaggacaggtggttagcggacagtacagaatgctggctaagcatggaggatacgtgtggctagaaacacagggcactgtgatttataatcctcgtaatctccagcctcagtgtataatgtgcgtgaactacgttctctcagagatagagaaaaacgacgtggtattcagtatggatcagactgagtcattatttaaaccccacctgatggctatgaattctatttttgactctagcgggaaaggggctgtgagcgagaagtccaacttcctctttacaaagctcaaggaggaaccagaggagcttgcacagctcgctccgacaccaggggatgccattatttctcttgattttggaaaccagaatttcgaggagagttccgcatacggcaaggctattcttcccccatctcagccttgggcgactgagttgcgcagccactccacacagagcgaggccggttccttgcctgccttcaccgtgccacaggcagcggcccccggaagtactacaccaagcgcgacttcttccagttcatcttgcagcactccaaactctccagaggactattacacctcgctcgataacgatctgaagatagaggtaattgagaaactgtttgccatggataccgaggccaaggaccagtgctcaacccagacagacttcaacgagctggatctggagaccctggccccatacatccctatggatggagaggattttcagcttagccctatctgcccagaagaaagactacttgctgaaaacccccagtccacaccgcagcactgctttagcgccatgaccaacatttttcagccccttgccccagtggcaccacatagccccttcctgctggacaaatttcagcagcagctggaaagtaaaaaaactgagccagagcaccgacctatgtccagtattttttttgacgctggatctaaagcttctcttcccccttgctgtggacaggcatcaactccgctcagctcgatgggtggtcgaagcaatacacaatggcccccagatccccccctacatttcgggcctaccaagtgggccgtgggcgaccaacgcaccgagttcctgggcgcagccccactgggtccacccgtgtcccctccccacgtgtctaccttcaagacgaggtccgctaagggctttggcgcccgaggcccagatgttctgtcacctgcaatggtcgcgctcagcaacaaacttaagttgaaacgacaacttgagtatgaggagcaggcctttcaggatctgtcagggggcgatcctcctggtgggtccacaagccacctgatgtggaagagaatgaagaaccttcgcggcggatcgtgcccactgatgcccgataaaccgttaagcgccaacgtcccaaatgacaaattcacccagaaccctatgagaggactgggccacccactgcggcacctgcccctgccacagccgccatccgccatctcccctggggaaaactctaaatcgaggttcccgccccagtgctatgcgactcagtatcaggactactccctaagctctgcccacaaagttagtggaatggcttctcgcctgttgggccctagcttcgaatcatatctcctgcccgagctgactcgttacgactgtgaagtgaacgtacctgtactgggaagcagtactctcttgcaaggcggggaccttctgcgagccctggaccaagccacctag

SEQ ID NO: 115764 - DNA, 780 bp, Artificial Sequence
  Description of Artificial Sequence: Synthetic coding sequence
atgaccgctgacaaggagaagaaaaggagctcttctgaaaggaggaaagagaaaagtcgggacgcagctcgttgcagaaggagcaaggaaacggaagtcttttacgaactcgcgcacgagctgcccctaccccactcggtgtccagccatctcgacaaggcgtcgataatgcgattggccatttctttcctcaggacccacaaactgctgagctcggtgtgcagcgagaatgagagcgaggccgaagctgaccagcaaatggataatctctacctgaaagccctggagggcttcattgctgtggtgactcaggacggcgacatgatctttctgtccgaaaacatttctaaatttatgggcctaacccaggtggaattaacgggccattccatcttcgattttactcatccttgtgatcacgaggaaattagagagaatctcagcctgaagaacggatctgggtttggtaaaaagagcaaagacatgagcaccgaaagggatttcttcatgagaatgaagtgtacagtgaccaaccgaggcaggacagtgaacctcaaatctgccacttggaaggttttgcactgcaccggacaggttaaggtctataataactgccccccccataactctctgtgtgggtacaaagaacccctgctgtcctgccttatcattatgtgcgaacctatccagcatccttcacacatggacattcctctggatagtaagacgttcttgtctcggcatagcatggatatgaaattcacttattgtgatgactag

SEQ ID NO: 115765 - DNA, 537 bp, Artificial Sequence
  Description of Artificial Sequence: Synthetic coding sequence
atggtgtccgtacccactacatggtgtagtgttgcgttagccctgctcgtcgctcttcacgagggcaagggtcaggcagccgcaaccctcgaacagccagcgtcatctagccatgctcaaggcacacatttacggttgcgccggtgtagctgcagtagttggctggataaggaatgtgtgtatttctgtcacctggacatcatctgggtgaacaccccagagcagacagctccctacgggctgggaaatcctccacggcgcaggcgccggtcgttacctcggcgatgtcagtgctcttcagctagggatcccgcctgtgccacattttgcctgagaagaccgtggacagaagctggtgctgtgcctagccgcaaatccccagcggatgtgttccagacaggtaagaccggagcgacaacaggcgagctcctccagcgcctcagagacatcagcacggtgaagtctctgttcgccaagagacagcaggaagcgatgagggaaccccgcagcacccactccagatggaggaaacgctag

SEQ ID NO: 115766 - DNA, 660 bp, Artificial Sequence
  Description of Artificial Sequence: Synthetic coding sequence
atggagcccgggctgtggctgctctttggcctgactgtgacctccgctgctggctttgtgccatgttcccagagtggagatgcgggtaggagaggagtctcacaggccccaaccgccgctcgttccgagggcgattgtgaggagacagtggccggtcccggagaggagacagtggctggtcctggcgagggcacagtcgcccccactgccctgcaaggaccttcacctgggtcgccagggcaagagcaggcagccgagggcgctcccgagcaccacagatcccgccggtgtacatgtttcacctacaaggataaggagtgcgtgtactactgccacctggatataatctggataaacacccccgagcagacagtcccttatggactcagcaattaccgagggagtttccgcggtaaaagatccgccggtccactgcccggcaatcttcaattatcccatcgcccacatctccgatgtgcctgtgtcggaagatacgataaggcttgtctgcacttctgcacccaaacactggatgtttcttccaatagtaggacagccgagaagactgataaagaggaggaaggcaaggtgagaggagccaaccgagggctctgtcagaggcgcttaaagtctaggacaaataaagcctcccggctgtag

SEQ ID NO: 115767 - DNA, 717 bp, Artificial Sequence
  Description of Artificial Sequence: Synthetic coding sequence
atggagcctggtctgtggcttctctttggcctcacggttacctctgcggctggtttcgtaccctgttcccagtcgggggacgccggaaggagaggcgtgagccaggcgcccactgcagccaggagcgagggcgactgcgaggagacagtcgcagggcccggtgaggaaactgtcgccggccccggggagggcaccgtcgctcccacagctctgcagggaccgagtccaggaagccctgggcaggagcaggcggctgagggagcacccgagcatcaccgaagcagacggtgtacgtgtttcacgtacaaggataaggagtgcgtttactattgccacctggacatcatatggattaatacccccgagcagacggtgccttatggcctgtccaactatagaggctcttttaggggaaagcgtagcgcaggtccgctgccgggaaatttacagctcagtcaccgcccgcacctgagatgcgcttgtgtcggacgttatgacaaggcgtgcctccatttttgcactcagacccttgatgtttcctccaattcacgaacagctgaaaaaaccgataaagaggaggagggcaaggtggaggtcaaggatcaacaatcaaagcaggctctcgatttacatcatccaaagctgatgcccgggtccggtctggccctcgctccatcaacttgtccacgctgcttattccaagagggcgcaccatag

SEQ ID NO: 115768 - DNA, 579 bp, Artificial Sequence
  Description of Artificial Sequence: Synthetic coding sequence
atggagccaggactttggctgctgttcggactgacagtgacatcggcggctggcttcgtgccttgtagccagtcaggagacgccgggaggagaggggtgagccaggcaccaaccgccgcccgaagcgagggagactgcgaggagacagtagctggcccgggggaagaaacagtggccggccccggcgaggggaccgtcgcccctaccgctttgcagggcccctcccctggctcgccaggtcaggagcaggctgccgagggcgctccggagcatcatcggagtcgtcgatgcacatgcttcacttacaaagataaggagtgcgtgtactactgccacttggatattatctggatcaacacccctgagcagacggtgccctatggtctgtccaattaccggggatctttccgaggtaagagaagcgccggtccacttccaggcaacctgcagttatcccacagaccccatctgcggtgtgcttgtgtaggccggtatgataaagcttgcttacatttttgtactcaaactctggatgtgagccggcttaaaagccggactaacaaagcctctaggctatag

SEQ ID NO: 115769 - DNA, 717 bp, Artificial Sequence
  Description of Artificial Sequence: Synthetic coding sequence
atggagcccgggctgtggctgctattcggcctgacggttacttcggctgccgggttcgtgccctgctctcagtctggagatgcaggccggcgcggcgttagccaggccccgactgctgccagatctgagggggactgcgaggaaacagttgcagggccaggggaggaaaccgtggcgggtccaggcgaaggaacggtggccccaactgccctccagggcccatctcccggatcgccaggacaggagcaagccgccgagggcgctcccgagcaccacaggtctcggcggtgcacatgttttacctataaagacaaggaatgtgtttattattgccaccttgacatcatctggattaacactccagagcagacagtaccatacggtttatccaattaccgcgggtcatttcgcggtaagcggtcagccggtcccctgcctggtaaccttcagctatctcaccggccccatctccgatgcgcctgcgtggggaggtatgacaaggcttgtctacatttttgcacccagacgctggatgtctctagcaatagtcggactgccgagaagactgacaaagaggaggagggaaaggttgaggttaaagatcaacagagcaagcaagctttggacctccaccatccaaagctgatgccgggctctggccttgcccttgccccttccacgtgtccccggtgcttattccaggagggcgcgccatag

SEQ ID NO: 115770 - DNA, 675 bp, Artificial Sequence
  Description of Artificial Sequence: Synthetic coding sequence
atggaacccggcttgtggctgctttttgggctaactgtgaccagcgcagctggattcgtgccgtgttcccagtccggggacgccggacggcgcggagtgagccaggcaccgaccgctgctcgaagcgaaggggattgcgaggagacagtggccgggccgggtgaggagacggtggctggccctggagaaggcaccgtggcccctaccgccctgcaggggcccagccccgggtctcccggacaggagcaggcagctgaaggtgccccagaacatcaccgatctcgtaggtgcacgtgcttcacctataaggataaagagtgtgtgtactattgccatttagacataatttggatcaacaccccagaacagacagttccatatggcctcagcaattaccgtggaagcttcagagggaagaggtcagccggtccccttccaggcaacttacagttaagccataggccacatctcaggtgtgcgtgcgtgggcagatatgataaggcctgtctgcacttttgcacgcagactctggatgtgtctaggcaggtggaagtgaaggaccaacagtcgaagcaagcactggatctacaccatcctaagctgatgcccggttcaggcctggccctggcaccctccacctgcccaaggtgtctgtttcaggaaggggccccctag

SEQ ID NO: 115771 - DNA, 2304 bp, Artificial Sequence
  Description of Artificial Sequence: Synthetic coding sequence
atggaagcactccgagaaagtgtgctgcacctggctctgcaaatgagcacttacaagagagcgacacttgatgaagaagacctcgttgattctttgagtgaaggagacgcttaccctaacgggctccaggttaatttccatagtccccgcagtggtcaacgctgctgggcagcacggacacaggtggagaaacgtctagtggtgctggttgtactccttgccgccggcctcgtcgcttgtctggctgcgctcggcattcagtatcagacacgctcacccagtgtgtgcttgagcgaggcctgcgtctctgtgacttcttcaatcctctcctctatggacccaacagtggatccgtgtcacgacttcttctcatatgcctgcggagggtggattaaggccaatcccgtcccagatggacacagccggtggggaaccttttcgaatctgtgggaacataatcaggccattatcaaacacctgctcgaaaatagcaccgcgtctgttagcgaagctgaacgaaaggcgcaggtctattaccgcgcttgcatgaatgagacaaggattgaagagctccgggccaagcccctaatggagctcatcgaacgcttgggaggatggaacataactggcccatgggccaaagacaactttcaggacactctccaagtggttacagcacattaccgcacaagcccttttttcagcgtgtatgtcagcgccgatagcaagaactctaactctaacgtcatccaggtggaccagtccggcctggggctccccagcagggattactacctgaataaaacggaaaatgagaaggttctgacaggctacctaaactatatggtccagctcggaaaactcctgggaggcggggacgaggaggccatcagaccacagatgcagcagattctagactttgagaccgctctcgccaacatcacaatccctcaggagaagcgccgtgacgaggagctgatttaccacaaagttacggccgctgagctgcagacactggcacccgccatcaactggctgccgtttctcaacactatcttctaccctgtggagattaatgagagtgagccgatcgtagtgtacgataaggaatacctggagcagatctccacacttatcaacaccacggatcgttgcctcctcaataattatatgatatggaatcttgtgaggaaaacctcaagcttcctggaccagcgcttccaggatgctgatgaaaagttcatggaggtgatgtatggcactaagaagacctgcctcccccgctggaaattctgcgtcagtgacaccgagaataatctaggcttcgccttgggccccatgttcgtgaaggctacttttgccgaagatagcaagagtatagcaaccgaaatcattctggaaatcaagaaagcgtttgaagaaagtctgtctacactcaaatggatggacgaagagacccgtaaaagcgcaaaagagaaagccgatgccatctacaacatgatcggttatcccaattttatcatggatccaaaagaactggataaagtgttcaatgattatacagccgtgcccgacttatattttgaaaatgcaatgcgcttctttaatttctcctggcgggttacagccgatcagctgagaaaagctcccaaccgggaccaatggtccatgactccacccatggtcaacgcttactactcaccgactaagaacgaaatcgtttttcccgcaggaatcttacaagccccattctacacccggagttcacccaaggctcttaactttggaggcatcggcgtcgtggtgggccacgaacttacacacgctttcgacgaccaaggacgcgagtacgacaaggacgggaacctgcggccctggtggaagaacagtagtgtggaagcatttaagcggcaaactgagtgcatggtggaacagtactcaaattatagcgtgaacggtgagccggtgaacgggagacataccctgggtgaaaacattgctgacaacgggggcctcaaggcagcatatcgcgcgtaccagaattgggtgaagaagaacggggcagaacacagtctacccactctgggactcactaataatcagctgtttttcctgggcttcgcccaggtttggtgttctgttcggacaccagaaagtagtcacgagggcctgattaccgacccgcactccccatcacggttccgagtgattggatctctcagcaattctaaggaattttccgagcatttccggtgtccccccggctcccccatgaacccaccccataagtgcgaggtatggtag

SEQ ID NO: 115772 - DNA, 2277 bp, Artificial Sequence
  Description of Artificial Sequence: Synthetic coding sequence
atgcctctgcagggcctgggtctgcagcgcaatcctttcctccaagggaagagaggacccggcctaactagctcacctcctcttctgccgccatccttacaggtgaacttccattcacctaggagtgggcagagatgctgggcagccaggactcaggtggagaaaaggctagtcgtgctcgtggtgttactcgccgccgggttggttgcatgtctcgcagccctagggatacagtatcagacccggtccccatctgtttgcctctctgaggcctgcgtgtcagtaacatctagcatcctaagttccatggacccaaccgtggatccctgtcacgactttttttcatacgcatgcgggggctggattaaggcgaaccccgtgcctgatgggcactcaagatgggggacattttctaatctgtgggagcataaccaggccattataaagcatctccttgagaacagcacagcgagtgtttcagaggcagaaagaaaagctcaagtctactatcgagcttgcatgaatgagacccgcattgaggagctcagggccaaaccccttatggaactaatcgagcgtcttggcggatggaacatcaccggcccctgggctaaggataacttccaggacacgctgcaggtagtgactgcccactatcgcacctctcccttctttagcgtgtacgtaagcgccgacagcaagaactcaaacagcaacgttatccaagtagatcagagtggcctcggcctgccatctcgcgattactacctcaacaagactgaaaacgaaaaggtcctaactggctatttaaattacatggtccagctgggcaagttgttgggcggaggcgatgaagaagcaatcaggcctcagatgcagcagattctcgactttgagaccgcccttgccaatattactataccacaggagaaacgacgagacgaggagcttatctatcacaaggtaaccgcggctgaattacaaacactcgcaccagctattaattggttaccttttctaaacacaatcttttacccagtggaaatcaacgaatccgaaccgatagtagtgtacgataaggaatatctggaacagattagtacgctgatcaatactaccgaccgatgtttactaaataactatatgatttggaacctcgttaggaagaccagctcatttctggaccagcgatttcaggatgctgatgaaaaattcatggaggttatgtatggcactaagaaaacctgcctcccccggtggaagttttgcgtgagcgatacagagaataatttgggcttcgccctgggcccaatgttcgttaaagccaccttcgcagaggatagcaaatcgatagccactgagattattctcgagattaaaaaagcatttgaagaaagtctatctacactgaagtggatggatgaggaaactcgtaagagcgccaaagagaaggcagatgccatttataatatgattggttaccccaatttcattatggaccccaaggaactggacaaagtgttcaacgactacaccgccgtgccagacctatattttgagaatgccatgcgcttcttcaacttttcctggcgcgtcaccgctgaccagttaagaaaagcacccaatcgagatcagtggtctatgactcctccaatggtgaatgcttattactctcctactaaaaacgaaatcgtattccctgctgggatactccaggcacctttttataccaggtcaagtccaaaggcactcaactttggcggaataggcgttgtggtgggacatgaattaacacatgccttcgacgaccagggtcgcgagtacgataaggacgggaatctcagaccatggtggaaaaattcgtcagttgaagccttcaaacgccagaccgagtgcatggtggaacagtattctaactattccgttaacggcgagcctgtgaatgggcgccacacactgggagagaatattgctgacaatggaggccttaaagcggcctatagggcatatcagaactgggtcaagaaaaacggggctgaacactcgctgcccaccctgggattgaccaacaaccagctgtttttcctagggtttgcccaggtatggtgttcagtgaggactcctgagagcagccacgaaggcttgataaccgatccccattccccttcgaggttccgtgtgataggatctctatcaaattccaaagagttttcagagcatttcaggtgccctcctgggagcccaatgaatcctccccacaagtgtgaggtgtggtag

SEQ ID NO: 115773 - DNA, 2313 bp, Artificial Sequence
  Description of Artificial Sequence: Synthetic coding sequence
atgcgaggcgtgtggcctcctccagtgtccgccttgctcagtgctctgggaatgtcgacctataagcgggccactctggacgaggaggacctggtggattcgctgtctgaaggtgacgcttaccctaacggtctgcaggtgaatttccacagtccaaggagtggccagcggtgttgggctgcaagaacacaggtcgagaagcggttagtggtgttggtggtgctgcttgccgctggcctcgttgcttgcctagccgcgctgggcatacaataccagaccaggagccccagcgtgtgtctgtccgaagcgtgcgtctccgtgacgtctagcatcttatcctccatggatccaaccgtagacccatgccacgacttcttcagttatgcctgtggaggttggatcaaagcgaatcccgtacccgacggccactcacgctggggcaccttttctaacctatgggaacacaaccaggctataatcaagcacctgctagaaaactccacagccagtgtttcagaggcagagcggaaggctcaggtttactaccgggcctgcatgaacgagactcggatcgaagaacttcgagccaaacccctgatggagctgatagagagattggggggctggaacatcacgggcccctgggcaaaggataactttcaagataccctccaggttgtaaccgcacactatcggactagccccttcttcagtgtttacgtgtctgctgacagtaagaattcgaacagtaacgtgattcaggtcgaccagagcggtctcggactccccagccgcgattattatctcaacaaaactgaaaacgagaaggttctgaccggatatctcaactacatggtgcagctgggaaagctgttgggtggaggggacgaggaggctatacgtccccagatgcagcagatattagattttgagacagcactcgccaacatcacaattcctcaagagaaaaggagagatgaggagttaatctaccataaagtgacggcagcggagctccagacactggcacccgcaatcaactggctccctttcctaaacactatcttttaccccgtcgagatcaacgagtcagagcccatcgttgtatacgacaaagagtatctggaacaaatcagtaccctcataaatacaactgatcggtgcctgctgaacaattatatgatttggaatctggtgcgaaaaacatccagcttcctggatcagcggtttcaagacgcagacgaaaaatttatggaggtgatgtatgggactaagaagacttgcttgcctcgttggaagttttgcgtgtcagatactgagaacaatcttggatttgccctggggcctatgtttgtcaaggccacgtttgctgaagattccaagtccatcgctacagagatcattctggagatcaaaaaagcctttgaggaaagtctctccacgctgaagtggatggacgaggagaccagaaaatctgctaaggagaaagccgatgccatctataatatgattgggtacccaaacttcattatggatcccaaagaactagacaaggtattcaatgattacacagccgttcctgacttgtattttgaaaatgcgatgagattttttaactttagttggcgagtgactgcagaccaactgcgcaaggctccgaacagagaccagtggtcaatgaccccccccatggtgaacgcatactactcgccgactaagaacgaaatcgtttttcctgccggaatcctgcaggctcctttttacacaagatcctcccccaaagccctgaattttggcggcattggcgtggttgtaggtcacgaactgacgcacgcattcgatgaccaggggcgcgagtacgataaggacggcaacttaagaccttggtggaaaaacagctctgtcgaggccttcaaacgacagacagagtgcatggtcgagcagtattccaactactccgtcaacggggaaccagtcaatggcagacacacacttggagagaacatcgcagataacggtggtctaaaggctgcatatcgcgcttatcagaactgggtcaaaaagaatggtgctgagcactctctgcccaccctgggactgacaaacaatcagctattcttcctgggttttgcgcaggtgtggtgtagcgtgaggacccccgaatcatcgcacgagggactgatcacagatccgcatagtccctctagattccgcgttataggttcgctctccaatagtaaggagttttcggagcacttccggtgtccgcccggttcacccatgaatcccccccacaagtgcgaagtgtggtag

SEQ ID NO: 115774 - DNA, 2265 bp, Artificial Sequence
  Description of Artificial Sequence: Synthetic coding sequence
atgatgtcaacctacaaacgagcgaccttggacgaggaagatcttgtagactccctgagcgagggagacgcctaccccaacggactccaggtgaacttccactctcctaggtccggacagaggtgctgggccgcgcgcactcaagtggagaagcggctggtggtcctggtagtgctgctcgctgctgggctggttgcatgcttagcggccttgggcattcagtaccagacccgtagcccctcggtgtgtctgtccgaggcatgcgtgtcagttacctcatccattctgagctctatggatccaaccgtagacccatgccatgatttcttctcttatgcctgtggtggctggatcaaggccaatccggtgcccgacggacactctcgctgggggacatttagcaatctatgggaacacaaccaggccattataaaacatctgctcgaaaactctaccgcgtctgtgtctgaagccgaacgcaaggcccaggtgtactaccgggcctgcatgaatgaaactcgtattgaagaactcagggcaaagcccctaatggagctgatcgaacggcttgggggctggaatatcaccggaccatgggccaaggataatttccaggacacactgcaagtggtaactgctcattaccggacttcgccatttttctccgtctatgtgtccgccgacagtaagaatagtaatagcaacgttatccaggtggaccagtcgggtctgggactgccatcgagggattactatctgaacaaaactgaaaacgaaaaggtccttacagggtacttaaactatatggtccagctgggaaaactcctggggggtggtgatgaagaagctattaggccccagatgcaacagatcttagattttgaaaccgctctggccaatattaccattcctcaagagaagagaagagacgaggaacttatctaccacaaggtgacagccgcagaactgcagactctggcaccggcgataaactggctcccctttttgaacacaatattctacccggtggagatcaacgagagtgaacccattgtggtttacgataaggagtatttagagcagatttcaaccctgattaacactacagaccgatgcttgctgaacaactatatgatctggaatctcgtgcgcaaaacctccagcttcctggaccagcgttttcaggacgctgatgagaagttcatggaggtcatgtacggtacaaaaaagacatgcctgccacggtggaaattttgtgtgtccgacaccgagaataacctcggcttcgctctggggccgatgttcgtgaaagccacttttgctgaggacagtaagtctatcgcgactgaaattatactggagatcaagaaggcgttcgaggaatcgctctccacgcttaagtggatggatgaggaaactcgcaagagcgctaaagaaaaagccgacgctatctataatatgataggctatcccaactttattatggaccccaaagagttggataaagtctttaacgactacacagctgtccctgacctgtatttcgagaacgccatgcggttttttaacttctcatggcgcgtaacagccgatcaattaagaaaggctcccaatcgagatcagtggagtatgactcccccaatggtgaacgcctactactctccaacaaagaacgaaattgtcttcccagcagggatcctacaagctccattctacacccgatcttcacctaaggcactgaatttcggcggcattggggtggtggtcggacatgaacttactcatgcttttgatgaccaaggtagggagtacgacaaggatggcaatctaagaccgtggtggaagaactcctccgtcgaagcttttaagaggcagactgagtgcatggttgagcagtacagtaactactctgtgaacggagaaccagtgaatggccgccacacccttggcgaaaatattgccgacaatggtggtcttaaagcggcctatagagcctatcagaattgggttaagaagaacggggctgaacacagtctccctaccctcggactgactaacaaccagctgtttttccttgggtttgctcaggtatggtgcagcgtgaggacccctgaatctagccacgagggattgatcacggaccctcatagcccaagccggttccgggtgataggctccctgtctaatagcaaggaattctctgagcatttccgatgtccaccagggagccctatgaaccctcctcacaagtgtgaagtctggtag

SEQ ID NO: 115775 - DNA, 2217 bp, Artificial Sequence
  Description of Artificial Sequence: Synthetic coding sequence
atgaggggagtgtggccccctcccgtcagcgctctcctgagcgccctgggcatgtccacctacaagagggcgaccctggacgaggaagacttagtggacagtctgagcgaaggcgacgcctaccctaacggtcttcaggttaatttccacagtccacggagtggtcagaggtgctgggcagccagaacccaggtggagaaacgattagtggtcctggtagtgctactggccgccggcttggtggcttgcctggcggccttaggaatacaataccagacgcgatcacctagcgtgtgcctgtccgaagcttgcgtttccgtcacatctagtatcctgagcagcatggaccccacagtagatccatgtcacgactttttctcctacgcctgcggaggatggatcaaggccaatccagtccccgacgggcactcacggtgggggactttctctaatctctgggaacataaccaggctatcatcaaacatctgctggaaaactctacagcatcagtctccgaggccgagagaaaggcacaggtctattaccgcgcctgtatgaacgaaaccaggatcgaggagctgagggctaaacctctgatggaattaattgagcggctcggggggtggaacatcaccggaccatgggctaaagataactttcaggataccctccaggtcgtgacagcccactatcgaaccagcccgtttttctctgtttacgtgtctgcagattcaaaaaattccaattctaacgttattcaggttgatcaaagtggcttggggctgcctagcagggactactacttgaacaagacagagaatgagaaagtactaaccgggtacctcaactacatggtgcaactagggaaattgctgggaggtggagacgaggaggctattaggcctcagatgcagcagatcttggacttcgaaacagcacttgctaatattacgattccacaggagaagcggcgcgacgaagagctgatttatcataaggtgacagccgctgagctgcagacccttgctccagcaatcaattggctaccttttttgaatacaatcttttatccagtggagataaatgaaagcgagcccatcgtggtgtacgacaaggagtatctggagcagatctctactctgatcaacaccactgatcggtgtctgctgaataactatatgatctggaacttggtgcggaagacctcatcatttctcgatcagaggtttcaggacgccgacgaaaagttcatggaagtgatgtacgggaccaagaagacttgtttacctcggtggaaattttgtgtcagcgatacagaaaataatctgggcttcgctctagggcctatgttcgtaaaagctacattcgctgaagatagcaaatcaatcgccaccgagatcatcctggaaatcaaaaaggcttttgaagagtccctaagtactctgaagtggatggacgaggaaacccggaagagtgccaaagagaaagctgatgcaatctataacatgatcgggtatcccaattttatcatggaccctaaagagttggacaaggtatttaatgattatactgcggtgcccgatttgtacttcgaaaacgccatgcggttttttaatttctcttggagagtgacagcggaccaactgcggaaggccccgaatcgggatcagtggtccatgaccccacctatggtgaacgcctactattcacccacaaagaacgaaattgtgttcccagctgggattctgcaagctcccttctatacacggtcttctcctaaggcactcaattttgggggtattggcgtggtggtagggcacgaactgacacacgcatttgacgatcagggcagggaatatgataaggacggaaacttgcggccttggtggaagaattcgtctgtagaggcctttaagcgccagactgaatgtatggtcgagcagtattccaattattcagtaaacggcgaaccagtgaacggaaggcatacactcggtgagaacatagctgacaatgggggattgaaagccgcctaccgagtgtggtgcagcgttcgcacccccgagtcgagtcatgaggggctcatcacagacccacattctcctagccggtttcgggttattgggtcacttagtaattctaaagagttctcagaacacttcagatgtccacctggttcccccatgaacccaccccacaagtgtgaagtttggtag

SEQ ID NO: 115776 - DNA, 2328 bp, Artificial Sequence
  Description of Artificial Sequence: Synthetic coding sequence
atggaacccccgtattctctgaccgctcactacgacgaattccaagaggtgaagtacgtatcaagatgcggggccgggggagcccgcggcgcctcccttccgcctggtttcccgctgggggccgcccggtcagccactggagctcgttccggtcttcctcggtggaaccggagagaggtgtgcctcctgagtggattggtctttgccgccggattatgcgcaattctggcggccatgctggccttaaagtatctaggacccgtcgctgccggtgggggcgcatgccccgagggttgtcccgaaaggaaagcgttcgcgcgtgctgcacgattcctggctgctaatctggacgcatctatagatccgtgtcaagatttctactcctttgcatgcgggggctggctgaggaggcacgccattcccgatgacaaactcacatacggtaccatcgctgcgattggggaacagaatgaagaacggcttaggaggttgctcgcccgaccaggaggcggcccgggtggtgccgcacaacgcaaagtccgcgccttttttcgtagctgtctggacatgagagagatagagcgcctcgggcccagaccaatgctggaggtcatcgaggactgcgggggctgggaccttggcggcgctgaagaacggcccggcgtagctgcgcgatgggatctgaatagactgctgtacaaggcacagggcgtgtactctgcagccgccctattcagcctaaccgtctcactggacgacaggaattcctcccgctacgtaattagaattgatcaggacggtctaacactccctgaaaggacgttatatctcgcacaggacgaggactccgagaagatcttggccgcctaccgcgtgttcatggagagggtcctgagcctgcttggagccgatgccgtggaacagaaagctcaggagatcctgcaagtggagcagcaactcgcaaacattactgtcagtgagcacgacgatctccgcagagacgttagttccatgtacaataaggtgacactgggccaactgcaaaaaatcacgccgcatctgaggtggaaatggctactggatcagatctttcaagaagacttcagtgaggaagaggaagtggttctgctggcaacagactatatgcagcaagtgagtcagctgattcgttctacccctcaccgagtccttcacaactacctagtctggcgggtggtagtagtgctgtcagaacatcttagtcctccatttcgggaggccttacacgaacttgcacaagaaatggagggcagcgacaagccgcaggaactcgcccgcgtttgcctggggcaggccaaccgacattttggaatggcgctgggtgccttgtttgtgcatgagcatttctcagcagcttccaaagcgaaggtccagcagcttgtcgaagacattaagtatatcctgggtcagagactggaagaacttgactggatggatgcagaaacaagggccgccgcgcgtgccaaactgcagtacatgatggtgatggtgggctaccccgattttttacttaaacctgacgccgtcgataaggagtacgaattcgaggtgcatgagaaaacatatttcaaaaatatcctgaactctattcgattttccattcaactgtccgtgaaaaagattcgacaagaggtggataagtccacgtggctcctgcctccccaagcactgaacgcctactatctccctaacaaaaatcaaatggtgttccccgcaggcattttgcaaccaacattgtatgaccctgactttccgcaatctctgaattatggtgggatcgggacgataatcggccacgaactcacccacggctacgacgactggggaggccaatacgaccggtccgggaatctgctgcactggtggactgaagccagctactcacggtttctacgcaaggctgagtgtatcgtgagactgtacgacaatttcacagtttataatcagagagtcaatgggaaacacacactcggagagaatatcgcagacatgggcggccttaaattagcctatcacgcttaccagaagtgggtccgggaacacggccctgagcatcctcttccccgactgaaatacacccatgatcagttgttcttcatagcattcgcgcaaaattggtgcattaagaggcgctcgcaaagcatttatcttcaagtgctgacggacaaacacgctccagagcattaccgcgttctgggatcagtgtcccagttcgaagagtttggacgagcctttcactgccctaaagatagccctatgaaccccgctcacaagtgttctgtctggtag

SEQ ID NO: 115777 - DNA, 2322 bp, Artificial Sequence
  Description of Artificial Sequence: Synthetic coding sequence
atggaacccccttattcactcaccgcccactacgacgagttccaggaagtcaagtacgtgtcgcgctgcggggccggcggggctcggggagcaagtctccctccggggttccccctcggcgccgccagatccgcaaccggtgctaggtctgggctgccgagatggaaccgccgtgaggtgtgtctcctgtccggactcgttttcgcagcagggctttgcgcgatcctggccgctatgctcgccctgaaatatcttggcccagttgccgcggggggtggggcatgccccgagggatgtcctgaaagaaaagccttcgcacgcgcagcgcggtttctcgccgcaaatctggacgccagcattgatccgtgccaagacttttactcttttgcctgcgggggttggctgcggcggcacgcaatccctgacgataagctcacctacggcaccattgcagccatcggtgagcagaacgaagagcggctcaggagattactagcccgcccgggaggagggccgggaggtgccgcccagaggaaggtgcgagcattcttcagatcttgtttagacatgagggaaatagagcgacttggacctagaccgatgctggaagtgattgaagattgtggcgggtgggacttagggggcgctgaggaacggccgggagtagccgcccggtgggatcttaaccgactcctgtacaaggcccagggggtgtattcggccgccgccctcttcagccttactgtctccctggacgatcgaaattcctcccgatatgtgattcgtatcgatcaggacggcctcactctaccagaacgcacactgtatttggcacaggatgaagattcagaaaagatcctcgccgcctatcgggtgttcatggagcgggtcctgtccttgctgggggccgacgctgtagagcagaaggcacaagaaattttacaagtggagcagcagctggctaacataacagtgtctgagcacgatgacctgcgccgggatgtttcaagtatgtataacaaagtgacactcgggcagctccaaaaaataacgccccacttacgctggaagtggctgctggatcaaatttttcaggaggatttttctgaggaggaagaggtcgtattactcgctacagattacatgcagcaggtttcccaactcattaggtccactcctcatcgggttctgcacaactacctcgtgtggcgggtcgttgtggttttatcggaacacctttcaccacctttccgtgaagccctgcacgagctagcgcaggaaatggaggggagcgacaagccccaggaactggcccgggtgtgccttgggcaggccaatcgccactttggcatggctctgggtgcacttttcgtacacgaacacttctccgcagccagcaaggcaaaagtccagcagctggtcgaggacatcaaatacattctgggccagcggctggaagagttggactggatggacgctgaaactagggcggccgccagggcaaagctgcagtacatgatggttatggtcggctaccctgacttcctgctcaagcctgatgccgtcgataaagagtacgagttcgaagtgcacgaaaagacctatttcaaaaacatcttaaacagcatacggtttagcattcagctttcagtgaagaagatcagacaggaggtggacaagtggcttctgccaccacaggctctgaatgcgtattacctccccaacaaaaatcagatggtgtttccggcgggtatccttcagcctacactctacgatcctgacttccctcagagcttgaattacgggggaattggaacgattatagggcatgagttgacacacggttacgacgactggggcgggcagtacgatcgcagcgggaatttactacactggtggacagaggcgtcttactctcgcttccttaggaaagccgagtgtatcgtccggttgtatgacaactttactgtgtataaccagagagttaatggcaagcacaccttgggcgaaaacattgccgatatgggcggtctcaagcttgcttaccacgcttatcagaagtgggttcgcgaacatggaccggaacatcccctccctcggctcaagtacactcatgaccaactgttcttcatagcatttgcacagaactggtgcataaaaaggcgatcccagtctatatatcttcaggtactcactgacaagcacgcccccgaacattatcgtgttttgggtagcgtcagccaatttgaagaatttgggagagcgttccattgccccaaagattcgccaatgaatcccgcacataaatgttcagtttggtag

SEQ ID NO: 115778 - DNA, 1284 bp, Artificial Sequence
  Description of Artificial Sequence: Synthetic coding sequence
atggagaccctctgtttgcgagcatctttttggcttgccttggtagggtgtgttatctccgacaaccccgagaggtattccacaaacctttcgaaccatgtcgatgattttacgacgttccggggcacggaactaagctttctggttacaactcatcagcctactaatcttgtcttaccatccaatggatcaatgcataactattgccctcagcaaaccaaaattacttccgcttttaagtacatcaataccgtgatatcatgtacaatctttattgtcggtatggtgggaaatgcaaccctgctgagaatcatatatcagaataaatgcatgcggaatggccctaacgccctgattgcctccctggcccttggcgacctgatctacgtcgttattgaccttccaattaatgtcttcaaactcctagctggccgctggcctttcgaccacaatgacttcggcgtgttcctctgcaagctttttcccttcctgcaaaaatcaagcgtgggcattactgtcctgaacttatgtgccctcagtgtggaccgataccgggcggtggcgtcctggagtagggtacagggtattgggattcccttagtcactgcaattgagattgtcagcatttggatactgtcctttatcctggctatccctgaggccattggcttcgtgatggtgccctttgaatatcgcggcgagcagcacaagacatgcatgctcaatgccacctcaaaatttatggagttctaccaggatgtcaaagattggtggctttttggcttctacttttgcatgcccctcgtctgtacggcaatcttctacactctgatgacatgtgagatgctgaacaggagaaacggatctttgaggatcgctttgtctgaacacctgaaacagcgtagggaagtagccaagacagttttctgcctggttgtaattttcgccttgtgctggtttcccctccacctcagcagaattctgaagaaaactgtgtacaatgagatggacaagaacaggtgtgagctgctgtcctttcttttactgatggattatatcggtataaatctagcaaccatgaactcctgcatcaatcccatcgctctgtacttcgtgagcaagaaattcaagaattgcttccaaagctgcctgtgctgctgctgttatcagagcaagtctctgatgaccagcgtgcctatgaatggcacttcaatccagtggaagaatcacgaccagaataatcataacacagacagatcctcacacaaagattctatgaactag

SEQ ID NO: 115779 - DNA, 486 bp, Artificial Sequence
  Description of Artificial Sequence: Synthetic coding sequence
atggaaacactatgtctacgagcatctttttggttggccctcgtaggctgcgtgatctcagataaccccgaacgctactcaacaaacctatcaaaccacgtcgacgacttcacaacctttagaggaaccgagctcagcttcctggttactacccaccagcccacgaatctcgtgctaccttccaacggcagtatgcataattattgtccccaacagaccaagatcacttctgcgtttaaatatatcaacaccgtgatttcctgcacaatcttcattgtgggtatggtggggaacgctaccctcctccggatcatctaccagaataagtgtatgcggaatgggcccaatgccctgattgcatctctggctctaggtgacctcatatatgtagtcatagatctgcccataaatgtgtttaaagtgcagtcaagttgtcttctggagtcgtgctcaggcaactgggactctttcggaaactgtcattag

SEQ ID NO: 115780 - DNA, 957 bp, Artificial Sequence
  Description of Artificial Sequence: Synthetic coding sequence
atggagacactgtgcctgagggccagcttctggctcgccctggtgggttgcgtgatttccgacaatcctgagagatatagcacaaacctctccaatcatgtggatgattttactaccttcagaggaactgagctgagctttctagtgactacgcatcagcctaccaaccttgtcttgccgtctaatgggtctatgcacaactactgcccacagcaaacaaagattacgtctgcattcaaatatatcaataccgttatttcatgcaccatatttatcgtaggtatggtgggcaatgccactttactccgtattatctaccagaacaagtgtatgaggaacgggcccaacgccctgatagcttccctcgccctgggtgatttaatctacgtggtgatagatctgcccatcaacgtatttaagttctatcaggatgtgaaggattggtggctgtttggcttttatttctgtatgcccttggtgtgtactgctatattctataccctgatgacgtgcgaaatgttgaacaggagaaatggatcccttaggattgccttatccgaacatctgaagcagaggcgagaggttgccaagacagtgttttgcctggtggtcatctttgcactctgctggttcccgctgcatttgtccagaatcctgaaaaagactgtttataatgagatggacaagaatcggtgcgaactgttatcattcctgttgctgatggattatataggaattaacttagctacaatgaactcttgcattaacccaatcgcgctctattttgtcagcaagaaattcaagaattgtttccagtcctgtctctgctgctgctgctaccagtcaaaaagcctcatgacaagcgttccgatgaatggaacttcaatccagtggaaaaatcacgatcaaaacaaccacaataccgataggtcgtctcacaaggatagcatgaactag

SEQ ID NO: 115781 - DNA, 564 bp, Artificial Sequence
  Description of Artificial Sequence: Synthetic coding sequence
atggaaaccttgtgtttgcgagcctccttctggttggccctggtggggtgcgtgatctccgacaaccccgagagatactccaccaatttaagcaaccatgtggatgactttaccactttccgcggtacagagctcagcttcctcgtcaccactcaccagccaactaacctggtgctgccttccaatggctctatgcataattattgcccacagcaaacaaaaataacaagcgctttcaagtacatcaatactgtcatctcttgcactatttttattgttggcatggtgggcaacgcaacattgctccggattatctatcagaacaagtgcatgagaaatgggcccaacgccctcatcgccagcctcgccctgggcgatttgatctacgttgtgatagacctcccaattaacgtattcaagttattggccggaagatggcctttcgatcataacgacttcggtgtgttcctgtgcaaactattcccttttttacagaagtcaagcgtgggtattaccgttttgaacctttgtgctctgtcagtggaccgtaagactgagatgtag

SEQ ID NO: 115782 - DNA, 957 bp, Artificial Sequence
  Description of Artificial Sequence: Synthetic coding sequence
atggaaacgctgtgtctgcgcgcgagcttctggctggccctcgttggttgcgtcatttcagacaacccagagagatactctactaatttgagcaaccacgtggacgactttaccacttttcgcggaactgagctgtcctttctggtcacgacacaccagccaactaacctggtgctaccttcaaatgggagtatgcacaattactgtccccagcagactaagatcacctccgcattcaaatatataaacaccgtaatcagctgtactatcttcattgtggggatggttggaaacgccaccctgctaagaattatctatcagaacaaatgtatgcggaacgggccaaatgctctgattgcttctctcgctctcggagatcttatatatgttgttatagacctcccgatcaatgtttttaagttttaccaggacgtcaaggactggtggcttttcggattttacttttgcatgccattagtttgtactgctattttctacaccctgatgacctgcgaaatgctgaatagaagaaacggtagcctccggattgccctctcggagcacttgaagcagcgccgggaagtcgcaaaaacagtcttttgtttggttgtcattttcgccctatgttggttcccactgcacctgagccgcatcttgaagaagaccgtgtacaacgagatggacaagaaccgatgcgaactcctgtcattcctgctcctcatggattacatcgggataaacctggcgacgatgaacagctgcatcaatcctattgccctctacttcgtctccaagaagttcaagaattgctttcagagctgtttgtgctgctgttgttatcagtctaaaagtctcatgacatcagtgccgatgaatgggacatctatccagtggaagaaccacgaccaaaataaccataataccgacaggtccagccataaagacagtatgaattag

SEQ ID NO: 115783 - DNA, 1179 bp, Artificial Sequence
  Description of Artificial Sequence: Synthetic coding sequence
atggaggaacagcagccagagcctaaaagccaacgcgatagcgctcttggagccgccgctgctgctacccctgggggattatcgctttcactgtcccctggcgctagcggttccagtggaagtggctcagacggcgactcagtacccgtatccccccaacctgcacccccgtcacctccggccgcgccatgtttgccacctctggcccatcatccacaccttcctccacatccaccccccccccctccccagcatttggcagcccctgcccatcagcctcagccagccgcgcagcttcatcgtactactaacttttttatcgataatatcctgcggccagacttcggatgcaaaaaggagcaacctcccccacagctgcttgtggccgcagccgcgagagggggtgccggcggcggcggcagagtcgagcgggaccggggtcagaccgctgcaggccgagatcccgttcaccccctgggaacaagggccccgggagcagcaagccttctgtgcgccccagatgctaactgcggcccaccagacggctcacaacccgccgcagcaggagccggagcgagcaaggccgggaacccagccgcagctgccgcagcagccgcagccgctgttgctgcagcggctgcagccgccgccgcaaagccctctgacaccggaggagggggttcaggaggaggagccggctctcccggcgcgcagggtacgaagtacccagaacacgggaaccccgccatactgctgatgggctccgccaatggaggtcccgtggtgaaaactgattcacagcaacctcttgtctggcccgcctgggtgtattgtacccgctacagcgataggccgtcaagcgggcctcggactcggaagttaaaaaagaaaaaaaacgagaaggaagataaacgccctcggacagcctttactgcagagcaactccagagactgaaggccgagttccaggctaatcgatacatcacagaacaacgcaggcagacccttgcacaagagcttagcctcaacgagagtcagattaaaatttggtttcagaacaagcgggccaaaattaagaaggctaccggaataaaaaacggtctagcccttcatctgatggcccagggactgtataaccactcaaccacaacggtgcaagataaagatgaatcagaatag

SEQ ID NO: 115784 - DNA, 1002 bp, Artificial Sequence
  Description of Artificial Sequence: Synthetic coding sequence
atggaagagaacgatccaaaaccaggagaagccgcagcagctgtagagggtcagcgtcagcccgagtccagccctggcggaggctcaggaggaggaggaggttcctcacccggcgaggcggacacaggacgaaggagagccctgatgcttcctgcagtgttgcaggcacccgggaaccaccagcatccccaccggataactaacttctttattgataatattttacggcccgagtttggtagaaggaaagacgccgggacttgctgcgcgggagctggtggagggcgtggcggtggggccggtggagagggaggcgcaagcggggcggagggtggaggtggcgctggcgggtcggagcagctcctaggctccggctctcgggagccacggcagaacccaccctgcgcccctggcgctggagggcctctgcccgccgccggatccgactccccaggagatggcgaaggaggtagtaaaacactgtctctacacgggggcgccaagaaaggtggagaccctggtggcccactggacgggtctctaaaggcaagaggcctagggggcggtgatctgagcgtgtccagcgactctgactcatcacaagctggggccaatctgggcgctcaacctatgctctggccagcctgggtctattgcacacggtattcggatcgcccatcctccgggccgaggtctcggaagcctaagaagaagaaccctaacaaggaggacaaaagaccacgtacggccttcactgcggaacagcttcagcggctaaaggctgagtttcagacgaaccggtacctaaccgagcagagaagacagagcctggctcaagaactctctttgaatgaaagccagatcaagatctggtttcagaataagagagccaaaattaaaaaggcaacgggcaacaaaaatactctggcagtgcacctcatggctcaggggttgtataaccattccactacagccaaagagggcaagtctgactctgaatag

SEQ ID NO: 115785 - DNA, 2184 bp, Artificial Sequence
  Description of Artificial Sequence: Synthetic coding sequence
atgcccccacccgcagacattgttaaagtggccatcgaatggccaggcgcgtaccctaaactcatggagatcgaccaaaagaagcctctttctgccatcattaaggaagtctgcgacggctggtccctcgcaaaccatgaatacttcgcactgcagcacgccgatagctccaacttttacatcacggagaagaatagaaacgagattaaaaatgggacgatactgcgcttaacgacttcaccagctcagaacgcccagcagctccacgaacggatccagagctcctccatggacgcaaagcttgaggctctgaaagaccttgcttcactttcaagggacgttactttcgcacaggaattcataaacttggacgggatctctctgcttacccagatggtggagtccgggaccgagcgctatcaaaagctgcagaaaatcatgaaaccatgctttggggatatgttgtcttttacactgacagcctttgttgaactgatggatcacggtatagtgtcctgggacaccttcagcgtggcgtttataaagaagattgcatcgtttgtgaacaagtccgccattgatatttcaatcctgcagcggtcactggctatactggagtctatggtactgaatagccacgatctatatcaaaaagtggcccaggagattaccatcggtcagctaataccacacctgcaagggagcgaccaggaaattcagacttataccattgctgtgattaacgctttgttcttgaaggcccctgacgagcggaggcaggaaatggctaacatcttggcccagaagcaactgaggtcaataattctgacccacgtaattagggcgcagagagcgataaataatgaaatggcacaccagctttatgtactccaggttctaacatttaacctattagaggatcgaatgatgacaaagatggacccgcaggaccaggctcagagggacatcatctttgaattacggcggatcgccttcgatgctgagtcagagcctaataattcatctggatcaatggagaaaaggaaatctatgtacacacgtgactataaaaaactggggtttatcaaccacgtgaatcctgcaatggacttcactcagacgcctccagggatgttagccctggacaatatgctgtactttgcaaaacaccatcaggacgcctatatcagaatcgtgctcgaaaatagttcccgggaggataaacacgagtgcccgttcggtcgatcatctattgaattgaccaaaatgctgtgtgaaatactgaaagtgggcgaactgccttctgagacatgtaatgatttccaccccatgttctttacgcatgacaggtcgtttgaagagtttttttgtatttgcatccagttactaaataagacctggaaagaaatgagggccacctccgaggactttaataaggttatgcaggtcgtgaaggagcaggtgatgcgtgcgttgactacaaaaccatcctcattggaccagttcaaaagcaagctgcagaaccttagctacactgaaatcttgaaaatcaggcagagtgaaaggatgaatcaggaggactttcagtcgaggccgatcttggaactcaaggagaaaattcagcctgaaatcctggagttgatcaagcaacagagactcaatagacttgtcgagggcacatgtttccgaaagctgaacgctaggcggcgacaggataaattttggtactgtagactgtcccccaatcacaaggtgctgcactatggagatttggaggaatctccacagggagaagtcccccatgatagcctgcaggacaagctgcccgtcgccgacatcaaggctgtggtgacagggaaagactgcccccatatgaaagaaaaaggtgctctaaagcaaaataaggaggtcctggagctcgccttcagcatcctgtatgatagcaactgccagctcaactttatcgcaccagacaagcacgaatactgtatttggacagacgggttgaacgcgctgcttggcaaagacatgatgtctgatttaaccagaaacgacctggacacactgctctccatggagataaagctgcggctgctcgatttggagaatatccagattccagacgctcctcccccaattccgaaagagccatccaactatgacttcgtgtacgattgcaattag

SEQ ID NO: 115786 - DNA, 1290 bp, Artificial Sequence
  Description of Artificial Sequence: Synthetic coding sequence
atgagtgagcaccagaaagaacagacattagatactccctctctgcgcaccgtcacgctcaccgttcgggtgcatgggtttattctagaggtgagcaaaacaaagaatccccccatcccagataccttttggccacctaggtgggatcaccgtccgagcccaggaggagagacgaatgcctattgccagatgaatcacgtgaatccagcgatggatttcacccaaacccctcctgggatgttagccctcgacaacatgctgtacttcgcaaaacaccatcaggatgcttacattaggatcgttcttgagaacagtagccgcgaggacaagcatgagtgccccttcggacgctctagcattgaactgaccaaaatgctgtgcgaaattctgaaggtgggcgagctgccatcagaaacatgtaatgatttccatccgatgttctttacacatgataggagtttcgaagagtttttttgcatttgcatccagttgctgaataagacatggaaagagatgcgcgctaccagcgaagattttaataaggtgatgcaggtagtgaaggagcaggtcatgcgggccctgactaccaagccctcttccctcgatcagttcaaaagtaagctacaaaatttgagctatactgaaattctcaagataaggcagtccgagaggatgaatcaggaagactttcagtcccgccctatactcgaactgaaagaaaaaatccagccagaaatactggaactgattaagcagcaaaggctcaatcggctggttgagggaacctgcttcagaaaattaaacgcccgcaggcgacaggataaattttggtattgcaggctatcccctaaccataaggttctgcattatggtgacctggaggagtcaccccagggggaagtgccacatgactccctgcaggacaagcttcctgtggccgacatcaaagccgttgtaacagggaaggattgtccgcacatgaaggaaaagggggctttaaagcagaacaaggaggttttggaactggcttttagcattctttacgattccaactgccagctgaactttatcgccccagataaacacgagtactgtatttggaccgatggtttgaacgccctcctgggaaaggacatgatgtcggacttgacacgaaatgacctggacactctccttagtatggaaattaaattgcgtctactggacctcgaaaatatccagatccccgatgccccgcccccaatcccaaaggagccgtctaactatgactttgtatatgattgtaattag

SEQ ID NO: 115787 - DNA, 1896 bp, Artificial Sequence
  Description of Artificial Sequence: Synthetic coding sequence
atggacgccaagctcgaagctctcaaagatctggctagtctgtctagggacgtcactttcgctcaggagttcataaacctggacggaatatcccttcttacacaaatggttgaatcgggcaccgagcgataccagaagcttcaaaaaattatgaagccttgcttcggcgatatgctgagcttcaccttgaccgcatttgtggagctgatggaccacggtattgtaagctgggataccttcagtgtggcgtttatcaagaagatcgctagcttcgtcaataagagcgccattgatataagtattctccagaggagcctggccattctggagtctatggtattgaactctcatgatctgtatcagaaagtcgcccaggaaatcacgataggacaacttattccacacttgcagggatctgatcaggaaattcagacatacaccatagccgtcatcaatgccctgttcctgaaggcaccggatgagcggaggcaagagatggcaaacattctagcacagaagcaattacggtctatcattctcacgcacgtgattcgtgctcagagggctatcaataatgagatggcccaccagttgtacgtactgcaagtgctgacattcaaccttctggaagaccgaatgatgactaaaatggaccctcaggatcaggctcagcgcgacatcatctttgagctccgaagaatcgctttcgacgccgaatcagagcctaataattcctcagggagtatggagaaacggaagtcaatgtatactcgtgactacaagaaactcggcttcattaatcatgtcaaccccgcaatggatttcacacagaccccccccgggatgcttgctttagacaacatgctatactttgcaaaacatcaccaggatgcatacattaggatcgtgctggagaatagttccagagaagacaagcacgaatgtccgttcggtcgaagcagtatcgagttaacgaaaatgttgtgtgaaatcctgaaagttggcgagctgccatccgagacatgtaatgacttccatcccatgttcttcacgcacgataggtcgttcgaagagtttttctgcatctgcattcagttgctgaacaagacttggaaagaaatgcgggccacatccgaggattttaataaagttatgcaggtggtgaaggaacaggtgatgcgcgctctcacaactaaaccctcttctttagaccagttcaagtcgaaactgcagaacctgtcctacactgagatcctgaaaatccgccagagtgagagaatgaaccaggaggatttccaaagtcggccgatactggaactgaaggagaagatccaacctgagatcctggaacttatcaaacagcagaggctgaatcgacttgtggagggaacgtgctttcgaaaactcaatgcccggcgccggcaggacaagttctggtattgtcgcttgtccccaaatcacaaggtgctgcattatggcgacctggaggagtccccccagggagaagttcctcacgactctttgcaggataagctgcctgtggcagacatcaaggctgtggtcaccggaaaggactgcccccatatgaaggagaagggggccctgaagcagaacaaagaggtgctggaactggccttctctattctgtacgattcaaattgtcaactgaacttcattgctcccgataaacacgagtactgtatctggaccgatggcttaaatgccctgctcggtaaggacatgatgtctgatttgacgcgtaatgacctagacacactgttgagtatggagataaagttgaggctcctcgacttggaaaatatccagattccggatgccccccctcccatcccgaaagagccaagtaactacgattttgtctatgattgtaactag

SEQ ID NO: 115788 - DNA, 744 bp, Artificial Sequence
  Description of Artificial Sequence: Synthetic coding sequence
atgcaggttgtaaaagagcaagtgatgcgggctctcaccactaagccctccagtttggatcaatttaagtcaaagctgcagaacctctcatacacagaaatactgaaaattaggcagagcgagagaatgaatcaggaggacttccagagccggccaatcctggagttaaaagagaagatccagcccgagatcctggaacttatcaagcagcagcgcctgaaccgcttagtggagggcacttgtttccggaagctgaatgcacgccggcggcaggacaaattctggtactgtcggcttagtcctaatcacaaggttcttcattacggagacctcgaggaaagcccgcagggcgaagtgccccacgattccttacaggacaagctgcctgtggccgacatcaaggcagtcgtgacaggaaaggattgtccacacatgaaagagaaaggagccctgaagcagaacaaagaggtgctggagttagcgttttctatcttatatgacagtaactgtcagctaaattttattgcgcccgacaagcatgaatattgtatctggaccgatgggctcaacgccctgctgggaaaagatatgatgtccgacctcacgaggaacgacctggatactctgttatcaatggaaataaaattgagacttctggatctggagaacattcagattcccgacgctccaccccccatccccaaagagccaagcaattacgactttgtgtacgattgtaactag

SEQ ID NO: 115789 - DNA, 744 bp, Artificial Sequence
  Description of Artificial Sequence: Synthetic coding sequence
atgcaggtggttaaagaacaggtgatgcgtgctctcactaccaagccatctagtctggaccagtttaaaagtaagctgcagaacctgagctacactgagatcctgaagatcagacagtccgagagaatgaatcaggaggatttccagtcacgacctattttggagctcaaggaaaagattcagcctgaaattctcgagctgatcaaacagcagaggctgaacagactggtggagggaacatgtttcagaaagctcaacgcaaggaggagacaggacaagttttggtactgtagattgagtcctaatcacaaagtgttacactatggtgaccttgaggagagcccccagggagaggtgccacatgacagcttgcaggacaagctgccggtggcagatattaaggcagttgtcacaggaaaagactgcccgcatatgaaggaaaagggcgccctgaaacagaacaaagaggtgctggagctggcctttagcatcctctacgactctaattgccaactgaactttattgccccagacaagcatgaatactgtatatggactgacggtcttaacgctctgctcggcaaagatatgatgtcagacttgacacggaatgacttggacactctgctttccatggagataaagttaagactgctggacttggaaaacatccaaatcccagacgctcctccgcccatcccaaaagagccttctaattacgacttcgtgtatgactgtaattag

SEQ ID NO: 115790 - DNA, 2184 bp, Artificial Sequence
  Description of Artificial Sequence: Synthetic coding sequence
atgccaccgcctgctgatatagtgaaagtggccattgaatggcccggcgcctacccaaaattaatggaaatcgatcagaaaaagcctctctcagcaattataaaagaggtgtgtgacggttggagccttgcgaatcacgaatactttgcacttcagcacgctgacagttctaacttctacatcacagagaagaatcgaaacgaaataaagaatggcaccattcttcggctgacgacgtcccccgcgcagaatgcgcagcagctccacgagcggattcagagcagcagtatggacgcaaagctagaggcgctcaaagacctcgcctcattgagccgtgacgtgaccttcgcgcaagagttcattaatctggacggcataagcctcctgacacaaatggtggagtcaggcaccgagcggtaccaaaagctgcagaaaattatgaaaccatgcttcggtgatatgctgtcattcacacttacggcattcgtggaactaatggaccatggaattgtatcttgggacactttctcagtcgccttcattaaaaagattgccagctttgtcaacaaatctgctatcgatatctctatcctgcagcggagcttggccatccttgagtcaatggtgctcaactctcatgatctgtaccagaaagtggcgcaggaaatcacaattgggcagctcattccacatctccaaggaagtgaccaggaaattcagacatacacaatcgcagttattaatgccctctttcttaaagcacctgatgaaaggagacaggagatggcaaatatcctggctcagaagcaactgaggagcataattctgacccatgtaataagagcccaacgtgcaatcaacaacgagatggcccaccagctgtatgtcttgcaggtgctgactttcaacttactcgaggatcgcatgatgacaaaaatggacccccaggaccaagcacaacgggatatcatttttgagctccgtcgaatcgctttcgacgcggagtccgaacctaataacagttccggaagcatggagaagcgcaagagcatgtatacccgagactataaaaagctagggttcattaatcatgtgaatcctgctatggatttcacacagacccccccgggcatgctggctctggacaatatgctttactttgccaaacaccaccaggatgcgtacattagaatcgttctggaaaactcttcgcgggaggataagcacgagtgtcccttcgggagatcctccatcgagctgactaaaatgttgtgtgaaattctaaaagtgggggagctaccaagcgaaacgtgtaacgactttcacccgatgttttttacacacgaccggtctttcgaggagttcttctgcatatgcattcaactgctgaacaaaacttggaaagagatgcgcgctacctccgaggacttcaacaaagttatgcaggtggtgaaggagcaagtgatgcgcgctctgactacaaagccaagctccttagatcagtttaaatccaagctccagaatctctcgtatacggagatcctcaaaataagacagtctgagagaatgaaccaggaagacttccagtccagacctattttggagctcaaggagaagatacagcctgaaatcctggaacttattaagcagcagaggttgaatcggctggtggaggggacctgtttccggaaattgaatgcgcgccgcagacaggacaaattttggtattgtaggttgagccccaatcataaagtgcttcattacggtgacctcgaagaaagtccacaaggtgaggttccgcacgatagtctgcaggataaattgccggtagcggatatcaaagccgtggttaccggaaaagactgtccccacatgaaagagaagggagcactcaagcagaataaggaagtgcttgaattggccttttctatattatacgactccaattgccagctgaacttcatagccccggataagcacgaatactgcatttggactgacggccttaacgctttacttggtaaggatatgatgtctgacctgacccggaatgacctcgatacactgctgtccatggagatcaagctgaggctgttagatctcgagaacattcagatacccgatgcgcctccccctataccaaaggagcccagtaactatgacttcgtgtacgactgcaactag

SEQ ID NO: 115791 - DNA, 180 bp, Artificial Sequence
  Description of Artificial Sequence: Synthetic coding sequence
atgcctccacccgcggatattgtcaaagtggccattgagtggcctggtgcataccccaaactgatggagatcgatcagaaaaaaccactgagcgccataattaaggaagtgtgcgacggatggagcctggcaaaccatgaatactttgctttacagcacgccgactcaagcaatttctag

SEQ ID NO: 115792 - DNA, 2184 bp, Artificial Sequence
  Description of Artificial Sequence: Synthetic coding sequence
atgcccccaccagccgacatcgtgaaagtggccatcgagtggccgggggcttatcccaagcttatggagatagatcaaaaaaagcccttgtctgccatcattaaagaagtgtgtgacggctggtctctggccaaccatgaatattttgccttgcagcatgccgatagcagcaacttttacatcactgagaagaatcgaaatgaaatcaaaaatgggactatccttcggctcaccaccagtccagctcagaacgcacagcagctgcacgagaggatacagtcctcaagtatggatgccaagctcgaagcactgaaagacctagcctcattaagcagagatgtcaccttcgcccaggagtttatcaacctggatggcatatccctgttgacccaaatggtagagagtggcacagaacggtaccagaaactccagaagattatgaaaccctgcttcggtgacatgctcagctttacactcacagcctttgtcgagctgatggaccatggcatcgtgtcatgggacacttttagcgtcgcttttattaaaaagatcgcatcctttgtgaataagtctgcaatcgatatcagcattcttcagaggtcactggccatcctcgagtcaatggtgctgaactcccatgatctttaccagaaggtggcccaggagattacaatcggacagctgattcctcacttacaaggctctgatcaagagatacaaacctacacaattgcagtcataaacgccctcttcttaaaagctcctgacgagcgacggcaggaaatggccaatattctggctcagaaacagctgcgctcaataattctgacgcacgttattagggcgcagcgggctattaacaacgaaatggcccaccaactatatgtgcttcaggttttaaccttcaacctcctagaagataggatgatgaccaaaatggacccacaggaccaggcacagagggatataatattcgagcttaggcgcatcgcctttgacgccgagagcgagccgaacaacagcagcggctccatggagaagcgtaaatctatgtatacgcgagactataaaaagttaggcttcataaatcatgttaatcccgccatggattttactcaaaccccccctggcatgttagccctggataacatgctctacttcgccaagcaccaccaggacgcctatataaggattgttctggagaattcaagtcgtgaggataaacatgagtgcccttttggcagatcctcaatcgaactaacgaagatgctgtgtgagattttgaaggtcggcgaactgccatcggagacctgcaacgacttccacccgatgtttttcacacatgatcgctctttcgaagaattcttctgcatttgtattcagttactgaataaaacttggaaggagatgcgagccacgagcgaagattttaacaaagtgatgcaggttgttaaggagcaggtgatgagagccctgaccaccaagccatccagtctcgatcaattcaagtcaaagctgcaaaatttatcatacacagaaatcttgaaaatcagacaaagtgagcgtatgaaccaggaggatttccagtcacgtcccatactagaactgaaagagaagatccagcccgagatccttgagctgattaagcagcagagactgaacaggctggtggagggcacgtgttttaggaagctgaacgctcgccgccgtcaggacaagttctggtactgtaggctaagccctaaccacaaggttttgcattatggggatctagaggaatcaccacagggcgaggttccccacgatagtctccaggataagttaccagtcgctgacattaaggctgttgtgaccggcaaggactgccctcacatgaaggagaagggcgccctgaaacagaataaggaggttttagagctcgctttcagcatactgtacgactcgaattgccagctgaatttcattgctcccgataagcacgagtattgcatttggaccgatggactgaatgcacttctcggcaaggacatgatgtcagacttaacccggaatgacctagatacgcttttaagcatggaaatcaaattaaggcttttagacctggaaaacatccagataccggacgctcctcccccgattccaaaagaaccaagtaactatgattttgtctatgattgcaattag

SEQ ID NO: 115793 - DNA, 246 bp, Artificial Sequence
  Description of Artificial Sequence: Synthetic coding sequence
atgcctccaccagctgacattgtcaaggtcgccattgaatggcccggtgcttacccaaaactgatggagatagatcagaaaaaacctctgtctgctataattaaggaagtttgtgacggatggagcctggccaatcacgaatacttcgctctccagcatgcagattcctccaatttctatataacagaaaaaaacaggaacgagatcaaaaacggaactattctgaggctgaccacttcaccatag

SEQ ID NO: 115794 - DNA, 450 bp, Artificial Sequence
  Description of Artificial Sequence: Synthetic coding sequence
atgcccccacctgcagacattgtaaaagtggctatcgagtggccaggagcttaccccaaattgatggaaattgatcagaagaagcccttatccgccattatcaaggaggtgtgtgatggatggtccctcgctaaccatgagtacttcgccctgcagcatgccgatagtagtaacttttacataactgagaaaaacaggaacgagatcaagaacggaacaatcttacggcttacaacttcacccgctcagaacgcgcagcagctgcacgaacggattcagtcctcttccatggacgccaaattggaggctttgaaagacctggcctccctgagccgggatgttaccttcgcacaggaatttatcaacttggacgggatctcactactcacgcaaatggtggagtcaggaaccgaaaggtaccaaaagctgcagaagataatgaaaccttag

SEQ ID NO: 115795 - DNA, 2163 bp, Artificial Sequence
  Description of Artificial Sequence: Synthetic coding sequence
atgccccccccatccgacatagttaaagtcgcaatcgaatggcccggggcgaatgctcagcttttagaaatagaccagaaacgtcccctggccagcatcatcaaagaggtgtgtgacggctggtctttacctaacccagagtactacacgcttagatacgccgacggcccccagttgtatattactgagcaaacccgctccgatattaagaatggaaccatcctgcagctggccataagtccgtctagggccgccaggcagctgatggagcgcacgcagagctcaaacatggaaactcgcctggacgccatgaaggagttagctaaactgtccgctgacgtcacctttgctacagaattcattaatatggatgggattatcgtgctcaccagacttgtggagtcagggaccaagctcctctctcattactcagagatgctggcatttaccttgaccgcattcttagagttaatggaccacggtattgtatcctgggacatggtgtcaatcacttttataaagcagatcgcgggctacgtgagccagccaatggttgatgtctcaatcctgcagaggtccctggccatcctcgagagcatggtgctaaattcccagtcattgtatcagaagatcgccgaggagataacggtgggacagctgatttcacacctgcaggtgtccaaccaggagattcagacttacgcgatcgcactgatcaatgccttgttcttgaaagcacctgaggacaagcggcaggatatggctaacgccttcgcccaaaaacaccttaggagtatcatactcaatcacgttatccgaggcaatcgtccaatcaaaacggagatggcacaccagctctacgtacttcaagtactgacctttaatctcctagaagagcggatgatgaccaagatggacccaaacgaccaggcccagcgcgacatcattttcgaactaaggaggatcgccttcgacgctgagtccgacccatctaacgcaccagggtccgggaccgaaaagcgcaaggccatgtatactaaggactataaaatgcttggatttacaaaccacatcaatcccgccatggattttacacagactccgccaggaatgctggcactggacaacatgctgtacctggcaaaagtgcaccaggacacttatatccgaattgtgcttgaaaactctagccgggaggataaacacgagtgtccctttggacgcagcgctattgagcttacaaagatgctgtgtgagatcctccaggtgggagagctacctaacgaaggtagaaatgactatcacccaatgttctttacccacgacagagcctttgaggagctgttcggcatttgtattcagttgctgaataagacctggaaggagatgcgcgccacggccgaggattttaacaaggtgatgcaggtcgtgcgagagcaaatcacaagggccctgccttcgaagccaaattccttggaccaattcaaatccaagcttaggtctctgtcgtactctgagatactgcgcctgcgtcagagtgagcgcatgtcccaggacgacttccagtcacctcctatcgtcgaactgagggagaaaattcagccagagatcctagaactgattaaacaacagcgtctcaatcgcttatgcgagggatcttccttccggaaaattggcaatcgaagacggcaggagcggttttggtactgtcgattagcgctgaaccataaggtcctgcactacggagatctggacgacaatccgcagggagaggtcacatttgaatctttgcaggagaagatacccgtggcagacatcaaagctatagtgaccggcaaagactgtcctcacatgaaggaaaaatcagccctcaagcaaaataaggaggtcttggagttagcattctccatcttatacgaccctgacgagacccttaacttcatagccccaaataagtatgagtactgtatttggatagacggcctgagcgctctgttgggtaaagacatgagttctgagctaacaaagtcggacttagacaccctgcttagcatggaaatgaagctccgcctcctcgacttggagaatattcaaatcccagaggccccgccgcccattcctaaggagccctcctcatatgatttcgtatatcattatgggtag

SEQ ID NO: 115796 - DNA, 2157 bp, Artificial Sequence
  Description of Artificial Sequence: Synthetic coding sequence
atgccccccccgtctgatattgtcaaagtggccatagagtggcccggtgcaaacgcacagttgctcgagatagatcagaagcggcctctggcttctatcataaaggaagtgtgcgacggctggagcttgcccaatcctgaatattacaccttaaggtacgcagatggaccacagttgtacataactgaacagactcgcagcgacattaaaaacggaacaatcctccagttagctatcagcccatctagggccgcccgacagctgatggagcgcacacagagcagtaacatggagacgcggttagatgctatgaaagaactcgctaaattgagtgccgacgtgactttcgccacggagtttattaatatggacggcattatcgtgctgactaggctcgtggagtccggaactaagttgctgtcccacgagatgctagcgttcaccttgaccgcatttctggagctgatggatcatggcatcgttagttgggacatggtgtctataaccttcattaagcaaattgcgggatacgtgtctcaacccatggtggacgtctccattctgcagcgtagtcttgcaatactggaaagtatggtcctgaattcccaaagcctctaccagaaaatcgcggaggaaataacagttgggcaactgataagccacttacaagtttccaatcaagagattcagacatacgctattgcactcatcaatgccttattcttgaaggctcctgaggacaagaggcaggatatggctaatgcattcgcgcagaagcacttgcgatcgatcattctcaaccatgtgatccgcggcaaccgtcctattaaaacggagatggcacaccagctgtatgtgttacaggtcctgacgtttaacctcctcgaggaaaggatgatgaccaagatggaccccaacgaccaagcccaacgcgacattatctttgagctccgccgaatcgcttttgatgcagagtccgatcccagcaacgcgcccggtagtggtacggagaagaggaaagccatgtatactaaggattacaagatgcttggttttaccaatcacattaatcccgcaatggactttacccagaccccccctggaatgcttgccctagacaacatgctttacctggcgaaagtgcaccaagacacctacataaggatagttctcgaaaacagcagcagggaagacaagcacgagtgcccttttgggcgctccgcaatcgaactgactaagatgctttgcgagattttgcaagtgggagagctacctaacgagggccggaatgactaccacccaatgtttttcacgcacgatcgcgcgttcgaagaactctttggaatttgtatccagttgcttaacaagacgtggaaagagatgagggccaccgccgaagatttcaacaaagtcatgcaggtggtgcgcgagcagatcacacgggcactcccaagtaagccgaactcactggatcagttcaagtccaaactcaggagcttgtcctattccgagattctcaggctgcgacagtctgagagaatgtcccaggatgattttcaaagtccgcccattgtagagttgagagaaaagattcagccagagatactggagctgattaagcaacagcgattaaatcggctttgcgagggctctagcttccgcaagattggaaatagacggcgccaagagcggttctggtactgcagacttgccctgaatcacaaggttctccactacggcgacctggacgacaatccacagggagaggtcacgttcgaatctctgcaggaaaagattcctgtggctgacataaaagctatagtgacagggaaagactgcccacacatgaaggagaaatccgcattgaaacaaaataaggaggttctggagctggctttctccatcttatacgatcctgatgagacgttgaacttcattgcgccaaataaatacgagtactgcatctggatagacggtctatctgccctgctgggaaaagatatgagcagcgagctgacaaagtcagatctcgacacactgttgtccatggaaatgaaactgaggctcctggatctggaaaacattcaaattcctgaagctccccctcctatccctaaagagccttcctcttatgatttcgtgtaccactacgggtag

SEQ ID NO: 115797 - DNA, 1899 bp, Artificial Sequence
  Description of Artificial Sequence: Synthetic coding sequence
atggagcgcacccaatcctctaatatggagactcgccttgatgcaatgaaggaactggcaaagctcagcgccgacgttaccttcgccacggagttcataaatatggacggcatcattgtgttaactcggctagtggaaagcgggaccaagctcctgagtcactattccgaaatgctggcatttacgctcacagccttcctcgaactaatggaccacggaattgtttcctgggatatggtgagcattactttcatcaagcagattgctggatacgtgagtcagcccatggtggacgtttctatcctacagcgctccctggccatattggaaagcatggttctcaacagccagagtttataccagaaaatagctgaagaaatcaccgttgggcagctgatctcacacctccaggtgtccaaccaggagattcagacttatgccattgcactcatcaatgctttgtttctcaaagcccccgaggataaaagacaggacatggccaatgcttttgcgcagaaacatttgcggtctattatattgaaccacgttattagggggaaccgcccaattaagaccgaaatggcccaccagttgtatgtgcttcaagttctgactttcaacctgctagaagagcgtatgatgacaaagatggacccaaacgatcaggcccaaagggatattattttcgaactgcgtcgtatcgcctttgatgccgagtctgacccttctaacgctccaggaagcggaactgaaaagaggaaagccatgtacaccaaggattataagatgctgggattcaccaaccacatcaaccccgccatggacttcactcagaccccaccaggcatgctggctttggataacatgctgtatctagcaaaggttcatcaggacacctatatccgaatagtgttagagaattcatctagggaggataaacatgagtgcccctttggacgttccgctatcgagttgacgaagatgctttgcgagatactacaggtgggggaattgcccaacgagggacggaatgactaccatccgatgtttttcactcacgaccgcgcctttgaggagctgttcgggatatgcattcagcttctaaataaaacgtggaaagagatgagggccaccgctgaagatttcaataaggtcatgcaggtggtccgggagcagatcacaagggctctgccaagtaagccaaacagcctggaccagttcaaatcaaagctgcgttctctgtcctattccgagatcctgagactccgccagtctgagaggatgtcacaggacgattttcagagccctccgatcgtcgaactgagggaaaaaatccaacccgagattttagagttgatcaaacagcagcggcttaatcgtctgtgtgaggggtcgtccttcagaaaaataggcaaccgccgtcggcaggaaaggttttggtattgcaggctggcattaaaccacaaggtgctccactacggagatctcgacgataacccacagggcgaggttacttttgagtctctgcaggaaaagatccccgtggccgacattaaagccattgtaaccggaaaggattgtcctcacatgaaggagaagtccgcactcaagcagaacaaagaggtcctcgagctggcattttcaattctttacgaccccgatgagactctgaattttatagctccaaacaagtacgagtattgtatctggattgacggattatcagcgctgctcggaaaagacatgtcctccgaactgacgaaatccgatctcgatacactcctctctatggagatgaaacttcgactgttggacctggagaacattcaaattccagaagcgccacccccaataccaaaggagcccagtagctatgacttcgtctatcactacggctag

SEQ ID NO: 115798 - DNA, 2163 bp, Artificial Sequence
  Description of Artificial Sequence: Synthetic coding sequence
atgccccctcccagtgatattgtcaaggttgccattgagtggccgggtgctaacgctcagttactggagattgatcagaagaggcctctcgcctccatcattaaagaagtttgtgacgggtggagtctcccgaatcctgaatattacacgctgcggtacgccgatggacctcagctgtacatcacagagcaaacccgcagtgacataaaaaacgggactatccttcagttggccattagtccatccagagccgcgaggcagctgatggaaaggactcagagttctaatatggaaaccaggctcgacgccatgaaggagctcgccaaactttctgccgacgttaccttcgcgacagagtttattaacatggatggcattattgtgcttacaagacttgtagagtccggcactaagcttctgagccactattctgagatgcttgcattcactttgaccgctttccttgagcttatggatcacggaattgtttcctgggatatggtgagcatcacattcatcaagcagatcgctggctatgtctctcagcccatggtggatgtgtctatcctgcagagatccctggccatactggagtccatggtgctgaattcccaatctctgtaccagaagattgctgaagagattaccgtgggccaacttatctctcatctccaagtgtccaatcaggaaatccagacttatgcgatcgccctgataaatgcgctgttcctgaaggcaccggaagataaacgtcaggacatggctaacgctttcgctcagaaacacttgcgttcaattatcctgaaccatgtcatacgaggcaatagaccgataaagacagagatggcccaccagctctacgtactgcaggtcctcacctttaacctgctggaggagagaatgatgaccaaaatggatccaaatgaccaagcccaacgggacattatttttgaactacggcggatcgcattcgacgctgaatccgatccatcaaatgcacctggttcgggtaccgaaaagcgcaaagctatgtatacgaaggattacaagatgctagggttcactaatcacatcaacccagccatggactttacccagaccccacctggaatgctagcactcgataatatgctatacctggctaaggttcaccaggacacgtacatacgaatcgtgctggagaatagctcgcgcgaggacaagcacgaatgccccttcggccgctcggctatagagctcacaaaaatgctgtgcgagatcctgcaggtcggggagctgccgaacgaaggccgcaatgactatcatcccatgttttttactcatgaccgcgcatttgaggagctgtttggaatctgcatccagttgctgaacaagacctggaaggagatgcgcgctaccgccgaggatttcaataaggtgatgcaggtggtcagagagcaaatcaccagggctctccccagtaaaccaaactcgttggaccagtttaagagtaagctgcggtcactgtcttattccgaaatcctgagacttagacagtccgaacgcatgtcacaggacgatttccaaagccctcccatcgtcgagctacgggaaaaaattcagcctgagatcctcgaactcattaagcagcaaagactcaatcgcttgtgtgaggggtcttcctttagaaaaattggaaatcggagaagacaggagcgcttttggtattgcagactggctcttaatcacaaggtcctgcattacggcgacttggatgataaccctcaaggtgaagttacattcgagagcctccaggaaaaaatcccagtcgctgacatcaaagcaatagtgaccgggaaagactgtcctcatatgaaggaaaagagcgctttaaagcaaaacaaagaagtgctcgaactcgcgttcagcattttatatgacccagacgagacactcaatttcatcgcgccaaataagtatgagtactgcatctggatcgatggccttagtgccctcctcgggaaggatatgtcctctgagcttacaaagtctgacctggacaccttgttatccatggagatgaagctccgccttttggatcttgaaaatatccagatccctgaagctcctccacccattccgaaggaacctagcagttatgacttcgtttatcattacggctag

SEQ ID NO: 115799 - DNA, 804 bp, Artificial Sequence
  Description of Artificial Sequence: Synthetic coding sequence
gaagaaataactgtggggcagctgatctctcatcttcaggtgtcaaaccaagagatccagacctacgccatcgctcttattaacgcactgtttttgaaggctcccgaggacaagagacaagatatggcaaatgcctttgctcaaaagcatctccggagtatcatcctcaaccatgtgatcagggggaataggccaattaagaccgagatggctcaccaactctacgtgctgcaagtcctgacatttaatctgctggaagagcgaatgatgacaaagatggatcctaacgaccaggcacagcgggatatcatctttgagttacggcgtattgctttcgacgccgaatcggatccatccaatgccccaggaagcggcaccgagaaaaggaaggccatgtacacgaaggactacaaaatgctgggtttcactaaccatatcaacccggcaatggacttcacgcagacccctcccggcatgctggcacttgacaacatgttatatctcgccaaggtgcaccaagacacttacattagaattgtactggaaaatagtagccgcgaggacaagcacgagtgccctttcgggcgttctgcgatcgaattaaccaagatgctctgcgagatcctgcaggtcggcgaattgcccaatgagggacgcaacgactatcatcctatgttttttacccatgatcgggctttcgaggagctattcggaatttgtattcagctgctgaataaaacatggaaggagatgagagcaaccgccgaagattttaacaaagtctcggtttccggactgctttag

SEQ ID NO: 115800 - DNA, 2199 bp, Artificial Sequence
  Description of Artificial Sequence: Synthetic coding sequence
atgccacccccaagtgatattgtgaaagtcgctatcgaatggcccggagccaacgcgcagctcctcgagatcgaccagaagaggcccctcgctagcatcataaaagaggtctgtgatggctggtcgctccctaatcccgaatattatacacttagatatgccgacgggccacaactttacatcacggagcagaccagatcagacattaaaaatgggactattctccagctggctataagcccctcaagggctgcaaggcaactcatggagagaacacagagttcaaatatggaaacccgtttggatgcaatgaaagagctggccaagttatccgccgatgtcacctttgccactgagttcatcaacatggatggaattatcgtgctaactcgcctggtggaatccggtacgaaactgctgagtcactattccgaaatgttagcgtttactctgacagctttcttggaattgatggatcacggcattgtgtcgtgggacatggtttccattacttttattaaacagatcgcgggatacgtgtcccagcctatggttgacgtgtccatcttacaaaggtcccttgccatcctagagagcatggttcttaactcacagtccctgtaccagaagatcgctgaggaaattaccgtgggacagctgatttcccatctgcaggtgtccaaccaggaaatacagacatatgccatcgctctcattaatgccctgttcctgaaagcgccggaggacaagcgtcaagataaacacttgaacccattggacctgccggtgacggacatggccaacgcctttgcccagaagcatctcaggtccatcatcctcaaccacgtcattaggggcaacagaccaattaagaccgagatggcacatcaactatatgtcctgcaggtgctcaccttcaatttgctggaagagcggatgatgactaagatggaccccaatgaccaggctcagagggatatcatcttcgaattgcgaaggattgcattcgacgctgaaagcgatccctccaatgctcccggctctggtaccgaaaaacgcaaagctatgtacaccaaggactataaaatgctgggattcactaatcatatcaatccagccatggatttcacgcagacccctccaggtatgctggctcttgacaatatgctgtacctggctaaggttcatcaagacacctacattaggattgtcctcgaaaactcatctcgggaggacaaacacgaatgtcccttcggccggtccgccatcgaactaaccaaaatgttatgcgagattctgcaggtgggcgaactgcctaacgagggccgcaacgattaccaccctatgtttttcacccatgaccgggcattcgaggagctcttcggcatctgtatccagcttttaaataagacctggaaagagatgagagccacggccgaggatttcaataaagtcatgcaggtggttcgcgagcagatcaccagggcgctgccctccaagcccaactctctggatcagtttaaatctaaactccgctctctaagctactctgagatcctccggttaaggcagtcagaacggatgtcccaggacgatttccagtccccgcctattgtggaactgcgcgagaagattcagcccgagattcttgagctgattaagcagcagcggctgaaccgtctgtgcgaggggagttcctttagaaaaatcggaaaccgccggcgtcaggagaggttttggtactgtcgtcttgcccttaatcacaaggttctgcactatggggatttggacgacaatccacagggagaagtcaccttcgagtccctccaggaaaagattcccgtggccgacatcaaggcaatagtcacaggcaaggactgtcctcacatgaaagagaaatccgcccttaagcagaataaagaggtactcgagctagccttctccatcctttacgacccagatgagacattaaattttattgccccaaacaagtatgaatactgcatctggattgacggcctctccgcactgctgggcaaggatatgtcttctgagctcacaaaatcagatctcgatacgttgttaagtatggagatgaaactgagattactggatctcgagaatattcagatccccgaggcccctcccccaattcccaaagaaccatcctcctacgacttcgtttatcactacggttag

SEQ ID NO: 115801 - DNA, 1614 bp, Artificial Sequence
  Description of Artificial Sequence: Synthetic coding sequence
atggtagatgtgtccatcctccaacgaagtctcgccattttggagtctatggttctcaattcccagtctctgtaccagaagattgcagaagagatcaccgtgggtcagcttataagtcacttgcaagtgagtaaccaggagatccaaacctacgcaattgccctaatcaatgctctattcctgaaggctcctgaagataagcggcaggacatggctaatgccttcgcacagaaacatctgcgttcaatcatcctgaatcacgtcatccgcggcaacagaccaatcaagaccgaaatggcccaccagctttacgtcctgcaggtcctgacttttaatctgctggaggagcgtatgatgacaaaaatggaccccaacgaccaagctcagcgagacattatttttgagctccgtagaattgcttttgatgccgagagtgatccgtccaacgcccccgggagtggcactgaaaagcggaaggctatgtacacaaaggattacaagatgctagggttcacaaaccatatcaaccccgctatggattttacccagacgcctcccgggatgctggctctagacaatatgctgtatttggctaaggtgcaccaggacacctatatacgaatcgtgctggaaaattcatcccgggaagataaacatgaatgtcctttcggccggagtgccatcgagctgaccaagatgctgtgcgagattctacaggtgggcgagctaccaaatgagggaaggaatgattaccatcccatgttttttacacacgaccgggcatttgaggaactatttgggatatgtatccagctacttaacaaaacttggaaagaaatgcgcgcgacagccgaggatttcaataaggttatgcaggtcgtgcgagagcagataactagagctcttccatcgaagccgaatagcctagaccagttcaaatccaagctgagatctctttcatatagtgagattctgcgactcagacagtccgagagaatgagccaggatgatttccagtccccccctatcgtggagctgcgggaaaagatccagcccgagattctggaacttattaaacagcaaaggcttaatcgcctctgcgaagggagcagctttaggaaaatcggtaaccgccgtcgacaagaaaggttctggtactgtcggctggccttaaatcacaaggtactacactatggcgaccttgacgacaatccacagggagaagtgactttcgaatcattacaagagaaaattcccgtcgctgatattaaagctatagtgactggaaaggactgcccgcacatgaaggaaaaaagcgccttaaagcaaaacaaggaagttctcgagctggccttttcaatcctgtatgacccagacgaaacactgaacttcatagctcctaataagtatgaatactgtatatggattgatgggctgtccgccctcctgggcaaggacatgagctcagagttaaccaaatctgatttagatactttactcagcatggaaatgaaactgcgtctgttagatttggagaatattcagattcctgaagccccccctcccatccccaaagagcctagcagttatgatttcgtgtaccactacggatag

SEQ ID NO: 115802 - DNA, 1017 bp, Artificial Sequence
  Description of Artificial Sequence: Synthetic coding sequence
atgccacccccctccgacatcgtcaaagtggctatcgagtggcccggggcgaacgcccagctcttagagatcgatcaaaaacgtcctcttgctagtatcatcaaagaagtgtgcgatggttggagcctgccaaaccccgagtattataccttgcgctacgctgatggcccgcaactatacatcaccgagcagacacgctccgatataaagaacggaaccattctccagctggccatctctccaagcagggcggcacgccaattgatggaaaggactcagtcctccaacatggagacccggctagacgctatgaaggaactggcaaagctctccgccgacgtgacatttgccacagagttcattaatatggatgggatcatagtcttaacacgtctggtggaaagtggtaccaagcttctttcacactattccgaaatgctggccttcacgctcaccgctttcctggaactaatggatcatgggatcgtgagctgggatatggtaagtattacattcatcaagcagatagccgggtatgtctcccaacctatggtggatgtgagcattctgcagcggtctctagccatcctggagtcgatggtgctcaactctcagagcttgtaccagaaaattgctgaagaaattacagtaggacagctgatctcacacctccaagtgagtaaccaggaaatccagacttacgccatcgccctgatcaatgcactgttcctgaaagcccccgaggataagagacaagacatggctaacgcttttgctcagaagcacctgagaagcattatcttgaatcatgtgattcgtggcaaccggccaattaagactgagatggctcatcagctgtatgtgctacaggttctgacctttaatctcttggaggaacgcatgatgaccaaaatggatcctaacgaccaggcccagcgggatatcatttttgagctcaggagaatcgcatttgacgccgaatcggatccctccaatgcccctggtagcggcacctag

SEQ ID NO: 115803 - DNA, 852 bp, Artificial Sequence
  Description of Artificial Sequence: Synthetic coding sequence
taccaccccatgttttttacacatgaccgggccttcgaggagctgttcggaatatgcatacagctcctgaacaaaacgtggaaggagatgagagctaccgcggaagacttcaacaaagtgatgcaagttgtgagagaacagatcacacgggcactgccatctaagcctaacagcctagaccagtttaagagtaagctgagaagcctgtcttacagcgagatcctgagactgaggcagtctgagcggatgtcccaggatgatttccaatctccgcctatcgtggagctgagggagaagatccagcccgagattctggagttgatcaagcagcagagacttaatagactctgtgagggtagttcattcaggaaaatcgggaaccggcgcagacaggaaagattctggtattgtaggttagccctgaaccacaaagtactccactacggtgatctggacgataaccctcagggtgaggtgactttcgagagcctgcaagagaagaatattaaagcaatcgtgactggaaaagattgcccccacatgaaagaaaaatcagccttgaagcagaacaaggaggtgctggaattagcgttcagcattctttatgatcctgacgaaaccctgaactttattgcacctaacaagtatgaatattgcatttggattgatggtttgagcgccctgctgggcaaagacatgtcatccgaattgacaaagtcagatctggacactctgctgtcgatggagatgaaactaagattactggacctagagaatattcagatcccggaggcgcctccccctatccccaaggagcctagttcatacgatttcgtgtatcattacggctag

SEQ ID NO: 115804 - DNA, 1359 bp, Artificial Sequence
  Description of Artificial Sequence: Synthetic coding sequence
atgcacgtgattagggggaaccgaccgattaagactgagatggcccaccagctgtatgtactgcaagtgcttaccttcaatttgttggaggaacgcatgatgaccaagatggacccaaatgaccaggcacagcgggatataatttttgagctccgcaggattgcgttcgacgccgagagcgaccctagcaacgcccccggaagcggaactgagaaacgaaaagccatgtacacgaaagactataaaatgctgggctttaccaatcacatcaatcccgccatggatttcacccagacgcctccaggcatgttggctttggataatatgttgtacctggccaaggtgcatcaggacacatatataaggatcgtgctagaaaattcgagccgagaggacaagcacgaatgtccctttggacgctccgccatcgaattaaccaagatgttatgtgaaatactacaggtcggagaactgccgaacgagggacgcaatgactaccatccaatgttctttacacacgaccgagcttttgaggagctctttgggatctgtatccaacttctaaacaagacctggaaagagatgagagctacagcggaagatttcaataaggtgatgcaggtggtgagggagcagataacgagggccctgcctagcaagccaaatagcttggatcagtttaaatcaaagttgcgctcactcagctattccgaaattcttcgccttcgacaaagcgagcgcatgtctcaggacgatttccaaagcccacccatagtggagcttagggagaagatacagcctgaaatacttgaactgataaagcagcagcggctgaacagactttgtgaggggagctcttttcgcaaaattggcaaccgccgaagacaggaacgcttttggtattgtagactggccctgaatcacaaagtactgcactatggcgaccttgatgataatccccagggcgaagtgacctttgagtccctgcaggagaagatacccgtggccgacatcaaggccatcgtgaccgggaaggactgtccacacatgaaagagaaatccgcactgaaacagaataaggaggtcctcgaactcgctttctcaatcctttacgatcccgatgagaccctgaacttcattgctcccaataagtacgagtattgtatctggatcgacggcctgtcagcactgctgggaaaggatatgtcctctgaattgaccaagagtgatttggacacactgctgtccatggagatgaaactgaggctccttgacttggagaacatccagattcctgaggcccccccccccatccccaaggaaccttcttcttatgactttgtttatcattacggttag

SEQ ID NO: 115805 - DNA, 2322 bp, Artificial Sequence
  Description of Artificial Sequence: Synthetic coding sequence
atggcacggtcatctagcctcggacgggagtgcggcacaccaagatctggactgggcaagggagggccacccaggccacaaggaccacaggcaaggtgtacacttgggcgtcggtgtactgtgtctggcaagtgcaggcgacccagaccctcttggaccatggcgccccctagaaacgtggtcaagatcgctataaagatgagagacgcaattcctcagcttattcagctggaccaagccaagccgttagccgccgttttgaaggaggtgtgtgacgcatggagcctaactcactcagagcgatacgccttgcagttcgcagatggtcaccgccggtatataactgagaacaaccgcgccgagatcaaaaatggaagcatactgtgtctttcaacagctcccgatctggaggctgagcagcttttaggggggctgcagagcaactctcctgaaggcaggagggaggctttgcggcgcctcgttccccttgcttcagatatgatctttgctcgcgaggtgatatcacgtaacgggcttcagattctgggcaccattatcgaagacggcgacgatctaggagaagtcctcgccctgagcctccgcgctttcagcgaactcatggaacacggagtagtgtcatgggagacactcagtattccattcgtgaggaaggtcgtctgttacgtcaatatgaacttgatggatgctagcgtccctccgcttgccttagggctgctagagtcagtgacactgagttcccccgccctgggccaattagtgaagagtgaagtccctttggatcggttactcgttcatctgcaagtcatgaaccagcaactccagacgaaggccatggctcttctgacggcactccttcagggtgccagtccagttgaacggaagcacatgctcgattacctctggcaaagaaatctacggcagtttatatacaagaatattatccactcagccgcgcctatgggagacgagatggcccatcatctttatgtattgcaggctctgatgctcggcctgcttgaaccaagaatgcgaacgccgttggacccttactcccaggaacagagggagcagctgcaggttctgaggcaggccgccttcgaggtcgagggcgagagctcaggcgctggcctctcagccgatcgccgcaggtctctctgcgctcgcgagtttcgaaaactggggttttcaaatagtaaccccgctcaggatctggaacgagtacctcccggattgctggcactggataacatgctctatttcagtcggaacgccccttctgcctattcacggttcgtcttggagaattcaagccgagaggataagcacgagtgtccttttgcccggggtagtatccaactgaccgttcttctgtgtgagttattgagagttggtgaaccatgcagtgaaacggcccaggactttagcccaatgttttttggacaggatcagtcctttcatgaacttttctgcgtcggtattcagctgctgaacaagacgtggaaagagatgcgagctactcaggaagattttgataaagtgatgcaggtcgtgcgagaacagttggctcggactctggctcttaagccgacgtcactcgagctgtttcgtacgaaggtgaatgcattgacatatggcgaagtgctgagactccgacaaaccgagcgcttgcatcaagaagggacattggcccccccgatcctggagctgcgggaaaaattgaaacccgagctgatgggcctgatcaggcaacagcgcctgctgcgtctctgtgaaggcacgctcttcagaaagatcagctcacgccgacgccaggacaagttgtggttttgttgtctgtcgcccaaccacaaactgctccagtatggagacatggaagagggcgcatctccccccactctggagtcactgcccgagcagctccctgtggccgatatgagagccctgctaaccggaaaggactgccctcacgtcagagagaagggaagcggcaagcagaacaaggacttgtatgaactggcctttagtatttcctacgatagaggggaagaagaggcttatctgaattttattgcccccagtaagcgcgagttttacctttggaccgatggattgtcggccctactaggtagccccatgggttctgagcagacgaggcttgatctggagcagctgcttacaatggaaaccaagctcagattactcgagctggagaatgtccctattcccgagcgtccgcctccagtacccccacctcctactaattttaatttttgctacgactgcagtatcgccgagccttag

SEQ ID NO: 115806 - DNA, 2511 bp, Artificial Sequence
  Description of Artificial Sequence: Synthetic coding sequence
atgagtaaactttctttccgagcgcgggcgctcgacgcctcaaaacccttaccggtctttcggtgtgaggatctgcccgacttgcatgaatatgcatccattaacagagctgtgcctcagatgcctaccggcatggagaaggaggaggagtctgaacaccatttgcaacgcgctatctctgcacaacaagtgtatggcgagaaacgggataacatggtgataccagtccctgaagccgagagcaacattgcttactacgagagcatctaccccggggagtttaagatgcctaagcagttgattcacatccagccattctccctggacgcagagcagcctgattatgaccttgattcagaagatgaggtgttcgtaaacaagcttaagaagaagatggatatctgcccactgcagttcgaggagatgatcgatcggctcgagaaaggctcaggacagcaacctgtctctctgcaggaggccaagcttctccttaaagaagacgacgagcttataagagaagtttacgagtattggattaaaaagaggaaaaattgtagaggaccaagccttataccctccgtgaagcaggaaaaacgagacggatcctctacaaacgatccctatgtcgctttcagaagaaggactgagaaaatgcagacacgtaagaataggaaaaatgatgaagcctcatacgagaaaatgcttaagctgaggagagatctgtctcgtgctgtgacaatcctggagatgatcaagagaagggagaagtccaaaagagaactgctccacttgacgttggaaatcatggagaagaggtataacctcggagactataacggggagatcatgagtgaagtcatggcccagcggcagcccatgaagcccacctatgccatccctattatccctatcaccaatagtagtcagtttaagcaccaggaggcgatggatgtcaaggagttcaaggtgaataagcaggacaaggctgatctgattcggcccaagcggaaatacgagaaaaaacccaaggtcctaccaagcagtgctgcagccactcctcaacagacttctcctgcagcgttgcctgtgttcaatgcgaaagatctaaaccagtacgatttcccctcctcagacgaagaacccctgagccaggtcctttccgggagctcggaggccgaggaagacaacgatcccgatggccccttcgcattcaggaggaaggcgggctgccaatactatgcccctcacctcgaccagacaggcaactggccctggacatcgcctaaggacgggggactgggggatgtgaggtatagatactgcttgaccacactgactgttccgcagagatgtataggctttgccagacgacgggtgggacgtgggggcagagtcctgcttgatagagcccattcagactacgactccgtctttcaccacctggaccttgaaatgctgtcaagtccccaacattcgcctgtcaaccagtttgcaaacacaagcgagaccaatacatctgacaaatccttctctaaagacctctcgcagatactagtcaacatcaaatcttgtaggtggcgccattttagaccccgaactcccagtctccacgattccgataatgatgagttatcgtgccgaaaactctatagatccatcaataggactgggaccgctcaacccggcactcaaacctgcagcacctccacccagtcaaaatcttctagcggctctgcacactttgctttcaccgcagagcagtaccagcagcaccagcagcagcttgccctgatgcagaagcagcagttggcccagattcagcagcagcaagccaacagcaactcatcaactaacacaagccaaaacttagcctctaaccagcagaagtctggattccggctgaacatccagggcctcgaaaggaccctacaggggtttgtctcaaagacactcgatagcgccagcgcgcagtttgctgcttccgcattggtgacgtcagagcaactgatgggtttcaagatgaaggatgacgtcgtgcttggcatcggcgtcaacggcgtactacctgcaagtggcgtgtacaaaggcctgcacctgtctagcactacacccacagccttggttcatacctctccctctaccgccgggagcgccctgctccaaccttctaatattacacagacaagctccagtcactccgccttaagccatcaggttaccgcagccaactctgccactactcaagttctcataggaaataatatacgcctaaccgttcccagctccgtggccaccgtgaacagtatagcacccatcaatgctaggcacatcccccggaccctgtcagccgttcctagttccgccctcaaactggctgccgcagcaaactgccaagtgtccaaggtcccgtccagctcatccgtggacagtgtccctcgtgagaatcacgaatccgaaaaacctgctttaaacaatatcgcggacaacaccgttgccatggaggttacatag

SEQ ID NO: 115807 - DNA, 2442 bp, Artificial Sequence
  Description of Artificial Sequence: Synthetic coding sequence
atgtccaaactgtcttttagagcaagggccctcgacgcctccaaacccctgccggtgtttagatgtgaggaccttcccgacctgcatgagtacgcatctatcaatagagcagtcccacagatgcccaccggcatggagaaggaagaggagagtgagcatcatttgcaaagagcaatctcggcccagcaagtgtatggcgagaagagggataatatggttattcccgtgccggaggctgaaagtaacatagcctactatgaaagcatctatcctggagaatttaaaatgcccaaacagctcatacatattcaaccattctccctggatgccgaacaacccgactacgacctggacagcgaggatgaagttttcgttaacaaactgaagaaaaagatggatatttgtcctctccagtttgaagaaatgatcgaccgcctggagaaggggtctggccaacagcccgtgagccttcaagaggccaagctattgctgaaagaagatgacgagctcattagagaggtgtacgagtactggataaagaagcgaaagaattgtagggggccaagcctaataccgagcgtgaagcaggaaaagagagatggctcaagtactaatgatccttatgtcgctttccgtcgcaggactgagaagatgcagacacgcaagaatcggaaaaatgacgaggcttcatacgagaagatgttgaaattgaggcgtgacctttcacgtgctgttacaatcctggagatgatcaaaagacgtgagaagagcaagagggaactgctgcacctcacgttagagatcatggagaaacgctataacctcggagattataatggagaaattatgagcgaagtgatggcccaacgccagccaatgaagccgacatatgctatccctatcatccccatcacaaactcttctcagttcaagcaccaggaggccatggacgtgaaggaattcaaggtcaacaaacaggacaaggccgacctcattcgccccaaacgtaagtacgaaaaaaaacccaaggtgctccccagctcagcggccgccacaccccagcaaacttcgccagcggcactgcctgtattcaatgccaaagacctgaatcagtacgacttcccttcctccgacgaagaaccactgtcccaggtgctttctggaagcagcgaagctgaggaagataacgatccagatggacctttcgcattcagaaggaaagccggctgccaatactacgccccgcaccttgatcaaacggggaattggccctggacgtcaccgaaggacggaggactaggcgatgtgcggtacagatactgcttgaccacattaacggtgcctcagcgctgcatcgggttcgcaagacgccgtgtgggccgaggcggccgggtgctgcttgatcgggcccacagcgactatgactctgtgtttcaccacttggatctggaaatgctgtcttctccccagcattcaccagttaaccagttcgccaacacatcggaaactaacacatcagataagtcattcagcaaggatttaagccagatcctggtgaatatcaaaagttgccgatggcggcacttccgcccaagaaccccctctttacacgattcagataatgacgagctgagctgtagaaagctctatcggtctattaaccgcacaggtacagcccaaccaggcactcaaacctgcagcacttccactcagtccaaaagctcctccgggtcggctcattttgccttcactgccgagcagtaccagcagcaccagcagcagcttgccctcatgcagaagcagcagctagctcagattcagcagcagcaagctaactccaattccagcacaaacacctctcagggcttcgtcagtaagaccctcgacagtgccagtgcacagttcgcagccagtgcattagtgaccagcgagcagctgatggggtttaagatgaaggacgatgtcgtcctaggtatcggcgtcaatggcgtcctgcccgccagcggcgtgtacaaggggctccacctcagttcaactacacctactgcactggtgcacacttcgccctcaactgcagggagcgctctgctgcagccatcgaacattactcagacatctagttcccacagcgctctgagccatcaagtgacggccgccaatagtgcaactacgcaggtactgattgggaacaacatccgtctcaccgttccctcaagtgtggcaaccgtgaatagcattgcaccaattaacgctcgccacatccctagaaccctgtcggcggtgccaagtagcgccttaaagcttgctgctgccgctaactgtcaagtcagcaaagttccctcttcttcatcagtcgatagcgttcctagagaaaatcacgaaagcgaaaagccggctctgaacaacattgcagacaacactgtggccatggaggtgacttag

SEQ ID NO: 115808 - DNA, 2292 bp, Artificial Sequence
  Description of Artificial Sequence: Synthetic coding sequence
atggagcatcatctacagcgcgctatcagcgcacaacaggtatatggagagaagagggataacatggttatccccgtcccagaagcagaaagcaatattgcttactacgagtctatatatcccggcgagttcaagatgcccaagcaactcattcatatccaacccttttcactggacgctgaacagccagactatgacctggacagcgaggatgaagtattcgttaacaagcttaaaaaaaaaatggacatctgtcctctgcagttcgaggagatgattgatagactggagaaaggctcaggccagcagccggtgagcctccaggaggctaaactcctgttaaaagaagatgacgaactgatacgagaagtttacgagtattggatcaagaagagaaagaactgccgcggccctagtctcatcccctccgtgaaacaagaaaagcgcgatggttcctcgactaatgatccgtacgtggcgtttaggcgcagaactgaaaagatgcagacccggaagaacagaaaaaacgacgaagcatcctatgagaagatgctgaagctgcgtcgcgatcttagcagggcagtcacgattttagaaatgattaaacgtcgggaaaagtctaagagagaactcctgcacctgaccctggagattatggaaaagcgctataatctaggtgactacaacggagaaatcatgtctgaggtcatggctcaaaggcagccaatgaaacccacttacgcaattcctattattcctattactaattcaagtcagttcaagcaccaggaagccatggatgtaaaggaattcaaggttaataagcaagataaagcggatttaatccgaccgaaacgaaaatacgaaaagaagccaaaggttctgccctcctccgcagccgctactcctcagcagaccagtccagctgcactgcccgtcttcaacgctaaagatctgaaccagtacgactttccatcttccgacgaggaacctcttagccaggtgctgagcggctccagtgaagccgaagaggataacgatcctgacgggccgtttgcttttaggcgaaaagccgggtgccagtactatgctcctcacctcgatcaaaccggaaactggccgtggacctcacccaaggatggcggcctgggtgacgttcggtatcgctactgcctcacaaccctcacagtaccccaacgctgtattgggtttgctaggcgtcgcgtcggacggggtggtcgtgttctactggacagagcccattctgattatgacagcgtgtttcatcacttagatctcgagatgctgtcttcccctcagcacagccctgtgaatcaatttgccaatacatcagagacgaatacaagtgacaaatccttctccaaagatctctcccagattcttgtgaacatcaagagctgccgctggagacactttagacctcgcacaccctcgctgcatgatagtgataacgatgagttgagctgccggaagctctacagatctattaataggactggcaccgcgcagccgggcactcagacatgttccaccagtacgcagagcaaatcttcaagcggatcagcccattttgcctttaccgccgagcaataccaacagcaccagcagcaacttgctttaatgcagaaacagcagcttgcccagatccagcagcaacaggctaacagtaattcatccacaaacacaagccagggttttgtcagcaagacgctcgattccgccagtgcccagttcgccgcatctgccctggtgacgagcgaacagctgatgggattcaaaatgaaggatgatgtggtgctcgggattggcgtgaacggagtgctccctgcgtcgggcgtgtacaagggactgcatttatctagcaccactcccacagcacttgtgcatacttctccctcaaccgcaggatccgccctgttacagccttccaatatcacacagacctcctcttcacactcagccctaagtcatcaggtgacagccgccaattcggctactacacaagtattgattgggaacaacatacggctgactgtcccctccagtgtcgccaccgtgaactccattgctcccattaatgcaaggcacattccaaggaccctgtctgcagtgccaagctccgcactgaaactggcagctgccgccaattgtcaagtttccaaagtcccgagcagcagcagtgtcgatagcgtgccacgagaaaaccacgagtcggaaaaaccggctttaaataacatcgcagataacaccgtggctatggaggttacctag

SEQ ID NO: 115809 - DNA, 2424 bp, Artificial Sequence
  Description of Artificial Sequence: Synthetic coding sequence
atgagcaagctgtcctttagggctagggccctggacgctgcgaaacctttgcctatttaccgaggcaaggatatgcctgatctcaacgattgtgtctcaatcaaccgagctgtgccacagatgcccacaggcatggagaaggaggaagaatctgagcaccacctgcagcgggccatctccgcacagcaggtgttcagagaaaagaaagagagtatggtgatccccgtgcccgaagccgaaagtaacgtcaattactacaaccgtctttacaagggagagtttaagcagcctaagcaattcattcacattcaaccatttaacctagataacgaacagcccgattacgacatggactccgaggacgagaccttgctgaaccgcctgaaccgaaagatggagattaagccattgcagttcgaaatcatgatcgaccggttagaaaaggctagttccaatcagttggtgacgctgcaggaggcgaaactgcttctgaatgaggatgattatctcatcaaggcagtgtatgactactgggtgagaaaacgcaaaaattgcaggggcccatccctcatccctcagatcaagcaggaaaaaagagacgggtctacaaataatgacccttatgtggcgtttagaaggcggacagagaagatgcagaccagaaagaaccggaaaaacgacgaagcttcttacgagaagatgctgaaattacggcgggagttctcccgtgccattactattctggaaatgattaagcggcgcgagaagactaaaagggagctcctccacctgactttagaggtcgtggagaaaaggtaccatttgggggactacggcggggaaatcctaaacgaagtgaagatatcaagaagcgagaaggaattgtacgccactcccgctaccttgcacaatggcaaccatcacaaagttcaggagtgcaagacaaaacatccgcaccatttatctctcaaagaagaagcatctgatgtggttaggcagaagaaaaaatacccgaagaagcctaaggctgaagctctcatcacatctcagcagccgacccctgagacacttcctgttattaataaatcggacatcaagcaatacgattttcattctagcgacgaagatgaattcccacaggtcctgtcaccggtcagtgaacccgaggaggaaaacgatccggatgggccctgcgccttcagaaggcgggccggctgccaatattatgcaccaaggctagaccaagctaatcactcttgtgaaaactccgaactggcagacttggacaaacttcggtatagacattgtctgactacactgaccgttccgagacgttgtatcgggttcgcgcgacggcgtattggcagaggcggacgcgtaataatggataggatatctactgagcacgatccagtcctgaaacaaatagatcccgagatgctcaattcgttttccagtagttcgcaaacaattgacttttccagcaatttttccaggaccaacgcttcttccaagcactgcgaaaatcgactcagcttgagtgagattctttccaacatccggtcttgtcgacttcagtgttttcaaccgagactgctgaatttgcaggattctgattccgaggaatgcaccagcaggaagccgggccagacggtgaataataaacgcgtctcggccgcctccgttgccctcctgaacacatccaagaacggcatcagcgtaacagggggaataaccgaagagcaattccagactcaccaacagcagttagtacagatgcagaggcagcagctggcccaactacaacagaaacagcagtctcaacactccagtcagcagacccaccccaaagcccaggggagttccacatcagattgcatgagcaaaaccctcgactctgcctcagcacattttgcagcctcggccgtggtcagtgctcccgttccttcacggtctgaagtagccaaagagcagaataccggtcataataatattaatggtgttgtgcagcccagtggtacctcaaagactctgtatagtaccaatatggccttgtctagcagcccgggcatatctgccgtccaactcgtgcggaccgtcgggcacactacaacgaatcacctgattccagctctgtgtacctcctctccacaaaccctaccaatgaacaattcatgcctcacaaatgctgtccatctcaacaacgtaagcgtggtcagccctgtcaacgtccatattaatacaaggacatctgcaccctctcctaccgcactaaaactggccacagtggcggcgagcatggaccgcgtccccaaggtgacaccttctagcgccatcagcagcatcgctcgagagaatcacgaacccgagcgactggggttgaacggtattgccgaaactaccgtagcgatggaagtgacttag

SEQ ID NO: 115810 - DNA, 315 bp, Artificial Sequence
  Description of Artificial Sequence: Synthetic coding sequence
atgtcccacaccatcttgctggtgcagcccacgaagcgtcccgagggtagaacatacgccgactatgagtctgtgaacgagtgcatggaaggcgtgtgcaagatgtacgaagagcatttaaagaggatgaacccgaacagcccctctattacttacgatatcagccaattattcgattttatcgacgacctggccgaccttagctgtttggtgtatcgcgctgatacacaaacctatcagccgtataataaggattggataaaagaaaagatctacgtgctgttgcggaggcaggctcagcaagccggtaagtag

SEQ ID NO: 115811 - DNA, 2253 bp, Artificial Sequence
  Description of Artificial Sequence: Synthetic coding sequence
tatagcaagatggagataccaaacccgccaacaagcaaatgtatcacttattggaagagaaaggtaaagtcggaatatatgaggctgcgccaattgaaacgtttacaggcaaacatgggtgctaaagctctttacgtagcaaatttcgcaaaggtgcaggagaaaactcagatcctaaacgaggaatggaagaaattgcgtgttcagcccgttcagtctatgaagcccgtgagcggtcacccctttctgaagaagtgtaccatcgagtctatatttcccggatttgcatctcagcacatgttgatgcgctcgttaaacaccgtcgctcttgtccctatcatgtatagctggtctccactgcaacagaacttcatggtggaagacgagacagtgctatgtaatataccttacatgggggacgaagttaaggaagaggacgaaaccttcatagaagaactaatcaacaactatgatgggaaggtgcacggggaagaggagatgattcctggctccgtcctcatttcggacgctgtattcctcgagcttgtcgatgctttgaaccaatactctgacgaagaggaggagggacataatgatacaagcgacggtaaacaggacgactcaaaggaagatttgcctgtgacacgcaagagaaagaggcacgctattgaagggaacaagaaatctagtaaaaaacaattcccaaacgatatgatcttctcagccattgcctctatgttcccggagaacggggttcccgacgatatgaaagaaagatatagggagctcaccgagatgtccgaccctaacgcacttccgccccagtgcacccccaacattgatgggccaaatgcaaagtcagttcagcgcgagcaatccttgcactcttttcatacactgttttgcaggcgatgctttaagtacgattgctttctgcaccccttccacgctaccccaaacgtgtacaagagaaagaataaggagatcaaaattgagcccgaaccctgcggcaccgattgctttctgttactcgaaggggcaaaagagtacgctatgcttcataaccctagatctaaatgtagcggacggagacgccgaaggcaccacatcgtgtccgcgtcctgttccaatgccagtgcaagcgcagttgccgagaccaaggaaggcgattccgatcgtgacacaggaaatgattgggccagcagtagcagtgaagccaacagccgctgccagacccctacaaaacagaaagcatcacccgcacccccccagctgtgtgtcgtggaggccccttcagaacccgtagaatggacaggggctgaagaaagcctgtttagggtgtttcatggaacttatttcaacaatttctgttccatcgctcggctgcttgggacaaaaacctgtaaacaggtcttccagttcgccgtaaaggaaagcttaattttgaaattgccgacagacgaattgatgaacccaagccagaaaaaaaagcgcaagcaccgcctgtgggcggctcattgtcgcaagattcaactgaaaaaggataactcctccacacaggtgtataactaccaaccatgtgaccaccccgatagaccatgtgacagtacatgtccctgtattatgactcaaaatttctgtgagaagttctgccaatgcaatcctgactgccagaaccgcttccccgggtgtaggtgcaagacccagtgcaacacaaagcagtgcccttgctacttagctgttcgcgagtgcgacccagacctatgtctaacttgtggtgcctctgagcattgggactgtaaggtggtctcctgcaaaaattgtagtatccagaggggcctgaaaaaacatttgctgcttgccccctccgacgtggccggttgggggacattcataaaagagtcagtccagaaaaacgaattcatctccgaatattgcggcgaattaatcagtcaggatgaggcggaccgccgaggaaaggtgtacgacaaatatatgagttccttcctctttaacttgaacaacgattttgtcgtcgacgctactcggaaaggtaataaaatacggtttgcaaaccactctgtcaatcctaattgctacgcgaaagtcgtgatggtaaacggcgatcataggattgggatcttcgcaaaacgcgctattcaggcgggggaggagctgttctttgactatcgctacagccaggccgatgccctcaagtatgtgggcatcgaacgagaaacagacgtcctctag

SEQ ID NO: 115812 - DNA, 2124 bp, Artificial Sequence
  Description of Artificial Sequence: Synthetic coding sequence
atggagatccccaaccctccaaccagtaaatgtattacttattggaagagaaaggtgaagagtgagtacatgaggctccgccagttaaagagactgcaggcgaacatgggcgccaaagcactgtatgttgcaaactttgctaaggtacaggagaagacccagattctgaatgaagagtggaaaaaacttagggtgcagcccgtacaatcaatgaaaccggttagcggtcatccttttctgaagaaggttgaagacgagacagtgttatgcaacattccttatatgggcgatgaggtgaaggaggaagacgagacttttatcgaagaattgatcaataattacgacgggaaagtgcacggtgaggaagagatgatccccggcagcgttctgatcagcgacgccgtgtttctagagcttgttgacgccctgaatcagtatagcgatgaagaggaggaagggcacaatgacaccagcgacgggaaacaggacgacagtaaggaagacctgccggtcacacgtaagaggaaacgccacgcaattgagggcaataaaaaaagctcaaaaaaacagttcccaaatgacatgattttttcagctatagctagcatgttcccagagaatggcgtcccggacgatatgaaggagagataccgcgaattgacggagatgagcgacccaaatgcgcttcccccacaatgtaccccaaacatcgatggaccaaacgcaaaaagcgttcaacgagagcagagcctgcattcattccacacactcttttgtagaagatgctttaagtatgattgctttctgcacccattccacgcgacccctaacgtctataagcgaaaaaataaggaaattaaaatagagcccgaaccatgcgggacagactgcttcctgttgctcgagggggcgaaagaatacgctatgcttcacaacccacggtcaaagtgtagtggtaggcgaaggcgtaggcaccatattgtgtctgccagttgcagcaacgcctccgcctcagccgtggcggagactaaggaaggggattctgaccgcgacaccgggaacgattgggcatcctctagctccgaagctaattctagatgccaaactcccaccaaacaaaaggcaagtcccgcgccaccccagctgtgcgtggtggaggcgccatccgagccagtcgaatggacaggcgccgaggaatccttattcagggtctttcacggcacgtacttcaacaatttttgctccatcgctcgcctcttaggtacaaagacatgtaaacaggtcttccagttcgcagtcaaagagtcactcatactcaaactccccaccgatgaactgatgaacccttcacagaaaaagaagcgcaaacatcgtctatgggcagcccactgccgcaaaatacaattaaaaaaagataattcatcgacccaggtatacaattaccagccttgcgatcaccccgaccggccttgcgattcaacttgcccctgtatcatgacccagaatttctgcgagaagttttgtcaatgcaaccctgactgtcagaaccgatttccggggtgcagatgcaagactcagtgcaacacaaagcagtgtccatgttacctggccgtacgtgaatgcgatcccgacctgtgtttgacttgcggagcttccgagcactgggactgtaaggttgtaagttgcaagaattgctctatccaaagaggactgaagaaacatctcctgttggcacctagcgatgtggctggctggggtacttttatcaaagaaagtgtgcagaaaaacgagttcatctccgagtactgcggggaactaatcagccaagatgaagccgaccgcagaggcaaggtgtacgacaaatatatgtctagctttcttttcaacttgaacaatgatttcgtggtagatgcgaccagaaagggtaacaagatcaggttcgccaatcacagcgtgaatccaaattgctacgccaaagtggttatggtgaacggtgaccatcgcattggaatattcgcaaagagagccattcaagcgggtgaggagctcttctttgactatcgctacagccaagccgacgccctgaagtacgtgggcatagagcgcgaaaccgacgtgctttag

SEQ ID NO: 115813 - DNA, 2244 bp, Artificial Sequence
  Description of Artificial Sequence: Synthetic coding sequence
atggagatacctaatcctcccacaagtaaatgcatcacatattggaagaggaaggtgaagtctgagtacatgcgcctgagacagctgaaacgtctccaggcgaacatgggcgctaaagctctgtatgtcgccaacttcgcaaaagtacaggagaaaactcaaatactgaacgaagagtggaaaaaactgagagttcagccagtacagagtatgaagccagtttcaggacatcctttcctgaagaaatgtaccatcgagtctattttccctggctttgcttcacagcatatgttaatgcgatcccttaacaccgtcgctctagttccaatcatgtactcctggagccccctccaacagaacttcatggtcgaggatgaaacagttctctgcaacataccttatatgggagatgaggtcaaggaggaagacgaaacctttatcgaagagctgataaataactatgacggaaaggtccatggcgaggaagagatgatccctggatcagtgctgatttctgacgccgtgtttctggagcttgtagatgcccttaaccaatactcagacgaagaagaggagggacacaatgatactagtgacggaaagcaggatgactccaaagaagacctgccagtgacccgaaagagaaagaggcacgctattgaggggaacaagaagtccagcaagaagcagtttcccaatgatatgatattttctgccatagcatccatgttccctgagaatggggtccctgacgatatgaaagaacgctacagagaactgacagagatgagcgaccctaacgccctgccacctcagtgtaccccaaatatagacggaccgaacgcgaaaagcgtgcagagggaacaatccctgcactcctttcatacccttttctgccgtcgctgctttaagtacgactgcttcctgcatccgttccatgctacacctaacgtatacaagcgaaagaataaggagatcaagatcgagcctgaaccctgtggcaccgactgttttctgctgctggaaggcgcaaaggagtacgctatgctccataatccgaggagtaagtgtagtggaagacgcaggagacggcaccacattgtgagcgcctcctgttcaaacgcctcagcctccgcagttgctgagacgaaggagggggattcggatcgggacacagggaacgactgggcatctagctcatccgaggctaattcgaggtgccagactcctactaagcaaaaagcgagtcccgctccaccccagctgtgcgttgtggaggccccatcggagcctgttgaatggaccggcgccgaagaaagcctgttcagggtattccatggcacctacttcaataacttttgctctattgcacggctgttggggacaaagacatgcaaacaggtcttccagtttgctgtgaaggaatcccttatcctgaaactgcccacagacgaattgatgaacccctctcagaaaaagaaacgaaaacatcggctgtgggcagcccattgtagaaagattcagctcaaaaaggataacagctccacacaggtttacaattaccagccatgcgaccacccagatcggccttgcgattctacctgtccttgcatcatgacccagaatttctgtgagaaattttgccagtgtaaccccgattgccagaaccgatttccaggatgtagatgtaaaacacaatgtaacactaaacagtgtccttgctatttggccgtccgagaatgcgatccggatctctgccttacatgtggcgctagtgaacactgggactgtaaggtggtgagttgtaagaattgctcaatccagaggggtctgaagaaacacttactcctcgcccccagcgatgtcgccggatggggaacatttataaaagaatcggtccagaaaaatgagttcatctcagaatattgcggcgagctgatctcacaggacgaggccgaccgccggggcaaggtgtatgacaaatacatgtcaagttttctttttaacctgaataacgatttcgtggttgatgcaacacggaaaggcaacaagattcggtttgctaatcactcagtcaaccctaactgttatgccaaggtggtgatggtgaatggtgaccaccggatcgggattttcgcaaaacgggcgatccaagcaggggaggagttatttttcgactaccggtattcccaagcggacgccctgaaatacgtcggaatcgagcgcgaaacagatgtgctgtag

SEQ ID NO: 115814 - DNA, 1827 bp, Artificial Sequence
  Description of Artificial Sequence: Synthetic coding sequence
atggaggaagcaagctgccctacatgtagcgtaaacgaggcttgcgagtggacgccttttagccagaaggagatgatcccgggatccgtcctaatttccgatgccgtgttcttagagctggtggacgctcttaatcaatactctgacgaagaggaagagggccacaacgatacctccgatggaaaacaagacgactccaaggaggacttgcctgtgaccagaaaaaggaagaggcacgccatcgaaggcaacaagaagtcctcgaagaagcaatttccaaacgacatgatcttctccgctattgcttccatgtttccagagaatggggttcccgatgatatgaaggaaaggtaccgcgaactgaccgaaatgtcagatcccaacgcgctgcctccccaatgtacacctaatatagatggacctaatgcaaaatcagtccagcgggagcagagcctgcattcctttcatacacttttctgccggcgctgctttaagtacgactgtttccttcacccttttcatgcgacccctaatgtttacaaaaggaaaaacaaagagatcaaaatcgaaccggaaccgtgtggaaccgactgttttctgcttttggaaggtgccaaagaatacgctatgctgcacaaccctaggtccaagtgctccgggcgtcgacgccgacgtcatcacatcgtgtccgcttcctgttccaacgctagtgcatccgccgtagcagaaacaaaagagggcgactctgatcgagataccggtaatgattgggcatcctcctcatctgaggcaaactcccgatgtcaaacccctaccaagcaaaaggctagcccggctccgccccaactgtgtgtcgtagaggcaccatccgagccggtggaatggaccggtgcagaggaatctctttttcgggtgtttcacggcacatattttaacaacttctgttcgatcgctcgtctgctggggactaaaacttgtaagcaagtgtttcagttcgctgtcaaggagtctctcatcctcaaactgcctacagatgaactgatgaatccaagccaaaagaagaaacgaaaacaccgactgtgggccgcacactgcaggaaaattcagctgaagaaggacaattcatcaacccaggtgtataattatcaaccctgtgaccacccggatcggccttgtgatagcacttgcccatgcattatgacccaaaatttctgtgaaaaattctgtcagtgcaatcctgactgccagaacagatttccaggatgcagatgtaagacacaatgtaatactaagcagtgcccatgttatctggccgtgagagaatgtgaccccgacctgtgcctcacttgcggggcaagcgagcattgggattgcaaagtggtgagctgcaaaaattgtagtatccagcggggactcaaaaaacacctgctgctggcgccaagtgacgtggccggttggggtacatttattaaggagtccgtgcagaagaatgagttcatctccgaatattgcggcgaacttatcagccaggatgaagcggacagaagaggcaaagtgtatgataagtatatgtcatcctttctgttcaacctgaacaacgattttgtcgtggacgctactagaaagggcaataagatcaggttcgccaatcattccgtgaaccccaattgttacgcaaaggtcgttatggtcaatggcgaccatcggattggcattttcgccaaacgggccatacaagcgggcgaggaactgttctttgattacaggtacagccaggctgacgcactgaagtacgtgggtatcgagagggagacagatgtgctttag

SEQ ID NO: 115815 - DNA, 2256 bp, Artificial Sequence
  Description of Artificial Sequence: Synthetic coding sequence
atgggacaaaccggtaagaagagcgagaaaggccctgtgtgctggcggaagcgtgtgaagtcagaatacatgaggcttagacagctcaagcgattcaggcgtgccgacgaagtgaagtcaatgttctcctcaaaccgacagaagatcctggagaggacagaaatcctgaatcaggagtggaagcagcgtcgaatccagcctgtgcatatcctgaccagcgtcagttcactgcgtggcacaagagagtgttcagttacctctgatcttgatttccccacacaggtgatcccactcaagaccttaaacgccgtcgcgagcgtgccaatcatgtactcctggtctcccctgcagcagaatttcatggttgaagacgaaacagtgctgcataacatcccttacatgggggacgaggtgctggaccaggatggaacctttattgaggagttaatcaagaactatgacggaaaagtccatggggacagagaatgtggatttattaatgacgaaatcttcgtggagctcgttaacgcactgggccagtataacgatgacgatgatgatgacgacggagacgatcccgaggagagagaggaaaagcagaaggatctagaggatcacagggatgacaaagagagtcgtccccctcgaaagttccccagtgacaagattttcgaggcaatctcatctatgttccctgacaagggtacagccgaagaactcaaagaaaaatataaagaattaactgaacagcagctgcctggtgcccttcctcccgaatgtaccccgaatattgacgggccgaatgcgaaatcagtacaacgtgaacagagcctgcactcctttcacaccttgttctgtagaagatgcttcaagtacgactgctttctacaccggaaatgcaattatagcttccacgccacgccgaatacctacaaacgcaaaaacaccgagaccgctctggacaacaagccatgcggcccacagtgttaccagcatctggagggcgccaaagaatttgctgccgccctgacagcggagagaatcaaaactccccccaagaggcctggcggaagacggagaggaaggctgcccaataacagctctcgaccaagcactcctaccattaatgtgctggaatccaaggacacagacagcgacagagaagccgggaccgaaaccgggggggagaataatgacaaggaggaggaagagaagaaggatgagacttccagcagttcggaggcaaattcaagatgtcagacaccaataaagatgaaacctaacattgaaccacccgagaacgtggagtggagcggcgccgaagccagcatgtttagggtgctgatcggtacatattatgataatttttgtgcgatcgccaggctgattggtacaaagacctgcagacaggtgtatgaatttagggtaaaggagtcaagcattatcgctccagcacccgcagaggatgtcgataccccaccaaggaagaagaaaagaaagcatcggctctgggctgcacattgtcggaaaattcagctgaagaaagatggaagctccaaccacgtctacaattaccaaccctgcgaccacccccgccagccttgtgactcttcttgtccatgcgtgatcgcgcagaatttctgcgaaaagttttgtcagtgttcatctgaatgccagaatcgctttcctgggtgcaggtgcaaagcacaatgtaataccaaacaatgcccttgttatctagcagtgcgcgaatgtgaccccgacttgtgtcttacatgcggcgctgccgaccattgggacagcaaaaatgtttcttgtaagaactgctctatccagagagggtctaagaaacatctgctcctggccccaagtgacgtggcaggatggggaatttttatcaaagacccagtccaaaaaaacgagttcatcagcgaatactgtggggaaattatctcccaggatgaggccgaccgccgaggcaaggtttacgacaagtatatgtgcagctttctttttaatttgaataatgacttcgtcgtcgacgctacgcggaagggcaataaaattagattcgccaaccacagcgtcaatcctaactgctatgcgaaggtaatgatggtaaacggcgaccatagaattggaatatttgcgaagagagcgattcaaacgggcgaggagttgtttttcgactacagatacagccaggcggacgccctcaagtatgtcggcatcgagcgtgagatggaaatcccttag

SEQ ID NO: 115816 - DNA, 2124 bp, Artificial Sequence
  Description of Artificial Sequence: Synthetic coding sequence
atgggccagactggcaaaaaatctgagaaggggcctgtgtgttggaggaaacgtgtgaagagcgagtatatgcgcctgagacagctgaagaggtttagacgagcagacgaagtaaagtccatgttttcttccaatcgacagaaaatcttagaacgtactgaaatattaaatcaggaatggaaacagaggaggattcagcctgtccacatccttactagtgtgagctctctgaggggcactagggaggttgaagacgaaacagtcctacataatattccctatatgggcgacgaggtactcgaccaagacggcacgttcatcgaggaactaatcaaaaattatgacggcaaagttcatggcgatcgggagtgcggcttcatcaacgatgaaatctttgtagaacttgttaacgctctgggtcaatataacgacgatgacgacgacgacgacggcgacgacccagaggagcgcgaagagaagcaaaaggatctcgaagatcatcgggacgataaggaaagcagacctccgagaaagtttcccagtgacaaaatttttgaagccattagcagcatgtttccggataaggggacagccgaggagctgaaggagaagtataaggaactgactgagcagcagcttcccggagccctcccccctgaatgcacccctaacatagatggcccgaatgccaaaagcgtccagcgcgaacaatcccttcactcctttcatactttgttctgtcggagatgcttcaaatatgactgctttcttcaccccttccatgccactcccaatacttacaagaggaagaatacagaaactgccctagacaacaaaccctgtgggccacaatgttatcagcatttagagggggccaaggagttcgctgcagctctgacagccgagaggataaaaactccccctaagaggcctggcggccgccgcagaggacgcctgcctaacaactctagccgacctagtactccaacaatcaatgttctggaatctaaggacaccgacagtgacagggaggcaggtactgagacaggtggtgaaaacaacgacaaagaggaggaggaaaaaaaggatgagacatccagcagctctgaagctaattctcggtgccagacccctataaaaatgaaacccaacatcgagccgccagagaatgtggagtggtctggggctgaggcctcaatgttccgtgtgttgatcggcacgtactatgacaatttctgtgctatagctaggcttatagggaccaagacgtgtcgccaggtgtacgagttccgggtaaaggagagcagcattatcgcacccgcccccgccgaggacgtggacacaccaccccgtaagaaaaagcggaagcatcgcctgtgggcggctcactgcagaaagatacagttgaaaaaggacgggtctagcaaccatgtgtataattaccagccctgtgatcatcccaggcagccctgcgattcttcctgcccgtgtgtgatcgcgcagaacttctgcgaaaaattctgtcagtgcagctccgagtgtcagaatagattcccagggtgtcgatgcaaggcccagtgtaatactaagcaatgcccatgttacctggctgtgagggaatgcgacccagatctttgtctgacatgtggtgcggccgatcattgggacagcaagaatgtttcatgtaaaaactgtagtatccaacgggggagcaagaagcaccttcttttagctcccagcgacgtggctggttggggaatttttatcaaggacccagtccagaaaaatgagtttatttcagaatactgtggcgagatcatcagccaggacgaagctgacagaaggggcaaggtgtacgacaaatatatgtgtagcttcttgttcaacttgaacaacgatttcgtggtagacgctacaaggaaggggaacaaaatccggtttgccaaccattccgtcaaccccaattgctacgccaaggttatgatggtgaatggggatcatcggatcggcatttttgccaaacgggctatacagactggcgaggagctcttctttgactaccgctactcccaggctgacgccctgaagtatgtaggcatagagagggagatggagattccctag

SEQ ID NO: 115817 - DNA, 2241 bp, Artificial Sequence
  Description of Artificial Sequence: Synthetic coding sequence
atgggtcagaccggcaaaaaatccgagaagggtcctgtttgttggagaaagcgggtgaagtccgagtacatgaggctcagacagctcaagcgtttcaggcgcgccgacgaggtgaagtcaatgttttcgagcaataggcagaagattctcgagaggactgagatcctgaaccaggaatggaagcaaagaagaatccaacccgtccacattctgacatcggtttcaagcctaagaggaacccgggaatgttctgttacgagtgatctggatttccccactcaggtgatccccctcaaaacccttaacgccgtggcctcagtgcctataatgtattcatggtcacctctacagcagaatttcatggttgaggacgaaacggttctgcacaacatcccttacatgggagacgaagttttggaccaggatgggactttcattgaggaactgattaaaaattatgatgggaaagtgcatggtgatcgggagtgcgggttcatcaatgacgagattttcgttgaactggtgaatgccctgggtcagtacaatgacgatgacgatgacgacgacggcgacgatccagaagaacgggaggaaaaacagaaggatctggaggaccaccgagacgacaaggagtctagacctccacgcaaattcccatctgataaaattttcgaggcaatttctagcatgttcccggataagggcacagcagaagagctgaaggaaaagtacaaggaactgactgagcagcagttgcccggggcgctgccccccgaatgtacgccaaatatcgacggaccaaatgccaaatctgtgcaacgggagcaatctctgcactcattccacaccctgttttgtcgacgctgctttaagtacgactgctttctgcaccctttccacgccactcctaatacatacaagcgcaaaaataccgagaccgcactggacaacaaaccctgcggaccccagtgttaccagcacctcgagggagcaaaagaatttgcagctgccctaacagccgagcgaataaagacacctcctaaaagacccggcggtcgcagaaggggacgcctccctaacaactctagccgcccttcaactcccacaataaacgtgctggaatccaaggatactgattcagatcgcgaagccggaactgagaccggcggggagaacaatgataaggaggaggaggaaaaaaaagacgagaccagcagtagttccgaagctaactcaagatgtcagacccccatcaaaatgaaacccaacatcgagccgcccgagaatgtagagtggagtggtgccgaggcttccatgtttagggtgctgattggcacgtactacgacaatttttgcgccattgccagacttattgggaccaaaacgtgtcggcaggtgtatgaattccgggtgaaggagtctagcatcatcgctcccgcgccggcagaggatgttgacacccccccgaggaagaaaaagcggaagcaccggctgtgggccgcgcattgtaggaagatccaactcaagaaagatgggagttctaatcacgtgtataactaccagccgtgcgatcatccccgccagccttgcgatagttcttgtccatgtgtgattgcacaaaacttttgtgaaaagttttgccagtgcagctctgagtgtcagaatagatttcctggatgtcgatgcaaggctcagtgcaacacaaaacagtgcccatgttacctcgccgtcagagaatgcgatccagatctttgtctgacctgcggagcggccgaccattgggattcgaagaatgtatcatgtaagaactgctcaatccaaagaggaagtaaaaagcacctgcttttggccccaagtgatgtggccggatgggggatctttattaaggacccagtgcagaagaacgagttcatcagtgagtattgtggggaaataatatcacaggacgaggcagatcgacgcggaaaggtctacgacaaatacatgtgttcctttcttttcaatcttaacaacgacttcgtggtggacgctaccaggaaaggtaataaaatcagatttgcgaaccatagcgtcaatccgaactgttacgctaaagtaatgatggtcaatggtgaccacaggattggtatatttgcgaaacgagccattcagactggagaagagttgttcttcgattatcgctatagtcaggccgatgctcttaagtatgtggggatagagcgagagatggaaatcccatag

SEQ ID NO: 115818 - DNA, 678 bp, Artificial Sequence
  Description of Artificial Sequence: Synthetic coding sequence
atgtatagttggtcacctttgcaacaaaacttcatggtagaagatgaaaccgtgctccataatatcccttatatgggcgatgaggtcttggaccaggatggcacattcatcgaagagttgattaaaaactatgatggcaaagtgcacggtgaccgcgaatgtggcttcatcaacgacgaaatatttgtggagctggtcaacgccctgggtcagtataacgatgatgatgatgacgatgatggggatgacccagaagaacgggaggagaaacagaaagatctcgaggaccatcgcgacgataaagaaagccggccgcccagaaagtttcctagcgataaaatattcgaagccatttcctccatgtttcctgataagggcaccgccgaggagctcaaggagaagtacaaagaattgaccgagcagcaactccccggggctctcccacctgagtgcactcctaacattgatggaccaaacgctaaatccgtccagcgggaacagtctctgcactcttttcacaccctcttttgccgcaggtgctttaagtatgattgttttttgcaccccttccatgctacaccgaacacatataagcggaaaaacacggaaaccgcacttgacaataagccctgcggacctcagtgctaccagcatttgccccttctgccccggaactag

SEQ ID NO: 115819 - DNA, 2088 bp, Artificial Sequence
  Description of Artificial Sequence: Synthetic coding sequence
atgggccaaacaggcaaaaagtccgagaaggggccagtgtgttggaggaaacgagtgaaatctgagtacatgcgcttaagacagctgaagaggtttcgtcgggcagacgaagtaaaaagcatgttttccagcaataggcaaaagatcttggagcgcacggagatcctcaaccaggagtggaaacaacgacggatccagcccgtgcacatcctgaccagctgctctgtaactagtgacctggatttcccaacccaagtgattcctttaaagacacttaacgccgtggccagtgtgcctatcatgtactcctggagcccactccaacagaacttcatggtggaggatgagacagttctacataacataccatacatgggggacgaggtcctggaccaggacggtaccttcattgaggagctgatcaagaactacgatggtaaggtccacggggaccgggagtgtggtttcattaacgacgaaatattcgtggagttggtgaatgcgctggggcagtataacgacgacgatgacgacgacgatggagatgatcctgaagaacgtgaagaaaaacagaaagacttggaggaccacagagacgacaaggagagccgcccacccaggaagttcccttccgacaaaatctttgaagccatatcctcaatgtttcccgacaaggggactgcagaggagctgaaggaaaaatacaaggagttgaccgagcagcagctgcctggcgcactgccacccgaatgcacacctaacattgacgggcctaatgcaaaaagcgttcagcgcgagcagtcccttcacagctttcacacgctcttctgtcgtcggtgttttaagtatgactgcttcctgcacccattccatgcaacaccaaacacgtataaaaggaagaacactgagacagctctggataataagccatgtggacctcagtgttatcagcatttagagggggcgaaagaattcgctgcagccctgaccgctgagcgaatcaagactccccctaagcggcccggtggtagacggcgtgggcgtctgccgaataatagctcccgtccatccactcctacaatcaacgttctagaatcaaaggacacggactcagaccgggaggccggcaccgagactggaggcgaaaacaatgacaaagaggaagaggaaaaaaaagatgagacctccagtagcagtgaagcaaactcacgatgccagacccccattaagatgaaaccgaacattgaacccccggagaatgtggagtggagcggggcagaggcgagcatgtttcgggtgcttatcgggacttactacgacaacttctgcgctattgcgcggctgattggcacaaagacatgccggcaggtgtacgagttcagggttaaggagtcaagtattattgcgcctgccccagcagaagatgtggacactccccccagaaagaaaaagagaaagcataggctgtgggccgcccattgtaggaagattcagttaaagaagggacagaaccggttcccagggtgtcggtgtaaggcccaatgcaataccaagcaatgcccttgttatctggccgtgcgcgaatgcgatccagatctgtgcctgacctgtggagcagccgatcattgggactctaagaacgtcagctgcaagaactgtagcatacagcgaggtagtaagaagcacctgctactggctccgtcggacgtcgcaggttgggggattttcatcaaagatcctgtgcaaaagaatgaatttataagcgaatattgcggtgagatcatctcacaggacgaggccgaccggcgggggaaggtgtacgacaagtacatgtgctcgttccttttcaacttgaacaatgacttcgtcgttgatgctactaggaaaggaaacaaaattagatttgccaatcactcggtgaatcccaactgctacgccaaggtgatgatggtgaacggagatcatcgtatcggcatctttgcaaaaagggccattcagaccggtgaagagcttttcttcgactacaggtatagccaggccgatgcgctcaagtacgtgggtattgaaagggagatggagatcccctag

SEQ ID NO: 115820 - DNA, 2088 bp, Artificial Sequence
  Description of Artificial Sequence: Synthetic coding sequence
atgggtcaaacaggcaagaagtccgagaaaggccccgtgtgctggaggaaaagggtgaagtcggagtatatgagactgagacagttaaaacggtttcgcagggccgatgaggtaaagagcatgttcagtagcaacagacagaagattctcgaaaggaccgaaatacttaatcaggagtggaagcagaggagaatccagccagtacacattttgacaagctgttcagtgacgtctgaccttgattttccaactcaggtcattcccctgaaaaccctgaatgctgtggcttccgtaccaatcatgtacagctggtcccctctacagcagaattttatggtggaggacgagaccgtcttgcacaacataccatatatgggggacgaagtgcttgatcaggatgggaccttcattgaggagctgatcaagaattatgatggaaaagtgcacggtgaccgggagtgcgggttcattaatgacgagattttcgttgagttggtgaatgccctgggacagtataatgacgatgacgatgacgacgacggggatgaccctgaggagcgggaagaaaaacagaaggacctagaagaccatagggacgacaaggagtccaggcctccacgtaagttcccttccgataagatctttgaggctatctctagtatgttcccagataagggaactgccgaggaactcaaggaaaagtacaaggagctgacagagcagcagctcccgggagcgcttccacctgagtgtaccccaaacattgatggccctaacgcaaaatccgttcagagagaacagtcactgcattcattccacaccctcttctgtagaagatgctttaaatatgattgcttccttcatccctttcacgccacacctaatacctataaacgaaaaaacaccgagacggcactggataacaagccgtgtgggcctcagtgttaccagcacctcgagggggctaaagaattcgcagccgcactaactgctgaacggatcaaaactccccctaagcgccctggcgggcggcggagaggacgattgcccaataacagctcccgccctagtaccccaaccattaatgtgctagagagtaaagacactgattcggaccgagaggcaggcacagagaccgggggcgaaaataacgataaggaggaggaagagaagaaggacgagactagctcctccagcgaagcgaattcacgatgccagacacctatcaagatgaagcccaacatcgagccccctgagaacgtggagtggagcggcgcggaagccagcatgttccgtgtcttgatcgggacctattacgataatttttgtgccatcgctcgtctcattggcaccaaaacttgtcgccaggtgtacgagttcagagttaaggaaagtagtataatcgcccctgctcctgctgaggacgtggacacacccccgcgaaaaaagaagaggaagcacagattgtgggcggcacactgcaggaagatccaattaaagaaggggcagaacagattccctgggtgcagatgtaaagcccagtgcaacacaaagcaatgcccctgttatctagctgtcagagagtgtgatcccgacctgtgccttacctgcggcgccgccgaccactgggattcaaagaacgttagttgcaaaaactgttccattcagcgagggtccaagaaacatctcttgttggctccatctgacgtggccgggtggggaatatttataaaagaccccgtccaaaagaacgagttcattagcgaatattgtggagaaatcatttctcaggacgaggccgacaggagggggaaggtatatgataaatatatgtgttccttcttattcaatttgaataacgatttcgtcgttgacgccacacggaagggtaacaagatacgatttgcaaatcactcggtgaatcctaactgctacgctaaggtaatgatggtgaacggcgaccaccgaattggtatcttcgcaaaaagagcgatccagaccggtgaggaactgttttttgactatcggtacagtcaggccgacgccctcaagtatgtcggcatcgaaagagagatggagatcccttag

SEQ ID NO: 115821 - DNA, 2214 bp, Artificial Sequence
  Description of Artificial Sequence: Synthetic coding sequence
atggggcagaccggaaagaagagcgaaaagggcccggtgtgttggagaaagagagtcaaatcagagtacatgaggctacggcaattgaagcggttccgaagagcagacgaggttaagagcatgttttcctcgaatcgacagaagatcctcgagcggacagagatcttgaatcaagaatggaagcagagaaggattcagcctgttcatatcttgacgtcatgtagtgttacgagtgatctggacttccccactcaagtcattccattgaagacacttaatgcagtggccagcgtcccgataatgtacagttggtcacccttgcagcagaactttatggtggaggacgagacagtactgcacaatatcccctatatgggcgacgaagtgttagatcaggacggcacattcattgaggaattgatcaagaattacgacggaaaagtgcatggggatcgcgagtgcgggttcataaacgacgaaattttcgtggaactagtaaatgctctcggacaatataatgacgatgacgatgacgacgatggagatgacccagaagaaagagaagagaagcaaaaagacctcgaggaccatagggacgacaaggagtctcgccctcccagaaaatttccgtctgataaaatattcgaggcaatctcctcaatgtttcccgacaaaggtactgctgaggaactaaaggagaaatataaagagctgaccgaacagcagctccctggggcactcccacccgaatgtaccccgaacattgatggcccaaacgcgaagtcagtccagcgagaacagagccttcattcattccacaccctcttctgtaggagatgttttaaatacgattgtttcttgcacccctttcatgccacacctaacacatacaagcgtaaaaacactgagacagccctggataataaaccttgtggaccacaatgttaccaacatttagagggagccaaggaattcgctgcggcgctgacagcggaacgcatcaagactcctcctaagcgtcccggagggaggcggagaggtcgcctcccaaacaattcctctcgtccttccacccccactataaacgtgttagagtccaaggacacagatagcgacagggaagcaggaacagagacaggaggggagaacaacgataaggaggaggaagagaaaaaggatgaaaccagctcctcgagcgaggccaattcaaggtgccagacacctataaagatgaaacctaacatagagcctcccgagaacgtggaatggtcaggagcagaggctagtatgtttagagtcctaattggaacttactacgataatttctgcgcaattgcccgcttgattggcaccaagacttgtcgccaggtgtacgaattccgggtcaaggaaagctcaatcatcgcacctgctcctgccgaagatgtggacacccctccgagaaagaaaaaaagaaagcaccggctgtgggcggctcactgccggaagatccagctgaaaaaggatggcagctctaatcacgtgtataactaccagccatgcgaccaccctcggcagccatgtgattcctcttgcccttgtgttattgcccaaaacttttgcgaaaagttttgtcagtgctcatccgaatgtcagaaccgattccctgggtgccggtgcaaggcacaatgcaacactaaacaatgcccatgttacctggctgtgagggaatgcgatcctgacctttgcctgacatgcggtgcggccgatcactgggattctaaaaatgtgagttgtaagaattgcagtattcagcgcggctccaagaagcacctgttactcgccccaagcgacgtagcagggtggggtattttcatcaaagaccccgtgcagaagaacgagtttatcagcgaatactgtggagaaatcatctctcaagatgaagccgatcggagaggaaaagtttacgataagtacatgtgctcatttctcttcaacctgaacaatgatttcgttgtggatgccacaaggaaagggaataagattcggttcgcgaatcactctgtgaatcctaactgttatgcaaaggttatgatggttaatggcgaccatcgtattggcatctttgccaagcgcgcgattcaaaccggcgaggagctctttttcgactatcgctattcccaagcagacgcacttaagtacgtcggcatcgagcgtgaaatggagattccttag

SEQ ID NO: 115822 - DNA, 939 bp, Artificial Sequence
  Description of Artificial Sequence: Synthetic coding sequence
atggcagcactgtacgcctgcactaagtgccaccaaaggttcccttttgaagccctctcccaaggacagcaactgtgtaaggaatgccggatcgcccacccagttgtgaagtgcacatattgtaggaccgaataccagcaggagcgactggagtgtaacgggaccatcagcgcccattgtaatctccacctgcccggaagctccgacagccctgctagctcaagcagggtagcgggtatcacaggaatcaaaaccaacaccatttgcaaaaaatgcgcccagaacgtgcaactttatggcacacccaaaccgtgccagtactgcaacattatcgcagcctttatcggcaacaagtgccagcggtgtaccaattctgagaaaaagtatggtccaccgtatagctgtgagcaatgcaaacagcaatgcgccttcgatcgaaaggatgaccggaaaaaagtcgacggaaaactcttgtgctggctctgcactctgtcatacaaaagagtgttgcagaaaactaaggaacaacgaaagcacttgtcctcaagcagcagagccggccaccaggaaaaagaacaatacagtcgccttagcggagggggacactacaactctttctcccccgacctagcccttgacagccctggtactgaccactttgttataatcgcacagctgaaagaggaggtcgcaaccctaaagaagatgctgcatcaaaaagatcagatgatcctggaaaaagagaaaaaaataaccgagctcaaagccgattttcagtatcaggagagccagatgagagcaaaaatgaaccagatggaaaagacacacaaggaggttactgaacagctccaagcaaagaacagggaacttctaaagcaggcggccgcacttagcaaaagtaagaaatcagaaaaaagcggtgctattacgtcaccatag

SEQ ID NO: 115823 - DNA, 861 bp, Artificial Sequence
  Description of Artificial Sequence: Synthetic coding sequence
atggcagaggacggcgaagaagctgaatttcacttcgctgccctgtatatttcagggcagtggcctcgcctacgagccgacacagacttgcagcggcttggttcaagtgccatggccccatcgcggaagttcttcgtgggtggcaattggaagatgaacggacggaaacagtccctgggagaacttattggaaccctgaacgccgcgaaggttccagccgacactgaagtggtctgtgcacctcctactgcttacattgacttcgccaggcagaagttagacccaaagatcgccgtggccgcacagaactgctacaaggtgacaaacggagctttcactggtgaaatatcccctggcatgatcaaagactgcggagcaacctgggttgtgcttggacactcagagcggcgacacgttttcggtgaatccgatgaacttattggtcagaaggtggcacacgctctggctgaaggcctgggagtcattgcatgtattggcgagaagctggacgagagggaggccgggatcaccgaaaaggtggtcttcgaacagactaaggtcatagccgataacgtgaaggactggagcaaggtggtcctagcgtatgagccggtctgggccatcggaacgggtaagaccgccacgccccagcaggcccaagaagtgcacgagaagctgagaggctggctaaagtccaacgtcagcgatgcagtggctcagagcacaagaattatctacggtggcagtgtgacaggcgcaacttgtaaggagctggcgagtcagcctgacgtggacggcttcctggtggggggagcaagcctgaaacccgagtttgtggacataatcaacgccaaacaatag

SEQ ID NO: 115824 - DNA, 1305 bp, Artificial Sequence
  Description of Artificial Sequence: Synthetic coding sequence
atgagcatcgaaaagatatgggctcgcgagatacttgacagccggggtaaccctaccgtggaggtggacttatacaccgcaaaagggctgttccgggctgccgtgccatcaggggcatcaaccggcatctacgaggcgctggagcttagggatggcgacaaacagcggtacctggggaaaggagtgctgaaggccgtcgaccacatcaacagcaccatagcccctgctctgataagtagtgggctgtcagtcgtggagcaggagaagttggacaacctaatgttggaattggacgggaccgaaaacaaatctaagttcggcgctaacgctatccttggcgtcagcctggccgtgtgcaaggccggagctgcagagcgtgaactgcctctgtaccgtcacatcgcccagttggctggtaactctgacctgatcctgcccgtgccagcgtttaatgtgatcaatggagggagtcacgctggaaacaagctggcaatgcaagaatttatgattctgcctgtgggcgctgagagtttcagagatgctatgaggctaggagccgaagtgtaccacaccttaaagggggtgattaaagacaaatacggcaaagatgctaccaatgtcggcgatgaaggcggtttcgccccgaatattctggagaacagcgaggcattggaactcgtgaaggaagctatagacaaagcaggttatactgagaaaatagtgattggcatggatgtggccgctagtgagttttaccgggatggtaagtatgatctcgactttaaaagtcctaccgatcccagtaggtacattacgggggaccagctaggggcactttaccaagatttcgtgcgggactatcccgtcgtctccatcgaggatccattcgaccaggatgattgggcggcttggtctaagttcacagcaaatgtcggcatccaaattgtgggggatgatcttaccgtcacaaatccaaagagaattgagagagcggtggaagaaaaggcctgcaattgcctgctgctgaaggtcaatcaaatcgggtctgtcacggaggcaatccaggcttgcaaattagcacaggagaatggttggggagttatggtgtcgcaccgcagcggcgagactgaagatacctttatcgcagacctggtggtgggcctatgcactggacagataaagactggcgcaccttgcagatccgagcgcttggccaagtacaatcagttgatgcggatcgaggaagagttgggagacgaagctagattcgccgggcacaactttagaaacccaagtgtgctttag

SEQ ID NO: 115825 - DNA, 1176 bp, Artificial Sequence
  Description of Artificial Sequence: Synthetic coding sequence
atgtccattgaaaaaatttgggcacgcgagatcttagatagtcgcggcaaccctaccgtggaggttgatttgtacacagctaagggtttattcagggcagctgtgccttccggcgcctccacagggatctatgaagcactggagctgagggacggagacaagcagcgctacctcggaaaagcaaagttcggtgcaaatgccattttgggggtatccctggcagtgtgtaaggctggagccgctgaaagggagcttccactgtataggcacatagcccagctagccggtaactcagatctcatattgcctgtgccagcctttaacgtgataaacggggggtcccacgctggaaataaactcgctatgcaggaattcatgatccttccagtgggtgcagagagtttccgggatgctatgaggcttggcgccgaagtatatcataccttgaagggtgtgatcaaggacaaatacgggaaggacgctactaacgtgggagatgaaggcgggttcgctcctaatatcctggaaaacagtgaggcactggagctcgttaaggaagccatcgataaagctggatacactgaaaagatcgtcattggaatggatgtagcagcctctgagttctacagggacggtaagtatgatttagatttcaaaagtcctactgaccctagtcggtatatcacgggtgatcagctcggagctctttaccaggattttgtccgcgactaccccgtggtgtcgatcgaggatcccttcgatcaggatgactgggccgcctggtccaagtttacagcaaatgtgggaatacagatcgttggcgacgacctgaccgtgactaatccaaagcgcatcgaacgtgcggtagaggaaaaagcttgcaattgcctgctgctaaaggttaatcagatcggctcagtgactgaggcaatccaggcctgcaagcttgcccaagagaatgggtggggagtcatggtaagccaccgatccggggagactgaggataccttcatagctgacctcgtcgtagggctatgcaccgggcaaattaaaactggcgccccatgtcgcagtgagagattggcaaagtataaccaactaatgagaatcgaggaggaattgggcgatgaggctcgctttgccggacacaatttccggaatccttcggtgctgtag

SEQ ID NO: 115826 - DNA, 1305 bp, Artificial Sequence
  Description of Artificial Sequence: Synthetic coding sequence
atgtcgatcgaaaaaatctgggctagggagatactggattctcggggcaacccgacggtggaggtggatttgtatactgccaaagggctgttccgagccgccgtaccatctggggcatcaacgggtatttatgaggccttggagctgagagacggggataagcagagatatctgggaaagggtgtcctcaaggccgttgatcacatcaactcaaccatcgcccctgctctcatctcctccgggttgagcgtcgtggagcaagagaaactggataacttaatgctggagctggatgggaccgaaaataagtcaaagtttggagccaacgcaatccttggagtatctcttgccgtttgtaaagccggggcagcagaacgtgaacttccactgtatcgacatatcgcgcagctggctgggaacagcgatcttattctccccgtgcccgcatttaacgtaattaacggtggctcacacgcgggtaacaagctggccatgcaagagttcatgatccttcccgtcggtgctgagtcattcagggacgcaatgcgcctgggggctgaggtgtaccacacactcaagggcgtcatcaaggacaaatatgggaaggacgctaccaacgtaggagatgaaggtggcttcgcccccaacattcttgaaaactcggaagctttagagctcgtgaaggaggccatagacaaggctggctacaccgaaaagatcgttatcggtatggatgtggcagcaagcgagttttatcgagatggaaagtatgatctggacttcaaatctcccacagacccatctaggtatataaccggcgatcagctgggagccctgtaccaggatttcgtgcgcgactatcccgtggtatccatagaagaccctttcgatcaagatgattgggcagcctggtctaagtttacagcaaacgtgggaatccagattgttggtgatgacctaacagttaccaaccctaagcggatagagcgcgccgtcgaagaaaaggcttgtaattgcctcctcctcaaggtcaatcaaattggcagcgtaaccgaggccatacaagcttgtaagctcgcccaggagaatggctggggcgtgatggttagccataggtcgggcgagactgaagacacctttatcgccgatctggtagtgggcctgtgcaccggacagattaaaactggggctccctgtaggtcagaacgactcgctaagtataatcaactaatgagaatagaagaggagctcggcgacgaagcgcgatttgccggacataattttcgcaacccctcagtactttag

SEQ ID NO: 115827 - DNA, 1176 bp, Artificial Sequence
  Description of Artificial Sequence: Synthetic coding sequence
atgagcatcgagaagatttgggcgcgggagattttggactccagagggaacccaaccgtcgaagtggatctctacaccgcaaaaggcctgttccgcgccgccgttccatccggggcatcaacgggcatatatgaggcactggagctgcgcgatggtgacaaacagcggtatctgggcaaggccaaattcggagccaatgctatcctaggggtgtccttggcagtctgcaaggccggagcagctgagcgagaactgcctctctacaggcatattgcccagctggcaggcaactccgacttgatccttcccgtccccgccttcaacgtgattaatggcggctcacacgccggaaacaaactcgctatgcaggaatttatgattctgcccgtgggcgccgaatcatttagggatgcgatgaggcttggcgccgaggtttatcatactctgaagggagtcattaaggataagtatggtaaggatgctacgaatgttggcgatgaaggcggctttgctcctaacattcttgagaatagcgaagccctcgagttagtgaaagaggccatcgataaagcaggctacacggaaaaaattgtgattggaatggatgtagctgcctcagagttttaccgggatggcaaatacgacttggacttcaaatcaccgacagatccaagccgatacataaccggtgatcagctcggggcactgtaccaggactttgtcagggattaccctgtcgtaagcatcgaggacccgttcgaccaggacgactgggcagcctggagtaaattcacggcaaatgtcggcattcaaattgtgggggatgacctgacagtgacaaatcccaaaaggattgagcgggccgtagaggagaaagcctgcaactgcctgctgctgaaggttaatcagatcggcagtgtgacagaggccattcaggcatgtaagctggcacaggaaaacggctggggtgtgatggtgagtcaccggtcaggggagactgaggacactttcatcgctgacttggttgtgggcctttgtacaggccagatcaaaaccggagctccatgccgcagtgaaagactcgcaaaatacaatcaacttatgcgtatagaggaagaactgggtgacgaggccaggtttgcaggacacaacttcagaaacccatcggtgctatag

SEQ ID NO: 115828 - DNA, 1176 bp, Artificial Sequence
  Description of Artificial Sequence: Synthetic coding sequence
atggcaatgcaaaagatatttgctagggagattctggatagccgtgggaatccgactgttgaggtggaccttcatacagccaaggggcggtttcgcgctgctgtcccatcaggagcaagcaccgggatttatgaggcgctggaactgcgagacggtgacaaaggcagatatttgggcaaggcgaagtttggcgccaatgccattctgggagtgtcacttgcagtatgcaaggccggcgctgcagaaaaaggcgtacctctctacagacacatcgccgacctggccggcaatccagaccttatcctgcctgtcccagccttcaatgtgatcaacgggggatctcatgcaggcaacaaactggcgatgcaggagttcatgattttgccggtgggagctagttccttcaaggaagccatgagaattggcgctgaagtctatcaccacttgaagggcgtaatcaaggccaaatatggaaaggatgctacaaatgtaggagacgaagggggctttgcccccaacatcctggaaaacaatgaagcgttagagctgttgaaaacagccatacaagcagccgggtacccagacaaggtggtcattggaatggatgtcgctgcttccgaattctaccggaacggtaagtacgatttggacttcaagtctccagatgatccggcccgtcatattaccggtgagaagctcggagagctgtacaaatcatttatcaaaaattatccagtcgtcagcattgaagatccctttgatcaggatgactgggcaacctggacatcttttctgtctggcgtcaacattcagattgttggagacgacctcactgtcactaatccgaaacgcattgctcaagccgtcgaaaagaaggcttgcaactgcctactgctcaaggttaaccagatcggatccgtcactgagagtattcaggcatgcaaactggcccagtccaatggctggggggtgatggtcagtcatcgcagcggagagaccgaagacacgtttattgctgatctggtcgtcggtctgtgcactggccagattaagacgggggctccttgtcgatccgagaggctcgcgaaatacaatcaactaatgcgcattgaagaagctttgggtgataaagcgatttttgcaggtaggaaatttcggaaccctaaggccaagtag

SEQ ID NO: 115829 - DNA, 1305 bp, Artificial Sequence
  Description of Artificial Sequence: Synthetic coding sequence
atggctatgcagaaaatttttgccagggagatcctggacagtagaggaaatcctacagtggaggtagacctgcatacagcgaagggacgctttcgggcagctgtcccaagtggtgcttctaccgggatctacgaagctctggaactgcgcgatggcgataaagggcggtacctaggaaaaggtgtcctcaaggcggtcgagaatattaacaatacactgggcccagcactgctccaaaaaaaactgtcagtggttgaccaggagaaagtagataagttcatgatcgagctggatggcaccgagaacaaatccaagttcggagccaatgccatactaggcgtatcccttgccgtatgcaaggccggcgcggccgagaagggagtgccgctgtacaggcacattgcggatctggcgggcaatcccgacttaatcctccctgtgccggcttttaatgtgattaacgggggatcacatgccgggaacaaactggccatgcaggagtttatgatcttgcccgtcggggccagctctttcaaggaggccatgaggatcggagcagaggtctaccatcatttaaaaggtgtcatcaaggcaaagtatgggaaagacgccacaaacgttggtgatgaaggaggcttcgctcccaacatcctagagaataatgaagcccttgagctattgaagactgccatccaagccgcggggtaccccgataaagtcgtgattggcatggacgtagccgcaagcgaattctaccgcaacggcaaatacgacttggattttaaaagcccggacgaccccgcccggcacattactggggagaaacttggcgaactgtacaaaagcttcattaaaaattacccggttgtcagcatcgaagaccccttcgaccaggacgattgggccacatggacgtcctttctctctggcgtcaatatacaaatcgtgggcgacgatctaaccgttaccaaccccaaacgtattgcacaggccgttgaaaagaaagcatgtaactgtcttctgctgaaggttaaccagattggctctgtaaccgaaagcatccaagcctgtaaactcgctcagagcaatggctggggtgttatggtatcccatagaagtggtgaaaccgaagacaccttcatcgccgacctggtcgttggattgtgtacaggccaaatcaagaccggtgcaccatgcaggtcagagcgactcgctaagtataatcagctcatgaggattgaggaggccttaggagacaaggccatctttgccggaaggaaattccggaaccctaaggccaagtag

SEQ ID NO: 115830 - DNA, 1305 bp, Artificial Sequence
  Description of Artificial Sequence: Synthetic coding sequence
atggctatgcagaagatctttgccagagagattctggacagccgggggaatcccaccgttgaagttgatctgcacacggctaaaggcaggtttcgggctgccgttccgagcggggcctctactggcatttacgaagccctggaactgcgtgatggtgacaaaggcagatatctgggaaagggagtgttaaaggccgtcgaaaatatcaataacacgcttggccccgccttacttcagaagaagctgtccgtggtggatcaggagaaagtcgataagttcatgatcgagctggacggtaccgagaacaagtctaagtttggggcaaatgccatcctcggagtaagcttggccgtctgcaaagccggggcagccgagaaaggggtgcccttgtatcgccacatcgccgatttggcgggtaatcccgatctgattctccctgttcctgccttcaatgtaatcaatggtggttctcacgccggcaacaaactcgcgatgcaggaatttatgatcctcccggttggcgcctctagcttcaaggaagctatgcggattggagccgaggtttatcaccacctgaaaggggttattaaagctaagtatgggaaagatgccacaaatgtgggagatgagggtggctttgcacccaatatactagaaaacaatgaggctttagagctgctaaaaactgccattcaggcggccggctaccctgataaggtagttattgggatggatgtggccgcttccgagttctatagaaatgggaaatatgacctggacttcaaaagccccgacgatccagccagacacatcacaggcgagaaactcggggagctgtataaaagcttcattaaaaactatcctgtcgtcagtatcgaggatcctttcgatcaggacgactgggccacatggacttctttccttagcggcgtgaatattcagattgtgggggatgatctgactgtcaccaatcccaaacgcattgcccaggcggtggagaaaaaagcctgcaactgccttttgttgaaggtgaatcagattggcagtgtgactgagagcatccaggcttgcaagctggcacagagcaacggctggggtgtcatggtgtcgcaccgctcaggtgagacggaagacacttttattgccgatcttgttgtcggtctgtgcaccgggcaaatcaaaaccggcgctccgtgccgcagtgagagattagcaaaatataaccagctgatgaggatcgaagaggccctcggcgacaaggccatctttgcaggccggaagtttagaaatcccaaagccaagtag

SEQ ID NO: 115831 - DNA, 852 bp, Artificial Sequence
  Description of Artificial Sequence: Synthetic coding sequence
atggccatgcagaagatttttgcccgcgaaatactggactctcgcggcaaccccactgtggaggtggatttgcatacggctaaagggaggtttagggccgcagtgccttctggggccagtaccggcatctatgaggctctcgagctgcgggacggcgataaaggtcgatacctcgggaagggtgttctgaaggctgtggaaaatatcaataacacattgggccctgcactgttgcagaaaaaactgtctgtcgtggaccaggagaaggtcgacaaattcatgatcgagctcgacggaactgaaaacaagagcaaattcggcgctaacgcaattcttggtgtttccttggccgtctgcaaagccggagcagccgaaaagggagtgccactgtacaggcatattgctgatctggcaggaaatcccgacctcatcctgccagtccctgcgtttaatgtcattaatggcggctcccatgctggaaataaacttgcaatgcaggaattcatgattctgcctgtgggggcatccagttttaaagaagctatgcggataggcgccgaagtgtaccatcatctcaaaggggtgatcaaggctaaatacggaaaagatgctacgaatgtaggtgatgaaggtggtttcgcaccaaatatactggaaaataacgaagctcttgagctcctgaagactgccatccaggccgcgggctacccagacaaggtggtgatcgggatggatgtcgccgcctctgagttttaccgcaatggcaaatacgatcttgactttaagtcccctgacgatcccgcgagacacatcacaggcgagaaacttggggagctttataaatccttttag

SEQ ID NO: 115832 - DNA, 465 bp, Artificial Sequence
  Description of Artificial Sequence: Synthetic coding sequence
atggctatgcaaaagatcttcgcccgggagatccttgattcacgcggcaaccctaccgttgaggtggatctccacaccgcaaagggacggtttcgggccgcagtacccagcggcgcctctaccggaatctacgaggcgttggagctgagggacggagataagggtagatacctggggaaaggcgttctcaaagccgtggaaaacattaataacacgctgggtccagccctgctccagaagaagctttctgtggtggaccaggagaaagtcgacaaattcatgattgagctcgatgggaccgagaacaagtctaagttcggggctaatgccatactaggtgtgagtctggccgtctgtaaggccggcgcagcggaaaagggcgtgcccctctatcggcacattgccgatctcgcaggaaatcctgacctgattttacccgttcctgccttcaatgtcattaattag

SEQ ID NO: 115833 - DNA, 447 bp, Artificial Sequence
  Description of Artificial Sequence: Synthetic coding sequence
atggccatgcagaaaatcttcgcaagagagatcttagactcacgcggaaacccaaccgttgaggtcgatctgcacactgctaaagggaggtttagggccgcagttcctagcggcgcttccacaggcatatacgaagccctcgagctcagagatggagataaggggcgatatttaggaaagggggtactcaaagcagttgagaacattaacaacaccctcggtccagcacttctccagaaaaagcttagcgtggtagatcaggagaaggtcgacaagtttatgatcgaactggacggcaccgaaaataaatctaaattcggcgcaaatgccatacttggtgtgtcgttggcagtgtgcaaagctggcgccgctgaaaaaggcgttccgctttatcgacacattgcagatctcgcgggcaatccagacctgattttgcctgtgccttag

SEQ ID NO: 115834 - DNA, 1332 bp, Artificial Sequence
  Description of Artificial Sequence: Synthetic coding sequence
atggtgcgtggaagaatcagtagactctccgtccgcgacgtccgatttcccacttccctgggcggccatggtgctgacgctatgcatacagacccggactatagcgccgcctacgttgtaatagagactgatgcagaggacgggattaagggctgtgggattaccttcacacttggcaaggggaccgaggtggtagtgtgcgccgtgaatgctctggcccatcatgtactgaataaggacctgaaagatatagttggagactttcgaggcttttaccgacagctcacttcagacgggcaattacgctggataggcccagaaaagggagtggttcacttggcgactgccgccgtgttaaatgctgtgtgggacctgtgggctaaacaggaggggaagcccgtgtggaagttgctggtagacatggaccctcggatgttggtgtcctgtatcgatttccgatacatcacggatgtcctgacagaggaggatgccttggagatcctgcagaaaggccagatcggaaaaaaagaacgtgagaagcagatgctcgctcagggctacccagcttatacaacatcttgcgcctggcttggatattctgatgatacacttaaacagctttgcgctcaggcccttaaagatggctggactagatttaaagttaaagttggcgccgacctccaggacgatatgaggagatgtcagattatcagggatatgatcggacctgagaagaccttaatgatggacgcaaaccaacgatgggacgtgccggaggcagtagagtggatgagcaagcttgccaagttcaaaccgctatggatcgaagaacctaccagcccagacgacattctcggccacgccactatctcgaaggccctggttcccctgggaatcggtattgccacaggtgagcagtgtcacaatcgtgtgatcttcaaacaactccttcaagccaaggctctgcagttcctccagatcgacagttgtaggctggggtcagttaacgagaacctgtctgtgctgctgatggctaagaagttcgagatacctgtatgtccgcacgccggcggagtgggactgtgcgaactggtgcagcatttaattattttcgattacattagcgtttccgcgtctctggaaaaccgagtttgtgagtatgtggaccacctacatgagcattttaaataccccgtgatgattcagcgtgcctcctatatgccacccaaggaccctggctacagtacagaaatgaaggaagaatccgtcaagaagcaccaatatccagatggagaggtgtggaagaagctgcttcccgcacaggagaactag

SEQ ID NO: 115835 - DNA, 642 bp, Artificial Sequence
  Description of Artificial Sequence: Synthetic coding sequence
atgcgccgttgtcagatcatcagggacatgattggccccgagaaaacactgatgatggacgctaatcaaaggtgggatgtgcccgaggctgtagagtggatgagcaaactcgcaaagtttaaacctctgtggatcgaggagcccacgtctcccgatgacattctcggccacgcgaccatttccaaagcgttggtgccgctagggattggcattgctaccggagagcagtgtcataatcgcgtcattttcaagcaactgctccaggctaaagctctccagtttctgcaaatcgattcgtgccgccttggttcggtcaatgaaaatttgagcgttctgttgatggccaagaaattcgagattccggtctgtccccatgctggaggagttggcctctgtgaattggtccagcacctgattatcttcgactacataagcgtgtctgcctctctggagaaccgtgtttgcgagtacgttgaccatcttcatgagcacttcaaatatcccgtaatgatccagagagcgagctacatgccccctaaggatcccgggtactccacagaaatgaaagaggagtctgtgaagaagcaccaataccccgatggtgaagtttggaagaaactgctgcccgcacaggagaactag

SEQ ID NO: 115836 - DNA, 1353 bp, Artificial Sequence
  Description of Artificial Sequence: Synthetic coding sequence
atggtgagcgccgatgccatggtctccgccgatgccatggtttcagcagacgctatggttagtgctgatgctatggttagcgccgacgcaatggtctctgcggatgcaatggtgtccgcagatgctatggttagcgcagacgctatgcacacagaccctgactactccgccgcatacgtggttattgaaacggatgccgaggatggcattaagggttgtggcatcacttttacgctaggtaagggcactgaagtggtggtatgcgctgtgaacgctctggcccatcatgttctgaataaggacctgaaagatattgtgggggacttccgaggcttttataggcagcttacttccgacgggcagctgaggtggatcggtcccgagaaaggcgttgtccacctggcaactgctgccgtgctgaatgctgtatgggacctttgggcaaagcaggagggcaaaccagtgtggaaattactggtcgatatggacccaaggatgctggtgagctgcatcgattttagatacataactgacgtgctgaccgaggaggacgctctggaaattctgcaaaaaggccaaattggtaagaaagagcgggaaaagcagatgttagcccaagggtatccagcgtatacaacatcatgcgcctggttagggtattctgatgacacgttaaagcagctgtgtgcccaagctctgaaagatggatggacgcgttttaaagtgaaagtgggagctgacctccaagacgacatgcggcgatgtcagataattagagatatgatcgggcccgagaaaacactgatgatggacgccaatcaacgttgggacgtgccggaggccgtcgaatggatgtccaagttggcaaaatttaaaccgctatggattgaagagccaactagccccgacgatatcctcggacatgctaccatctcgaaatgtcacaatcgcgtgattttcaaacagctgttacaggccaaggctctccagtttctgcagatcgactcctgccgtttaggatccgtcaatgagaatctctcggtgctcctcatggcaaaaaaatttgagattcctgtatgcccacatgccggcggggtggggctgtgcgaactcgtgcagcacctgatcatcttcgactacatctccgtaagtgcctccttggaaaaccgtgtgtgtgagtacgtggatcatttgcatgagcacttcaagtatcccgtgatgattcagcgcgcgagctacatgcctccaaaagaccccggatattccaccgagatgaaggaggaaagtgtgaagaagcaccagtatcccgacggagaggtgtggaagaagcttcttcctgcacaggagaactag

SEQ ID NO: 115837 - DNA, 1086 bp, Artificial Sequence
  Description of Artificial Sequence: Synthetic coding sequence
atgcagaagatggaatccagaggcgtggagctgccgagcctctgggagaaggccctcaagctgattggccctgaaaagggggtggttcacttggccaccgccgcagtgctgaatgcagtctgggatttgtgggccaagcaagagggaaagcctgtgtggaaattgctagttgacatggacccacggatgctggtatcctgtatcgacttccgttatattacagatgtcctcactgaagaagatgccctggagatcctgcaaaagggccagatcggcaagaaagaacgggaaaagcagatgttggctcagggataccctgcatataccacatcttgcgcatggctgggctattccgatgacacgcttaagcagctctgcgctcaggccctcaaagatggctggacacgcttcaaagttaaagtcggggccgatttacaggatgacatgcggaggtgtcagattattagggacatgataggacccgaaaaaacactgatgatggatgccaaccagcggtgggacgtgcccgaagccgttgagtggatgtcaaagctggcaaaattcaagcctctatggatcgaagaaccgacctcccccgatgatatcttggggcacgccaccattagcaaagcattggttcctctcgggattggcattgcgacaggcgaacagtgccataacagggtgatattcaagcagctgctgcaggcgaaagcgctccagttcctgcagattgacagttgtcgactgggaagtgtgaacgaaaacttatctgttcttctgatggcaaagaagttcgagattcccgtctgcccacatgccggtggcgtaggcttatgtgagttggttcaacatctgattatttttgactatatatctgtgtctgcaagccttgaaaatcgagtgtgcgaatacgtagatcacctccatgaacatttcaagtatccagttatgatccaacgcgcctcgtacatgcctcccaaagatcccggctactccacagagatgaaagaagagtcagtgaaaaaacaccagtatcccgatggcgaggtgtggaagaaactcttgccggcccaagagaattag

SEQ ID NO: 115838 - DNA, 429 bp, Artificial Sequence
  Description of Artificial Sequence: Synthetic coding sequence
atggtaaggggaagaatcagccggttatcagtgagggatgtgcgcttcccaacctccctgggcggtcatggggccgacgcaatgcacacagatcccgattattccgctgcgtatgtggtcatagaaacagatgcagaagacggaatcaagggatgcggcataacttttactttaggtaagggtacagaagtggtggtttgtgccgttaatgcgctggctcaccacgtgctgaataaggatctcaaggacattgtcggcgattttcggggtttttataggcaactgacatcagacggccaactgagatggatcggacccgagaaaggggttgtacacctcgctaccgcagctgtcttgaacgctgtctgggacctgtgggccaagcaggaagggaaaccggtttggaagctgctcgtagacatgggctag

SEQ ID NO: 115839 - DNA, 1392 bp, Artificial Sequence
  Description of Artificial Sequence: Synthetic coding sequence
atggcgacagtgacggctactacgaaggtgcctgaaattagagatgtgacccgaatcgagcggataggcgctcattcacacatccgagggcttggacttgacgacgcactggagccacgccaagccagccaggggatggtgggccagctcgctgcccgtcgggccgcgggggtggtactagaaatgatcagggaaggaaaaatcgcggggcgagccgtattgatcgccggccagcctgggaccggcaagacagctattgcgatgggaatggctcaggctttgggaccagataccccatttactgctatcgctggtagcgagatcttttccctggaaatgagtaagactgaggctcttacgcaagccttccgacgctcaattggggtccgaattaaggaggagactgaaattattgagggcgaagttgtcgagatccagattgacaggcctgcgacaggcaccgggagcaaggttggtaagttgaccttgaagactaccgaaatggaaacaatctatgacctgggcacaaaaatgattgaaagcctcacaaaagacaaggtgcaagctggcgatgtgattacaattgacaaagctacaggaaaaataagtaagctagggcggagttttactagagctagggattacgacgccatgggaagccagactaaattcgtgcagtgccctgatggagagcttcaaaagcgcaaggaggttgtccataccgtatcactgcacgagatagatgtgattaattcccgcactcagggttttcttgctctgtttagcggcgatactggtgaaataaaatccgaggtgagggaacaaattaacgccaaagtagcagaatggcgcgaagagggcaaggctgagattatccctggtgtactctttattgatgaggtgcatatgctggacattgagagttttagttttctgaaccgggccctcgagtcagatatggcccctgttctgattatggccactaaccgagggatcacaagaattcggggaacttcctatcagtcgcctcacggcatcccaattgatctgctcgacaggttgctcatcgtaagcaccacaccgtactctgagaaagacactaaacagatactgcggatcaggtgtgaagaagaggatgtcgagatgtccgaggacgcctacaccgtgctgacaaggatcgggctggagaccagcctccggtacgctatacagctaataaccgctgcctccctcgtgtgtagaaagcggaagggcactgaggtgcaggtagatgatataaagcgcgtgtactcattgttcctggacgaaagtcgatcaactcagtacatgaaggagtaccaggacgcattcctgtttaatgaattgaaaggtgagactatggacacatcatag

SEQ ID NO: 115840 - DNA, 855 bp, Artificial Sequence
  Description of Artificial Sequence: Synthetic coding sequence
atggccaagagtctactgaagaccgcaagcctatctgggaggacaaaactgctccatcagaccggtctgtcactgtactccacttcccacggattctacgaggaggaggtcaaaaagactctgcagcaatttcccgggggcagcatcgacttgcagaaggaggataatggtattggaattcttactctcaacaatccctcccgtatgaacgccttttctggtgtgatgatgctgcagttgttagagaaggtcatagaattggagaattggacggaaggaaaggggctgattgtcagaggcgccaagaataccttcagtagcggaagtgatttaaacgccgtcaagtcactgggattacagcgacgacttcctttaatatctgtggctttggtccagggatgggccctgggaggtggagccgaatttacaaccgcttgcgattttcggctgatgacccctgagtcaaagatcagatttgtccacaaggaaatggggatcattccgtcttgggggggcacaacccgactggtggagatcataggatccaggcaggcactgaaagtgctatcaggagccctcaaactggacagtaagaatgcactgaacatcggcatggttgaagaggttctacagagctctgatgaaaccaaatctctggaggaggcccaggagtggttgaagcaatttatccaggggccccccgaagtgattcgcgcactgaagaaaagcgtgtgcagcggaagagaactgtatctcgaggaggccttgcaaaatgagcgggacctgttggggacagtgtggggcgggccggccaacttggaagctatcgctaagaagggcaaatttaataagtag

SEQ ID NO: 115841 - DNA, 438 bp, Artificial Sequence
  Description of Artificial Sequence: Synthetic coding sequence
atggctaagtccctgctcaaaacagcatccttgtctggcaggacaaagttgctccatcagactggcctgtccttgtacagtacctcccacgggttttacgaagaagaggtcaaaaagaccctgcagcagtttccgggcggatcaatcgatttgcaaaaagaagataacggcatcggaatcttaacgctcaacaatccgagccgcatgaacgccttcagtggagtaatgatgttacagttgctagaaaaggtgattgagctcgagaattggactgagggcaaggggctgattgttaggggcgctaaaaacactttttcctctggaagcgatttaaacgccgtaaagtcactcggcactcctgagaccagcttcaacaaatgttgcgccggctcccgcttaggaattgggtggaggagtagaatttattattccatgtag

SEQ ID NO: 115842 - DNA, 441 bp, Artificial Sequence
  Description of Artificial Sequence: Synthetic coding sequence
atggcaaagagcctcctcaaaaccgcgagcttgtccggccgcactaaacttttgcatcagactggcctgtctctatattccacgtcccacggtttttacgaggaagaagttaaaaaaactctccagcagtttcctggtggctccatagacctgcagaaagaagacaatggcattggaatccttacacttaacaatccttctaggatgaatgcgttttctggtgtgatgatgttacaactgttggagaaagtgattgaactcgaaaattggacagagggcaaggggcttatcgttaggggggccaagaacactttcagttccggatccgacctcaacgctgtcaaaagcctgggaacgcctgaggaaactagctttaacaaatgttgcgccgggagcaggcttggaatcggctggcggagcagaatctattattcaatgtag

SEQ ID NO: 115843 - DNA, 438 bp, Artificial Sequence
  Description of Artificial Sequence: Synthetic coding sequence
atggccaaatccctgttaaagactgcttcactttcaggacggaccaaactcctacaccagactgggctttctctgtactccactagtcacgggttctacgaggaagaagttaagaagactttgcagcagttccccggaggctcaattgatcttcagaaagaggacaacggcataggcatcctgaccctgaacaacccctctcgaatgaatgcgttttcaggcgtcatgatgctgcaattattggaaaaagtgatcgaactggagaactggaccgagggtaagggactgatcgtgagaggagccaagaatacttttagcagcggttcagacctaaacgctgtgaaaagcctggggacccctgaaacatctttcaataagtgctgtgctggcagtcggttgggaatcgggtggaggagtcgcatctactatagcatgtag

SEQ ID NO: 115844 - DNA, 642 bp, Artificial Sequence
  Description of Artificial Sequence: Synthetic coding sequence
atgaacgctttttctggcgtgatgatgcttcagctactggagaaggtgatcgagctcgaaaactggacagagggcaagggattaatcgttagaggcgcgaagaatacattttcctcaggatccgatctcaacgcagtgaaaagcctcggaacacctgaggaaagttgcagatggaataccgagttcctgtacactctccatccagtgtctcctttcattaacattctctacagttacgggtggaacggaaggatgcatgttcatgccaagcacctgaataagatctacgaagtcaagaagcaacggggcaaaatattgcttggtctgtcacggctgccgctcatcagtgttgctcttgtgcagggatgggccctgggagggggggctgaatttaccacagcatgcgactttaggctgatgactccagaaagcaaaataagatttgtccataaggagatgggaataatacctagttggggcggaacgacccggttggtggagattataggaagccgtcaggctttaaaagtattaagcggcgcccttaagctagattccaagaatgccttaaatatcggtatggtggaggaagtgctgcagtcttccgacgagaccaagagcttggaggaagcacaggaatag

SEQ ID NO: 115845 - DNA, 906 bp, Artificial Sequence
  Description of Artificial Sequence: Synthetic coding sequence
atggccaagagccttctcaagaccgccagtttaagcgggcgtaccaaacttctccatcaaacagggctgtctctatactcgacctctcatgggttctacgaggaggaggtgaaaaagacgcttcagcagttccccggagggagcatcgacttgcaaaaggaggacaatggaatcgggattctgaccctcaacaacccctctcgaatgaacgccttttctggagtaatgatgctgcaacttctggaaaaggtaattgagctggagaactggaccgaaggaaaaggcctcatcgtgcggggggcgaagaacacattttcaagtgggagcgaccttaatgcagtcaagagtttaggtacaccagaggacggtatggcagtctgcatgtttatgcaaaacactctcacccggttcatgaggctcccactgataagtgtagctcttgtccaaggctgggccctcggaggcggggccgagttcactaccgcctgcgacttccggctgatgacgcctgagtcaaagattcgattcgtgcataaagaaatgggtattatcccctcatggggcggcacgactcgactggttgaaataatagggagccggcaggccctcaaagttctcagcggcgcactcaaactggattccaaaaacgccctgaacattggcatggtggaagaagtgctgcagtcttccgacgagactaagagtctagaagaagctcaggagtggctcaagcaattcatacaaggaccgcctgaagtaatcagagccttgaaaaagagcgtttgcagtgggcgtgagctttacttggaagaagcactgcaaaacgagagagacctacttggcaccgtgtggggaggcccggcgaatttagaggctatagcaaagaagggaaagttcaacaaatag

SEQ ID NO: 115846 - DNA, 681 bp, Artificial Sequence
  Description of Artificial Sequence: Synthetic coding sequence
atgatgctccagctccttgagaaagttatagaactggagaattggaccgaaggcaagggcctgattgttcggggggcaaagaatacgtttagctctgggtctgatctgaatgctgtcaagtcacttgggacaccagaggacggaatggccgtgtgcatgttcatgcagaatacactgacccgtttcatgcgcctgccactgatcagcgtggcccttgtacagggctgggcccttggaggcggcgcagaatttaccaccgcctgcgatttcaggcttatgaccccggaatcaaagattcggttcgtgcataaggagatgggtataatcccatcatggggaggtactaccaggctcgttgagatcattggctctcggcaggccttaaaggtcctgtctggagcacttaaacttgactctaaaaatgccctcaatataggcatggttgaagaggtcctacagagcagcgacgaaactaagagcctggaggaggcccaggaatggctcaagcagttcatacagggaccccctgaggtgatacgggccctgaaaaagtccgtctgctcaggccgtgagctttatctagaggaggcacttcagaacgagcgggacctgctaggcactgtatggggcggcccagctaatctggaagcgattgcaaaaaaagggaaattcaataagtag

SEQ ID NO: 115847 - DNA, 906 bp, Artificial Sequence
  Description of Artificial Sequence: Synthetic coding sequence
atggctaagagcttgctcaagaccgcgtccttgtcgggccgaaccaagctgcttcatcagaccggactgtccctctactcaacttctcatggtttctacgaggaggaggttaagaagactctccagcagtttcctggcggttctattgacctgcaaaaggaggacaatggcatcgggatcttaacgctcaacaacccaagccgtatgaatgcattctcaggtgtgatgatgcttcaactgctcgagaaggtaatcgaactcgagaattggaccgaaggcaaagggctaatagtgaggggagcaaagaacaccttttcatcggggtcagatctgaacgccgtgaagagtctgggcaccccagaagacggaatggcggtttgtatgtttatgcagaacacattgactcgctttatgagactgcctctaatttccgtggccctggtgcagggctgggcactgggcgggggggctgagttcacaacggcctgtgatttcagattaatgacccctgaatccaaaattcgctttgtccataaggagatgggaatcatcccatcctggggcgggaccactcgcctcgtcgaaatcattggcagtagacaggccctcaaggtgctgtcaggggccttaaagctcgattccaagaatgcccttaatatcggcatggttgaagaagtgcttcaaagttcggatgagaccaaaagcctcgaggaggcccaggaatggctgaagcaattcattcagggccccccagaagtaataagggcactgaaaaagtcagtttgcagcggccgcgagctgtacttagaagaggccttacagaatgaacgcgatctgttggggactgtttgggggggccctgccaacttagaagcgatcgccaagaaaggaaaatttaacaaatag

SEQ ID NO: 115848 - DNA, 906 bp, Artificial Sequence
  Description of Artificial Sequence: Synthetic coding sequence
atggccaagagtttgctgaagactgcctctctatccggccggacgaaactattgcatcagacaggactttccctgtattctaccagtcatggcttctacgaggaagaagtgaaaaagacactgcagcagttccccggcggctctatcgatctacagaaagaagacaatggcatcggtatcctgactctgaacaatccttcaaggatgaacgcgttctccggggtgatgatgctgcagctgctggagaaggtgattgagcttgagaattggaccgagggcaagggtctgattgtacgcggcgcgaaaaacacattttccagtggttctgacctcaatgctgtaaaatcactcggaacaccagaagacggcatggctgtctgcatgtttatgcagaatacccttacgagattcatgagactgcccctgatctccgtggccctggtgcagggatgggcattaggcggcggagccgaatttaccactgcctgtgacttccggcttatgacacccgagagcaagatccgatttgtgcacaaagaaatgggaataattcccagctggggcggtaccactagattggtggaaatcattggatccagacaggcactgaaagtgctttccggggccctcaaattggactcaaagaatgccctcaatattggcatggtggaagaggttctgcaatcaagtgatgaaaccaagagccttgaggaggcccaggagtggttaaagcaatttattcagggcccccccgaggtgatcagggctctgaagaagagcgtttgtagcggccgcgaactttatctggaagaagccctgcagaatgaaagagacctcctgggtacagtgtggggcgggcccgccaatctcgaagctatagctaagaaaggaaaatttaacaaatag

SEQ ID NO: 115849 - DNA, 408 bp, Artificial Sequence
  Description of Artificial Sequence: Synthetic coding sequence
atggccaagtctcttctgaagacagcatctctctcaggtcggactaagctcctgcatcagaccgggctgagcttatattcgaccagccacggattctacgaggaggaggtaaagaagactctccagcaattcccaggagggtcaattgatcttcaaaaagaggacaatggcattggcattctcacactgaataacccaagccggatgaacgcattttctggagttatgatgttgcagctgctggagaaggtgatagaacttgagaattggactgaaggaaaggggctgattgttcggggagctaaaaacactttttcctccggaagtgatcttaacgccgtcaagagtctcgggactccagaggacggcatggcagtttgcatgttcatgcagaataccctgacatag

SEQ ID NO: 115850 - DNA, 924 bp, Artificial Sequence
  Description of Artificial Sequence: Synthetic coding sequence
atggccctgaaacaagaaatggccaaatccttgttaaagacagctagcctctccggcaggactaagctcctccatcagacaggcctgtccctgtactctaccagccacggtttctacgaggaggaagtgaagaaaacattacagcagttcccaggagggagcattgacctccagaaagaggataatgggatcgggattttaacactgaacaatcctagtaggatgaatgctttctcaggggtgatgatgctacagttattagagaaagtaattgaactggagaattggaccgaaggtaagggactgattgtgagaggcgcaaagaacacttttagttctgggagcgatctgaacgctgtcaagtcactgggaacccctgaagatggcatggctgtgtgcatgttcatgcaaaataccctcacaagatttatgaggttaccgctcatcagtgtcgcacttgtgcaggggtgggcactcggaggtggcgcagaattcactacagcgtgcgacttccgtttgatgaccccagagtcaaaaatacgttttgtgcacaaagagatggggataattccttcctggggtggcactacccggcttgtcgagattatagggtcacgccaagcccttaaagtactctctggcgctctgaaactggacagtaaaaacgccctgaatatagggatggtggaggaggtcttgcagtccagcgacgagaccaagagccttgaagaagcccaggagtggcttaaacagtttattcaaggaccacccgaggtgattcgggcgctgaaaaaaagcgtatgcagtgggcgagagctgtacttagaagaagcactccagaacgaaagagatttgctcggaacggtttggggcggacccgcgaaccttgaagcaatcgctaaaaaaggcaagttcaataagtag

SEQ ID NO: 115851 - DNA, 456 bp, Artificial Sequence
  Description of Artificial Sequence: Synthetic coding sequence
atggccaagtcactcctcaaaaccgcttctctgtcaggaaggacgaaactgctccaccagactgggctgtccttgtactccacttctcatggattttacgaggaggaagttaaaaagactctacagcagttcccaggaggttcgattgaccttcaaaaggaagacaacggaatagggatcctgacactgaataatccgagccggatgaatgcattctctggcgttatgatgctccagctgctggaaaaggtcattgagcttgagaactggacagaggggaaggggctcatagtgagaggtgcaaagaatactttctcctctgggtcagatctcaatgctgtaaaaagtctgggaacccccgaagatgggatggcagtttgtatgtttatgcaaaatacactgacaagattcatgcggctgccactcatctccgtagccctggttcagggctggtag

SEQ ID NO: 115852 - DNA, 378 bp, Artificial Sequence
  Description of Artificial Sequence: Synthetic coding sequence
atggcaaagtctctgctgaagacagctagccttagcgggcggaccaaactgttgcaccagacgggcttatcactgtattcaactagtcacggattttacgaggaggaagtgaagaagacgctgcagcagttccctggcggctccatcgacttgcagaaggaagataatggcattggcatcctgaccctgaacaaccccagtagaatgaatgcattctctggcgtgatgatgctccagctgctcgagaaggtgattgagctggaaaactggaccgagggaaaaggcctcatcgtgcggggcgctaagaacactttctcatccggcagcgacctaaacgcagtgaaatctctgggcacgcctgaggcgaacttcttatag

SEQ ID NO: 115853 - DNA, 213 bp, Artificial Sequence
  Description of Artificial Sequence: Synthetic coding sequence
atgatgctccagttattggagaaggtaattgagctagaaaattggactgaggggaagggcctgatcgtccggggcgccaagaacacattctcaagcgggtccgacctaaacgccgttaaaagcctggggacccctgagacaagcttcaataagtgttgcgccggctcccggctggggattggttggaggagtcgcatttattattcaatgtag

SEQ ID NO: 115854 - DNA, 873 bp, Artificial Sequence
  Description of Artificial Sequence: Synthetic coding sequence
atggctgccctgcgagtgttgctcagctgcgtccgagggccccttaggccaccagttcgttgtccagcatggcgcccgttcgccagtggcgctaatttcgagtatatcatcgctgaaaagaggggtaaaaacaatacagttggattgatccagcttaaccggcctaaagcccttaacgcgctgtgcgatgggctgatcgatgaacttaatcaggccctgaagacgttcgaagaagatcctgccgtgggggccatcgtgttgactggtggcgacaaggctttcgctgccggggctgacatcaaggagatgcaaaatttgtctttccaagattgctactcctccaagtttctgaaacattgggaccatctaactcaggtaaagaaacccgtcattgccgcagtcaacggttatgctttcgggggtggctgcgaactggccatgatgtgcgatatcatctacgctggcgaaaaggcacaattcgcccaaccagaaattcttatcgggaccatacctggggctggcggtactcagcgattgactcgcgctgtcggaaaatccttggcgatggagatggttctgaccggcgatcggatctctgcgcaagacgcaaagcaggctgggcttgtttccaaaatatgtcccgtggagacactggtagaagaggccatccagtgtgccgagaagattgcctcaaacagtaagattgttgtggcaatggccaaagaatctgttaacgctgcctttgaaatgactctgaccgaaggatctaaactggagaagaaactcttttatagcacgttcgctacggacgatagaaaagaaggaatgacagcgtttgtcgagaagagaaaagccaacttcaaagatcaatag

SEQ ID NO: 115855 - DNA, 2271 bp, Artificial Sequence
  Description of Artificial Sequence: Synthetic coding sequence
atgtctttcgtggcaggtgttattcgaaggctggacgaaactgttgtgaaccggatcgccgcaggagaggtgatccagcgtcctgctaatgccattaaagagatgatcgaaaattgcctcgatgctaagtcgacatcgatccaagtcattgtgaaggaaggcggcctgaagctgattcagatacaggacaatggtacgggcatcaggaaggaagacctggatattgtctgcgagagatttacgacatccaaactgcaaagttttgaagatctcgccagcatttccacatatgggtttcggggtgaagccctggccagtatctctcatgtggcgcacgttaccattacaaccaagaccgcagatgggaagtgcgcctaccgggcctcgtattctgatggaaagctaaaggcaccaccaaaaccgtgtgcaggaaaccagggaacccaaatcacggtcgaagatctgttttataatatcgcaacgagaagaaaagccctgaagaacccttccgaagagtacgggaagatcctggaggttgtcggtaggtactctgtgcacaatgccggcatctccttttcagtgaaaaagcagggggaaaccgtcgcagacgtgcgcacattgccgaatgcatcaaccgtagataacatccgtagcatttttggcaacgccgtgagccgcgagctgattgagatcgggtgtgaggacaagacactggcctttaaaatgaacggctatatctcaaacgcaaattattccgtgaaaaagtgtattttccttctttttatcaatcaccgtctcgtcgaaagtacctcccttagaaaagctatcgaaacagtgtatgctgcctatttacccaagaacacccatcccttcctctacctgtccctggagatctccccacaaaacgttgatgtcaacgtccaccctacgaagcacgaagtccacttcctacatgaggaatcaatactggaacgagttcagcaacatatcgagtcgaagcttctcggatctaacagctcaaggatgtacttcacacagactctcctccccgggctggccggcccttccggtgagatggtgaaaagcacaacctccctaacttcaagtagcacttctggtagctctgataaagtctacgcccaccagatggtgagaaccgactcaagggagcagaaacttgacgcttttctgcagccacttagtaagcctctgagtagccagcctcaagcaatagtgaccgaagacaaaacggatatctcaagtggccgggcgcgacagcaggacgaggaaatgctggaacttcccgcacctgctgaggttgccgccaagaaccagagtctcgagggggacacgaccaaaggaaccagtgaaatgtccgagaagcgcggccccacctccagcaaccctagaaagcgccacagggaggatagcgatgtggagatggttgaagatgattcaaggaaagaaatgacagcggcctgcaccccgagacgcaggatcattaatctgacaagtgtcctcagcctgcaagaggagatcaatgagcagggacatgaggtgctgcgtgagatgctccacaaccattcttttgtcggctgcgttaatccccagtgggcactggcgcagcaccagaccaaactatatcttctcaatacaactaaattgagcgaggagcttttctaccaaatacttatctatgattttgcaaacttcggggtattacgtctcagtgagcccgcacccttgtttgatctggcaatgctggctctcgatagtccagaatccgggtggactgaggaggatggaccaaaggaggggttggcagagtatattgtggaattcctgaagaagaaggcagaaatgctagctgactacttcagtctagagatcgacgaagagggaaatttaattggcctccccctcttaattgacaattacgtccctcccctggaggggctccctattttcatcctgcgactcgccactgaggttaactgggacgaggagaaagaatgcttcgagtctctgagcaaagaatgtgctatgttttactctattcgcaaacagtacatctccgaggaatcaacactcagcgggcaacagtctgaggtgcctggttctatccccaacagctggaagtggactgtggaacacatcgtgtataaggcattgaggagtcacatcctcccaccaaagcacttcactgaagacggtaacattttgcagctcgccaacctgccagatctctataaagtctttgaacggtgttag

SEQ ID NO: 115856 - DNA, 1884 bp, Artificial Sequence
  Description of Artificial Sequence: Synthetic coding sequence
atggctttcgggggtggattggaactggcgcttggttgccactaccgaatcgcacatgccgaagcccaggtcggcctgccggaggtgaccctcggtctcctgcccggcgctagagggactcagctgctcccccggctcacaggcgtccccgcggccctcgatctgatcacctctgggcgaagaattctggctgacgaggccctcaagttagggattcttgacaaggttgtcaatagcgacccagttgaggaggcaatccggtttgctcagcgggtttccgaccagccattggaaagccgccggttatgtaacaaacccatccaatctctgcctaacatggattctatcttctctgaagcactgttgaagatgcgcagacagcatcctggctgccttgcacaggaggcctgcgtgagagcagtacaagccgccgtccagtatccatacgaggtcggaatcaagaaagaggaggaactgtttttgtacctcctgcagtccggccaggcacgagcccttcagtacgcgttctttgcagaaaggaaagctaataagtggtcaacaccgtccggggcgtcatggaagaccgctagtgctcgacccgtgagttctgttggggtagttggcctgggcaccatgggaagagggatcgtgatatcatttgctagagccagaattcccgtcatcgctgtggactccgataaaaaccagctcgccacggccaacaagatgataacttcagttctggagaaagaagcatctaagatgcagcagtctggtcacccctggagcgggcccaagccccgattaacttctagtgtgaaggagttggggggagtcgatctagtaattgaggctgttttcgaggaaatgtctctgaagaagcaagtctttgccgagctgtctgccgtctgcaaaccagaggcatttctctgtacaaatactagtgctttagatgttgacgaaatcgcctctagcacagatcgaccccacttggtaatcgggacacactttttctcaccggcacacgtgatgaagctcttagaagttatccctagtcagtactcctcaccaaccaccatcgcaactgtgatgaatctctctaagaagattaagaagatcggtgttgtggttggtaactgtttcggctttgttggaaaccgaatgctgaacccatattacaatcaagcttactttctgctggaagagggctccaagcccgaggaggtggatcaggtgctcgaagaattcggttttaaaatgggtccattccgggtgagcgacctggcgggcctagatgtggggtggaagtcacggaagggtcaaggactgaccgggccaactctgctcccggggacccctgcccgcaaacggggtaatcggcgctattgcccaatccctgacgttctgtgcgaactaggcagattcggccagaaaactgggaagggctggtaccaatacgacaaacccctgggacgcattcacaagcctgacccctggctgtctaaattcttgtctcgctatcggaaaacccatcatatagagcctcggacaatatctcaagacgaaatcttggagagatgcctctacagcctgatcaatgaagcttttcgcatcctcggcgagggaattgcagctagtcccgaacatatcgatgttgtctatcttcatggctatgggtggccccggcacaagggtggcccaatgttctatgcaagcacggtggggctccctaccgtgctggagaagcttcaaaagtattaccgccaaaaccccgacatcccacaacttgagcctagcgattatctaaagaagcttgcttcacagggcaaccctccattgaaggagtggcagtctcttgctggctcaccttcatcaaaactgtag

SEQ ID NO: 115857 - DNA, 1464 bp, Artificial Sequence
  Description of Artificial Sequence: Synthetic coding sequence
atggcagaatacacaagacttcataatgccttggctctgattcgccttcgcaaccccccggtgaacgctatcagtacgaccctgctaagggacatcaaagaggggctccagaaagcggtaatagaccacacaatcaaggccatcgtgatctgcggggccgaaggaaagttctctgctggggcagacatcaggggcttctccgcccccagaacatttggtctcacattgggccatgtggtcgatgagattcagcggaacgagaaacccgtcgtcgccgccattcaaggcatggcctttgggggggggctcgagctggcgttaggatgtcactacagaatcgctcatgcggaggcccaagttggactgccggaagtgacgttgggactgctgcccggcgcccggggcactcagctcctgcccagactgaccggggtgcctgctgccttagacctgatcacttcaggtcggcggatcctggctgatgaggccctcaaactcggaatcctcgacaaagtggtgaacagtgacccagttgaggaggcaattagatttgctcagcgtgtgtctgaccagccccttgagagcaggaggctgtgtaacaaacccatccagtccttgcccaatatggatagcatctttagcgaagcattgctgaagatgaggagacaacatcctggctgtctagcccaggaggcttgtgtaagggccgtgcaagccgcagttcagtatccctacgaggtcggaatcaagaaagaagaggaactcttcctgtacttactgcagagtggtcaggctcgagctctacagtatgccttctttgccgagcgtaaggcaaataagtggagcactccctcgggagccagctggaaaacagcctctgcgcgcccagtctcttcagtgggagtcgtggggctgggaacaatggggagaggcatcgtcatttcgttcgcacgcgcccgcattcctgtgattgccgtggacagcgacaaaaatcagttagctaccgcaaacaagatgatcaccagtgtcttggaaaaggaagcctcaaagatgcaacagtctggacacccttggagcgggccaaagccccgcctgactagcagcgtaaaagaattaggaggggtcgacctagtgattgaagccgtgtttgaagagatgtcacttaaaaagcaggtttttgccgagctcagtgccgtgtgtaaaccggaggccttcctgtgcacaaatacgtctgctttagatgtggatgagattgcctcgagtacagacagacctcacctggtgatcgggacccacttcttctcaccggctcacgtgatgaagctcctcgaagttattccatctcagtattcttcaccaaccaccatagcaaccgtcatgaatttatcgaagaagattaagaaaatcggtgtggtggtggggaactatagcgtttcaaaaaaaaagaaaaagaagaaaaagtag

SEQ ID NO: 115858 - DNA, 6102 bp, Artificial Sequence
  Description of Artificial Sequence: Synthetic coding sequence
atgttcaagggcctgtctaagggatcacagggcaaaggctctccaaagggctccccagctaaaggcagccccaaaggcagccccagtcggcattcccgtgccgccacacaggagctggcgctgctgatttcaagaatgcaagccaacgccgatcaggtggaacgggacattctggagactcagaaacgtttacagcaggaccgtctgaattctgaacagtcacaggctctccagcaccagcaggaaacaggtcggtccctgaaagaggccgaagtccttctcaaagacctgtttctcgacgtcgataaggcacgtagactaaagcatccacaagccgaagagatagagaaggatataaaacagctacacgaacgggtcactcaggagtgtgcggaataccgcgccctttatgagaaaatggtgttgccacctgacgtcggacccagagtcgactgggctcgggtcctcgagcaaaagcagaaacaggtgtgcgcaggacagtacggccccggcatggccgagttagagcagcagatcgccgagcacaacatcctccagaaggagatcgatgcatatggacagcagttgcgatcattggtgggcccagatgccgccactatccggtcgcagtatcgggatctgcttaaggccgccagttggcgtggacagtctttgggcagcctgtatacacatcttcaggggtgtactcgacaactgtcagccctggcagagcagcagagacggattttacaacaggattggtccgacctgatggcagaccctgcgggggttagacgcgaatatgaacacttcaagcaacatgagttgctgtctcaagaacagagtgtgaaccaactggaggacgatggcgagagaatggtggaactgcgccatcccgccgttggcccaattcaggcccatcaggaagcattgaaaatggaatggcaaaacttcttgaatctttgcatttgccaggaaactcagctacagcacgtcgaagactaccgccggtttcaggaagaagctgacagcgtgtcacaaacactggccaaactcaactccaatctcgatgcaaaatacagtcccgctcccggcggtccccctggcgcgccaactgagttactgcaacaactcgaagctgaggagaagagactggccgtgaccgagagagcaacaggggaccttcagcgaaggtctagggatgttgccccgctgccacagcgccgtaatccaccacagcaaccacttcacgtagattctatttgcgattgggactccggcgaggtccagctgttacagggcgagagatacaaactagtagataatacagacccacacgcctgggtggtgcagggtccaggcggagagactaagagggcgcctgccgcctgtttctgtattccagctcccgatccagacgctgtggcaagagcgtccagactggcaagtgagcttcaggccctgaagcagaagctggctactgtgcaaagtaggctgaaggcgtccgccgtggaaagtctgcggccttcccagcaggccccgtctggcagtgatctggcaaaccctcaggcccagaaattgctgacccagatgactaggctcgacggtgacttaggccagatcgaaaggcaagtcctggcctgggcccgggctcctctgtctcggccgactcctttggaggatctggaagggagaatccactctcatgaaggaactgcccaaaggcttcagagcctcgggacagagaaggagaccgctcaaaaagagtgtgaagcttttttaagcaccaggcctgtgggaccagcagctctccagctgccagtggcactgaatagcgtgaaaaacaaattctcagacgtccaggttctttgctccctttatggtgagaaggctaaagctgccttggaccttgaaagacagatacaggatgccgatagagtgatcagaggcttcgaagcgaccttggtgcaggaggcacccattcccgccgagcctggcgccctacaggagcgcgtgagcgagctccagcggcaaaggcgcgagctgctcgaacagcagacttgcgtattgcgcctccacagagctcttaaggccagcgagcacgcctgtgccgccctgcaaaacaacttccaggagttttgtcaggatttaccccgccaacagcgccaagtgcgcgccctcaccgaccgctatcatgcagtgggtgaccagttagacctgcgagagaaggtggtccaagacgctgctctgacctaccagcagtttaaaaattgtaaggataatctctcttcatggctggagcacctgccccgctcccaggtgcggccatctgatggcccctctcagattgcttacaaattacaggcacagaaacgactgactcaagaaatccagagcagggaaagggaccgggccacagcttctcatttgtctcaggccctgcaggcagcactccaggattatgagctccaggccgacacctaccgttgttccctcgagcctactttggcggtatcagctccaaaacggcctagagtggcacctcttcaggaatctatccaagcccaagaaaaaaatctggctaaggcctacaccgaagtcgctgccgcccagcaacaactcctgcagcagctcgaattcgctagaaaaatgcttgaaaaaaaggagctctcagaggacatcaggcgcacacatgatgccaagcagggtagcgagagcccagcacaggcaggtagagagtcggaggcactgaaggcccagctcgaggaggagcggaaaagggtggccagagtccagcacgagctggaagcacagaggtcccaacttctccagctgaggacccaacgccccttggaacgtctcgaagaaaaggaggtggtcgaattttatagagatccccagcttgaaggctcgctctccagggtaaaggctcaagtggaggaagagggtaaaaggcgggccggcctgcaggctgacttagaagtggcagcacaaaaggtggtgcagctggaatctaagaggaaaaccatgcagcctcacttgctaactaaagaggtgacccaggtcgagagggaccccggtctggactctcaggctgcacagctgagaattcaaatacaacagttgcggggagaggatgctgtaatctcagcccggttggaggggctcaagaaagaactgcttgccctcgagaagagagaggtcgacgtcaaagagaaggtcgtcgtcaaggaggtagtcaaggtggaaaagaacctggagatggttaaggccgctcaggccctgcggctgcagatggaggaggatgccgctcgcaggaaacaggctgaggaggcagttgccaagctccaggcgcgaatcgaagatctagagcgcgccatttctagcgtggaacctaaggtcatcgttaaggaagtcaagaaggtggagcaagacccgggactcctgcaggagagctccagattgcgaagtctgttagaagaagaaagaacaaagaatgctactctagcccgtgagctgagtgacctccacagcaagtattccgttgttgagaagcagagacctaaggtccagttacaggaacgggtgcacgagatctttcaggtggatcctgaaaccgagcaagagattacgcggttgaaagccaagctacaggaaatggcagggaaacgctctggcgttgagaaagaggtagaaaagttactgcctgatctggaggttctgcgcgcacagaagcccactgtcgagtacaaggaagtcacgcaggaggtggtgcgccacgagagatcccctgaggtgctcagggaaatcgaccggcttaaagcccagctcaatgaactggtgaattcacacggccgaagccaggagcagcttatcaggttgcagggagagcgagatgagtggcgtcgcgagcgcgccaaggtagagacgaaaacagtgtcgaaagaagtcgtgcgccacgaaaaggatcccgtcttagaaaaagaggccgaacgccttcgacaggaagtgagggaagctgcccagaaacgtagggcagccgaagacgcagtctacgagcttcagagcaaaaggttgctgctcgaaaggagaaagcctgaagaaaaggtggttgtccaagaagtggtggttacacaaaaggatcctaagctgcgggaagaacactctaggctaagtggtagcctggacgaagaggtggggcgtaggcgccagctggagttggaggtccaacagctccgcgctggagtggaggaacaggaagggttactttcatttcaagaggacagaagcaagaaactggcggttgagagagaactaagacagctcaccctcagaatccaggaactcgagaagagaccccctacagtacaggaaaaaattataatggaagaagtggtcaaactggaaaaggaccccgatctcgaaaaatcaaccgaggctttgcggtgggatttagaccaagagaagacccaagtgactgaactaaacagagaatgtaaaaacctccaggtacaaatcgacgtcctccaaaaagccaaatcgcaggaaaaaaccatatataaggaagtgattcgggtccagaaagatcgagtcttagaggatgagcgtgcccgggtgtgggaaatgttgaaccgagaacgcactgcgcgccaagctcgggaggaggaggcacggaggttgcgcgaacgtatcgatagagctgaaacgctgggccggacctggtctagggaggagagcgagctacagcgggctcgggaccaagccgatcaggaatgcggcagactccagcaggaactccgggctttagaacgacagaagcagcagcaaaccctgcagttgcaagaggaaagtaaactgttatcccagaaaactgagtctgagaggcagaaagcggctcaaagagggcaagagctgtcaagacttgaggccgccatccttcgggaaaaggaccagatctacgagaaagagcgcacactgagagatcttcacgcaaaggtgtctcgggaggagctgtcacaggaaactcagacgcgggaaaccaacttaagcactaaaatcagtatattggaacctgagacaggcaaggatatgtccccctatgaagcctacaagagaggaattatcgataggggacaatatttacagctgcaggagctagagtgcgactgggaagaggtcactacatccggtccatgcggggaggaatctgtgctgctcgataggaaaagcggcaaacagtattccatcgaagccgccctcaggtgccggaggattagcaaggaggaatatcatctgtacaaagatggacacctaccaattagtgaattcgccttactggttgcaggcgaaacaaagccatcctcgtcactttctatcggaagcatcatttctaaaagccctctggcatccccagcccctcaatccacaagctttttcagcccttccttttcactgggacttggggatgattccttccctatcgccggcatttatgatacaacaaccgataataaatgctctattaagacagccgttgccaagaatatgctcgacccaattactggacagaaattactcgaggcccaggctgccaccggcggaatcgtggacctgctgtccagggaacgttattctgttcataaagctatggaacgcggccttatcgagaacacctccactcaacgtctactgaatgcgcaaaaggccttcactggcatagaggacccagtgactaaaaagcggctatccgtgggcgaggctgtacagaagggctggatgcccagagaatccgttctgccccatcttcaagtacagcacctgacaggcggtctaatcgatccaaaaaggacaggcaggatccctatacaacaagccttactgagcgggatgatctcagaagagcttgctcaactgctccaggacgagtcttcgtacgaaaaggacctaacagaccctatcagcaaagaaaggctgtcctataaagaggccatgggacgctgtcgcaaagatccccttagcggactgctgctgctccctgctgcacttgagggctacaggtgttatcgttccgcctcccctacagtccctagatcgctgaggtag

SEQ ID NO: 115859 - DNA, 2061 bp, Artificial Sequence
  Description of Artificial Sequence: Synthetic coding sequence
atgcaattaggtgaacagctattagtgtcctctgtgaatctgcccggtgctcatttttacccactggaaagcgctcgcggagggagcggaggatcagcaggccatctgccctccgccgccccttccccccagaagctcgatctagataaggcttcaaaaaaatttagcggcagcctcagctgtgaagccgtgtctggcgagcctgcggccgcctctgctggcgcacctgccgctatgttgtccgatacggatgccggagatgcctttgccagcgccgcggcagttgcaaagccaggaccacccgacggccggaagggaagtccatgtggggaggaggaactcccctctgcagcggcagccgccgcggcagcagcggccgctgccgccgctactgcacggtatagcatggactcattatcatcagaacggtactacctgcaaagccctggcccacaaggcagtgagctcgctgctccttgtagcctgtttccgtaccaggccgccgccggggctccacacggccctgtgtatcccgctccgaacggagcacggtacccctatggaagtatgttgccccccggcggattccccgccgccgtatgcccccccggcagggcccagtttggccccggggccggcgctggcagcggcgccggtgggtcaagcggaggaggggggggacccggaacttaccagtacagtcagggagccccactgtacggaccgtacccgggcgctgctgcagccggctcctgcggggggcttggtggactgggagtccctgggtccggctttagggcacacgtctatttgtgcaacagaccactctggctaaagttccataggcatcagacggaaatgatcataaccaaacagggccggcggatgtttccttttctgagctttaacatcaacggcctgaatcctaccgcccattacaatgtctttgtggaggtggttcttgccgacccaaaccattggagattccagggtgggaaatgggtcacatgcggtaaagcggataacaacatgcagggtaataagatgtatgtgcaccccgaaagtcccaataccggttcccattggatgagacaggagattagtttcggcaaactgaagttaacaaacaacaaaggagcgaacaataacaacacccagatgattgtgttgcagtccttgcacaagtatcagcccaggctgcacatagtcgaggtgacagaggacggtgtagaagatctgaatgagcctagtaagacacaaacgttcacctttagcgagacacagttcatagctgtcactgcttaccagaacacagatataactcagctgaaaattgatcacaaccctttcgcaaagggattccgtgataactacgacagctcccaccagattgtgcccggcggccgctacggcgtgcagtcgttctttcctgagccctttgttaatacgctgccccaggcaaggtactacaatggcgagcggactgtaccccaaacaaacggactgctgtctccccaacaatcagaagaagtagcgaatcccccacagcgctggctggtgactcccgtacagcaacccgggaccaataagctagacatttcctcctacgagtcagagtacaccagctctactctgctgccatacgggatcaaaagcctgccccttcagacttcccatgcgttaggatattatccagatcccacattcccagccatggctggctggggtgggcgtggatcatatcaacggaagatggctgcgggtctgccttggaccagtcgcacctccccaacggtgttttcagaggaccaactgtcgaaggaaaaggtgaaagaggaaataggctcttcgtggattgagacacccccgagcattaagtcactcgatagcaacgatagcggtgtgtatacgtcagcctgtaaacgcagacgcctgagcccttctaatagttcaaacgaaaattcaccttcaatcaaatgtgaggacattaatgctgaggagtattcaaaggacacatcaaaaggcatggggggctactacgctttctacacgactccgtag

SEQ ID NO: 115860 - DNA, 2118 bp, Artificial Sequence
  Description of Artificial Sequence: Synthetic coding sequence
atgcagttgggcgagcagctgctggtgtcttcagtgaatttgccaggggctcacttttacccactggagtctgctagaggaggatcaggaggctccgctggccatctgcccagcgcggctccctccccgcaaaaactcgacctcgataaagcctctaagaagttctcaggttctctgtcctgtgaagcagtctcaggcgagcccgccgctgcgtccgccggcgcccctgccgccatgctgtcggacacagatgccggagatgccttcgcaagtgccgccgcggtcgctaagcctgggcctcccgacggtaggaaaggaagtccttgtggcgaggaggaactgccttcagcggctgcagccgcagccgccgctgctgcggcagccgcagccactgcccgttattctatggacagcttgtcaagtgagcggtattacctgcaatcacctgggcctcagggatccgaactggctgccccctgtagtcttttcccatatcaggcagccgcaggtgcgcctcatggtcccgtatatcctgctcccaacggtgcacggtatccgtacggttcaatgctgcctccgggcgggttccctgccgccgtttgcccccccggacgagcccagttcgggccaggagctggcgccggctctggtgccggcggcagcagtggcggcggcggcgggccaggtacctaccagtacagccagggtgcccccctgtacggcccatatcctggagccgcagcggcaggctcatgcggggggttgggagggctcggcgttcctggtagcggtttccgcgcccatgtttacctgtgtaatcggcctctgtggcttaagttccaccggcaccagaccgagatgatcattactaagcagggtcgtcgcatgtttccattcctcagctttaatatcaatggtctcaaccctacagctcattataatgtgtttgtcgaagtcgttttagccgatccaaatcactggaggttccaggggggaaaatgggtgacctgtggaaaagccgataacaatatgcagggtaataagatgtacgtacaccctgaatcgcctaataccgggtcacactggatgcgccaggaaattagcttcggtaagctgaagctcacaaacaacaaaggagcaaacaataacaacacgcagatgatagtgctgcagtctctgcacaagtatcaacccagactgcacatcgtcgaagtcacagaagatggcgttgaggatctaaacgagccgagcaaaacacagacgttcaccttttcagaaacccaatttattgccgtgacagcttaccagaataccgacattactcagctgaagattgaccacaacccctttgccaagggatttagggacaattatgacagcatgtacactgccagcgaaaatgaccgcctgacaccttcacctacagacagcccacgatcccaccagatcgtccctggcggccgctacggtgttcaatcatttttcccggagcctttcgtcaacacactcccccaagccagatattataacggggaacggacagtcccacagaccaacgggttactgagcccccaacagtcggaggaagtggccaatcccccccagagatggttggtaacacctgtacaacagcctggcactaacaagctcgatattagctcctacgagtcagagtatacaagtagcacactgctgccctatggaatcaagtccctgccactgcaaacctcccatgcactgggatactaccctgacccgacttttcccgcaatggcagggtggggaggacgcggaagctatcagaggaaaatggccgctggtctcccctggacctcccgcacctccccaacagtgttctctgaggaccagctctctaaagaaaaggtaaaagaagaaatcggctcaagttggatcgagacgcctcctagtatcaagagcttggactcgaatgattctggagtgtacacctccgcatgtaagcgcaggcgtctgtcaccgtctaacagctccaatgagaattctccctcaatcaagtgcgaggatatcaacgccgaggagtactccaaagacacatcaaagggaatgggaggctactatgccttctatactacaccctag

SEQ ID NO: 115861 - DNA, 1713 bp, Artificial Sequence
  Description of Artificial Sequence: Synthetic coding sequence
atggactccctgtcctccgagcgctactatctccagagccctggcccccagggctcagaacttgctgctccttgttcactctttccttatcaggctgcagctggggccccacacggccccgtttaccccgcacctaacggcgccaggtacccctacggcagcatgctccccccagggggcttccccgccgccgtctgcccccctggccgcgcacagtttggaccaggcgccggtgccggctcaggggcaggaggcagcagtgggggaggcggaggccccggcacatatcagtacagtcagggcgctcctttgtatggaccataccctggggccgcggcggcagggtcctgcggtggtttaggcgggctcggtgtgcccggtagtggattccgcgcgcacgtctacctgtgtaatagaccactgtggttaaaatttcaccggcaccagaccgagatgatcattactaagcaaggtcggagaatgttcccctttctgtcctttaatattaatggactgaaccccaccgcccattacaacgttttcgtcgaagtggtgctggcagatccaaatcactggcggttccagggcgggaagtgggtgacatgtggaaaagcagacaataacatgcaaggcaataaaatgtatgtgcatccagagtctccgaatacaggatcccactggatgcggcaggaaatttcctttggcaaattaaaactgacaaacaacaaaggtgcgaacaataacaatacacagatgatagtgttgcagtcactgcataaataccaaccacggctgcatattgtggaggtgactgaggacggcgtagaggaccttaacgaaccatccaaaacccagacctttacatttagtgagacccaatttattgccgtcactgcctatcagaataccgacattactcagttaaaaatagaccacaacccattcgcaaagggctttcgtgacaactacgacagcatgtataccgccagtgaaaacgaccgactgacaccatcaccgacagattcccctaggagccaccagatcgtgcctggcggccggtatggagtgcaaagcttcttcccagaacccttcgtgaacactctgccgcaagccagatattacaacggcgaaagaaccgtgccccagacaaatggcttactcagcccacagcagtccgaggaggtcgccaaccctccccaacgctggctggtcactccagtgcagcagccaggaaccaataaactggatattagtagttacgagtcagagtatacctcttcaactctgctcccctatgggatcaagtctctcccccttcaaaccagccatgcgttgggctactaccccgacccgactttccctgccatggcagggtgggggggtcggggctcatatcagcggaaaatggctgccgggctaccttggacctcacggacaagccccactgtgttttctgaagatcagctgagtaaagagaaagtgaaggaggagattgggtcgagctggattgaaacacctccgagcatcaagtctctggattcgaacgacagcggtgtctacacctcggcctgtaagaggcggcggttatcgccctccaattcctctaatgagaacagcccatctattaaatgtgaggatattaatgcagaagagtactccaaggacacatccaaggggatggggggctattacgcgttttacacaactccttag

SEQ ID NO: 115862 - DNA, 1233 bp, Artificial Sequence
  Description of Artificial Sequence: Synthetic coding sequence
atgttccccttcctttcattcaacatcaatggtctgaatccgaccgcacattacaacgtgtttgtggaggtcgtactggccgatcctaaccattggaggttccaggggggtaaatgggtcacatgcggaaaggccgacaacaacatgcaagggaacaaaatgtatgtgcatcccgagagccctaacaccggcagtcactggatgaggcaggagataagttttggcaaacttaaactgactaataataagggcgccaataataacaacacccagatgattgtgctgcagtctttacataaatatcagccccggttacatatagtagaggtgaccgaagacggggtggaagacctgaacgaaccttctaaaacacagaccttcacgttttctgagactcaatttattgctgtcaccgcttatcaaaacacagacattacacagcttaaaatagaccataatcccttcgcaaagggcttccgggataattacgactcaatgtataccgcttccgaaaacgacaggctgacgccatcccccaccgacagtcctcgcagtcatcagatcgtgcctggtggaagatatggggtccagtcattctttccagagccctttgtgaacacactgccacaggcacgatattacaatggagaacgcacggtgccgcagacaaacggactcctcagcccccagcagtctgaggaggtggctaaccctcctcaaagatggctggtcacacctgtgcagcagccggggacgaataaacttgatatctccagctatgaatccgaatatacgtcttccaccctgctgccttatggcatcaagagcttgcctctgcagacttctcacgctcttgggtattaccccgacccaactttccccgctatggcagggtggggaggcagagggagttaccaaaggaagatggccgccgggttgccttggaccagtcgtacatcccccaccgtcttcagtgaggatcagttgagcaaagagaaggtgaaggaggagatcggtagttcttggattgagacacccccgtctatcaagagcctcgacagtaatgactctggggtgtataccagcgcttgcaaacgccgccgtctctccccctccaactcaagtaacgagaattccccctccattaagtgtgaagacattaatgccgaggagtactcaaaggatacaagtaaaggcatgggcggctattacgcattctatacaacaccgtag

SEQ ID NO: 115863 - DNA, 1269 bp, Artificial Sequence
  Description of Artificial Sequence: Synthetic coding sequence
atgggtcaagctggctgtaaaggtctgtgcctgtccctattcgactacaaaactgagaaatacgtgatcgctaaaaataaaaaggtgggcctgctttatcgcctgttacaggctagcatactcgcctacctggtagtgtgggtttttttgataaaaaaaggctatcaggatgtcgacaccagccttcagtccgccgtgatcacaaaagtgaaaggagtcgccttcaccaatactagcgacttgggacaaagaatctgggatgtggcagactacgtcataccagctcagggggagaatgtgttcttcgtggtgacgaatctgatcgtgaccccaaatcagcggcagaacgtgtgcgctgaaaacgaaggcattccggacggcgcatgcagcaaagatagcgactgccacgccggagaagcagttacagctggcaacggggtaaaaaccgggcggtgtctgcggcgtgagaacttggccaggggtacgtgtgaaatcttcgcctggtgccctctggagacatccagtcgccccgaggaaccattcttaaaggaggctgaagactttactattttcatcaaaaatcatattcgcttccccaagtttaactttagcaaatccaatgtgatggacgtgaaggaccgttctttcctgaagagttgccattttggacctaagaaccattactgtcctatttttaggttgggctcagtgatcagatgggcggggtctgattttcaagacatagccctcgaagggggtgtcattggtatcaatatcgaatggaattgtgacctggataaggccgccagcgaatgtcacccacactactctttctcgcgcttggacaataaactctctaagagcgtgtcctccggttataatttcaggttcgcacgctattaccgggacgcagctggcgtggaattccgtacacttatgaaggcctatggaattagatttgatgtgatggtgaatggaaaaggagcattcttctgtgatttggtgttgatatatctcataaaaaaacgcgaattctatagagataagaagtatgaggaggtgcggggcttagaagacagcagccaagaggcagaagacgaagcctcaggattgggtctgtctgaacaactgacaagcggccctggactacttggtatgcccgaacagcaggaactccaagaacctcccgaggcgaagcgcggctcttcgtcacagaaaggcaacgggagtgtgtgcccacagttgttggagccacaccgctctacgtag

SEQ ID NO: 115864 - DNA, 564 bp, Artificial Sequence
  Description of Artificial Sequence: Synthetic coding sequence
atgtctgagatggctgagctctcggagctttatgaggaatcttctgacctgcagatggacgtgatgcctggcgaaggagacctgcctcagatggaggtcggttccggaagccgcgaactttcactcaggccatctcgtagtggagctcagcaactcgaagaggagggaccaatggaggaggaggaggcccagcctatggctgcaccagaaggtaaaaggtccctcgcaaatggcccgaacgccggagaacagcctggccaggtggccggggccgatttcgagagcgaagacgaaggcgaggaatttgatgattgggaagatgactatgactatcctgaggaggaacagctgtccggtgcaggctaccgagttagcgcagctttggaggaggccgataaaatgtttctcaggaccagggagcctgctctcgatggggggtttcagatgcactacgagaagacacccttcgatcagttggcttttatcgaggaactcttcagtctgatggttgttaatagactgactgaagagctgggctgcgatgagatcattgacagggaatag

SEQ ID NO: 115865 - DNA, 711 bp, Artificial Sequence
  Description of Artificial Sequence: Synthetic coding sequence
atgtccaagctcccagctgatagcagtgtgccgcagacaggtgcggcgaacggcgaccgagacgtgccccaggccgaagtaggacgggggagacgcgagcccgcacccgcgcagcccgaagaggccggcgagggagcaatggcagccgctagaggcggaccagtgcctgcagcgagggaggggcggatggcagccgcccgggctgcccccgcagccgccgcaagaggggcccccgtcgcggcagcagccctggcaagagctgcggctgctgggcgggagagcccagcagcagctgcagcgcgggaggcaagaatggccgaggtggcacgactgctcggggagcccgtggacgaagaggggcctgaaggccggcctcgcagcagacacgggaatggtgggctggccgcactgccttacctacgcctgcggcacccactttctgttctggggataaattatcagcagttcctccgccactacctcgagaactacccaatagcccctggccggatccaggaattggaggagcgccggcgccggttcgtggaagcttgtagagctcgggaagcagccttcgatgccgagtatcaacggaatccgcatcgcgtcgacctggacattctgacattcactatcgctctgacggcctcagaagtcatcaatccactgattgaagagctgggctgtgacaaattcatcaatagagagtag

SEQ ID NO: 115866 - DNA, 564 bp, Artificial Sequence
  Description of Artificial Sequence: Synthetic coding sequence
atgtccaagctgcccgcagactccagcgtgcctcagacaggcgctgcaaatggggacagggacgtcccacaggctgaggtcgggcgaggccgcagggaaccagccccagcgcagcccgaggaagctggcgagagtcccgccgccgccgcagccagagaagccagaatggccgaggtcgcccggctgctgggagagccggtggacgaagaggggcccgaaggcagaccacggagtaggcacgggaacggcggcctcgccgccctgccctacctgcggctgcgccacccgctatctgtcctcggcattaattatcagcagttcttaagacactaccttgaaaactatcccattgcacccgggagaatccaagagcttgaggaaaggagaagacgctttgtggaggcttgtagagccagggaggcagcattcgatgctgagtatcagcgtaatccccaccgcgtggatctggatatattaaccttcacaatagctttgaccgcttcagaagtcatcaatccattgatcgaggaactaggctgtgacaagttcatcaaccgcgagtag

SEQ ID NO: 115867 - DNA, 1002 bp, Artificial Sequence
  Description of Artificial Sequence: Synthetic coding sequence
atgaaaatggacgtctccgtcagagcggctggatgttctgacgatctcagcagcggagaggccgacgtggacccgaaactgctcgagctgaccgccgacgaggagaagtgtcggtccatccgaaggcagtatcgccagttaatgtactgcgtgagacagaatagggaggacattgtaagcagtgcgaacaattctctaacggaagccctggaggaagccaatgtcctgttcgacggagtctcaagaactcgggaggccgcccttgatgccagattcttggtcatggcatcggacctggggaaagagaaagccaaacaattaaactccgacatgaacttttttaaccagctcgctttttgcgactttctcttcctctttgttggtctcaattggatggagggagaccccgataagctgagtgattgtgacgactctatcgcactctccttctggaaggccattgaaaaagaagccacatcttggatggtcaaggctgagaccttccactttgtgttcggcagctttaagctggaaaggtccgcacccaaaccaagactggaacatcaaaaaaaggtacgcaaaatggaggagaacgggaacatgccaacgaagctccagaagcttgacttgtcatcatatccggaagcaactgagaagaatgtggagaggatcctgggacttctgcagacatattttcggaagtacccagatactccagttagctattttgagttcgtcattgatccaaacagcttttctagaaccgtcgagaatattttctatgtgtccttcatcgtccgggatggttttgcacgcatcagactcgatgaagaccggctgcccatcctggaacccatgaatgtgaaccagatgggggaagggaatgactcttcctgtcacggccgaaagcagggcgtcatctcgctgaccctccaggaatggaaaaacattgtggccgctttcgagatctcagaggccatgatcacctactccagttattag

SEQ ID NO: 115868 - DNA, 2931 bp, Artificial Sequence
  Description of Artificial Sequence: Synthetic coding sequence
atggagagaaggtggccactgggtctgggattagtgcttctcctgtgtgcacctcttccgccaggagcgcgagctaaggaggtcacccttatggatacctctaaagcccagggagaactggggtggctcctggaccctcctaaggatgggtggtcggagcagcagcagatcctgaacggcacaccactgtacatgtaccaggactgtccaatgcagggccgcagggacactgatcactggctcaggagcaactggatctatagaggagaagaggctagtagagtgcatgtggaactgcagttcactgtgcgcgattgtaaatcttttcccgggggggctggtcccttaggttgtaaggaaacctttaatttgttgtacatggaaagtgaccaggatgtgggtatccagctgcggaggcccctgttccaaaaggttaccactgtggctgccgatcaaagcttcactattagggacctggtctctggctctgtgaaattaaatgtcgaaagatgcagcctgggccggctcacccgacggggcttgtaccttgcgtttcataatcccggcgcctgcgttgctctagtgtcagtgcgggtcttctatcagcggtgtccagagactctaaatggactcgcgcagtttcctgatactctcccaggacccgccgggctggtggaagtagctggtacatgtctgccccacgctagagctagtccaaggccctcaggcgcgccgcggatgcattgttctcccgacggcgaatggcttgtgccagtagggcgatgccactgcgagccgggatacgaggagggcgggtcaggcgaggcctgcgttgcatgcccatcgggatcttatagaatggatatggatactccgcattgtttaacctgtcctcagcagtctactgctgaatccgagggtgcaaccatatgcacctgcgagagcggccactatagagcacctggggagggaccccaggtggcctgtaccgggcctccttctgcccctcgcaacctctctttcagcgcatccggtacccagctctccctaaggtgggaacccccagccgataccggaggccgacaagatgtgagatactctgtacgatgctcccagtgccagggcacagcacaggatggcggcccatgtcagccatgcggtgtgggcgttcactttagccccggggccaggggactgactactcccgctgtgcacgtgaacggccttgaaccctacgccaactacaccttcaacgtcgaggcccagaacggcgtgagcggtttaggttccagcggacatgccagcaccagtgtcagtatctctatgggacacgccgagtcactcagtggactcagcctgcgccttgtcaaaaaagagcctaggcaattagaactgacatgggccggatctcggcctcggtcgccgggggctaatctcacttatgaactccacgtgctgaatcaggacgaggagaggtaccaaatggttctggaaccgagagtgttgttaacggaactccagcctgacacaacatatattgtgagagtaagaatgctgacgccactgggtcccggcccgttcagtccggatcacgaattccgcacttctccaccagtcagcagaggcttgaccggaggcgagatagtcgcagtcatattcggactgttgctgggtgcagctctccttctgggtatcctggtgtttcgatctcgcagggcccagcgacagcgtcagcagcgacaacgcgatcgggccacagacgtggatcgggaggacaagctgtggttaaagccctacgtggaccttcaggcatacgaagatccagcccagggtgctctagacttcactcgcgaacttgatcccgcgtggcttatggtggatacggtcatcggtgaaggagaattcggagaggtgtataggggcacgttaagacttcctagtcaagactgcaagaccgtcgctattaagaccctgaaagatacttcccccgggggccagtggtggaacttcctcagggaggcaacaatcatgggacagttttcacacccccatattctacatctggagggagttgttacaaagcgcaaaccaatcatgatcatcaccgaatttatggagaatggggccctggacgcttttttgcgagaaagagaggaccaactagtacccggacaactggttgcaatgttgcaaggtatcgcttctgggatgaattacctgagcaatcacaattacgtacatcgagatctggccgcaaggaacatcctcgtaaatcagaatctgtgctgcaaagtctctgattttggtctgacccgccttctcgatgacttcgacggcacgtacgaaacccagggcggcaagattccaatcagatggacggctcccgaagccattgcccacaggatctttacaacagcttccgatgtatggtcctttggaatcgtaatgtgggaggtactgtcctttggcgacaagccttatggcgagatgagcaaccaagaggtgatgaaaagtattgaggacgggtacaggttgccaccaccggtggactgcccagctcccctttatgaacttatgaaaaattgctgggcctatgatagagcccggagaccacactttcagaagctgcaggcccacctcgaacagcttctggccaacccgcattccctcagaacaatcgccaattttgatcccagaatgactctgaggctgccatctttgtctggatcagacggtataccatatcgtactgtctccgaatggctggagtcaattcggatgaaacgttacattttgcattttcactctgccggcctggatacaatggagtgcgtgcttgaacttaccgccgaggatttgacgcagatgggcatcacattgccagggcatcagaaaaggatcctgtgttcaattcaggggttcaaagattag

SEQ ID NO: 115869 - DNA, 888 bp, Artificial Sequence
  Description of Artificial Sequence: Synthetic coding sequence
atggagacatgcgcaggaccacaccctctgagactctttttgtgccgaatgcaactctgtctggctctgttgcttggcccatggaggcccgggacagcagaggaagtcatcctgttggactccaaggccagccaggccgaactcggttggacagccttgcctagcaacgggtgggaggagatctccggagtcgatgaacacgatcggcctatccgaacatatcaggtgtgtaatgtgttggaacctaaccaggataactggcttcaaaccggctggattagccggggacgcggacagagaatatttgtggagcttcagttcacccttagggattgtagcagcatccctggcgccgccgggacatgcaaggaaaccttcaatgtttattacctggaaactgaggcggatcttggccgcggaagaccgcggcttgggggctccaggcctaggaaaatagacaccattgccgcagatgagtctttcacacaaggagatctcggcgaacgcaagatgaaactgaatactgaagtgagggagattggacccttgtccagaagggggttccacctggcgttccaggacgtgggagcttgcgtagcgctggtgtcagtgagggtgtattataaacagtgtcgagccaccgttcgcggtctcgccacattccccgccaccgcggccgaatctgccttttctacacttgtggaagtggctggcacttgcgtcgcacacagcgagggggagcccggcagccccccgaggatgcactgtggcgcagacggggaatggctggtccctgtagggcgctgcagctgtagcgccggcttccaggagagaggagatttctgcgagggcattcagttggccggcgggcggggggtgggagtgtag

SEQ ID NO: 115870 - DNA, 1632 bp, Artificial Sequence
  Description of Artificial Sequence: Synthetic coding sequence
atggttaaaacaggtgctccgacggtgaccgtgaccaatcttaaaccagcaacaagatacgttttccaaatccgcgccgcatctccaggacccagctgggaagctcagagttttaacccaagcatcgaggtacagaccttgggcgaagctgccagcggctcacgggaccagtctccggcgattgtcgtgaccgtcgtgaccatcagcgcgctgctggtcttaggatcagtgatgagcgtcctggctatctggcgaagaccttgctcttacggtaagggcgggggggatgcccatgacgaggaagagttgtacttccacttcaaagtcccaacacgacgtaccttcctggacccccagagttgtggtgacctgctccaggctgtccatcttttcgccaaagaactggacgcgaagtcagttacacttgagcgatcacttggaggcggcaggttcggggaattatgctgtggatgtctccagttacccggacgtcaagagttactggtggcagtgcacatgttaagggactctgcttcggacagtcagcgcttgggttttcttgctgaagctctgactttaggtcagttcgaccacagtcacatagtgcgcctcgagggcgtagtcaccagaggatccacccttatgattgtcaccgagtacatgagccatggggctctggatggctttctgcgaaggcacgaagggcagctcgttgctggacaacttatgggtctgctacccgggttggccagtgctatgaaatacctatctgagatggggtacgtgcacaggggcttagctgcacgacacgtgctcgtgtctagtgacctggtctgtaagatttcaggattcggccgcggcccccgagacaggtctgaggcggtgtatacgaccatgtcaggccggtcccccgccctgtgggctgcacccgaaacgttacaattcggtcatttttcatctgcgagcgacgtctggagcttcggaattatcatgtgggaggtgatggcttttggggagcggccctattgggatatgtccggtcaagacgtgatcaaagcggtggaagatgggtttagactgcccccccctcgcaattgtccaaatctgttacacaggctgatgctagattgttggcaaaaggatcccggagagcgaccacgattcagccaaattcattcaatactgtctaagatggtccaggacccagaacctcctaaatgcgctttaacaacctgtccaaggccaccaactcctctagcagaccgggcattcagcacatttcccagctttggatcagtgggggcctggctcgaagctctggatctgtgcaggtacaaggattcatttgctgcggctggttacggcagtctggaggccgttgccgagatgaccgctcaggatctcgtgagcctgggtatatcacttgccgagcatagggaggccctgttgtccggcattagtgctcttcaagctagagtcttacagcttcagggacagggtgtgcaggataataagaacctctccgttatatggtgtcttttcgagtggcagcttcttgaccactgcatcgccggggtggaaggccttctgcccccaagctcgcgtacaggagtgagccggatctgcgtttag

SEQ ID NO: 115871 - DNA, 3027 bp, Artificial Sequence
  Description of Artificial Sequence: Synthetic coding sequence
atggagacctgtgcagggccccacccattaaggctatttctgtgtagaatgcagctctgcctggccctactcctgggaccttggcggcccggaaccgcggaagaagtcattctgctggactcaaaggcaagtcaggccgagcttgggtggacagcgttgcccagcaacggctgggaggagattagtggcgtggacgagcatgatcggccaatcagaacctaccaggtttgtaatgtgctcgaacctaaccaggacaattggcttcaaactggctggatttccagggggagaggccagaggatattcgtggaactccaattcacattaagagattgttcgtcaatacctggagcggcaggcacgtgcaaagaaactttcaacgtctattatttggagactgaagcggatctgggaaggggaagacctagattaggcgggtctcgcccacgaaagatcgacactattgcagccgacgagagtttcacgcagggggatctgggggagaggaagatgaaattgaatactgaggtcagggaaattggtccactgtcacggcggggattccacctggcctttcaggacgtcggtgcttgcgtcgcactcgtgtcggttagagtgtactataaacaatgccgcgctacagtccgcggcctcgctacgttccccgccacagcagcggaatcagccttttctacattggtggaggtagcaggaacctgcgtggctcacagcgaaggggagccgggttcccccccacgtatgcactgcggcgcggatggcgaatggctggtcccggtcggaagatgcagttgtagcgcaggttttcaggaacgcggggatttctgtgaggcatgtccgcctggcttctacaaggtcagcccacgacgccccttgtgtagcccttgtccagagcatagtcgggcgttggaaaatgctagcaccttttgtgtgtgccaagactcgtatgctcggagtccgacagatccgccaagcgcctcctgcacccggcctccatctgccccaagggacttacagtactctttatcacgctctcctctggtgctgcgcctgcggtggttgcctcccgccgacagtggcggaaggtcagacgtaacgtattcactgctgtgtctgagatgcggtcgagaaggtcctgccggggcctgtgagccatgtggccctagggtggcttttctcccccgacaggctggacttcgcgaacgcgctgctaccttgctgcatctgcgccccggcgcccggtatactgtaagggtcgccgcgctcaatggcgtgtctggaccagctgctgccgcaggcacaacctacgctcaagtgacagtgtcgactggacctggggccccatgggaagaggatgagatcaggcgcgaccgggttgaaccccaatcagtctctctatcttggagggaacccatccctgccggagccccgggggcaaatgataccgaatatgagatccgttattacgaaaagggccagtcagagcagacatactcaatggtcaagacgggagcccccaccgtcactgtgaccaaccttaaaccggcgacacgatatgtctttcagataagggcagcttcgcctggaccttcttgggaagcacaatccttcaacccaagcatagaagtgcagactttgggcgaggccgcctccggaagcagagatcagtcccccgccattgtcgtgaccgtggtcactatttcagccctcctggtcctcgggtcagtaatgtccgttcttgccatctggaggaggccctgtagctacggcaaaggcgggggggatgcccatgatgaagaggaactgtattttcactttaaggtgcccacgcggcgtacgttcctggatccacagagttgcggtgatttgctccaggcagtacacctgtttgcgaaagagctcgatgccaagagtgtgacgttagagcgaagcttgggaggcggaaggttcggcgagctgtgctgtggatgtctgcaattgcctggccgtcaggaattacttgtagctgtgcacatgttgcgcgattctgccagtgattcccagcgattaggttttcttgccgaagccctgactctggggcagttcgaccattcccatatcgtgcgcctggagggagtggttacaagagggtcaactctgatgatcgtcaccgagtacatgtcgcacggagctttggatggatttcttcggcgccacgagggacagctcgtagccgggcaactcatgggactgttacccggacttgcctcggccatgaaatacttgagtgaaatggggtatgtgcacaggggcttagccgcccgacacgtgcttgtgagctccgatctggtttgcaaaatatcggggttcggacgcgggccaagggacagatctgaagccgtctacaccacgatgtctggtcgatctccggccctgtgggcagcaccagagacgcttcagttcgggcacttctccagcgcctccgacgtgtggagcttcggtattataatgtgggaagtgatggctttcggagaacgaccctactgggatatgagcggacaggatgttataaaggcggtcgaagacgggttcaggctcccaccacctcgtaactgccccaacctgcttcataggctgatgctggactgttggcagaaggaccccggcgaacggccccgtttttcgcagatccattcaattctatctaaaatggttcaggaccccgagccacccaaatgtgccctcacaacatgtccacggccaccaacccccttagcggaccgggccttcagtaccttccccagcttcggcagcgtgggtgcttggttggaagctctcgatctttgcaggtacaaagatagttttgcggctgcaggatacgggagcttggaagcagttgccgagatgactgcacaggatctcgtctccctggggataagccttgccgaacatagggaagcgttgctgtctggcatcagtgctctgcaagccagagttttgcagctgcagggccaaggtgtgcaagtgtag

SEQ ID NO: 115872 - DNA, 3045 bp, Artificial Sequence
  Description of Artificial Sequence: Synthetic coding sequence
atggagacatgcgcaggcccacaccctctgcgcctatttctttgcagaatgcagctgtgtctggctctcttgctgggcccttggagaccaggcaccgcggaagaggtgatccttctggactcaaaggcgagtcaggctgagttgggctggacagccttgccaagcaacggttgggaggagatcagcggtgtggatgaacatgacaggccaatccgaacctaccaggtttgcaacgtgctggaaccaaatcaggacaactggctgcagaccgggtggatctcccggggtagaggacagaggatatttgtcgagcttcagtttaccttgcgcgactgtagttccatcccaggcgcagccggtacttgtaaggaaacatttaacgtctactatctggaaactgaagctgacctgggcaggggtcgaccaaggctgggtgggtctaggcctcgcaagattgataccatagccgccgacgaatcctttacccagggcgatctcggagagaggaaaatgaagctcaacaccgaggtgcgcgaaatcggacctctatccaggagaggtttccacctcgcctttcaggacgtgggtgcatgcgtggcattggtgtccgtgcgcgtgtactataaacaatgccgggccactgtgcgcggtcttgcgactttccctgcaaccgcagcggagagtgcattcagtactctggtggaggtggctggtacgtgcgtcgcccacagtgaaggcgaaccaggttcccctccacggatgcactgtggagccgatggcgaatggttggtgcccgtcggccgctgttcttgtagcgctggttttcaggagagaggagacttttgcgaagcctgtcccccaggcttttacaaggtgagtccaaggcgccccttatgctccccttgtcccgagcacagtcgcgctctggagaacgcgtctaccttctgtgtgtgccaggatagttatgctagaagccctacggatcctcctagtgcctcctgcacccgccctcctagtgctcccagggatctccagtacagtttgagtcgctcacccctggtgttgaggctcagatggttgcccccagccgactccgggggccgttctgatgtcacttacagcctcctgtgcttaagatgcggtcgggagggccccgccggagcatgtgagccttgtggtcctagggttgccttcttgcctcgtcaggcaggcctgagagagcgcgccgcaacgctcctccaccttcgcccaggggcccggtatacagttagggtcgccgccctcaatggagtatccggccctgctgctgctgctgggacgacttatgctcaagtcactgtcagcaccgggcccggtgctccctgggaagaggacgaaatacggcgtgaccgagtggagccacaaagcgtgagcttaagctggcgtgagccaattcccgccggggctcccggagcaaacgatacagagtatgagattaggtattacgagaaaggacagtccgagcagacttattccatggttaagaccggggctccaaccgtcacagtgacgaatctgaaacctgcaaccagatatgttttccaaatcagagcggcaagccccggaccttcgtgggaggcgcagtccttcaacccatcgatcgaggttcagacacttggcgaagctgcttcagggtctagagatcagagtcctgcaatagtggtcacagtggtaaccatcagcgcactgctcgtcctggggagtgtgatgtccgttctggccatctggaggagaccatgctcctatggcaaaggcggtggcgatgcccatgacgaagaagagctgtactttcattttaaggttccgacccggagaacttttttggatccccagagttgcggggatctccttcaggcggttcacttgttcgccaaagagttggatgccaagagcgttaccctggagagatccctgggcggaggccgctttggcgaactatgctgcggctgtctgcagctgcccgggcgtcaggaattgctcgtcgccgtccacatgctccgagattcagcttccgattctcagagactgggttttcttgccgaagccctgacgcttgggcaattcgaccacagtcacatcgttcgcctggagggggtggtgacgcggggaagcaccctgatgatagtcactgagtacatgagtcatggggcgctggatggctttcttcgccggcatgagggccagctggtggcgggccaattaatgggtttgcttcccgggttagccagtgcaatgaagtacctgtccgaaatgggatatgtccaccgaggacttgctgctaggcacgtgcttgtgtcgtccgatttggtgtgtaaaatttcaggtttcggacggggaccacgagatcggtccgaagcagtgtacacgacgatgtctgggagatcccccgccctatgggcagccccggaaacattgcaattcggacacttcagcagtgcttcagatgtctggtcctttggaatcattatgtgggaagtgatggcattcggagagcgaccttactgggatatgtccggacaggatgttatcaaagccgtggaggatggcttcagattgccaccgcctaggaactgtcctaacctgttacaccgactgatgcttgattgctggcagaaagatccgggggaacgcccacgctttagtcagatccattcaattttatccaaaatggtccaggatcccgagccccctaagtgtgcgctgactacatgccctcgcccgcctacccctctggccgaccgagccttttctacctttccatccttcggcagtgttggggcttggctggaggccctggatctgtgtagatacaaagattccttcgctgccgcaggctatggcagtctcgaggccgtagctgagatgacagcacaagatttggtaagtctggggatatctctggcagaacaccgcgaggctctgctctcaggtatatcagctctccaggctcgtgtgctgcagctgcaggggcagggggtacaggtcattataaaaacttgcctgtag

SEQ ID NO: 115873 - DNA, 468 bp, Artificial Sequence
  Description of Artificial Sequence: Synthetic coding sequence
atggttaaaaccggtgcacccacggtgaccgtaaccaacttaaagcctgcaactcggtacgtgtttcagattcgggcagcctcaccagggccctcctgggaggcacaaagcttcaacccctctatcgaagtccagaccttgggggaagcggccagcggttcgcgtgaccagtctcccgccatagtagtcaccgtggtgacaatctccgctcttctggtgctcggaagcgtcatgtccgtgttggctatttggcggagaccctgttcatacgggaaaggcggcggcgacgcccacgacgaagaagagctctacttccactttaaagttcctacaaggaggaccttcctagatccacagtcatgcggggatctcctgcaggcagtgcatctgttcgctaaggagctggacgctaagagcgtaaccttagagcgatcattgggtgggggtctcgagacaagccctcactag

SEQ ID NO: 115874 - DNA, 2931 bp, Artificial Sequence
  Description of Artificial Sequence: Synthetic coding sequence
atggagctccaggccgcaagagcttgttttgcacttttatggggatgcgcgctggctgctgctgccgctgcccaggggaaggaggtcgtgctgctcgacttcgcagcagctggtggggagttgggatggttgactcatccctacgggaaggggtgggatttgatgcagaatattatgaacgacatgcctatttatatgtactcagtgtgcaacgtcatgtcaggggatcaggataattggttgcgtactaactgggtgtataggggagaggctgagagaatcttcatcgaactgaagttcactgtgagggattgtaattccttccctgggggcgcatcatcctgcaaagagactttcaatttgtactacgcagagtccgatttagattatggcacgaactttcaaaagaggctcttcaccaagatcgatacgatcgcacccgatgaaatcaccgtgtcatcagacttcgaagcaagacacgtcaaactcaatgtagaagagagaagcgtgggccccctgaccagaaaaggattttatctagcgtttcaggacatcggcgcttgtgtcgcattactctctgtgcgggtttattacaagaaatgtcccgagcttctccagggcctggcgcactttcctgagaccatcgcaggcagcgatgctccatcactggccactgtcgcagggacttgcgttgaccatgctgtggtgcctccaggaggcgaagagccgagaatgcattgtgccgtagacggtgagtggttggttccaatcgggcaatgcctgtgccaggcagggtacgagaaggtcgaggatgcttgccaggcttgtagccccggcttttttaagttcgaagcctccgagtcgccttgcctcgaatgtccggaacatacactgcccagtcccgagggggccacaagttgcgagtgcgaggagggattctttagagcaccccaagaccctgcaagcatgccttgtacaaggccacctagtgcccctcactacctcactgcagtaggcatgggagcgaaagtggaacttcgatggactccaccacaggactcgggcggaagggaagatatagtgtatagtgttacctgtgagcagtgttggccagagtcaggtgagtgcggcccctgcgaggccagtgtgcgttactcagaaccgccccatggattgactagaaccagtgttaccgtatcagatttggagccacatatgaattacaccttcacggtagaggcacgcaacggagtgtcagggctagtgacatctagaagcttccggacggccagcgtttctattaaccagaccgagccaccaaaagtccgtctcgaaggccgatccaccacgagtctgagcgtgtcctggtctattcccccaccacaacagagccgggtgtggaagtacgaagtgacatatcggaaaaaaggagattccaactcctacaacgtgcgtcggaccgaagggtttagtgttacactggatgacctggccccagacaccacctacctggtgcaggtgcaggctttaactcaggagggccagggcgcagggagcaaggtacatgaatttcaaaccctgtcaccagaggggagtggcaacctggccgttatcggcggcgtcgccgtcggggtggtcctgcttctcgttcttgcaggcgtgggatttttcatccacagaagacgcaagaaccaaagagcacgccagagccctgaggacgtgtacttctcaaagagcgagcagcttaaaccgctgaaaacatatgtcgatcctcatacttacgaggaccccaatcaggcggtgctgaaatttaccaccgaaatccatccaagttgtgtaacaaggcagaaggtaattggcgctggtgaatttggtgaggtatataaaggtatgctgaagacgagtagcggaaaaaaagaagtgccggtggctatcaagaccctaaaagctgggtacacagagaaacaaagggtggattttctgggtgaggccgggatcatggggcaattttcacaccataatattattaggttggaaggggtcatcagtaagtataaaccgatgatgattatcactgaatacatggagaatggggctctcgacaagtttctgagagagaaggacggtgaattttctgtcttacagctggtcgggatgttgagggggatcgctgctggcatgaagtacctcgcaaacatgaattatgtgcacagagatctggccgcacgaaacatcctggtgaactccaatctggtctgtaaagtttccgactttggactcagccgtgtcctcgaggacgatcctgaagcgacctacacgacctccggcggcaagattcctattaggtggacggcacctgaggccatctcctacagaaaatttacttcagcttctgacgtgtggtcattcggtatagtcatgtgggaggtcatgacttacggggagcgaccttactgggaactgtcgaaccacgaggtcatgaaggccataaatgatggcttccggcttcctacacccatggattgccctagcgcaatctatcagttgatgatgcagtgttggcagcaagagagggcccggcggcccaagtttgccgatatcgtgtccattctcgacaagctgatcagagcgcccgactcattgaaaactcttgccgatttcgacccgcgcgtctcaattcggctcccttcgacgtccggcagcgagggcgttccatttcgcactgtgagcgaatggctggagagcatcaagatgcagcagtacacagagcacttcatggcagctggctacaccgcaatcgaaaaagtagttcagatgacaaatgacgatattaagaggataggcgtgcgactacccgggcaccagaaacgtatcgcgtactccctcctgggtctcaaagatcaggtgaacactgtcggaattcctatctag

SEQ ID NO: 115875 - DNA, 2952 bp, Artificial Sequence
  Description of Artificial Sequence: Synthetic coding sequence
atggactgtcaactgtcaatactcctgttgctcagttgtagcgtgttggacagcttcggcgaactaattccccaaccttccaatgaggtgaacctgcttgattccaagaccatccaaggagagctgggatggatttcatatccctcacatggctgggaggagatcagcggcgtagatgagcattatactcccatccgtacctaccaggtgtgtaacgtcatggatcacagtcaaaataactggctcaggacaaactgggtgcctcggaattcagcccaaaagatttacgttgaactgaaatttacgttgcgcgactgcaatagtatcccactcgtgcttggcacctgtaaagaaacatttaacctctattatatggagtctgacgacgatcacggcgttaaattcagagaacatcagtttacgaagatcgacacaatcgctgccgatgaaagttttactcaaatggacctgggagaccgaatcttgaaacttaataccgagatcagagaagtggggcccgtgaataagaagggattttatctggccttccaggatgtgggcgcttgcgtggccctcgtgagcgtccgggtctactttaagaagtgtccttttacagtaaaaaatctggcaatgtttcccgatactgtgccgatggactcccagtcattagttgaggtcagagggagttgcgtgaacaactcaaaggaagaggatccgccgcgtatgtattgctccacagaaggcgagtggctagtgcctattggaaaatgtagttgcaacgcaggatacgaagaacgcggtttcatgtgccaggcctgcagacctgggttctacaaggccttagatggtaatatgaagtgtgcaaaatgtcccccccactcttcaacacaggaggacggttccatgaactgccgctgcgagaacaactactttcgagctgataaggatcctccaagtatggcatgcacacgacccccatcttctccgcgaaatgttattagtaatattaatgaaacgagcgttattttggactggtcatggcctttggatacaggcggccggaaggacgttacctttaatattatttgtaagaaatgcggatggaacatcaaacagtgcgagccctgttcacccaatgtacgctttctgccccggcaatttggactgacaaacacaacagtaaccgtcaccgacctgttggcacataccaactatacctttgagatagatgccgttaacggtgtgagtgaactctcatcgcctccccgccagtttgccgccgtttcaattaccaccaaccaggcagcaccctctccagtgctcacaattaagaaagaccgaacctccagaaacagcattagcttgtcgtggcaagaacccgagcatccaaatgggataatcctagactacgaggttaaatattatgagaagcaggaacaggagactagctacactatcttacgcgccagggggaccaatgttacaatcagtagtctaaagcccgacacaatctacgttttccagattagggctaggacggccgcgggatatgggacgaacagtaggaaatttgagtttgaaactagccctgactctttctctatctccggtgagtcttcccaagttgtcatgattgccatatccgctgctgtggcgatcatcctcttgaccgtcgtgatttacgtgctgataggcaggttctgcggctacaaatccaagcatggggcggatgaaaagcgacttcacttcggaaacggtcatctcaagctcccagggttaagaacctacgttgatccccacacctatgaagaccccacccaggcggtccacgaatttgccaaggaactggatgcgaccaatatttccatagacaaagtggtgggtgctggggaattcggagaggtgtgttccggacgtctcaaactgcccagtaaaaaggaaatctcagtggccatcaaaactctgaaggtgggttacactgagaaacagaggagagactttttgggggaggcaagcataatgggacagtttgaccaccctaatatcatccggttggagggcgtcgttacaaaatccaagcctgttatgatcgtgacggaatatatggaaaatgggtcactcgatagctttctacggaagcatgacgcgcagttcaccgtcatccagctcgtggggatgctgcgcggcattgctagcggtatgaagtatctctccgatatgggttacgttcatagagacctcgccgcaaggaacatactgatcaatagtaaccttgtgtgtaaggtgagcgattttggcctgagccgcgttctcgaagatgaccccgaggccgcttatacgaccagaggaggaaagattcctatccgatggacatctcctgaggccattgcctacagaaagttcactagcgccagcgacgtttggtcttacggcatcgtactgtgggaagtcatgtcatatggtgagcgtccttattgggaaatgtcaaatcaggacgtaattaaggccgtggacgagggatacagactgccaccccccatggactgccctgccgccctgtaccagctcatgctcgactgttggcagaaagaccgcaataatcgtccaaagtttgagcaaattgtctccatccttgacaagttaattagaaaccctggaagcctgaagattatcacttcggctgcagcccgtcctagcaacctactgctagaccagagcaatgtggacatcaccaccttccggaccaccggagattggctgaacggggtgtggactgcgcactgcaaggaaatattcactggcgtcgagtacagctcttgtgatactattgccaaaatctccacggatgacatgaagaaggtgggtgtcacagtggtaggcccacagaagaagataatcagctctatcaaagcactcgagacgcagtccaagaatggacctgtgcctgtatag

SEQ ID NO: 115876 - DNA, 1620 bp, Artificial Sequence
  Description of Artificial Sequence: Synthetic coding sequence
atggactgccaattatccatccttcttctgctctcttgctctgtgctcgacagctttggggaattgattccacagcccagcaatgaagtgaacttgcttgattcaaaaaccatccagggtgaactgggatggatcagctatcctagccatgggtgggaggagatctcgggggtggacgaacattatacacctatcagaacatatcaggtgtgtaacgttatggatcactctcagaataattggttgaggacaaactgggtgcctcgaaattccgcccagaagatatacgtggagcttaaattcaccctgcgggactgcaactccatccctttggtgctgggcacctgcaaggagaccttcaatctgtactacatggagtccgacgacgatcatggcgtgaagtttcgtgagcatcagttcacgaagattgataccatcgctgcagatgagtcattcactcaaatggacttgggcgaccgcattctcaaattaaacaccgaaatccgtgaggtgggaccggtgaacaaaaagggtttttacctcgcatttcaggacgtgggagcgtgcgtggctcttgtgtcggtacgggtatacttcaagaaatgccccttcactgtaaagaacttagcaatgttccctgataccgttccgatggacagccagtcattggtcgaggttcggggctcctgtgttaataatagcaaggaggaggatcctcccagaatgtactgctcaaccgagggcgagtggttggttcctatcgggaaatgttcctgcaacgctggatacgaggagcggggctttatgtgtcaggcctgtagaccgggattttataaggcgttagatggcaacatgaagtgtgctaaatgcccaccgcatagctccacacaggaggacggtagtatgaactgccgatgtgaaaacaactatttccgcgccgataaggacccaccctccatggcctgcaccagacctccatccagtcctcggaatgtcatctctaacatcaatgagacttcagtaatcctcgactggtcctggcctctcgataccggcgggagaaaggatgtgacattcaacattatctgcaaaaagtgtggctggaacattaagcagtgcgaaccatgttctcctaatgtacgctttctgccaaggcagttcgggcttaccaatacgaccgtgaccgtgactgacttgctcgctcacactaactacacgttcgagatcgatgccgtgaacggtgtatctgagctctcgtcaccacccaggcagttcgcagccgtcagcattactacgaaccaagccgctccatctcctgtcctgactattaagaaagaccgtacatctcgaaactcaatctccctcagttggcaggagcccgaacatcctaatggtatcattctcgattatgaagttaagtattacgagaagcaggagcaggaaacttcctatacaatcctgcgcgctagaggaacaaacgtcactatcagctctctgaagcccgatactatttatgtgtttcagatccgggcaagaaccgctgcaggttacggaacaaactcacggaagtttgaatttgagacaagccccgattgtatgtactatttcaacgcagtctag

SEQ ID NO: 115877 - DNA, 3114 bp, Artificial Sequence
  Description of Artificial Sequence: Synthetic coding sequence
atgcgcgggtcgggccctcgtggcgctggtcggcggcgcccccccagcggtggcggcgacactcctatcactcccgcctcactggcaggctgttactctgccccccggagagcccccctgtggacctgcctgctgctgtgcgcagctcttaggacgctgctggcatccccctccaacgaggtaaacctactggacagtagaaccgttatgggagacctaggttggatcgcattccccaagaacggatgggaggaaatcggcgaggtagacgagaactacgcacctattcacacataccaagtctgcaaagttatggagcagaatcagaacaactggcttctgactagttggatcagtaatgaaggcgctagtaggattttcatcgaactgaaattcacactaagagactgcaacagcctccccggcggacttggcacctgcaaggaaactttcaacatgtattacttcgaatccgacgatcaaaacgggaggaatatcaaagagaaccaatatatcaaaattgatacgattgcagcagacgagagctttacagagctggacctgggtgatagggtgatgaagctaaataccgaggtgagagacgtgggtccactaagtaagaagggattctacctggcctttcaggacgttggcgcttgtatcgctctggtgtccgtgagagtttattacaagaagtgcccctccgtcgtgcggcacctcgcggtgttcccagatacgatcacgggggctgacagcagccagttactggaggtttccggctcttgcgtgaatcatagtgtgacagatgagcctcccaaaatgcattgctctgctgaaggggaatggctggtgccaattggaaagtgtatgtgcaaggcagggtacgaggagaagaatggaacttgtcaggtgtgccgtcctggcttcttcaaagcttcgccccacatacagtcatgcggaaaatgcccgccccacagttatacccacgaggaggcaagtacatcttgcgtgtgcgaaaaggactactttagacgggaaagtgatccacccaccatggcttgcacaagaccacctagcgcccccagaaacgctatttccaacgtcaatgaaaccagcgtatttttagagtggattccccctgccgacactggaggacgcaaggacgtgagctattatattgcctgtaaaaaatgcaatagccacgccggcgtgtgcgaagagtgcggcggtcacgtccgctacctacctcgtcaaagcgggcttaaaaatacctcagtgatgatggtggatctgctagcccataccaattacacttttgaaatagaagccgtgaacggcgtctctgacctctcaccgggcgcacgccagtatgtgtccgtgaacgtcaccaccaatcaggcagctccatctccggtgaccaatgttaaaaaagggaaaattgcgaagaatagcataagcctaagctggcaggagcccgatcggccgaacggcattattttggaatatgaaattaaatacttcgagaaagaccaggagacttcttacacgatcattaagtcgaaagagaccacaattaccgctgagggccttaaaccagcgtcagtctacgtatttcagatcagggctcgaaccgctgccggctatggcgttttcagccgccgtttcgaattcgagaccacaccagtatttgccgcttcatcggatcagtctcaaatccctgtgatcgctgtctcggttacagtgggcgtgattttattggctgtagtaatcggcgtcctcctgtctggatcttgttgcgaatgtggatgcgggcgcgcatccagtctgtgcgctgtggcccacccctctctgatatggaggtgtggctactccaaggctaaacaggaccctgaagaggagaagatgcacttccataatggccacataaagctgccaggagtacggacatatatagacccccacacttacgaagaccctaatcaggcagtacacgagttcgcaaaagaaatagaggcttcctgcatcactatcgagagagtgataggcgccggcgaattcggtgaggtgtgctcaggtcggttgaagcttcctggcaaacgcgagttacctgtggctatcaaaacacttaaagtgggatacaccgagaagcaacgccgcgatttcttaggggaggcttccattatgggccagttcgaccatcctaacattatacacttggagggcgtggtcacgaaaagcaaaccggtcatgatcgtaacagaatacatggaaaacggaagcctggacacctttctgaagaagaacgacggccagtttactgtcatacagttggtcggtatgctgcgcgggatttcagccggtatgaagtacctgtccgatatgggatacgtccaccgcgacctggctgcaaggaatattttgatcaacagcaatttagtttgcaaagtcagcgatttcggattgtccagggttttggaggacgatcccgaggcagcttacaccacccgtggaggcaagatcccgattagatggacagctcccgaagctatcgcattcaggaaattcacttctgcctccgatgtgtggagctatggtatcgtgatgtgggaggtcgtttcttatggagagcgaccctactgggagatgacgaatcaggacgttatcaaggctgtggaggaaggttatagactgccctctcccatggactgccctgccgcactatatcaattgatgctggactgctggcagaaagaaaggaattcacggccaaaatttgacgagatcgtcaacatgctggacaagctgattcggaacccctcatcgctgaagaccctcgtcaatgcttcttgtcgtgtctccaaccttttggccgagcactctcccttggggtccggagcctatcggtccgtgggtgagtggctggaagccatcaagatgggccgatacactgaaattttcatggagaacgggtacagcagcatggatgcggtggcccaagtcacactggaggacctgcgacgtctcggcgtcacactggttggccaccagaaaaagatcatgaactctctccaggagatgaaggtgcagctggtcaacggcatggttccactttag

SEQ ID NO: 115878 - DNA, 3048 bp, Artificial Sequence
  Description of Artificial Sequence: Synthetic coding sequence
atgcgcggatccggacccaggggggctgggcggcgccgccctcctagcggaggaggcgacaccccgatcactcctgccagtctggctggctgctactctgcgccccgccgtgcccccttgtggacttgcctcttactttgtgccgcccttcgaacattactggccagtcccagcaatgaggtgaatcttctggacagtcggacggtcatgggcgaccttggctggattgccttcccaaagaatggttgggaggaaatcggcgaggtagacgaaaattatgcccctatccacacttaccaggtgtgtaaggtcatggagcaaaaccagaataattggttacttacttcttggatctctaatgaaggggcatccaggatcttcatagaattgaagttcacattgcgcgattgcaacagcctgcccggaggcctggggacatgcaaggagactttcaacatgtattattttgagagtgacgaccagaacggacgtaacatcaaagaaaatcagtatattaaaattgatacaattgcagccgacgagagcttcactgagctagatctcggtgaccgggtgatgaagctgaacaccgaagtgcgggatgtgggccctctttccaagaagggattttacctggcattccaggacgtgggagcttgcattgcactcgtatcagtccgcgtgtattacaagaagtgtccatctgttgttcggcacctggccgtcttccccgacactattactggtgctgactcgagtcaattgctggaagtgtctggctcatgtgttaaccacagcgtcactgacgagccccctaagatgcattgctccgctgaaggagaatggctggtccccattggaaaatgcatgtgtaaggctggctacgaggagaaaaatggcacttgtcaagtctgccggcctggcttcttcaaagcctccccacacatccagagctgtggcaaatgtcctccgcactcatatacccatgaggaggctagtactagctgcgtctgtgaaaaagattatttcaggcgcgagtctgacccgcccaccatggcatgcacacggccaccttctgccccccgcaacgcgatatctaacgtaaatgagacttctgtcttcctcgagtggattcccccagctgataccggtgggcgcaaggatgtcagttattacatcgcttgcaaaaaatgtaattctcacgcaggagtatgtgaggagtgtggtggacatgtcagatacctcccaagacaatcaggcctcaagaatacgtccgtcatgatggtggatctcctagctcacacaaattatacatttgaaatagaggccgtgaatggggtatcagacttgtctcctggagcaaggcaatatgtgtccgtgaatgtaaccacaaaccaggccgcccctagcccagtgacgaatgttaaaaagggcaagatagctaagaacagcatctccctgtcttggcaggagcctgaccgccctaacggtattatcttggaatatgaaattaaatatttcgaaaaagaccaggaaaccagttacacaattatcaagtctaaggaaacgacaataacagcggaaggtcttaagcctgcaagtgtgtacgtctttcagatacgtgcaagaaccgccgcgggctatggggtttttagcagacgatttgaatttgaaactactcccgtcttcgctgcctcatcagaccagtcccagataccagttattgctgtaagtgtgactgtgggcgtcatccttctggcagtggtaattggggtgcttctttccggacgacgctgcggttacagcaaggctaaacaggaccctgaggaggaaaaaatgcattttcacaacggccatatcaaactaccaggcgtcaggacgtatatcgatccccatacctacgaggatcccaatcaggccgtgcacgagttcgccaaagagatcgaagcaagctgcattacaattgaaagagttataggggcaggcgagttcggcgaagtgtgctcaggtcggctgaagttgccagggaagagggagcttccagtcgcgataaagactctgaaggttggttacaccgaaaagcaacgacgcgactttctcggggaggccagtatcatggggcagttcgatcatcctaacattatccacctggagggcgttgtgaccaaatctaaacctgtaatgattgtcacagagtacatggagaatggttcactagacacattccttaaaaagaatgatggtcagttcaccgtgatccaattagtaggcatgttgaggggcatcagcgccggtatgaagtatctctctgacatggggtacgtccatagagatctggcggcgcgcaatatcttgatcaacagtaaccttgtatgcaaagtgtctgattttggtctctcacgggtcctggaagacgatcctgaggcagcatacaccacccgggggggtaagatcccgattagatggaccgccccagaggccatcgcgtttagaaaatttacctccgccagcgatgtgtggagctatgggatcgtcatgtgggaggtcgtgagctacggggagcgtccatactgggagatgaccaaccaggacgttatcaaggcagtggaggagggctatcgtttgccgtctcctatggattgtcccgcagccctgtaccagctcatgttagactgctggcaaaaagaacgtaactcaagacccaagtttgatgaaatcgtgaacatgctcgataaactcatccggaatccatcaagtctgaaaacattagtcaacgccagctgcagggtctccaatttactggctgaacactctcccctaggatcgggtgcttatcgctctgtgggagagtggcttgaagccatcaaaatgggcagatataccgagatcttcatggagaacggctacagttcgatggatgccgtagcccaggtaacgttggaggatctgcgacgcctcggagtgactctggtggggcaccaaaaaaagatcatgaatagtctccaagagatgaaggtacagctggttaatggaatggttccactttag

SEQ ID NO: 115879 - DNA, 3015 bp, Artificial Sequence
  Description of Artificial Sequence: Synthetic coding sequence
atgcggggctcgggcccaaggggcgccggccggcgcagacccccttcagggggcggggacacgcctatcactcccgcttctttggcgggctgctattctgcccctagacgggctcccctgtggacatgtcttctcctgtgcgccgctctgcggacactactggcttccccatctaacgaagttaacttactggactctagaactgttatgggggacttgggttggatcgcctttcctaaaaacggctgggaagagatcggagaggtcgatgagaactacgctccaatccatacataccaagtgtgcaaggtgatggagcaaaatcagaacaactggctgctgacttcctggatttctaacgagggcgcaagccggatttttatcgagctgaagttcactttgagggattgcaactctttgcctgggggcctgggaacatgcaaagagacatttaacatgtattactttgagtctgatgatcaaaatggaagaaacattaaagagaaccagtacatcaaaatcgacaccattgccgctgacgaatcttttaccgaactggatctgggggatagagtgatgaagttaaacacagaagtacgagacgtcggccctctgagcaaaaagggcttctatctggctttccaggacgtgggggcctgcatcgctcttgtctcagtgcgcgtttactataagaaatgcccaagtgtcgtgcgccacctcgcggttttccccgatacaataacgggcgctgacagttcacaactgctggaagtttctggcagttgtgtgaaccatagtgtaaccgacgaacccccaaaaatgcactgcagcgctgaaggggaatggctggtcccaattggcaaatgcatgtgcaaggctggctatgaagagaagaacgggacttgccaggtgtgtaggcctggcttttttaaggcctcaccgcacatccaaagctgcggcaaatgtccccctcattcttacacacacgaggaagctagcacttcatgcgtgtgcgagaaagattacttccgcagggagtcggacccaccgaccatggcatgcacccggccgcccagcgcaccaaggaatgcaatctccaatgtgaacgaaactagtgtgtttctggaatggatcccccctgctgacaccggaggacgcaaggacgtctcttactacattgcgtgcaagaaatgtaattcccacgctggagtgtgcgaagaatgtggcggccacgtcaggtacttgcctcggcagtctggcctgaaaaataccagtgtgatgatggtagacttactcgctcatacaaattatactttcgagattgaggccgtgaatggcgtgtccgacctcagccctggagcccgccagtatgtgtccgtcaatgtgactaccaatcaggcagctccatcgccggtgaccaatgtcaagaaaggaaaaattgctaagaattccatatcgctcagctggcaagagccagaccgcccaaacgggatcatcctggaatacgaaattaagtatttcgaaaaagaccaggaaacatcatatactatcatcaagtctaaggagaccactatcacagccgaaggattaaagcctgcatctgtatacgtctttcaaatccgcgccaggaccgccgcaggatatggagttttttcaagacggtttgaatttgagacgacacctgtgagtgttgctgcctcttctgaccagagccagatacctgtcatcgccgtgtctgtcaccgttggcgtgatcctgttggccgtggtgattggcgtgctgttgagtgggagctgctgtgagtgtggctgtggaagggcgtcaagtctctgcgctgtggcacatccatctcttatatggcgctgcgggtacagtaaggccaaacaggatcccgaggaagagaagatgcactttcataatgggcatataaagctgccaggcgtgcgcacttacatcgatcctcatacatatgaggaccctaaccaggcagtccatgaattcgcaaaggaaatcgaggcatcttgtataaccatcgaacgcgtcattggagcaggagaatttggggaggtttgcagcggaaggcttaaactacccgggaagagagagttgcccgtggctattaaaaccctaaaagtcgggtacaccgagaagcaacgcagggactttctcggagaggcaagtattatgggacaatttgaccatccaaatatcattcaccttgagggtgtggtaacaaaatctaagccggtcatgattgtgacagaatacatggagaatggatccctcgataccttcttgaagaagaatgatggccagtttaccgttattcaactggtgggcatgctccggggaattagcgcgggtatgaaatacctgtctgacatgggatatgtgcatcgcgatctcgcagccagaaacattctgattaactccaacctggtttgtaaggtgtccgacttcggactgagtcgggttctggaggatgacccagaagccgcgtacactacgagaggtggcaagatcccaatccgatggactgccccagaggctatagccttccgtaagtttacgagcgcttccgatgtatggagttacgggatagtgatgtgggaggtagtgtcctacggggaacggccgtactgggaaatgactaaccaggatgtgatcaaggccgttgaggaagggtacaggctgccaagccccatggattgccccgcagccctctatcaactgatgctcgactgttggcagaaagagagaaattcaaggcctaagtttgatgagatagtgaacatgctcgataagctgattcggaacccatcaagcttgaagactctggtcaacgcttcatgtagagtcagtaatttactcgctgagcatagcccgttgggtagtggtgcataccgctcagtcggagagtggctggaggctattaagatggggcggtacacggaaatcttcatggaaaatggctatagttcgatggacgccgtcgcacaggtcacactggaatag

SEQ ID NO: 115880 - DNA, 3018 bp, Artificial Sequence
  Description of Artificial Sequence: Synthetic coding sequence
atggccccagcacggggcagacttccacccgcactgtgggtggtgaccgctgccgctgctgcagccacctgcgtgtcggctgcccgcggggaagtgaacctccttgataccagcacaatccacggggactggggatggctgacttatcctgcccatggatgggattctattaacgaggtggatgagagttttcagccaattcatacctatcaggtgtgtaatgtaatgagtccgaaccagaacaactggctccgtacaagctgggtccctagagacggcgctagacgcgtgtacgccgagatcaagttcactctcagggactgcaacagcatgccaggagtgctaggaacatgtaaagaaacatttaacctgtattatcttgaatcagatcgggatctgggagcaagcacccaggagtcacagtttctgaaaatcgataccatcgctgccgacgagtctttcactggtgccgatctgggggtgcggcggctgaagctcaacaccgaggtgagaagcgtcgggcccctaagtaagcgcggattctatcttgccttccaggatatcggtgcctgtttggctattcttagcttaagaatctactataagaaatgtcccgccatggtcagaaacctggccgccttttctgaggccgttacaggggcggactcaagctcccttgtcgaagtgcgagggcagtgcgtgagacactctgaggagagagacaccccaaaaatgtattgttcagcagagggcgaatggctggtaccaatcgggaagtgtgtatgttcggctgggtatgaagaaagacgcgatgcctgtgtcgcctgtgaactaggtttctataagtctgcaccaggcgatcagctttgtgcgaggtgcccaccgcatagccattctgccgcaccagcagctcaggcttgtcactgtgacttatcatattaccgggcagccttggatcctccaagcagtgcgtgtactagaccaccctccgctcccgtgaaccttatctcttccgtgaatggcacctctgtgacccttgagtgggcccctcctctggatccaggggggcgctccgacatcacttataatgcagtatgtagaaggtgtccttgggccctgtcaaggtgtgaggcctgtggcagcggaacacggtttgttcctcagcaaacgagcctggtgcaagcgagcttgcttgtcgcaaatctgctcgcgcatatgaattattcattttggatcgaggccgtcaatggcgtgtctgatctgagcccagagcctcgccgtgccgcggttgtcaacattaccacgaaccaagcagctccgagccaggtagtggtgatcagacaggagagagccgggcagacatctgtttccctgctgtggcaagaaccggagcagcctaatgggattatcctcgagtacgaaattaagtactatgaaaaagataaggaaatgcagtcatacagcactctcaaggccgtcactacacgggccactgtgtcaggtttaaaacccggtactagatatgtgtttcaggtgcgggcacgaaccagcgcagggtgtggccgcttttctcaagcaatggaggtggagacaggaaaaccgaggcctagatatgacactaggaccattgtctggatttgtctgaccctaatcaccgggctagttgtactgcttctcttgctgatctgcaaaaagagacactgtggctactcgaaagcattccaggactccgacgaggaaaaaatgcattatcagaatgggcaggccccaccacccgtttttctccctctacaccatccccccggaaaattgcccgagccgcagttttatgccgagccgcatacgtatgaggaaccagggcgagctggcaggtcctttacacgagagatcgaggcctccaggattcacatagaaaagatcatcggaagcggcgacagcggtgaggtgtgttatggccgactgagggtgcctggccagcgtgatgtgccagtcgccatcaaggcccttaaggctggatacacagaacgacaaaggagagactttttatcagaagcatctattatggggcaattcgatcatccaaatattatccggctagagggggtggttacccgggggcgcttggccatgatcgtgaccgaatatatggagaacggcagcctggatacttttctgagaactcatgacgggcagttcacaattatgcagctcgtggggatgctgcggggcgtgggggcgggaatgaggtacctgagcgatctcggctacgtgcaccgggatctggcagctcggaacgttttggtggacagtaacctggtgtgtaaggtctcagattttgggctgtccagggtcttggaagacgatcccgacgctgcctacacgaccactggggggaagattcctattcggtggactgcccccgaggcaatcgcgttccgcacattctccagtgcatcagacgtgtggtcctttggagtggtcatgtgggaagtcttagcatacggcgagaggccctactggaacatgaccaatcgggacgtcatctcttctgtggaagagggttatcgtctgcccgcacccatgggttgtccccacgccctgcaccagctgatgttggattgctggcataaagatagagcacagcgacctcgattttctcagatagtttctgtgctggacgccctgatcaggagtcctgagtctctaagggctacagctactgtgtcccgatgcccacctcctgcatttgtgagaagctgtttcgatttgagaggaggctctggaggaggcgggggactgactgttggcgactggctcgatagcattcggatggggcgttacagggaccacttcgcagccggaggatacagctcgctcggcatggttctgcggatgaatgcccaggacgttcgcgctttggggataacactgatggggcaccagaaaaagattctcggcagtatccagaccatgagggcacagctcacatcaacacagggtcctagacgccacctttag

SEQ ID NO: 115881 - DNA, 1488 bp, Artificial Sequence
  Description of Artificial Sequence: Synthetic coding sequence
atggcccccgcccggggcaggttgccccccgccttgtgggtggtcaccgcggcagctgctgctgctacctgcgtcagcgctgccagaggcgaggtgaacctgctggacacctccaccattcacggcgactggggatggctaacgtatccagcccacgggtgggactctatcaatgaggtagacgaatcatttcagcctatccacacctaccaggtgtgcaacgtgatgagcccaaaccagaataattggctgcggacatcatgggttccacgggacggggcccggcgggtctacgccgagattaaatttacattaagggactgtaatagtatgcctggggtgctaggtacatgtaaggagacattcaacctgtactaccttgaatctgaccgggatttgggcgctagcacccaggagtcccaattcttgaaaatcgatactatcgccgccgatgaatcattcactggtgccgatctcggcgtgaggagactgaagctcaataccgaggttagatctgtgggtccattgtctaagcggggtttttacctggcgttccaagacataggcgcatgtttggcaattcttagtctgaggatctactacaaaaaatgtcctgctatggtgcggaacttggctgcgttcagtgaagcagtcaccggagccgacagttctagtctagtggaggtgcgtggtcaatgcgtaaggcacagcgaagagcgtgacactcctaaaatgtactgttccgctgagggcgaatggctggtgcccatcggaaaatgcgtgtgctctgccggttacgaagagcggagagacgcatgtgtggcgtgcgaactcggcttctacaagtctgctcctggcgatcagctctgtgccaggtgtcctccccatagtcattcagcggctcctgccgcgcaagcgtgccactgcgacctgtcatattacagggccgcacttgaccctccatctagcgcttgtactcggcccccttccgccccagtcaatcttataagctccgtcaatgggacaagtgtgacactggaatgggccccgcccctggacccggggggtcgatcagacattacttacaacgctgtgtgccggcggtgcccctgggccctctctagatgcgaggcctgtggcagtggaacccgctttgtgcctcaacagacttccctggttcaggcctccctcctggtggcgaatctcctggctcatatgaattatagcttttggatcgaagcggtgaatggggtctccgatctaagcccagaacccagacgggcagcggtggtgaatattaccactaaccaagccggtaggaggcggaatagcgttccgcagagacctgggccgccagcctcgccagctagcgaccctagtcgggaccaaagctcagccggagatgtgctctgggcgtttcgccaggtgcccttgtggccctgtgcaccccaccaggacccggagctggaggcccttcattgcctttag

SEQ ID NO: 115882 - DNA, 1488 bp, Artificial Sequence
  Description of Artificial Sequence: Synthetic coding sequence
atggcccctgcacgcggacggctccctcccgcgctatgggtggtcacagctgctgctgccgcggccacatgcgtctcagctgcccggggggaggtcaatctgctcgatacctctactatacatggcgattggggctggctcacctatcctgctcacggttgggactcaattaacgaagtcgatgaaagcttccagccaattcatacttatcaggtgtgcaacgtcatgtctcccaatcagaacaattggctgcggaccagctgggttcccagggacggcgcgcgaagagtttatgccgaaatcaaatttaccttaagagactgcaactcaatgcctggtgtattagggacgtgcaaagagactttcaacttgtactatctggaatctgatcgagatcttggtgccagcactcaagaatcccagttccttaagattgacaccatcgccgccgacgaatctttcactggcgctgatctcggcgtgaggcgtctgaaattaaatacggaggtcagatctgttggaccactttcgaaacgtgggttctacctcgcattccaagacattggtgcatgtctggccatcctgagtcttcggatctactacaaaaagtgccctgctatggtccgcaacttggcagctttttcagaagcagtgacaggagcagattccagtagcctggtcgaggtgaggggacagtgcgttagacatagcgaggagagagacacccctaagatgtactgttctgcagagggggaatggctagtcccaatcggaaaatgtgtatgttctgcaggctatgaggaaagaagggacgcttgcgtagcttgcgagttaggcttctataagtccgcgccgggggatcaactgtgcgcgcgttgccctccacacagccactcagctgcgcccgcagcccaagcttgtcattgcgatctctcatactatcgggctgcactggatcctccctcatcggcctgtaccagacctccttctgctcctgtgaacctcattagtagtgtgaatggtactagtgtaactttggaatgggcccccccgctagaccccggaggtcgctctgacatcacgtataacgctgtgtgtcgtcgatgcccgtgggctctcagtcgctgcgaagcttgcggttccgggactcgcttcgtgccacagcagactagtctggttcaggcaagcctgcttgtggctaatctgcttgcgcacatgaactactccttctggatcgaggcagtcaacggggtcagcgacctgtctcccgaaccacgcagggcggctgtggtaaatataacaactaaccaggcaggccgcagacggaacagtgttccccagagacctgggccacctgcaagtccagccagcgacccatccagagaccagtcttcagcaggagatgtgctgtgggcgttcagacaagtccccttgtggccctgcgcgcctcaccaggacccggaactggaggccttgcactgtctctag

SEQ ID NO: 115883 - DNA, 2955 bp, Artificial Sequence
  Description of Artificial Sequence: Synthetic coding sequence
atggccctcgattacctcttgctgctccttcttgcttctgcagtcgcagccatggaggaaacactgatggatacaaggactgccactgccgaacttggctggaccgctaatcccgcaagtggatgggaggaagttagtggctatgatgaaaatctaaatacaatccgcacttaccaggtttgtaatgtgttcgaacccaatcagaataactggttactgactacattcattaaccgacgcggcgctcacaggatttatactgagatgcggttcacggtgagggactgcagttcgttgcctaatgtcccaggaagctgcaaagagaccttcaacctgtattattatgagacagacagcgtgatagctacgaaaaagtctgcattctggagcgaggccccgtacctgaaggtcgacaccatcgctgccgatgaatccttcagtcaagtggatttcggggggcggctgatgaaggtgaatacagaggtacggagttttggccctttgacgagaaacggcttctatttggcgttccaggattacggagcttgcatgtccctcctgagcgtgcgagtattctttaaaaaatgcccgagcattgttcaaaacttcgcagtattcccggaaaccatgaccggtgcggaaagtacatctctcgttattgctcgtgggacgtgcataccaaatgccgaagaggtggacgttccgataaagctttattgcaatggcgatggcgaatggatggtcccaataggccggtgtacatgtaaaccaggctatgaacccgaaaacagtgtcgcttgcaaggcttgtccggcagggacctttaaggcttcccaagaggccgaggggtgtagccattgtccctcaaactcacgcagccccgcagaggcttctcctatttgtacttgtcgaactggctattatagagcagatttcgatccaccagaagtggcatgcacttctgtaccttcaggacctaggaatgtcatcagcatcgttaatgaaacttccatcatcttggaatggcaccccccccgcgagacgggcggccgggacgatgtaacttacaacatcatctgtaaaaaatgccgagctgaccgccgatcttgcagtcggtgtgatgacaacgtagaatttgtgcctcggcaactgggcctcactgagtgtcgtgtgagcatttcgagtctctgggcacacacgccttacaccttcgacattcaggcaataaacggggtaagtagcaagtccccctttcctccccagcacgtgtccgtgaacattaccacgaaccaggctgcccccagcaccgtgccaatcatgcatcaagtgtccgccaccatgaggagtatcactctatcctggcctcaaccagaacagcccaacggtatcatccttgattacgaaatcaggtattatgagaaggaacataacgaattcaatagttccatggccagaagccagacgaatacagctcggattgatgggctacgacccggaatggtgtacgtagttcaggtgcgggctcgcaccgttgccgggtacggaaagttttctggtaaaatgtgcttccaaacgctcactgacgacgattacaagagcgagttgcgggaacagctcccactgatagctggatccgccgccgccggcgttgtcttcgtggtgtcacttgtagctattagcatagtgtgctctagaaaaagagcatactcaaaagaggcagtttactccgataagctccagcattacagtaccggaaggggttcacctggcatgaagatttacatcgatccctttacatatgaggatcccaacgaggccgtgagggaattcgccaaagagattgacgtgagttttgtgaagattgaggaggtgattggtgctggagagttcggcgaggtgtacaagggcaggctgaagttgcccggtaaaagggagatctatgtggccattaaaacgcttaaggctggttacagcgagaaacaaagaagggattttttgagtgaagcgagcatcatgggacagttcgaccaccctaacatcatccgcctggaaggcgtggtgaccaagagccgtcctgtcatgatcattactgaatttatggagaacggcgccttagacagtttcctcaggcagaatgatggacagttcacagtcattcagctcgtgggcatgctccgtgggatcgcggccggcatgaagtatcttgccgaaatgaactacgtgcaccgggacctggctgctcggaatatcctcgtgaactccaatttagtgtgcaaggtgtcagactttggcctcagccgctacctgcaggacgacacctctgacccaacctacacgtcttccctggggggaaaaattcctgtgcgatggaccgcaccggaggccattgcctatcggaaattcaccagcgccagcgatgtatggagttacgggatcgtaatgtgggaagttatgagctttggcgagcggccttattgggatatgtctaaccaggacgtcatcaacgcaatcgaacaggactatagactgcccccccccatggactgcccagctgccctccatcagctgatgctggactgttggcagaaagaccggaattctcgccctcgcttcgctgagattgtgaacactctggataaaatgattagaaaccctgcctcactgaaaaccgttgcaacgattaccgcagtgccttctcagcccctgttagataggagcattcctgactttactgccttcacaacagttgacgactggttgtctgcaatcaaaatggttcagtaccgggacagtttcctgaccgccggattcacgagcctccagttggttacccagatgacttctgaggatctccttcgtatcggtatcacactagcaggacaccaaaagaaaattttgaattcaatccactccatgcgggtacagatcagccagagcccgaccgcaatggcatag

SEQ ID NO: 115884 - DNA, 1638 bp, Artificial Sequence
  Description of Artificial Sequence: Synthetic coding sequence
atgcaccaagtctccgcaaccatgaggagcattaccctttcatggcctcagcctgagcaacctaacggaattattctggattacgaaatccggtattacgaaaaagaacacaacgaattcaacagctccatggccagaagtcagacgaacaccgcgcgcattgacggacttcgccctggcatggtttacgtcgtgcaggtgcgcgcccgcactgtcgcaggttacggaaagtttagcggtaagatgtgctttcaaacattaacagatgatgactacaagtcggaactgagggagcaattgccactgatcgccggcagcgccgccgccggtgtggtcttcgtggtgtctctggtggccatatccattgtttgctcgcgcaaacgggcctattcaaaggaagccgtatactccgacaaacttcagcactactctacaggaagagggagtccaggcatgaaaatctacatcgatccatttacgtatgaggaccccaatgaagctgtgcgcgagttcgctaaggagatcgacgtgtctttcgtgaagattgaggaagttataggagccggggaattcggcgaggtgtacaagggcagactgaagctccctggcaagcgagagatctatgtcgcaatcaaaactctaaaagcagggtatagtgaaaaacaacggagggattttctcagcgaagcttcaataatgggccagtttgatcacccaaatattatccggttagagggggtggtgactaagtctcgaccagtgatgatcatcaccgaattcatggagaatggtgccctagatagttttcttcggcagaacgatgggcaattcaccgtgattcagcttgtgggaatgctgagaggtatagccgccgggatgaaatacttggctgagatgaactacgtacatcgagacctcgctgctagaaatattttagtgaatagtaatttggtttgcaaggtatccgatttcggtctctctagatacttgcaggatgacaccagtgatccaacctatacgagttcgctcgggggaaagatcccagttagatggacagccccagaagcgattgcttataggaagttcacgagtgcctctgatgtttggtcatacggtattgttatgtgggaggtcatgtcctttggcgaaagaccctattgggacatgagcaaccaagacgtcattaacgctatcgagcaggattaccgccttcctcccccgatggactgccctgcagcactccaccagcttatgctggactgctggcagaaagatcggaatagcagaccccgcttcgccgagattgtgaatacactggacaagatgatccggaatcctgctagtttgaaaacagtcgccactataactgcagtcccaagtcagccccttctggatcgctctatacccgacttcactgcattcactacagtggacgattggctgagcgcaataaagatggtgcagtatagagactctttcctcacagctggtttcacttccttgcaactggtcacccagatgacatcagaggacctcctgcgtataggaatcactttagccggccaccagaagaaaatccttaatagcatccacagcatgagagtgcagatcagccagtccccgacggctatggcttag

SEQ ID NO: 115885 - DNA, 2997 bp, Artificial Sequence
  Description of Artificial Sequence: Synthetic coding sequence
atggcccgggcccgccccccacctccccctagcccccctccgggcctgcttccacttctgcctcctctgcttctattgcccttactcttacttcccgccggatgccgcgcccttgaggagaccttgatggataccaaatgggtgacaagcgaactcgcctggacaagccatccagagtccgggtgggaggaggtatctggatatgacgaagcaatgaacccgattcgaacttaccaggtgtgcaatgtgcgtgaatccagccagaacaactggcttcgcaccggattcatttggcgcagagacgtgcagcgcgtgtatgtggagttaaagttcaccgtccgggactgtaacagcatcccaaacattcctggcagttgcaaagagacctttaatctgttctactacgaggccgactccgatgttgcaagcgccagctctccattttggatggaaaatccttacgtcaaggtggacacaatagcgccagacgagtcctttagcaggctagatgccggacgggtgaacactaaggtccggagctttggaccactgagtaaggccggtttttacctggcctttcaggatcaaggcgcatgtatgagtctgattagtgtccgcgccttctacaaaaaatgtgccagtacgacggccggctttgctttattccccgagacacttaccggcgctgagcctacttccctagtgattgctcccggcacttgtattcctaatgctgtggaagtttccgtgccgttaaagctgtactgtaacggcgacggggagtggatggtccctgtgggtgcctgtacttgtgcgaccggccacgagcccgcagccaaagagagccagtgtcgcccatgtccccctggaagttacaaggctaaacagggcgagggaccgtgtctgccttgcccaccaaacagtcgcacaacttctccggccgcctccatttgtacctgtcataataatttctatcgggctgacagtgactcagctgactcagcctgtactacagtccccagcccgcctcgaggtgtcattagcaacgtgaacgaaacaagcctgattctcgaatggtcggaacctcgtgacctgggcggacgtgacgacctgctgtacaatgtgatttgcaagaaatgccacggggcggggggagccagtgcttgctcacggtgcgatgacaacgtggaattcgttcctaggcagctggggctcactgagcggagagtacacatttcacatctgttggcccatacgaggtacacattcgaggtgcaggccgtaaatggagttagtggcaagagtcccctgccaccgaggtacgcagctgtgaatattaccactaatcaggcagctcctagcgaggtgccaactcttcgcctgcatagctcatcagggtctagcctgaccctgtcctgggcccctcccgagagacccaatggggttatactcgactacgagatgaaatacttcgaaaaaagcgaaggcatcgcttcgacagtgacatcccagatgaactccgtacagctagacggtctgagaccggatgcacggtacgtggtgcaagttagagcccgaacagttgcagggtatggccagtactcccgtcccgctgaatttgagaccacctcagaaaggggctcaggtgcacagcagctccaggagcaactgccactgatagtcggttctgccacagccggactggtgtttgttgtggctgtggtggttatcgccatcgtgtgtctgcgcaagcaaaggcatggctccgacagtgaatacaccgagaaactgcaacaatatatcgcgcccgggatgaaagtctatattgatccgttcacttatgaagacccgaacgaggccgttagggagttcgctaaggaaattgacgtctcgtgcgtcaagattgaagaagtgatcggcgctggagaattcggagaagtttgtcgagggcgccttaagcagccgggacgaagggaggttttcgtggcaattaagaccctgaaggtgggttacacagagagacaacgaagagatttcctgtctgaagctagcatcatgggccagttcgatcatccgaacatcatacggttggagggagttgtaacgaagtctcggcccgttatgatcctgactgagttcatggaaaactgcgccctggacagctttctccggttaaatgatgggcagttcaccgtgattcagctggtgggaatgctgaggggcatcgcagcgggcatgaaatatcttagcgagatgaactacgtgcacagggacctggcagccagaaacattctggtcaactcgaatctggtgtgcaaagtatccgactttgggctgagccggtttctcgaggatgatccctccgacccaacgtacactagttcacttgggggcaagattcccatccgttggacagcccctgaggccatcgcctaccgcaagtttacctctgcgtccgatgtgtggtcgtacgggattgtcatgtgggaagtgatgtcatatggcgagcggccatactgggacatgagtaaccaggacgtcattaacgctgttgaacaagactacagattgcctccgcctatggactgtccgaccgctctccaccagctgatgttggactgttgggttagggatcggaatttacgtcccaagttttcacagatcgtgaatactctggataagctgatccgcaatgcagctagcctgaaagtgatcgctagcgcgcaatcagggatgtcccaacccctcctggatcgaactgttcccgattacacaaccttcactacagttggcgactggctggatgccatcaaaatggggaggtataaggagtctttcgttagtgctggcttcgccagtttcgacctggtggctcagatgactgcagaagatctgctccgcattggtgttacgctggcaggacaccaaaagaagatcttatctagcatccaggatatgcgccttcagatgaaccagaccctcccggtccaggtatag

SEQ ID NO: 115886 - DNA, 3066 bp, Artificial Sequence
  Description of Artificial Sequence: Synthetic coding sequence
atggccactgagggcgcggctcagctgggcaatagagtggcagggatggtttgctccctgtgggttctcctgcttgtgagtagtgtcttagctctggaagaagtactcctggacacaacgggggagacgtccgagattgggtggctgacttacccgccaggggggtgggatgaagtgagcgtcctggacgatcagaggcgactgacacgcacatttgaggcttgtcacgtcgccggtgcgccacccggcacaggccaggataattggctgcagactcacttcgtggaaaggaggggtgcccagcgagcccacatccgtctgcacttcagtgtccgtgcctgttcaagcctcggcgtcagcgggggtacctgtcgggagacatttacgttgtattaccgccaagctgaggaacctgactctcccgattccgttagttcctggcacctcaaacgttggacaaaagttgatacaattgctgctgatgaaagcttcccctcctcgtcatcttcctcctctagttcgagctctgcagcgtgggctgtgggaccccacggagctggacagcgagccggcttgcagctcaacgtgaaggaacggagtttcggcccgttgacccagcggggtttttacgttgctttccaggacaccggggcatgcctggccctagttgccgtgaggcttttttcctatacctgtcccgctgtgctgcggagcttcgcgtcatttccggaaacacaggcctccggggctggtggggctagtctggtggctgccgtagggacttgtgttgctcacgcagaacccgaggaagatggagtaggagggcaggcaggcggctcccctcctcgccttcattgtaacggggagggtaaatggatggttgcggtggggggatgtagatgtcagcctggttaccagcctgcaagaggagacaaggcttgtcaggcttgtccacgcggactttataagagcagcgcgggaaatgccccatgttctccgtgcccagcaagatctcacgcccccaatcctgctgcaccagtgtgtccatgtttagaggggttctacagggccagcagtgaccccccagaagctccatgtacgggtcccccatctgccccccaggagctttggtttgaggtccaagggtcagccctgatgctgcactggcgcctacctcgtgaacttggaggtcgcggcgatttgctgttcaacgtcgtgtgcaaagaatgcgaaggacgacaggagcctgcgagcggtggaggtgggacatgtcataggtgtagagacgaggtgcatttcgatcccagacagcgggggctcactgaaagccgagtgctggtcgggggcttgcgcgctcacgtcccatacatattggaggttcaggcagtgaatggcgtgtccgagctttcaccagatccaccacaggccgcagccataaatgtctccacaagtcacgaagtgccaagtgcggttccggtggtacaccaggtgtccagagcgtccaatagcatcaccgtctcctggccacaacccgatcagaccaacgggaatatcctggattatcagctgaggtattacgaccaagccgaagatgagagccactcttttacacttacaagcgagacaaatacagcaactgtcacccagttgagtccagggcacatatatggcttccaagtgagagcccggacagccgccgggcacgggccttatggcgggaaggtatactttcagacgttaccccaaggagaactgagctcgcagttaccggaaaggttgtccctcgtgattggaagcattctcggagcacttgcctttctccttcttgcagccattaccgttctcgcagtcgtctttcagcgcaagaggcgcggtaccggctacacagaacagcttcagcagtactcttctccaggactgggcgtgaaatattatatcgacccctcgacatatgaagacccgtgtcaggcaattcgcgagctcgccagggaggtcgatcccgcgtacattaaaatcgaagaagtcattggtaccggcagctttggtgaagtacggcagggtcggttgcaaccaagaggaagaagagagcagaccgtcgcaattcaggccctttgggccggaggcgccgagtcattacagatgaccttcctgggacgggctgcggtccttggccagttccagcacccaaacattctacggctggaaggagtcgttacaaagagcagaccactaatggtcctgactgaattcatggaattaggccccctcgattcatttctcaggcagcgggagggccaatttagttcattgcagcttgttgcgatgcagcgcggtgtggccgctgccatgcagtacctctctagtttcgcatttgtccacaggtccctcagcgcacattccgtgctggtgaacagtcatctagtgtgtaaggttgcccgactgggacattcccctcagggtccaagttgtctactgcgctgggcggctccagaggtcatcgcccatggcaagcacactacttcttctgatgtttggagcttcggcattcttatgtgggaggtgatgagctacggggagcgcccctactgggacatgtcagagcaagaggtgcttaacgccatagagcaggagtttcgcctgccaccgcctccagggtgccctcctggcctgcatcttcttatgttagatacgtggcagaaggaccgagctcgtcgaccacactttgaccagttggtggccgcgttcgataagatgatcaggaagcctgacaccctgcaggcagggggcgatccaggcgaaaggccgtctcaagctcttctgacccccgttgccctggatttcccatgtctggatagccctcaggcctggctctccgcaattggcctggaatgctatcaagataacttttctaaattcggtctctgtacattttccgacgtcgcacagctgtctctggaagatcttccagcactgggtataactctggcaggtcaccagaagaaattactccaccatattcagctactacagcagcacctccggcagcagggctcagtggaggtatag

SEQ ID NO: 115887 - DNA, 2235 bp, Artificial Sequence
  Description of Artificial Sequence: Synthetic coding sequence
atggcgacagagggagcggcgcagctcgggaatagggtggccggtatggtttcagtcgggggttgtcgatgtcagcctggctaccagccagcaagaggggacaaagcgtgccaggcctgtccccgcggcttgtacaaatccagtgctggtaacgcaccctgcagcccttgcccggctcggtcgcacgctccgaacccggctgctccagtctgcccctgtctggagggattttatagagcttcttccgaccccccagaggccccctgcaccggtccaccttctgccccccaggagttgtggttcgaggtacaaggtagtgcattgatgttgcactggcggctcccacgagagttaggcgggaggggtgatctgttattcaacgtggtgtgtaaagagtgtgagggacgccaggagcccgctagtggcggcgggggcacatgccaccggtgccgcgacgaagttcacttcgacccccgtcaaaggggtctgacagagtcccgagttctcgtcggcggcctccgcgcgcacgtgccctacatcctggaggtacaagctgttaatggagtctcggaactgtcgccagatcccccccaagctgccgctataaacgtatcaacttcacatgaggtgccaagtgccgtgccagtcgtccatcaggtctccagggcttctaattcaattaccgtgtcgtggccccagcctgaccagaccaacgggaatattctggactaccagttgcggtactacgaccaagctgaggacgaaagtcactccttcacactgactagtgaaactaatacagccaccgtgacacagcttagccccggtcacatctacggctttcaggtcagggcgagaaccgccgccggccatggaccatacggagggaaggtgtactttcagacattgccacagggggaattgagtagccagttgccagagaggttgagccttgttatcggatcaatcttaggggctctggcttttctcctgctggctgctatcacagtgctcgcagtggtgttccaaagaaagcggcggggtaccggctacacagaacagctccaacagtactcatctccaggtctgggagtcaagtattacattgatccgtctacgtacgaggacccatgtcaggccatacgcgagctcgcaagagaagtcgatcccgcctacattaaaattgaggaggttatcggtaccggatccttcggggaagtgagacagggccggctgcagccccggggccgacgcgagcagacagttgccattcaggccctttgggcggggggcgccgaatcacttcagatgacctttcttggtcgcgccgccgtgctaggccagtttcagcatccaaatatcctacgcctcgaaggcgtggtcactaagtctagaccgctgatggttttgaccgaattcatggaattagggcctttagacagcttcctccgacagcgcgagggccaattttctagtctgcagcttgtcgccatgcaaaggggggtcgcagccgccatgcagtatctgagctctttcgcctttgtgcatagatctctcagtgcccatagtgtgctggtcaactcccacttagtgtgtaaagtggctaggctgggtcacagtcctcagggcccaagctgtttgctacggtgggccgcccctgaagtaatagcacacggcaagcacaccacgagcagcgatgtctggtccttcggcatcctgatgtgggaggtaatgagctacggagagaggccatactgggacatgagcgagcaggaggttttgaatgcaattgagcaggagtttagactgccacctcctccggggtgtccccccggtctacatttactcatgctggacacatggcaaaaagaccgagcacgccgcccccacttcgatcaactggtggccgcgtttgacaagatgatccgcaaacccgacaccctgcaagctggtggggatccgggtgagaggccctcccaggcactgttgactcctgtcgctctggactttccctgtctggacagcccccaggcatggttatctgcaatcgggctggaatgttaccaagataacttcagcaagttcggcctctgtactttttcggatgtagctcaactctctctggaggatctgccagcactaggtattaccttagccggccatcaaaagaagctcttgcatcatatacaactgctgcaacagcacctacgacaacaaggtagtgtcgaagtttag

SEQ ID NO: 115888 - DNA, 3066 bp, Artificial Sequence
  Description of Artificial Sequence: Synthetic coding sequence
atggcaactgagggtgcagctcagttggggaaccgtgtggcaggtatggtctgtagcctgtgggtcctgctcctagtgtcctcagttctggctctagaagaggtcctgctcgacactactggggagacctccgagatcggctggctcacatatccccccggaggctgggacgaagttagcgtcctggatgatcagcggcgcttaactaggacgtttgaggcctgccacgtagcgggcgcacccccaggaaccgggcaagataactggttacagacccacttcgtcgaacggaggggcgctcagagagcgcacatacgtctgcacttttcagttcgagcatgcagcagcttaggggtaagtggagggacgtgtcgcgagacatttacactttactatagacaggccgaagagcccgatagccctgatagtgtttccagctggcaccttaagaggtggactaaggtggacactatcgccgcagatgaatcttttccttcgtcaagctccagttccagctcatcatcttcagccgcgtgggccgtgggaccccacggcgccggacaaagggcaggcctacagctgaacgtcaaggaacggtcgttcgggcctttgacccagcgcgggttttacgtagcgttccaggacacaggggcctgcctggcactggtagccgttaggctgttctcttacacatgccccgcggttctgcggagctttgcttcgttcccagagacacaggcttccggcgcagggggggctagtctggtggccgccgtcggcacatgtgtcgctcacgcagaaccggaggaagatggggtcggcgggcaagccggcggctctccacccaggcttcactgtaatggagagggcaagtggatggttgccgtgggcgggtgccgatgccagcccggatatcagccggcacggggcgacaaggcttgccaggcttgtccacgtggcctgtacaaaagcagcgcaggcaacgccccgtgctcgccatgtcccgcacggtcccacgccccaaaccccgccgcaccagtgtgtccctgcctcgagggtttttaccgcgcctcctcggaccctcctgaggcaccctgtactggacctccctcagccccgcaagaactatggtttgaggtccagggttctgcattgatgctgcactggagacttccccgagagcttggcgggcgaggagatctcctgtttaatgttgtttgtaaggaatgcgagggaagacaagagcccgcatcaggcggaggcggtacttgccacaggtgccgcgacgaggtccattttgaccctagacaacgtggcctgactgagtcgcgagtgctcgtgggcggcctcagagcgcatgtgccatacattctggaggtgcaggccgtgaatggagtctccgaactctcccctgacccgccacaggctgccgcgatcaacgtctcaaccagtcacgaggtgccttctgcggttccggttgtccaccaggtgtcacgggcatctaacagcatcaccgttagctggccgcagcccgaccagaccaatgggaatattctggattatcagcttcgctactacgaccaggctgaagacgagtcccattcattcacgctcacctccgagaccaacaccgccaccgtgactcagctctcacctgggcatatctacggatttcaggtgagggctcgaaccgctgcggggcacggcccctatggaggtaaggtgtactttcagaccctccctcagggcgagctgtccagccaactgcctgagaggctgagtctcgtgattggctccatcctcggagcccttgctttccttcttttggcagcgatcactgtcttggccgtcgtgttccagagaaaaaggagggggacggggtacacagaacagctccagcagtactcttctccagggctcggcgtaaagtactacatcgacccctccacttacgaagatccatgccaggcaatccgagagctcgctagagaggttgaccccgcctatatcaagatcgaggaagtgattgggaccgggagctttggcgaggtaaggcagggaaggctacaacccagaggacggagagaacagacggtggctatacaggccctgtgggctggaggcgccgaatcactccagatgacctttttaggtcgtgccgcggtcctcggtcagttccaacaccccaatatattgaggttggagggggtggtgaccaaatcacggccgttgatggtactgactgaattcatggagctgggtccacttgacagctttttgcggcaacgcgagggtcagttcagcagtctgcagctcgtggcaatgcagcgcggcgtcgccgccgctatgcagtatctgagctctttcgcatttgttcatcgatcgctgtcggcccactccgttcttgtgaactcccacctcgtctgcaaggtagcgcgcttaggtcattccccacagggaccgtcttgcttgctcaggtgggctgcacctgaggtcatcgcacatggcaagcataccacctcctctgatgtctggtccttcggcatcctgatgtgggaggtaatgagctatggggagaggccgtactgggatatgtccgaacaggaagttttaaatgctattgagcaagaatttcgactcccacccccaccagggtgtcctccaggcctgcatctcctcatgctggacacatggcaaaaggatcgcgcccggagaccgcactttgatcaactggtcgccgcttttgataaaatgatcagaaagcccgatacactgcaggcggggggagaccctggagagaggccatcacaggccttgttgacccccgtagccctcgactttccatgtctcgactctccccaggcctggctctctgcgatcggcctggagtgctaccaggacaacttcagcaaatttgggctgtgcacattcagcgatgtggctcagctgtctcttgaggacctgccagctctgggcataaccctggctggtcatcagaagaagttattgcaccacatccagctcctgcaacagcatcttagacagcagggatcggtggaggtttag

SEQ ID NO: 115889 - DNA, 654 bp, Artificial Sequence
  Description of Artificial Sequence: Synthetic coding sequence
atggccggcaggacggtccgggctgagactagaagtcgggccaaagatgacattaagaaggttatggctactatcgagaaggtgagaagatgggaaaaaaggtgggtcacggtgggggacacttcccttagaatattcaagtgggtgcccgtggtcgatccacaagaggaggaacgccggcgggccggggggggcgctgaacgctctcgaggtcgggagcgcagaggccgtggggctagcccgaggggggggggtccattgatcctcctcgaccttaatgacgagaatagtaatcaatcctttcacagtgaaggctccctgcagaaagggaccgagccatctcccggggggacaccacagccttctagaccagtgtcccctgcaggccctccagagggcgtccctgaggaggctcagccccccagactggggcaggagcgcgaccctggaggcatcactgctggaagcactgatgagccacccatgctgaccaaagaagaacccgttcccgaactgctggaggcggaagctcccgaagcgtacccggtgttcgaaccagtgccccccgtacccgaggctgctcagggcgacacagaggacagtgagggggcccctcctttgaagcgcatctgccccaatgcccccgacccatag

SEQ ID NO: 115890 - DNA, 717 bp, Artificial Sequence
  Description of Artificial Sequence: Synthetic coding sequence
atggctgcggcaccattgctcctcctgctcctgctcgttccagtacctctgctacctctgctggcacagggtccaggcggagcattgggaaaccggcacgccgtctactggaattcatccaatcagcacctgcgaagagagggttacaccgtgcaggtgaacgtgaacgattacctggacatttattgtccgcactacaattcttcaggcgtggggcctggggcaggtccaggccccggcgggggcgccgaacagtacgtgttatatatggtatcccgcaacggttatcggacttgcaacgctagtcagggattcaagcggtgggagtgtaataggccccatgcgcctcactccccaatcaagttctcggaaaagttccagagatactctgctttctccctcgggtacgagtttcatgcaggccacgaatattattacatcagtacacctacccacaatcttcattggaagtgcctgcgaatgaaggtgtttgtctgctgcgcgagcacaagtcattcaggtgagaagcccgtgccaactttaccccagttcaccatgggtccgaacgtaaaaatcaatgtgcttgaggattttgagggcgaaaatccacaggtgccgaaactcgaaaaatcgatatccggaacttctcccaagagggaacacctgcccctggcggttggcatagctttcttcttaatgacgttcctggctagttag

SEQ ID NO: 115891 - DNA, 639 bp, Artificial Sequence
  Description of Artificial Sequence: Synthetic coding sequence
atggccgctgctcctctgctgctcctgcttttactagtgcccgtgcccctccttccgcttctcgcacaggggcctggcggggctctcgggaacagacacgccgtgtactggaactcctccaatcagcatctcaggcgggagggttatactgtgcaggtgaacgtgaatgattatttggacatctattgccctcattacaatagctcaggcgttggcccaggggcagggcctggccccggcggaggcgctgagcaatacgtcctctatatggtgtctcggaacggatacagaacatgcaacgccagtcagggctttaagcgttgggaatgtaacaggcctcacgccccccactcccctatcaaattttctgagaaattccagagatattcagcatttagtttgggatatgaatttcacgccggccacgagtactattacatttcaacaccaacacacaacctgcattggaaatgcttacgaatgaaagttttcgtgtgttgtgcttccaaagattttgagggagagaatcctcaggttccaaaactggagaagtcgataagtgggacgagccccaagagagagcatctcccactagcagtgggcattgcattcttcctgatgacatttctggcatcttag

SEQ ID NO: 115892 - DNA, 702 bp, Artificial Sequence
  Description of Artificial Sequence: Synthetic coding sequence
atgaggttgctgcccctcctgcgtacggtgctgtgggctgcctttctgggatcgccactgcgtggcgggagcagccttaggcatgtggtctattggaattccagcaacccgtccctgcgcagggagggatacaccgtgcaggttaacgtcaacgactaccttgatatttactgcccgcactataattcaagcggcgttggccccggagccgggcctgggcctggcgggggcgccgagcaatatgtcctgtatatggtctcacgaaacggctatcgaacgtgcaatgcaagtcaaggcttcaagaggtgggagtgtaatcggcctcacgctccccactctcccatcaaattttctgagaaattccaaagatattctgcatttagcctaggttatgagttccacgctggacacgagtattattacatatccactccaactcataacttgcactggaagtgcttgcgcatgaaggtcttcgtttgttgtgcctcaacaagccatagcggggagaagcccgttcctacccttccgcagtttactatgggccctaatgtgaaaatcaacgtactggaggatttcgaaggagagaacccccaggtaccaaaactggagaaatctatctcaggcactagccctaaacgagagcatttacccctggccgtcggaattgccttcttcttaatgactttccttgctagttag

SEQ ID NO: 115893 - DNA, 582 bp, Artificial Sequence
  Description of Artificial Sequence: Synthetic coding sequence
atgcgattgctgcctctccttaggaccgtgctatgggcagccttcttgggctcacctctgaggggagggtcttcattaagacatgtagtgtattggaattcatcaaatcccaggcttctgagaggagacgccgtagtggagcttggtctgaatgattatttagacatagtctgccctcattacgagggtcctggtccaccagagggtcccgaaactttcgcgctgtacatggtcgactggccaggttacgaaagctgtcaggccgagggcccccgagcctacaagcgctgggtgtgcagtctccctttcggccacgtgcagttctccgagaagatccagcggttcacccctttttctctagggtttgaattcttgcctggagagacctactattatatatctgttcccacaccagagagctccggacagtgtttacgcttgcaggtgtccgtgtgctgcaaggaaagaaacctgccgtctcaccccaaagagcctgagagctctcaagatccccttgaagaggaggggagcctcctgcctgcattaggcgtgccaatacagaccgacaagatggagcactag

SEQ ID NO: 115894 - DNA, 606 bp, Artificial Sequence
  Description of Artificial Sequence: Synthetic coding sequence
atgaggctcctacccttacttcgcacggtcctatgggctgcattcctagggtcgccgttgagagggggcagtagcctccggcacgtagtgtactggaactcttccaacccccggctgttaagaggggatgccgtcgtcgagctcgggttgaatgactacttggacatagtttgcccccattacgagggaccagggccgccggaggggccagaaaccttcgccctttacatggttgattggcccggctatgagtcctgccaagccgaggggccccgcgcctataagcgatgggtgtgctctctcccttttggacatgtgcagttttcagagaaaattcagcggttcacgcccttttcgctgggtttcgagttcctgcctggcgaaacatactactatattagcgtcccaacaccggaaagctctgggcagtgcctaagactgcaggtgagcgtgtgttgtaaagagcggaaatcagagagcgcacaccctgtggggagtccaggggagtctggaacaagcgggtggcgggggggggatacgcccagccccctgtgcctgctcctgctactgttgttactgatcctgcgcctgctaaggatcctctag

SEQ ID NO: 115895 - DNA, 624 bp, Artificial Sequence
  Description of Artificial Sequence: Synthetic coding sequence
atgagactgcttcctcttctgaggaccgtgttatgggctgcatttctggggagccctctccgggggggatcttcactcaggcatgttgtttactggaacagtagtaacccgaggctgttaagaggcgatgccgtggtcgagctgggacttaacgattatcttgacatcgtttgcccccattacgagggtccagggcccccagaaggtccagagacttttgcactgtacatggtggactggcctggatatgaaagctgccaggctgagggccctcgcgcctataaaagatgggtttgtagtctccccttcggccacgtacagttctccgagaagatccaaagattcactccattttctctagggtttgagttccttccgggcgaaacttattactatatttcagttcctacacccgagtcttccggccagtgtcttcgactgcaggttagtgtttgttgcaaggaaaggcgggctcgcgtactgcctcgcagtcctggaggggggggtatccccgccgcctgcactggtggtgcgaacagtgatcgtcaggacggcgccctcatgggtgaaattagaggatccgaagtcaccttggcaggagcctgtcctctgattacaggctag

SEQ ID NO: 115896 - DNA, 1083 bp, Artificial Sequence
  Description of Artificial Sequence: Synthetic coding sequence
atgagtgactccaaggagcctaggctacaacagttaggactgctggtctccaaagttccaagttctatctcccaggagcagagcagacaggatgcaatctaccagaacctgactcaacttaaggccgccgttggcgaactctcagaaaagtctaagctacaggaaatttatcaggagttgactcagcttaaagctgccgtaggagaactaccagaaaaaagcaagctgcaggaaatttaccaggaacttactcggctgaaagccgctgtgggagaattgcccgagaagagtaagctccaggaaatctatcaggagctgacgtggctgaaggcggccgtgggagagttaccggaaaagtcaaaaatgcaggagatataccaggaactaaccaggctgaaagcagctgtcggagaattgcccgagaagagcaaacaacaagaaatctaccaagaattgaccagactaaaggccgctgtcggcgagttacccgagaaatccaaacagcaagaaatctatcaagaattaacccgactgaaagccgcggtgggtgaacttccagaaaaaagtaaacagcaagaaatttatcaggagctgacccagttgaaagccgccgtagagagactctgccatccatgtccgtgggagtggacctttttccaggggaactgttacttcatgtcgaacagtcagcgaaattggcatgactcaatcacagcttgcaaagaggtaggcgcccagctagttgttatcaagtccgctgaagagcagaatttcctgcaactgcagtcgagtaggtccaacagatttacatggatgggactttccgatttgaatcaggagggaacctggcaatgggtggacggcagccctctactacccagctttaaacagtattggaacagaggggagcccaataacgttggggaggaagattgtgccgaatttagcggcaacggatggaatgacgataagtgtaacctagccaagttctggatctgcaaaaaaagtgcagccagctgttctagggatgaggagcaatttctgagtcccgcccctgcaaccccaaacccaccgccagcatag

SEQ ID NO: 115897 - DNA, 888 bp, Artificial Sequence
  Description of Artificial Sequence: Synthetic coding sequence
atggagaagatgtctcgcccactccccctcaatcccacttttataccccccccatacggcgtgctgcgctccttgctggagaaccctcttaaattgccattgcaccacgaagatgctttctccaaggataaggataaggaaaagaagctggatgacgaatccaatagtcccacagtgccccagagcgctttcctcggtccaactctgtgggacaagacacttccttacgatggagatacattccagcttgaatacatggacctggaagaatttctcagtgagaatggcatcccacccagtccttcacagcacgaccacagcccccaccctcccggcctccagcccgccagctccgcggccccctctgtgatggacctctcctcacgcgcgagcgctcctttgcatcctggaattccgagcccaaactgcatgcaatcgccaatcaggccagggcaacttctgccagccaacaggaacacccctagtcctatcgatcctgatacgatccaggtgccagtgggttacgagccagaccccgcggatttggctctttcttcgatccccggacaggagatgtttgatccccgcaagagaaaattctcagaagaggaattaaagccacagccaatgatcaaaaaggcccgtaaggtgtttattccagacgacctgaaggatgacaaatactgggcccgaaggcggaaaaacaatatggccgcgaagcgatcccgggacgcccggagactgaaagaaaatcagatagcgattcgtgcatctttcctggagaaggaaaacagtgccctgagacaggaagttgcggacttacgcaaggaactcggaaaatgcaaaaatattttggcaaagtacgaagcaagacacgggccactctag

SEQ ID NO: 115898 - DNA, 780 bp, Artificial Sequence
  Description of Artificial Sequence: Synthetic coding sequence
atggccgcagctgcacagttgagcctcacgcagctgtcttccggtaaccccgtctatgagaagtattacagacaggtcgatactgggaacaccggtagagtacttgcaagcgacgctgcggcatttctcaagaaatcaggtctgcccgacctcattctcgggaaaatttgggacctggcggacacggatgggaagggtatcttaaacaagcaagagttcttcgtagcactgagactggtggcgtgcgcacagaacggcctggaggtgtccctcagctccttgaatcttgcagttcctccaccacgattccacgatactagcagccccctgctgatctctggtacatccgccgctgagttgccgtgggctgtgaagcctgaggataaggcaaagtacgacgcgatcttcgatagcttaagccctgtgaatggcttcctgagtggcgataaagtgaagccggtactcctgaattcgaaactgccggtggatatattaggccgtgtctgggaactgtcagacatagatcatgacggaatgctggaccgggatgagttcgctgtcacggagtctcacagcgtcactcaggccggggtgcagtggcgcgatctgtcatccttgcagccccggcccccagggttcaaactgtttttccacttgtcacttctaaggtcttgggactatcggcacgccccaccacccccggccaacttctacattttctcccgagattctgtcagtccctgcctgccggactggtccagggcccctgacaatcgctag

SEQ ID NO: 115899 - DNA, 2289 bp, Artificial Sequence
  Description of Artificial Sequence: Synthetic coding sequence
atggctgccgccgctcagctgtccctcactcagctgagctccgggaatcctgtctacgagaagtactatagacaggtcgacacgggaaacaccggcagggtcttggcttcagacgcagccgcctttctaaaaaagtctggcctgcctgaccttatcctgggcaagatttgggatctcgccgacacagacggtaaagggattttaaacaaacaggagtttttcgtcgccctacggttggttgcgtgtgcccagaatggactcgaggtgagcctcagctccttaaaccttgcagtacctccacctaggtttcatgataccagcagccctttattgatttcagggacatctgccgctgaactgccttgggccgtgaaacccgaagacaaagccaagtatgatgccattttcgactcactgtcaccggtgaatggatttctgtccggcgataaagtaaagccagttctgctgaatagcaagctgcctgttgatattctgggaagggtgtgggaactcagcgacatagatcatgacggaatgctagacagagatgaatttgcagtggctatgttcctggtctattgtgccctggaaaaggagcctgtgcccatgtctttaccccccgccctggtgccccccagtaagcgaaagacatgggtggtaagccctgccgaaaaggccaagtacgatgagatcttcctgaaaacagataaggatatggatggattcgtttccggcctggaagtcagggaaatattccttaagacggggctgccttcaacattgctagctcacatatggtctctgtgcgatactaaggactgcggcaagctgtcaaaggatcagttcgccttagccttccacttgatctcacagaagttgattaaaggcattgacccaccccacgtgcttacacctgagatgatacctccgagtgacagagcctctctgcagaagaacataattggaagttcccctgtggctgatttttcagccatcaaagagctggataccttaaataatgaaatcgtcgacctccagagagaaaagaacaacgttgaacaggacttaaaagagaaggaggataccatcaagcaaagaacttccgaagtgcaagatctgcaggacgaggtgcagcgcgaaaatacaaatcttcaaaaattacaggcccaaaagcagcaagtacaggagctgttggacgagctggatgagcagaaggcacagcttgaggagcagctgaaggaagtccgaaaaaaatgtgctgaggaggcccaactcgctaggagctctcctgagctgctgccttcgggcgtgacggacgagaacgaagtgacaaccgctgttactgagaaggtctgttccgagttggataataacagacacagtaaagaggaggacccgtttaatgtggacagctcatctctgacagggccagtggccgacaccaacttggacttctttcagagtgacccctttgtggggagcgatcctttcaaggacgacccattcggcaagatcgatccctttgggggagacccctttaagggttctgaccccttcgcctcagattgtttcttccggcaatccacagaccctttcgcaacctcaagcaccgatccgttctcagctgctaacaattcatctattacaagcgtggagactttgaagcacaacgaccctttcgcacctggtggcaccgtggtagcagcctctgacagtgcgacagaccccttcgcctcagtgttcggcaatgagagcttcggaggcgggtttgccgacttcagcacactaagcaaggtgaataatgaggaccccttccgtagtgccacctcttcatctgtgtctaacgtggttattacgaaaaacgttttcgaagagacttcagttaaatccgaagatgagcccccagcattaccccccaaaatcggtactcccactaggccttgtcccctgcctccagggaaacgctccattaacaagcttgacagccctgatcccttcaagctcaatgatccctttcaaccattcccaggcaatgactctcctaaggaaaaagatcccgagattttttgcgacccctttacgagcgccaccaccaccaccaacaaagaggcggatccatctaatttcgccaactttagcgcataccctagcgaggaggatatgattgagtgggcaaagcgggaatcggaacgcgaggaggagcagcgacttgcccgcctgaatcagcaggaacaggaagacttagaactggcaatcgcgttgagcaagagcgaaatttcagaggcttag

SEQ ID NO: 115900 - DNA, 2691 bp, Artificial Sequence
  Description of Artificial Sequence: Synthetic coding sequence
atggcggcggccgctcagctgtccctgacccagctgagctcgggtaatccggtctacgagaaatattataggcaggtggacactggtaacaccggacgggttttagctagcgacgctgcggcatttctgaagaaatccggactgcctgatctgattttagggaaaatctgggatcttgcggataccgacggaaaaggtatactgaataagcaggagttttttgtggcactgcgcttggtggcctgtgcccagaacggcttagaggtgagcctgtcctcactgaatctggccgttccgcctcctagattccatgacacatccagccctcttcttatctcaggcacctcagccgccgaactgccgtgggctgtcaaacctgaggataaagcgaaatacgatgcgattttcgattccctctcccccgttaatggtttcttaagcggagataaagtgaaacctgtgctgttgaactccaaattgcccgtggacatactcggtcgggtgtgggagctgtcagatatcgatcacgatggaatgctcgacagggacgagtttgctgtggcaatgtttctcgtatattgcgctctcgagaaagagcccgttccgatgtcactgcctcctgctttagtccctccctctaagcgcaaaacatgggtcgtgtctcccgctgagaaggcaaaatatgacgagatctttctgaaaactgacaaggacatggatgggttcgtgtcagggctggaggtgcgagaaatctttctgaagaccggtcttcccagtaccctgcttgcacacatttggagcctgtgtgacacaaaagattgcggcaaactatcgaaggaccagttcgccttggcatttcacctgatctcccagaaattaattaagggaattgatccacctcacgttttgacccctgaaatgatccctcctagtgatagggcttcactccagaagaacattattggctcctcccccgtggccgattttagcgccatcaaagagctggataccttaaacaatgagattgtggatctgcaacgggaaaagaacaacgttgagcaggacctgaaggagaaagaggatacaatcaagcagaggactagtgaagtgcaggacctgcaggatgaagtacagcgcgaaaacaccaacttgcaaaagctgcaggcccagaagcagcaggtccaggagctgttggatgaactcgatgaacagaaagcacagctagaggagcagttgaaggaggtgcggaaaaagtgtgcagaagaagcacagcttatctcgtccctaaaggcggaactaacctcgcaggaatctcagatctccacctatgaggaagagctcgcaaaagctagggaagagctgtcccgcctgcagcaggagaccgctgagttagaggagtctgtagaatctggaaaagcccaactggaaccattgcagcagcatctccaggatagtcaacaggagatctcctcgatgcagatgaagctcatggagatgaaagatctggagaaccataacagtcaactgaattggtgctcctccccgcatagtatcctggttaacggggccaccgattattgctcgctctctacatctagcagtgagactgccaacctgaatgagcatgtggaaggacagtccaatctggaatctgaaccaattcatcaagaatcccccgcccggtcgtcacctgagctcctcccttctggagtgacagatgagaacgaagttactaccgcagtgaccgagaaagtctgttctgagctggacaacaacaggcactctaaagaggaagatccttttaatgtggattcctcctctcttacgggtcccgtcgcggatacaaacctggactttttccagtccgacccattcgtggggagcgacccgtttaaggacgaccccttcggtaaaattgatcccttcgggggagatccatttaagggctctgacccatttgcctcagattgtttctttcgccagagcaccgacccatttgctacatctagcaccgacccctttagtgctgctaataatagctcgatcacctccgtcgagaccctgaagcataacgatcctttcgcccctggaggtacggtcgtggcagcctctgatagcgcaactgacccctttgcatcagttttcggaaatgaaagcttcgggggaggattcgcagatttctccaccctgtctaaggtcaacaatgaagatcccttcaggtctgctacgagctcgagcgttagtaatgttgtgattacaaagaatgtgtttgaagaaacctccgtcaaaagcgaagatgagcctccagccttgccaccaaaaatcggaacacccaccaggccttgtccactgccacctggcaagcggtccattaacaagctggactctcctgaccccttcaagctgaacgatccatttcagccctttcctggtaatgattctcctaaggagaaggaccctgaaatcttttgcgatcctttcacttcggcaacgacgaccacgaataaggaggctgatccatccaacttcgccaactttagcgcctacccttccgaggaggacatgatcgaatgggccaagcgcgagagtgaaagagaagaagaacagagactggcaaggctcaatcagcaggaacaggaggacctagagctggcaatcgctctctccaagagtgaaatcagtgaagcctag

SEQ ID NO: 115901 - DNA, 1722 bp, Artificial Sequence
  Description of Artificial Sequence: Synthetic coding sequence
atgatcctgatggtccgcgactgcctgaaaagtcagcacagggatccacactgcgaccctagcgacaagcgtgagaagaataatgtggagcaagacttgaaggaaaaagaggacaccatcaaacagagaacgagtgaggtgcaagacctccaggacgaagtccagcgtgagaataccaatttacagaagctccaagctcagaaacagcaggtgcaggagctgcttgacgaactggacgaacagaaagcccagctcgaggaacagctgaaggaggtgcggaagaaatgtgctgaggaagcacaactgatctcgagcctcaaagccgagctcaccagtcaggagagccagatttcgacctatgaggaagaattggcaaaagcccgtgaggagcttagcaggctgcagcaggaaactgcagaactggaagagagtgtggaaagtggaaaggctcagctggagccccttcagcaacacctccaggactcgcagcaggagatttcttccatgcagatgaagcttatggaaatgaaggatctggagaaccacaacagtcagcttaactggtgctcaagcccacattctatattagtgaatggcgcgacagactattgctcgttgagcacttcctcctcagagaccgccaatttgaatgaacacgtggagggtcagtcaaaccttgagtccgagccgattcaccaggagagcccagcccgaagtagtcccgaactgctaccatcaggagtcacagatgagaacgaggtcacgacagccgtgactgagaaagtctgttccgagctggacaacaataggcattccaaggaagaggacccgttcaatgtggacagcagttctctcacaggcccagttgctgataccaacctcgatttctttcagtctgacccgtttgtcggctctgatccttttaaagacgatccttttggcaagatcgacccgtttggtggcgatcccttcaagggcagcgatccttttgcctccgactgtttcttccggcagtcaaccgacccattcgcaacctcttcgaccgaccccttctccgccgctaataactctagtataacctcagtggagacgttgaagcacaacgatccatttgcgcccggaggtaccgtggtggctgcatccgattccgccactgaccccttcgcaagcgtgtttggtaacgagagttttggcggtggatttgccgacttttcaacgctgagcaaggttaataatgaggacccgttcaggtccgccacgagctcatctgtttcaaatgttgtgatcacgaaaaatgtgttcgaagagacatcggtcaaatccgaggatgagccaccggcccttccacccaagattggcacccctacccgcccttgtcccctgcctcctgggaagcgatctattaacaagctggattcaccggatccattcaaactaaacgatccatttcagccttttccgggcaatgattctcccaaagagaaagatccagaaatcttttgcgatccttttacgagtgcgaccaccaccacaaacaaggaggccgacccttctaacttcgctaatttctctgcctacccatccgaagaagatatgatcgaatgggccaaaagggagtctgagagagaagaggagcagcgtctcgcacgcttgaatcagcaggaacaggaggatttggagttagccatcgccctatctaagtccgagatttctgaagcctag

SEQ ID NO: 115902 - DNA, 2469 bp, Artificial Sequence
  Description of Artificial Sequence: Synthetic coding sequence
atgaatggtcatatctcgaatcacccaagctcctttggcatgtaccccagtcagatgaacggctatggcagcagccccacattctcccaaacggaccgagagcatggctcaaaaacctctgccaaggccttatatgagcagaggaagaactacgcacgagacagcgtgtcctccgtgtctgacatctcacagtacagggtggagcacctcacaacgttcgttttggacagaaaggatgctatgatcacggtggacgacggaattaggaagttgaaactgttggatgccaaaggcaaggtgtggactcaagacatgatcctgcaggtggacgatcgggcagtttccctcattgacttggagtctaagaacgaactggaaaatttcccgctcaatacaattcagcactgccaggccgtgatgcacagctgctcctacgactccgtactggctttagtttgtaaagagccaacacagaacaaacccgatctgcatctgttccagtgtgacgaggtcaaggccaatctgatttcggaggatatcgagtctgccatctcggattccaagggaggcaaacagaagagacggccagacgcactgagaatgatcagtaatgcagacccttcaatcccacctccaccaagggcaccagctccagctccacccgggaccgtaacacaggtggacgtaaggtcccgagtcgccgcctggagcgcctgggccgctgatcagggcgatttcgaaaagcctcgacagtaccatgagcaggaagaaaccccagaaatgatggcggctcggatagatcgggatgtgcagatactgaatcacatcctcgatgacatcgaatttttcatcacaaaacttcaaaaggcagccgaggcattctcggaattgagcaagcgcaaaaaaaacaaaaagggaaagcgaaaggggcctggggagggggtgctgacactgcgcgccaagcctcctccccctgacgagttccttgactgtttccaaaagtttaagcacggctttaatctgctggctaagctcaaatctcatatccaaaatccctctgctgccgatctggtccactttctgttcacccccctgaacatggtcgtgcaggccactggaggaccagaactggcctcttccgtgctgtccccactgctgaataaggatactatcgactttctcaactataccgtcaacggggatgagcgccagctttggatgtctttgggaggaacctggatgaaggcacgcgcagagtggccaaaggagcagttcatcccaccttacgtgcctcggttcagaaatggatgggagcccccgatgttgaatttcatgggcgcaaccatggagcaggacctctatcagttggcagaaagtgtcgcgaatgtggccgagcaccagagaaaacaggagatcaaaaggttgtcaactgaacatagctccgtgtctgagtaccatccggccgacggctatgcctttagctccaacatctacacaagagggagccacctggaccaaggcgaggccgctgtggcattcaagcccacgtcgaataggcacatcgaccgcaactacgaaccactgaagacacagccgaaaaagtacgctaagtcaaagtacgatttcgtggctcgtaataattctgagctcagcgtgctgaaggacgacatccttgagattttggacgacagaaagcagtggtggaaagttcggaatgccagcggcgatagtggttttgtgccaaacaatatactggacatcgttcggcctccagaaagtggccttggccgggcggatcccccatacactcatacaatccaaaagcagaggatggagtacggaccacggcccgcagataccccaccggccccatccccacctcccacacctgcacccgtgccagttcccctgcccccttccacccccgcgcccgttcccgtgtcaaaagtgcccgccaatataacccgtcaaaactcatcaagttcagactctggaggtagcattgtacgagactcacagaggcacaaacaattgccagttgacaggaggaaatcccagatggaggaggtgcaggatgaattgatacaccggcttacaatcgggaggtccgcggcacagaagaaatttcacgtgcctaggcagaatgtgcccgttattaatataacatatgactcaactcctgaggacgtcaagacctggttacagtccaaagggttcaaccctgttaccgtgaacagcctgggcgtccttaacggcgctcagcttttctccctgaacaaagacgaattgcgcacggtgtgccctgagggcgcccgagtttactcacagatcacagttcagaaagctgctctggaggactctagcggttcgtccgaactgcaggagataatgcggagacgtcaagagaaaatatccgcagccgcatctgacagcggagtggagtcattcgatgagggctcatctcactag

SEQ ID NO: 115903 - DNA, 366 bp, Artificial Sequence
  Description of Artificial Sequence: Synthetic coding sequence
atgaatggccatattagcaatcacccatccagttttggcatgtatccatcccagatgaacggatacgggtcttctcctacatttagtcagactgatcgagagcatgggagtaaaacatccgccaaggccttgtacgaacagaggaagaattatgccagagatagtgttagctccgtgtcagatattagccagtatagagtcgagcacctgacgacatttgtgctggatcgtaaggacgccatgattacagtggatgacggtatacggaaactgaaactcctggatgccaagggaaaggtgtggacgcaggatatgatcctccaggtggacgatcgggcagtgagcctgatcgatcttgagagctag

SEQ ID NO: 115904 - DNA, 207 bp, Artificial Sequence
  Description of Artificial Sequence: Synthetic coding sequence
atgaacggacacatttctaaccatccctccagctttggcatgtatccatctcagatgaacggctatgggtcttcaccaactttctcccaaaccgaccgggaacacgggagcaaaaccagcgccaaggcgctttatgagcagcggaaaaattacgcacgcgactccgtgagttcggtatctgacatcagccagtacagagtggagtag

SEQ ID NO: 115905 - DNA, 1689 bp, Artificial Sequence
  Description of Artificial Sequence: Synthetic coding sequence
atgatggcagcgcgaattgaccgcgacgtgcagatcctcaatcatattctggatgacatcgaattcttcattaccaagctgcagaaggcagcagaggctttcagtgaattgtctaagcgcaagaagaacaagaaaggcaaaaggaaaggcccaggtgaaggcgttctgactctgcgggcaaagcctcctccccctgatgaatttctggactgcttccagaaattcaagcacggcttcaacctgttagccaagctgaaaagccacattcagaacccctccgccgcggatctcgtgcacttcctgttcacgccactaaatatggtggtccaggccactggaggtccagagctggcctcatctgtcttatccccactgctcaataaggacacgatagattttttaaactatactgtgaatggtgacgaaaggcagctgtggatgagcctggggggtacatggatgaaagctcgggcagagtggccgaaagagcagttcattcccccgtacgtgcccaggtttagaaacggctgggaaccaccaatgttaaattttatgggagcaaccatggaacaggatttatatcaactggctgagtcagtggccaatgtggccgaacatcagagaaaacaggagataaaacgcctgtcaaccgaacattcgtctgttagcgagtatcatccagctgatggctatgccttctcttcaaatatttacacaagggggtctcacctggatcagggggaggcagccgtcgcgttcaaacccaccagtaaccgccacattgaccgcaactacgagcctctgaagacacaacctaagaagtacgctaaatccaagtatgattttgtagctcgcaacaattccgagctctccgtcctcaaagacgacatccttgaaatactggatgatagaaaacaatggtggaaggtgcgaaacgcatcgggcgatagtggattcgtgcctaacaacattctggacatcgtcaggccccctgaatccggtttgggccgcgccgatcctccctacacccataccatccagaaacagcgaatggagtatggcccccgccccgccgacactccacccgcaccttcaccgccgccaacccctgctcccgtgcctgtcccactgcccccatctaccccagccccggttcctgtttcaaaagtgccagccaacatcacccgccaaaattcctcctcctcagacagcggaggctccatcgtccgcgattcacagaggcataaacagttgcctgtcgatcgacgaaaatctcagatggaggaagttcaggatgagcttattcataggctgacgatcggacgcagcgctgcacagaaaaagtttcacgtgcccagacagaacgtgccagtgatcaacatcacttacgattctacccctgaagacgtcaagacctggctgcagtctaaggggtttaaccctgtcacagtcaattcccttggcgtcctgaatggtgcccagctgttcagtcttaataaagatgagttaagaaccgtgtgtcctgaaggggctagggtgtacagccagatcacagttcagaaggccgcgctcgaggattcatcaggatcatcagagcttcaggagattatgcggcgtcgccaagagaaaatctctgctgctgcaagcgactccggcgtggaatcttttgatgagggcagttcccattag

SEQ ID NO: 115906 - DNA, 1689 bp, Artificial Sequence
  Description of Artificial Sequence: Synthetic coding sequence
atgatggctgcccggattgaccgtgacgtgcagattttgaatcacattttggacgacatcgagttctttattacaaagctccaaaaagcagccgaggcattttcagaattgagcaaacgcaaaaaaaataaaaaaggcaaaaggaaaggccctggggagggcgttttgactctgagggctaagcctcccccccccgatgagtttctggactgctttcaaaagtttaaacatggatttaatctgctggccaaactgaaatcacacatacagaacccctcagccgccgatctggtgcactttctatttacccctctgaatatggtcgtccaagccacgggtggaccagagcttgcttctagtgtgctatcaccactgctgaataaggataccattgatttcctgaactacaccgtcaacggcgacgagcgccaactctggatgagcctggggggtacctggatgaaggcaagggccgagtggcctaaagagcaattcataccaccatacgtgccccgcttcagaaatggctgggaaccacccatgctgaactttatgggcgcgaccatggagcaagatctgtatcagctggcagagagcgttgccaacgtagccgagcatcagcgcaagcaggagataaagcggctatcaactgagcattctagcgtatccgagtatcatcccgctgacggctacgcttttagcagcaacatctacacccgcggttcgcatttagaccaaggcgaggcggccgtggcattcaagcctaccagcaatcgacacattgacaggaattacgagccgctcaagacgcagcctaaaaaatatgcaaagagtaagtatgattttgtcgcgcgtaacaattctgaacttagcgttctgaaggacgatatactggagatcctggatgatcgaaaacagtggtggaaggtcaggaatgccagcggggattcaggattcgttccaaataacatattagatattgtaaggcctcccgagtctggactcggacgtgccgacccgccctacacacataccattcagaaacagcgaatggaatatgggcctcgcccagccgatacacccccagcacctagccctccgccaaccccagcccccgtccccgtacctctcccgccctccaccccagcacccgtacctgtgagcaaagtgcccgccaatattaccagacagaactcatcgagctcagactcaggaggctctattgttcgggatagccaaaggcacaaacaattgcctgtggaccgccgcaagtcccagatggaggaagttcaggacgaactgatccacaggttgaccattggaagatccgcagctcagaagaaattccatgtgccaaggcagaatgttcccgtcattaatataacatatgattctactcctgaagatgttaagacatggctgcagtcaaagggcttcaacccagtaacagtgaactccctgggcgtgctgaatggggcccagctcttctctttgaataaggatgagctgaggactgtttgtcctgagggagcacgggtatactctcagataactgttcagaaggcagcccttgaggactcctccggaagctctgaactccaagaaatcatgagacgccggcaggagaaaatatcagccgccgcatcagatagcggagtggaatcatttgatgaggggagtagtcattag

SEQ ID NO: 115907 - DNA, 2076 bp, Artificial Sequence
  Description of Artificial Sequence: Synthetic coding sequence
atgaatgggcacatctccaaccacccaagcagctttggcatgtatccatcacagatgaatgggtacggctccagcccaactttttcccagaccgacagagagcacggttcaaagactagcgctaaggcactgtacgagcagcgcaagaactatgcccgcgatagcgtgagctccgtttccgacatctctcagtacagagtcgagcacctaaccaccttcgtccttgacagaaaagacgccatgatcacagtagacgacggtatccggaagctgaagctgctggacgctaagggaaaggtgtggacacaggacatgatccttcaggtggatgaccgcgccgtatctcttattgacctcgaaagcaaaaatgagctggagaacttccctctcaatacaatccagcactgtcaggctgtaatgcatagctgcagttacgactccgtgctggccctggtgtgcaaagagcccacccagaacaagcccgacctccaccttttccaatgcgatgaagtcaaggcaaatctgatcagcgaagacattgagtcggcaatctccgatagtaaaggtgggaaacaaaagaggcgaccagatgcactccggatgattagcaacgctgatccctcaataccacctcccccccgcgcaccagccccggctccaccagggacggttactcaggtagacgtgagatctcgcgtcgccgcctggtcagcatgggcggcggaccagggcgatttcgaaaagccaaggcagtatcacgagcaggaggaaactccagagatgatggcggccagaattgacagggacgtgcaaattctcaatcacatcctggatgacattgaatttttcatcacaaagctgcagaaggccgcagaggcattttccgagctctcaaaaaggaaaaaaaacaagaagggcaagcgaaaagggcccggagagggtgtgttaactctgagggctaaacctccaccccccgacgaattcctggattgcttccagaaattcaaacacgggtttaacctgctagccaagcttaagtctcacatacaaaatccgtcagcagctgaccttgtacactttttgttcactcctctgaacatggtggtgcaggctaccggcgggcctgagctagcgagcagcgtactgtcaccactgctgaacaaggatacaattgacttcttgaattacactgtgaacggagacgagagacagctttggatgagccttggcggcacctggatgaaggcacgcgcagagtggcctaaggagcagttcattccaccatatgtcccccgctttcggaacggctgggagccccccatgcttaactttatgggagccacaatggagcaagacttataccagctggctgagtccgtggccaatgttgccgagcaccaaagaaagcaggagatcaagagactgtctactgaacacagctcagtgagtgaatatcaccctgcagatggttacgccttttctagtaacatttacactcgcggcagccacctcgatcaaggtgaagccgctgttgcctttaagccaacgtctaacagacacatcgatcgcaactacgagcctctgaagacccagccgaagaaatatgcaaagagcaaatatgacttcgttgcccgcaacaacagcgaactcagtgtattgaaggacgacatattggaaatcttagatgaccggaaacaatggtggaaggtccgtaatgctagcggcgactcaggtttcgttcctaataacatcttggacatagtgcgaccccccgaaagcggactgggccgcgccgatcccccatatactcacacaattcagaagcagcgtatggagtatgggccccgccccgccgacactcctccagcccctagccctcctcccacacccgcccccgtgcctgtgccgctccctcccagcacacctgccccagtcccagtctcaaaggtccctgcgaatataacccgacagaattccagcagcagtgactccggaggatctattgtacgagattcgcagcgtcataagaccagcggagggccgaaggaaatctcagacggtggttccgctagatag

SEQ ID NO: 115908 - DNA, 207 bp, Artificial Sequence
  Description of Artificial Sequence: Synthetic coding sequence
atgaacggccatatcagtaaccatccttcctcattcggcatgtacccttcccagatgaatggatacgggagcagccctaccttctcacagaccgatagagaacacggctcaaaaacttcagccaaggctctgtacgaacaacgcaaaaattatgctagagattccgtctccagcgtcagtgacattagtcaatatcgcgtggagtag

SEQ ID NO: 115909 - DNA, 2469 bp, Artificial Sequence
  Description of Artificial Sequence: Synthetic coding sequence
atgaatggccacattagtaaccatccctccagcttcgggatgtacccctctcagatgaatggatatggttcctctccaactttttcccagacagaccgcgaacacgggtccaagaccagcgccaaagcactgtacgagcagcgcaagaattacgctagagattccgtgagctctgtgtccgatatcagccaataccgcgtcgaacaccttacaaccttcgtgctagacaggaaggacgccatgatcacagtggatgacggaatcaggaagcttaagctgttagatgctaaaggcaaggtgtggacacaggacatgattttgcaggtagacgaccgagcagtgtcactgattgatctggagtcaaagaatgaactcgagaacttcccccttaacaccatacagcattgtcaggcagttatgcactcatgctcttatgatagcgtgctggccctcgtgtgtaaggagcccactcaaaacaagccagatttgcacctttttcagtgtgatgaagtgaaggcaaacttgatctcggaagatatcgagtccgccatcagcgattctaagggcgggaagcaaaaaagacgccccgatgccctcaggatgatttccaacgccgacccttccattcccccacctcctagggctccagcccccgcccctcccgggactgtgactcaagtggatgtccggtcccgtgtagcagcatggagcgcatgggctgccgaccagggagattttgagaagccccgccaatatcatgagcaagaggagactccagagatgatggccgctcggattgaccgggacgtgcagatactgaaccacatactggatgacattgagttcttcattactaaactacagaaggctgccgaggctttcagtgagctctccaagcgcaagaaaaacaaaaagggcaaacgcaaggggccgggggagggagtgctcaccttgcgggccaagcccccacctccggatgagttcctggattgcttccaaaaattcaagcatgggttcaatcttttggccaagctgaagtctcacatccagaatccctcggccgccgatttggttcattttttgtttaccccactaaacatggtcgttcaggccacagggggtcctgaactggcctcatcagttctatctcctcttcttaataaggacaccatcgattttctgaactacaccgttaacggagacgagcggcagttgtggatgtcactaggcggcacctggatgaaggcccgggctgaatggcctaaagaacaatttattcctccctacgtaccccgcttcagaaacggctgggaaccaccaatgttgaattttatgggggcaaccatggaacaggatttgtaccagctcgccgagagcgtagccaatgttgcggaacaccaacgcaaacaagaaatcaagagattaagtacagagcattcatctgtctccgaataccaccccgccgacggctatgccttctcttctaatatttatacccggggctcccacctggatcagggcgaggccgcagttgcttttaaacccacttccaacagacacatcgatagaaactacgaaccattgaagacacagccaaagaagtatgctaaatcgaaatatgacttcgtcgctaggaataactccgaactttcagttctaaaagacgacatccttgaaattctcgatgatcgcaagcaatggtggaaagtgcggaacgccagcggggactctggattcgtacccaataacattctcgacatcgtcaggccccccgagagtggcctggggcgagcagatcctccttatacccacaccatccaaaaacaaagaatggaatatggcccccggcccgccgacacaccacccgcccctagtcctccccccacacccgccccagtgccggttcccctacccccctcaaccccagccccggtacctgtgtcaaaagtcccggcgaacattactcggcagaattctagtagctccgatagcggcgggagcatagtcagagattcacagaggcacaaacaactgccggtggaccggcgcaagagccagatggaagaggttcaagatgagctcattcacaggctcactatcggacgctctgcggctcagaagaaatttcacgtcccccgacaaaatgtccccgtcatcaacatcacttatgattctacaccagaggacgtgaagacatggttgcaaagcaagggctttaatcccgtaacagtaaactccctgggagtgcttaacggcgcccaactattttcgctgaacaaggatgagctgagaaccgtctgtccagagggcgccagggtctactcccagattacagttcaaaaggccgcacttgaagattccagtggcagcagcgaattacaggaaattatgcgtaggcggcaagaaaagatctctgctgccgcaagcgatagcggagtggagtcctttgatgagggctcttcacactag

SEQ ID NO: 115910 - DNA, 2469 bp, Artificial Sequence
  Description of Artificial Sequence: Synthetic coding sequence
atgaacgggcacatcagtaaccatccctcttcattcgggatgtaccccagccagatgaacggatacggaagtagccccactttcagccaaactgaccgggaacacggatcaaagacctcagccaaggcgctgtatgagcagaggaaaaattatgcccgtgactccgtgagtagcgtcagcgacatctcccagtatagagtggagcatctgactacttttgtgctagacaggaaagacgctatgataactgtggacgatggaattagaaagctaaagctgctagacgccaaaggcaaggtgtggactcaggacatgatccttcaggtggacgaccgagcagtgagcttgattgacttagagtcgaagaacgagttggagaatttcccactgaacaccattcagcattgccaggctgttatgcattcctgtagctatgatagcgtactagctctggtgtgtaaagaacctactcaaaataaacccgatcttcacttgtttcagtgtgatgaggtgaaggccaatctgatcagtgaggatatcgaatcagctatttccgactccaagggcgggaagcagaagcgccgccctgacgctctgagaatgatttccaatgccgatccctccatccctccacctcctcgggcccctgcccccgccccacccgggaccgtgacccaggtcgatgtgcggagtagagtggctgcatggagcgcctgggcggccgatcagggcgattttgagaaaccacgtcaataccacgaacaggaggagacaccagagatgatggcggccaggattgaccgggacgtgcaaatcttaaaccacattctcgacgatatagaattcttcatcaccaaactgcagaaagctgcagaggcattttccgaactgagcaaaagaaagaaaaataaaaagggcaagcggaaggggccaggggaaggcgttctcactctccgcgccaaacctccccccccggacgaatttctggactgcttccaaaagtttaaacacggctttaacctgctggcaaagcttaaaagccacattcagaatccatctgctgcagatctggtccactttctgtttactcccctgaacatggtggtgcaagcgaccggtggtccagagctagcaagcagcgtgctgtctcccttgctgaataaggatacgattgacttcttgaattacactgtgaacggcgatgaacgtcagctgtggatgtccctgggcgggacgtggatgaaggccagggcagaatggcccaaagagcagtttattcctccttatgtacctcgcttcagaaatggttgggagccccctatgctgaattttatgggcgccacaatggaacaggatttgtaccagctcgcagagtccgtcgctaatgttgcagagcaccagaggaagcaggagataaagcgcttgagtactgagcatagctccgtgtctgaatatcacccggcggatgggtacgccttcagctcgaacatttacacccgcgggagccacttggatcagggcgaggcggccgttgcttttaagcctacaagcaatcgccacatagatcggaattatgaaccactgaagacccaacctaaaaagtacgccaagtcgaaatatgatttcgtggccaggaacaactcggaacttagcgtccttaaggacgatattcttgagattctcgatgatcgaaagcagtggtggaaagtcaggaacgcttccggagacagcgggtttgtgcccaacaatattctggatattgtgcgccccccagaatcaggactggggcgcgccgacccgccgtacacgcatactattcagaaacagagaatggaatacgggccaaggcccgccgacacccccccagccccctccccgcccccaacaccggcccctgttcccgtccctctgccacctagcaccccagcaccagtcccagtcagcaaggtcccagcgaacatcacacgccaaaattcgtccagtagcgatagcggcggatcaatcgttcgtgacagtcaacgtcataagcagctccccgtggaccgcaggaaatcgcagatggaggaagtgcaggacgaactcatacaccgtctgactattggccgcagtgcagcccagaaaaagtttcacgtgccaagacagaatgtccccgtcattaacattacttatgattctacaccggaggacgtcaagacctggctccagtccaagggattcaatccggtgaccgtgaattccctgggagtgttaaacggcgcccagctcttttccttaaacaaagacgagctgcgaactgtgtgccccgagggcgctcgggtttatagtcagatcactgtccagaaagcagcactggaagacagttctggttcaagtgagttgcaggaaattatgagacggaggcaggaaaagatcagcgccgccgcgtctgactctggggtggaaagttttgatgaaggatcctcacattag

SEQ ID NO: 115911 - DNA, 204 bp, Artificial Sequence
  Description of Artificial Sequence: Synthetic coding sequence
atgaacggtcacatcagcaatcacccctcatccttcggcatgtacccgagccagatgaacgggtatgggtcatctccaacgttctcgcagacagatagagagcatggctcaaaaactagcgctaaagctctgtatgaacagagaaaaaattatgctcgggactccgtgtccagtgtgtccgacataagccagtatcgtgtatag

SEQ ID NO: 115912 - DNA, 387 bp, Artificial Sequence
  Description of Artificial Sequence: Synthetic coding sequence
atgaacgggcatatcagcaatcacccatcaagtttcgggatgtatccgtctcaaatgaacggctatggtagctcccccacattctcacagaccgatagggagcacggttctaagaccagtgccaaagccctgtacgaacagcgaaagaactacgctcgggatagcgtgagcagcgtaagcgatatttcacaatatcgagttgagcacttgaccacttttgttctggaccgaaaagacgccatgattacagtggacgacgggattaggaaactgaagctcctagacgccaaaggcaaagtgtggacgcaagatatgatcctccaagtagacgaccgggccgtgagcttgatcgacctagagtcaaagaatgagctggagaatttctag

SEQ ID NO: 115913 - DNA, 996 bp, Artificial Sequence
  Description of Artificial Sequence: Synthetic coding sequence
atgaggttcaggtttggtgtcgtggttccaccagccgtggctggagcaagaccagaactcctggttgtgggtagcagacccgagcttggtcgatgggagcctcggggagccgtccggctgcgcccagccgggacagccgccggagatggtgcattggcgctgcaagagcccggcctttggctgggtgaggtggagctggccgccgaggaagccgctcaagacggcgctgaaattggagctaccccgaagttgccctctacaatatttccttggtttgtgctgcgacaaggcctgattctagggaacggtccacaccatgatagatgctgcacttataatgagaacaatcttgttgatggcgtgtattgcctgcctatcgggcattggatcgaggctaccggacatacaaatgagatgaaacataccactgatttctactttaacatagcagggcatcaagccatgcactactctcggatcctgccaaacatctggttggggtcctgccctaggcaggtggagcacgtgactattaagctcaagcatgagctgggtattactgcagtcatgaatttccagactgagtgggatatcgtccagaatagttccggatgcaacagataccctgagccaatgactcccgacacaatgataaagctgtatcgcgaagaaggcctggcgtacatctggatgccaactccggacatgtctacagaaggtagagttcagatgttgccccaggcggtgtgtctcttacacgctctcctagaaaaaggccatattgtctacgtccattgcaacgccggggtgggccggagcaccgccgccgtatgcggatggctccagtatgtcatggggtggaatctgaggaaagtacagtacttcctgatggccaagcgaccagccgtatacatcgatgaagaagcgctggcaagggcccaggaggatttcttccagaagttcggcaaggtcaggagctccgtgtgctcactgtag

SEQ ID NO: 115914 - DNA, 996 bp, Artificial Sequence
  Description of Artificial Sequence: Synthetic coding sequence
atgagattccggttcggcgtggttgtcccccccgctgtggccggagcacggcctgagctactcgttgtggggtcccgtccagagttggggaggtgggagccacgaggggctgtgaggctgcgccccgctgggaccgctgcaggagacggcgcactagctctacaggagcccgggctgtggctcggcgaagtcgagttagccgccgaggaggcagcccaggatggggctgagcctggcagggtagataccttttggtacaagttcctgaagcgcgaacctggtggcgaactaagctgggaggggaacggacctcatcatgacagatgttgcacctacaacgagaacaatctcgtagacggcgtctactgtctcccgatcggccactggattgaggcaaccggtcatacgaacgaaatgaagcacaccacagacttttattttaacattgccggccatcaggctatgcactattctcgcatactccccaacatttggctgggctcttgccccaggcaggtcgagcacgtgactattaagctgaagcacgagcttggcattactgccgtaatgaattttcagaccgaatgggacatcgtgcagaacagctctgggtgcaacagataccctgaaccaatgaccccagatacaatgattaagctctacagagaagagggtctggcttacatctggatgccaacccccgacatgtccactgagggacgagtgcaaatgctacctcaggccgtatgcctgcttcatgccctgctggagaaagggcatattgtctatgtccactgcaacgccggggtgggccgatcaacagctgcagtttgcggctggctgcaatacgtaatggggtggaacttgcggaaggtgcagtattttctcatggccaaaaggcctgcagtgtacatcgacgaggaagcactggctagggcccaagaagatttttttcagaagttcggaaaggttagaagttctgtgtgcagtctttag

SEQ ID NO: 115915 - DNA, 954 bp, Artificial Sequence
  Description of Artificial Sequence: Synthetic coding sequence
atgaggttccggtttggcgtcgttgttcccccggcagtggcaggcgcccgccctgagctactcgtggtggggtcaagaccagagctggggagatgggagccgagaggcgcagtccgtctgcgccctgcaggcactgctgccggggacggtgcattggctctccaagagcccgggctgtggctcggcgaagtggaacttgccgcggaggaggccgcgcaagatggggctgagcccggaagggtcgacacattctggtataagttccttaagcgcgaacccggcggcgagctgagctgggaaggaaacgggccacatcatgaccggtgttgcacttataacgaaaacaatcttgtcgacggcgtctactgtctgccgatcgggcactggattgaggcaactggccacactaatgagatgaaacacacaacagacttctactttaacatcgccgggcaccaagccatgcattattcccggatactgccaaatatctggctgggaagctgtccccgtcaagtggagcacgtgacgattaagctcaaacacgagctgggaatcactgccgtaatgaactttcagacagagtgggatatagtgcagaacagctctggctgcaaccgctatccagagcctatgacgcccgacacgatgataaaactttatcgtgaagagggtctggcttatatttggatgccgactccggacatgtccaccgagggcagggtccaaatgcttcctcaggctgtgtgcctgctgcatgcgctgttagaaaagggacacatagtttatgttcactgcaatgctggggttggtcgcagtacagccgccgtgtgtggatggctgcagtacgtaatgggatggaatctccgcaaagttcaatatttcctcatggccaagaggcccgcggtatacattgatgaagaggccgcatcccaggacaccttccctctgtag

SEQ ID NO: 115916 - DNA, 714 bp, Artificial Sequence
  Description of Artificial Sequence: Synthetic coding sequence
tgagatacattttggtacaaattcttaaagcgtgagcccggcggcgagctgtcctgggaaggaaatgggccacaccacgatagatgctgtacctataacgagaataatttggtagatggagtgtattgcctgcctatcggccattggatcgaggctacaggccacacaaatgaaatgaaacacaccactgacttttatttcaatatagctggtcaccaggccatgcactattcccgcatcctgcccaacatctggctgggatcctgccctcgacaggtggaacacgtgaccattaaactaaaacatgagctcggaatcaccgccgtcatgaacttccaaaccgagtgggatatcgtgcagaacagtagtggctgcaatcggtatcctgagcctatgaccccagacacaatgatcaagctctaccgggaggaggggcttgcttacatttggatgcctactccagatatgtccaccgaaggccgagtgcagatgctaccgcaggcggtgtgcttgttgcatgctctgttggaaaagggacatattgtctacgtgcactgcaacgccggggtgggcaggagcactgccgctgtgtgcggttggctgcagtacgttatgggctggaatctgcgaaaagtgcagtatttcctcatggcaaagcgacctgccgtgtatattgacgaggaggccgcctctcaggataccttccccctgtag

SEQ ID NO: 115917 - DNA, 513 bp, Artificial Sequence
  Description of Artificial Sequence: Synthetic coding sequence
tagaatggacctcaccacgacaggtgctgtacctacaatgagaataacctggtggacggagtgtactgcttgccgatcggacattggattgaggctaccgggcatacgaacgagatgaagcatacaactgatttctacttcaacattgcaggccaccaggctatgcattattcacgcatcttgccaaacatttggttaggatcatgcccgaggcaagtggagcacgtcactattaagctgaagcatgagctgggaattacagcggtaatgaactttcagactgaatgggatatcgtccaaaattcttctgggtgcaatcgctatcccgaaccaatgacaccagatactatgatcaagttgtatcgcgaagaaggactggcgtatatatggatgccgaccccggacatgtccactgaagatgaaaaacgaaccgccgatatgtgctgcagcggcatgtgggaggaaacagctgacttcggactaggtattttggactatctgaaacaaaagtag

SEQ ID NO: 115918 - DNA, 813 bp, Artificial Sequence
  Description of Artificial Sequence: Synthetic coding sequence
atgcggttccggtttggagtggtggtcccccccgcagtggctggcgcgaggcctgagttgttggttgtgggctctaggcccgaattgggccggtgggagccacgtggcgctgtccggctaaggccagccggaacagccgccggggacggcgcactcgcgttgcaggagcccggcctttggcttggcgaggtagaactggcagccgaagaggcggcccaggatggggcagaacccggccgggtcgacacattttggtataaattcttgaagagggagccaggtggtgagctaagttgggaggggaacggcccccatcacgatcgttgttgtacttacaacgagaataatctcgtcgacggggtgtattgcctacccataggccattggatcgaggccacgggacatacaaacgagatgaaacatacaacagatttttattttaatatcgctggacatcaggcaatgcactattctcggatcctccccaacatctggctcggctcctgcccacgccaggtcgaacatgttactataaaattgaagcacgagctcggcattaccgcggtcatgaacttccagaccgagtgggatatcgtgcagaacagttcaggttgcaaccgctaccccgagcccatgactcccgacacgatgatcaagctctacagagaggagggtctagcttacatatggatgcccacacccgatatgtctacagaggacgaaaaacgtacggcagatatgtgctgctctggaatgtgggaggagacagctgacttcggcctgggaatcctcgattaccttaagcaaaagtag

SEQ ID NO: 115919 - DNA, 945 bp, Artificial Sequence
  Description of Artificial Sequence: Synthetic coding sequence
atggcacctccgcaggtgctggctttcggactcctgctggctgccgctacggccacattcgcagccgcccaagaggagtgtgtgtgtgagaactacaagcttgccgttaattgcttcgtgaataacaatcggcaatgccagtgtacctccgtcggagcccaaaataccgtaatttgcagcaaactcgccgccaaatgtctggttatgaaggcggagatgaatggcagcaaactcggaaggcgcgctaagcccgaaggcgctttacagaataatgacgggttgtatgacccagactgcgatgaatctgggctgtttaaggctaaacaatgcaacgggacgagcatgtgttggtgtgttaacactgctggggttagaagaaccgataaagacaccgaaataacctgttcagaaagagtacgaacttattggatcatcatagagctgaagcacaaagcccgcgagaagccctatgatagtaagagcctgaggaccgccttgcagaaagaaatcactactagataccagttagatccgaaattcatcacgagtattctctacgaaaataacgtcataacaatagacctcgtgcaaaattcctcacagaagacccagaatgacgttgatatcgccgacgtggcttactacttcgagaaggacgttaagggagagtcattattccactccaaaaaaatggatcttactgtgaacggggagcagctggacctcgacccgggccagacactcatctattatgttgatgaaaaagcccccgagttctcaatgcagggactaaaagctggagtcatcgccgtgatagtggtggttgttattgcagtggtggccggcatcgttgtactggtgatatccagaaaaaagagaatggcaaaatacgagaaggccgagatcaaagagatgggggagatgcacagagagttaaatgcctag

SEQ ID NO: 115920 - DNA, 474 bp, Artificial Sequence
  Description of Artificial Sequence: Synthetic coding sequence
atgctcgttctcctggccggcatcttcgtggtccatatcgccaccgtgatcatgttatttgtctctactatagccaatgtgtggctggtgtccaacaccgttgatgcttctgtcgggctgtggaagaactgtacaaatatatcctgcagtgattcgctatcatacgcgtccgaagatgctctcaaaactgtgcaggcgtttatgattctaagtatcattttctgtgtgatagctcttctggttttcgtgtttcaattatttaccatggagaaaggtaatcgtttctttctgagtggggctactaccctcgtgtgctggctttgcattttagtgggagtgtcaatctacacttcccattacgctaacagggacggaactcaataccaccacgggtatagctacattcttggttggatctgcttctgtttcagttttatcatcggcgttctctaccttgtgctcagaaagaaatag

SEQ ID NO: 115921 - DNA, 426 bp, Artificial Sequence
  Description of Artificial Sequence: Synthetic coding sequence
atgctcgtgctccttgccgggatcttcgtggtgcatattgccaccgtgatcatgctctttgttagcaccattgccaacgtttggttagtgagcaacaccgtggatgcctccgtcggcctgtggaaaaattgcacaaatatatcctgtagcgatagccttagttacgcgagtgaagacgccttgaagacggtgcaggcttttatgatcctcagtatcattttttgcgtcattgcattgcttgtgttcgtatttcagttgttcaccatggagaagggaaacaggttctttcttagtggggctactaccttagtatgttttattatgcggattgttatggagcgctcaatcaccacagcgatacccaccagttgggctggctctgcatcagcttctgcttcgagtagcgcgttttcaatttggtcttag

SEQ ID NO: 115922 - DNA, 12 bp, Artificial Sequence
  Description of Artificial Sequence: Synthetic coding sequence
atgctggtgtag

SEQ ID NO: 115923 - DNA, 504 bp, Artificial Sequence
  Description of Artificial Sequence: Synthetic coding sequence
atgctcgtcctgcttgccttcattatcgccttccacatcacttccgccgctctcttattcattgcgacagtggacaatgcttggtgggtcggcgacgagttttttgccgacgtgtggcggatctgtaccaacaatactaactgtacggtaatcaatgactcgtttcaggagtatagcacgctacaggccgtccaggcgacaatgattctgtctacaatcctatgttgtatcgcctttttcatttttgtactgcagctattcaggcttaagcaaggagagcgattcgtactgacctccattattcaactcatgagctgcctgtgcgttatgattgccgcttctatctatactgacagacgcgaggacatccacgataaaaatgccaagttctatccggtaacccgagaaggtagctacggctactcatatatcctcgcatgggtcgctttcgcctgcacattcatcagcgggatgatgtatctgattctcagaaagaggaagtag

SEQ ID NO: 115924 - DNA, 504 bp, Artificial Sequence
  Description of Artificial Sequence: Synthetic coding sequence
atgctggtcttgctggcatttatcatcgccttccatatcacctccgccgctctgttattcattgccacagtagataacgcctggtgggtgggagacgagttcttcgccgacgtgtggcggatttgtactaataatactaactgtacagtgataaacgattccttccaggagtactcaactttacaggccgtccaggcaaccatgattctatctacaatattatgctgtatagccttctttatcttcgtgctgcaactcttccgcctgaagcagggcgaacgttttgtattaaccagtataatccagctcatgtcctgcctgtgcgtcatgatcgcggcttccatctacaccgaccgcagggaggatatccacgataagaatgccaagttttatcctgtgacccgggagggaagttatggatacagttacattctggcttgggtcgccttcgcatgtacattcatctccgggatgatgtacctcattttgcgaaagcgcaaatag

SEQ ID NO: 115925 - DNA, 492 bp, Artificial Sequence
  Description of Artificial Sequence: Synthetic coding sequence
atgagcctgctgcttctggtggtgtccgcactgcacattctgatcctgattttactcttcgtggcgacgctcgacaaatcttggtggacgctgcctgggaaggaatctctgaatttgtggtacgactgcacatggaataatgacaccaagacctgggcctgctcaaacgtcagtgaaaacggatggctgaaggcagtccaggtcttgatggttctttctctcattctttgctgcttgtcgttcatcctctttatgttccagctatataccatgagaagaggcggactgttttacgcaactggcttgtgtcagctgtgtacatcggttgccgttttcacaggtgccctcatatatgccattcacgctgaagagattctcgagaagcaccccaggggcggcagcttcgggtactgcttcgccctcgcctgggtcgccttcccccttgcactcgtgtccggaattatctatatccacttgcgcaaacgcgaatag

SEQ ID NO: 115926 - DNA, 2034 bp, Artificial Sequence
  Description of Artificial Sequence: Synthetic coding sequence
atgaccgcgtcaccagactaccttgtcgtgctgtttggaattacagcaggggctaccggtgcaaagttgggcagtgacgaaaaggaactcatcctcctgttttggaaagtcgtggatctggcaaacaagaaagtcgggcaactacatgaagtgctcgtgcgacctgaccaactggagctgaccgaagattgtaaggaggagacgaagatcgatgtggaatctctctcctccgcatcacagctggaccaagcccttcgtcagttcaaccagagcgttagcaatgaattgaacattggtgttggaacttcgttctgcctctgtaccgatggacaactgcacgtccgtcagatccttcatccggaggcctctaagaaaaacgtactgctgcctgaatgtttttattcctttttcgacttgagaaaggagttcaagaagtgctgtccaggcagccccgacatagataagctcgatgtggccacgatgactgaatacttaaacttcgagaaatcctcgtctgtgtcccggtatggcgcatcccaagtggaggatatgggtaacataattctggcgatgatctccgagccatacaatcatagattttctgacccagaaagggtcaactataaatttgagagtggcacctgttccaaaatggagcttatagatgacaacacagttgtgcgggctaggggcctcccttggcagagctcagaccaggacatcgctcgcttttttaagggactgaacattgcgaaaggaggtgctgccctttgcctgaatgctcagggcagaagaaatggcgaagccctagtgcgctttgtctcggaggagcaccgagatttagccctgcagcggcacaagcatcatatggggactcggtatatagaagtgtataaagccaccggggaagatttcttgaagatcgctggtgggacctccaacgaagttgcccagttcctgagcaaagagaaccaagttatcgttcggatgcgtggccttcctttcacagctaccgccgaggaggtggtcgcgttctttggccagcactgccctattacaggtggcaaagaagggatattatttgtcacttaccccgatggaaggcccaccggagacgcgttcgtcctgtttgcatgtgaggaatacgcccaaaacgctctgcgtaagcacaaagatcttctgggcaaacgctatatcgagcttttccgatccactgctgctgaggtacagcaggtcctaaaccggttcagctccgcccctttgatccccctcccaacgccacccattatccctgtcctcccacagcagttcgtacccccaaccaacgtgagggactgcattcgactgagggggctgccgtatgctgcaactattgaggatattctagatttccttggcgagtttgctaccgatattcgaactcatggtgtccatatggtattaaaccaccagggacgcccatccggcgacgcgtttatccagatgaagagcgccgaccgggcattcatggctgcacagaagtgccataagaaaaacatgaaagaccgatatgtcgaggtgttccagtgcagcgcagaggaaatgaacttcgtgttgatgggagggacattaaatcgaaatggcctgagccctcccccttgtctgtccccaccttcttacacttttccagcccctgccgcagtcataccaacagaagccgctatctatcaaccttcagtcattctaaaccctcgagcgcttcaaccgtcaaccgcgtattacccagccggcacgcaactgtttatgaactacacagcatactacccttcccctcccgggtcacccaacagcctgggctatttccccactgccgcaaatctgtccggggtgcctccacagcctggcaccgtggtgagaatgcaggggttagcttacaatacaggcgtaaaggaaatactgaatttcttccaaggatatcagtatgcgaccgaggatgggctgatccataccaacgaccaggctaggaccctacctaaagaatgggtgtgtatctag

SEQ ID NO: 115927 - DNA, 1980 bp, Artificial Sequence
  Description of Artificial Sequence: Synthetic coding sequence
atgactgctagccccgactatctggtagtcctcttcggcataacggctggtgctacaggcgctaaattaggctccgacgagaaggaactgatacttttattttggaaggtggtagatctcgcaaacaaaaaagtgggacagctgcatgaggtgctcgtgaggccagatcagttggaactgaccgaagactgcaaggaggaaacaaagatcgacgtggaatcactgtccagtgccagccagcttgaccaagccctgcggcaatttaaccagagtgtatccaatgagctgaatataggcgtgggcacctccttttgtctgtgtactgacggacaactccatgtgaggcagatcctgcaccctgaggcctctaaaaagaacgttcttctgccagaatgtttttattctttttttgatctaagaaaggaattcaagaaatgctgtcctggttcccctgacatcgataagttggatgtggctactatgactgagtaccttaacttcgagaaaagtagcagcgtcagccggtacggcgcaagccaggtcgaagatatgggtaacattatcctagcaatgatctccgagccatacaatcatcgatttagcgacccagagagagttaattataagttcgaaagcggaacgtgtagcaaaatggagctcatcgatgacaacacagtggtgcgcgctcgtgggttgccctggcagtcctcggatcaggacattgcacgctttttcaaagggctgaacatcgctaaggggggtgctgccttgtgcctcaacgctcagggccgccgtaacggggaggctttggtccgattcgtctcagaagagcaccgcgaccttgccttgcagcgccacaagcaccatatgggcaccaggtatatcgaagtgtacaaggccacaggtgaagatttcctcaagattgctggggggacgtccaacgaggtcgcgcagttcctcagcaaggaaaaccaggtcattgtgaggatgcgcgggttgccgttcactgcgaccgcagaggaagtcgtagctttcttcggccagcactgtccaatcaccggtggcaaagaaggcattttatttgtgacctaccctgatgggaggcccaccggcgatgccttcgtactgttcgcttgtgaggaatacgcccagaacgcccttcgcaaacataaggatttacttgggaaaaggtacatcgaactgtttagatcaactgcggctgaagtgcagcaagtcctcaatagattttcctcggcaccactgattccgctccccacccctcctataattccagtgttgcctcagcagtttgtaccccccactaacgtgagggattgcatacgcctgcgcgggctgccttatgccgccaccatagaagatatcctggatttcctgggagagtttgctaccgatatcaggacccacggcgtccacatggtcctaaatcatcaggggcgaccctcgggcgacgcgttcatccagatgaaaagcgctgacagggcctttatggccgctcagaagtgtcacaaaaaaaacatgaaagaccggtatgtcgaagtgtttcagtgttcagccgaagagatgaactttgtcttgatgggtgggacacttaaccgcaacggattgtcccctcctccctgtctgtcgccgccctcctatacgttcccagctccagctgcggtgattccaaccgaagccgctatctaccaaccttcagtgatactgaaccccagagccctgcagcctagtaccgcctattatcccgccggcacacagcttttcatgaactacactgcatactaccccagtccacctggcagtcctaattctctggggtattttcccacggccgccaacctctctggagtgcctccgcagccaggtaccgtggtgcgtatgcagggactggcctataataccggggtgaaggaaatcctcaacttttttcaggggtaccagtgcctcaaagatgtgtggtag

SEQ ID NO: 115928 - DNA, 2046 bp, Artificial Sequence
  Description of Artificial Sequence: Synthetic coding sequence
atgacagcctcccccgactatctggtggtcctatttggcattaccgcgggcgctaccggtgctaaacttggaagcgatgagaaggaacttattctgctcttttggaaggtagttgacttggctaacaaaaaggtagggcagctccacgaggtgcttgtacgccctgaccagctggaactcactgaggattgtaaagaggagactaagatcgacgtcgaaagcctgtcttctgcctctcagctcgaccaggcgttgcggcaatttaatcagagtgtgagcaatgagctaaatataggcgtgggcaccagcttttgtctgtgcacggacggccagctgcatgtgcgccagatcttgcaccctgaggcaagtaagaagaacgtcttgcttccagaatgcttctatagtttttttgacctgaggaaggagtttaagaaatgttgtccaggtagccccgacatcgataagttagacgtggccaccatgacggagtatctcaacttcgagaaatcgtccagtgtgtccaggtacggggcctcccaggtggaagacatggggaatatcattctggccatgatatctgagccttacaaccatagattctcagatcctgagagggtcaattacaaatttgagtccggtacctgtagcaagatggaattaatcgacgacaacacagttgttcgggcccgaggactcccttggcaaagcagcgatcaggatatcgcaagatttttcaagggcctgaatatagcgaaaggcggagctgcattatgtctgaacgcgcaagggcgacgtaatggtgaggcactggtgaggttcgtgtccgaggagcaccgggatctggctctgcagaggcacaagcatcacatgggtacccgctatatcgaagtgtacaaggctactggggaagactttctgaagatcgccggcggaaccagtaatgaggtggctcaattcctgtcaaaggagaatcaggtaatcgttcgtatgcgggggctgccctttactgctacagctgaagaggtggtggcctttttcggacagcactgcccgatcaccggtgggaaggaaggaatcctttttgtgacctatcctgatggcagacctacgggtgatgccttcgtgcttttcgcctgcgaggagtatgcacaaaacgcacttcggaaacataaagatcttcttggcaagcggtacatcgagctcttccgctcaactgctgccgaggtccagcaggtcctgaaccggttctctagcgcccctctgattcccctgcctactccaccaatcatccccgtgctaccccagcaatttgtcccccccaccaatgtgcgtgactgtatccgcctgaggggcctgccttacgccgctacaatcgaggacatcctggacttcttgggggaatttgcgaccgacattcgcacacacggggtgcatatggtactgaatcaccaggggaggccttcaggggacgcttttattcagatgaagagcgctgatcgggcctttatggcggcccagaaatgccacaaaaaaaatatgaaagatagatatgtggaggtgttccagtgttcggctgaagaaatgaacttcgtgctgatgggcggaactctaaaccgcaatgggctgtctcccccaccctgtaagctcccatgcctgtcaccacccagctacacctttccagcccccgctgccgtcattcctactgaggctgcgatatatcagccatcggtcatcctgaatccacgggccttgcagcccagtactgcgtactacccagccggaactcagctctttatgaattacacagcctactatccatccccacctggtagtccaaactctctgggatactttcccactgcagccaatctctcaggtgtgcctccacagccaggcactgttgttcgaatgcaagggctggcctataacaccggggtaaaagaaatcctgaactttttccaaggctaccagtacgccaccgaagacggccttatccataccaatgaccaggccaggactttgccaaaggagtgggtttgcatctag

SEQ ID NO: 115929 - DNA, 1827 bp, Artificial Sequence
  Description of Artificial Sequence: Synthetic coding sequence
atgacagcatcccctgattacctggtcgtactgttcggaattactgcgggagccaccggtgcaaagctgggctcagatgaaaaagaacttatcctgctgttctggaaggtggtcgatctcgcaaataagaaggttggacagctccatgaagtgctggtaagacctgatcagctggagctaactgaagactgcaaagaagagactaaaatcgacgtggagagtctgagtagcgcctcccagctcgaccaggccctcaggcagtttaatcagagtgtcagcaacgaactcaatattggagttggaacctcattctgtctgtgcaccgatggccagctgcatgtgcgccaaatcctgcaccctgaagcttctaagaagaatgtattactccccgaatgtttttacagtttctttgacctccggaaggagttcaagaaatgttgccctggatcccccgacattgacaaacttgatgttgcgacaatgacagagtatctcaacttcgagaaatcaagctcagtcagtagatatggagcctcacaggtcgaagatatgggcaacataatcctggcaatgatttctgagccctacaaccatcggttcagtgatccggagagggttaattacaaattcgaatcaggtacctgttctaaaatggagcttattgatgataacactgtggtacgggcacgcggactgccatggcagtcctcggatcaggatattgcaaggtttttcaaaggcttgaacatcgcgaaaggaggggctgccttgtgtcttaatgctcagggacgcagaaatggagaggcactagtacggtttgtttccgaagagcatagggacctcgcactacagcggcacaagcatcacatgggaacacggtacatcgaagtttacaaagccacgggggaggatttcctcaagattgcaggcgggaccagcaacgaggttgcccagttcctctccaaggagaaccaagttatagtccggatgagagggctcccctttacagccacagcagaagaggtggtggcattctttggccagcactgcccaatcaccgggggaaaagaaggcatcctcttcgtcacttacccagacggccgccccactggggacgcattcgtgctgtttgcatgtgaggaatatgcccagaacgccctgaggaaacataaagatctcttggggaagcggtacatcgagttattcagatcaacggcggcagaagtgcaacaagtgctaaataggttctcatcagcccccctgatacctctgcccacaccacctattattccagttctcccacagcagttcgtgccccctaccaatgtcagggactgcatccgtctgcgggggcttccctacgctgccactatcgaggatatcctcgactttctgggagaatttgccaccgacatcagaacccatggagtccatatggtcctgaatcatcaggggaggccttccggtgacgcgttcatccaaatgaagagtgccgaccgcgcctttatggccgcccagaagtgccataagaaaaatatgaaggatcggtacgtggaggtcttccaatgctccgctgaggaaatgaatttcgtactgatgggaggaaccctgaaccgcaacggattgtcccccccaccttgcaaactgccttgtctgtcgcctccatcctacacattccctgccccggccgccgttattcccacagaggcagctatttaccaacccagtgttattctcaacccaagggccctgcagccctctacggcatattatcccgcggggactcagctctttatgaattacaccgcgtattacccctccgtctag

SEQ ID NO: 115930 - DNA, 2154 bp, Artificial Sequence
  Description of Artificial Sequence: Synthetic coding sequence
atgacacctccccctccgccccctcctccaccaggacccgacccggcagccgatcctgccgccgacccgtgcccttggcccggctcactggttgtcctctttggagccaccgccggagctctaggccgagatttgggttctgacgaaacggacttaattctcttggtctggcaggttgtggaaccgcggagtcggcaggtcggaactctgcataagtctctcgtgagagccgaggcagccgcactttccacacagtgcagagaggcttctggtctctccgctgatagtttggcccgcgctgagcctcttgacaaggtcctgcagcagttctctcagctggtcaacggagatgttgccctgctgggtggaggcccgtatatgctgtgcactgatggtcagcaactcctgagacaggtcttgcacccagaagcatctagaaagaaccttgtactgcccgatatgttcttctccttctacgacttgcgacgggaattccatatgcagcatcccagcacctgtcctgctcgggatctgacagtcgccacaatggcacagggcctgggtctagaaactgacgcgacagaagatgatttcggcgtgtgggaggtgaagaccatggtggcagtaatcctgcacctattaaaggagccgtcttcccagctgtttagtaaaccggaagtcatcaagcagaagtacgagactggcccatgctctaaagcagacgtggtggattctgaaacagtggtgcgcgctcgggggctaccatggcaatctagcgatcaagatgttgcacggtttttcaagggcctcaacgttgctcgcggaggagtggccctgtgcctgaacgcgcagggccgccggaacggcgaggccctcattcgcttcgtggactcagaacaaagggacttagctctccagagacataaacaccatatgggagtaagatatatcgaggtgtataaggccacaggggaggaatttgtcaagatcgccgggggaactagtttggaggtggcccgatttctgtcgcgagaagaccaggttatcttgcgccttcggggcctgccattctccgccgggcctacggatgtgctcggctttctgggacctgagtgtcctgttactggaggtaccgaaggccttctcttcgtccggcatccagatgggaggccaaccggagacgcctttgcattgttcgcttgcgaagagctggcccaagcagcactgagacgccacaaggggatgctcggcaaacgatacatagaacttttcaggtcgaccgccgctgaagtgcaacaagtactgaatcggtacgccagcggccctctgctccccaccctgactgcaccactccttcccatcccatttcctctcgcacctggaactgggcgggactgcgttagactgagaggtttgccctatactgccaccatcgaagacatcctgtctttccttggcgaagccgccgcggatatccgacctcatggtgtccacatggtgttgaatcaacaggggagaccctctggagacgccttcatccagatgacatccgctgagagggccctggccgcggctcaacgatgccataagaaggttatgaaggaacggtatgtagaggtcgtaccttgctccactgaagagatgtctcgggtcctgatgggggggaccctcggccggtccggcatgtccccccctccatgcaagctgccctgcctgagccccccgacctacactacattccaagccactccaaccctgatccccactgagacagccgccctgtacccctcaagcgcccttctgccagcagccagagttcccgccgcccctacacccgtcgcctactacccagggccggctacccagctgtatctaaattacacagcgtactacccgagccctccagtgagtcccaccactgtcggctacctgacgacccccacagcagcactggcgagcgcccctacgtccgtcttgagtcagtccggagccctggttcggatgcagggggtgccttacacagcaggaatgaaagatctgctaagcgtgttccaggcttaccagttgcccgccgatgactacacgtcgctgatgcccgtgggtgacccaccacgtacggtcctgcaggccccaaaggagtgggtgtgcctgtag

SEQ ID NO: 115931 - DNA, 924 bp, Artificial Sequence
  Description of Artificial Sequence: Synthetic coding sequence
atgaacacccgcaaccgggtagtcaactccggactgggggccagtcctgcttcacggcctactagagaccctcaagacccatccgggagacaaggggaactgtctccggtggaggaccagagagagggactcgaagctgccccgaaggggccatcgcgagagtctgtggttcacgccggccagcgacgcacatcagcatacacgctgatcgcccctaacattaatcgtaggaacgaaatccaacgcattgccgagcaggagcttgccaatctagagaagtggaaggagcagaaccgggctaagcctgtgcacctcgttcccagacgactgggtgggtcccagagtgagactgaggtgcgacagaaacaacagctgcaactgatgcaatccaagtacaaacagaaactgaaacgtgaggaatctgtgaggatcaagaaggaggccgaagaggccgagttgcagaagatgaaagccatacagcgggaaaagtctaacaaactggaggaaaagaaacgcctacaggaaaacctaaggagagaagcctttagggaacatcagcaatacaagacagctgaatttctgagtaaactgaacacagaatcccccgaccgcagtgcctgccaatctgccgtgtgtggcccccagagttctacgtgggcccggagttgggcctacagagactcattaaaagctgaagagaatcgaaagctgcagaaaatgaaggatgagcagcaccagaagtcagagcttttagagctgaagagacaacaacaggagcaagagcgcgctaaaatccatcaaactgagcatcgaagagtgaacaatgcattcctggaccgcttgcaagggaagtcgcagccgggcggcctggagcagtccggagggtgctggaacatgaattccggcaactcctggggtatttag

SEQ ID NO: 115932 - DNA, 1233 bp, Artificial Sequence
  Description of Artificial Sequence: Synthetic coding sequence
atgaatacaagaaatagagtggttaatagtgggcttggtgcctccccggcctcacggccgacgagagatccccaggatccgagcggccgccagggcgaattatcaccagtggaagaccagcgggagggcctcgaagccgcaccaaagggcccctcacgggagtctgtagtgcatgccggtcaaagaaggacaagcgcatacacacttattgctccaaacatcaacagacgcaacgagatccagagaatcgcagagcaggagttggctaacctcgagaaatggaaggaacaaaatcgagcgaaacctgtccacctcgtccctcggagacttggtggctcccagtctgaaacggaggtgcgccaaaagcagcaactgcagctgatgcagtcaaagtacaaacagaagctaaaaagagaagaatcggtccgcatcaaaaaagaggctgaagaggccgagcttcagaagatgaaggcaattcaacgcgaaaaatccaacaaacttgaggagaagaagcgcctgcaggaaaatctgagacgggaagccttccgagagcaccagcagtataagacagccgagtttctgtcaaaattgaatacagagtccccggacagatcagcatgtcagagcgccgtgtgcggtccgcagtcttctacttggaaattgccgatacttcctcgggatcattcctgggcccggtcatgggcctaccgagactccctcaaggccgaagagaatcggaagctccagaagatgaaggacgagcagcatcagaaaagtgaactactcgagctgaagagacagcagcaagaacaggagagggcaaaaatccatcagacagaacaccgacgtgtcaataacgctttcttagatcgactccagggaaagagccagcccggggggctcgaacagagtggcgggtgctggaatatgaactctggaaactcctggggctcactgctggtcttttcccggcatctgcgggtatatgaaaagatcctcaccccaatttggccttctagcactgacctggaaaaaccacacgaaatgctgtttctaaacgtgatcctattctccttgaccgtctttactcttatttcaactgctcatacgctggatcgggcggtacgtagcgactggctactactggtgctgatctacgcttgtctcgaagagttaatcccagaactgattttcaatctatactgccagggaaacgcaactttgttcttttag

SEQ ID NO: 115933 - DNA, 1368 bp, Artificial Sequence
  Description of Artificial Sequence: Synthetic coding sequence
atgtggctggagatactgctgaccagcgtgctgggctttgctatctattggttcatttctcgggataaagaagagaccctgcctttggaagacgggtggtggggtcccggcacccgctcagcagcccgggaggacgattctatcaggcccttcaaggttgaaacgagcgatgaagaaattcatgacctgcatcagaggatcgacaagttcaggttcacccctccactcgaagatagctgcttccactacggtttcaattcaaattacttgaaaaaggtgatctcatattggcggaatgagttcgattggaagaaacaggtagagattctcaacaggtacccacattttaaaactaaaatcgaaggcttggatattcattttatccacgtgaaacctccgcagctcccagctggacatacgcccaaaccactgctgatggtacacggatggcctggcagcttctatgagttttacaagattatacccctactgaccgacccgaagaaccacggcctgtccgatgagcacgtgttcgaggtgatttgtccttcaataccaggatatggcttttccgaagcaagttctaagaagggctttaacagcgttgctaccgcgagaatattttacaagctgatgcttcgcctgggctttcaggagttttacattcagggcggcgattgggggtctctaatatgcaccaatatggcacagttggtgccctctcacgtaaagggactgcatctcaacatggccctggttttgagcaatttctccacactcaccttattgttagggcagagatttggcagattcctgggtctgacagagcgcgatgtagagcttctgtatcctgtgaaggaaaaggtcttctatagcctgatgagggaaagcggctatatgcatattcaatgcactaagccagatacagtgggaagtgccctgaatgactcccctgttgggctggccgcttacattttagaaaagttttctacctggaccaatacagaattcagatacctggaggatgggggcttagaaaggaagttcagcctggacgatcttctgacaaacgtgatgctgtactggactaccgggactattatatcttcccagcgcttctacaaggagaacctgggacaggggtggatgacacaaaaacacgaaaggatgaaggtgtacgtcccgaccggattttcagcctttccgtttgagctgttgcacacccccgaaaaatgggtgcgtttcaaatatcctaagctgattagttattcgtatatggtcagaggcggccacttcgccgcctttgaagagccggagctgctggcacaggatatccgcaagttcttgtcagtgctggaacgtcagtag

SEQ ID NO: 115934 - DNA, 1368 bp, Artificial Sequence
  Description of Artificial Sequence: Synthetic coding sequence
atgtggcttgagatcctgctcactagcgttcttggcttcgccatctactggttcatcagccgggataaagaggagactctcccactggaagacggctggtggggcccaggcacacggagcgccgctagggaagatgacagtatccgcccattcaaggttgaaacaagcgacgaagaaatccacgatctacatcaacgcattgacaaattccgttttacacccccgttggaggatagttgtttccactacggattcaacagcaattacttgaagaaagtaataagctattggagaaacgagttcgattggaaaaaacaggtagagatcctaaaccggtaccctcatttcaagaccaaaattgagggcttggacattcacttcatccacgtcaaaccaccacaactgccagcaggccatactcccaagcccctgctaatggtgcatggctggccggggagtttctacgaattctataaaattattccactgctaacagatcccaagaaccacggcttgtccgacgaacatgtttttgaggtgatttgcccctctatccccggctatggattcagtgaagccagtagcaaaaaaggtttcaatagcgttgctactgccaggattttctataaactcatgctacgcctgggtttccaggagttctacattcagggcggtgattggggaagtcttatctgcacaaatatggcccagctcgttccttctcatgttaaaggcttgcacctgaatatggctctggttttatctaacttctccacccttaccctgctgttaggacagagatttgggagattcctggggctcactgagcgagacgtggagctgctgtatccagtcaaggaaaaagttttctacagcctgatgcgcgaatccggctacatgcacattcagtgcacaaaaccagacaccgtgggatctgctctcaacgatagtcctgtgggtctggccgcatatatactcgagaagttttcaacctggactaacacagagttcagatacctcgaagacggcgggcttgaacgaaagttctcactggacgacctcctcaccaatgtgatgctctactggacaacaggcaccattatctctagccagcgcttctacaaggagaacctgggtcaagggtggatgacccagaagcacgagcggatgaaagtgtatgtgcccacaggcttcagtgctttcccttttgagcttcttcatacaccagagaagtgggttcgatttaagtatccaaagctcatttcctatagctatatggtacgtggcggccatttcgccgcgttcgaagagccggagctgttggctcaggacataagaaaattcttaagcgtgctagaacggcagtag

SEQ ID NO: 115935 - DNA, 486 bp, Artificial Sequence
  Description of Artificial Sequence: Synthetic coding sequence
atgtggttggaaattcttcttaccagcgtcctcggcttcgccatttactggttcattagtcgggataaggaggagacactgcccctggaagacggatggtggggcccaggcactcgatctgccgctcgggaagatgactcaatccgcccatttaaggttgaaacgagcgacgaggagatccacgacctgcaccagagaatcgacaaattcaggtttacccctcctttggaggactcctgcttccactatggcttcaactcaaattatctgaagaaagtcattagctactggagaaatgagttcgactggaagaagcaggtggagatcctgaatcggtaccctcacttcaagaccaagatagaaggactagatatccactttatacatgtgaaaccgccccagttgccggccggccacaccccaaaaccactgttgatggtccacggctggccaggaagtttttacgagttttacaagatcatctag

SEQ ID NO: 115936 - DNA, 411 bp, Artificial Sequence
  Description of Artificial Sequence: Synthetic coding sequence
atgtggttagaaatccttctcacgtctgtcttggggttcgcgatatattggttcatctcccgcgacaaagaagaaaccctgccacttgaagacggatggtgggggccaggcacacgttctgctgcacgggaggatgactctattcggccgttcaaagtggagacttctgacgaagaaatccacgatctgcatcagcgcattgataagttcaggttcaccccccccctcgaggactcatgcttccattatggatttaactccaactatttgaagaaggtgatctcatactggagaaatgagttcgactggaagaagcaggtggagatacttaataggtatcctcacttcaagaccaagatcgagggtctagacatccatttcatccacgtgaaacctcctcagctaccttag

SEQ ID NO: 115937 - DNA, 1509 bp, Artificial Sequence
  Description of Artificial Sequence: Synthetic coding sequence
atgaagggcgaaataaccctctcgcaatggatcccactgatggaggagaattgtcgcaagtgcagcgagacagctaaggtctgcttaccaaaaaatttctctatcaaagagatctttgacaaggcaatctctgcccgcaaaataaacagacctatgctgcaggcggctctgatgctgaggaagaaaggctttaccactgccatcctgacgaacacttggctggatgatcgcgctgagcgggatggactcgctcagctcatgtgcgagctgaaaatgcatttcgactttttgatcgaaagctgtcaggtgggaatggtgaaacccgaacctcagatctataaatttcttttagatactctgaaagcttctcctagcgaagtggtgttcctggatgacattggtgccaacctgaaaccggctcgtgacttgggcatggtcaccattctggttcaggacacagatacagccctcaaagaactggagaaggtaaccgggatccagctcctaaatacccctgcaccactccctaccagctgcaacccatccgacatgtcccacggctatgtcacagtcaagccgcgggtgcgcttgcattttgtggaactcggctccggtccggccgtctgcctatgccacggctttccagagtcctggtatagctggcggtatcagattccagccttagcccaggcaggttacagggttctggctatggacatgaaagggtatggtgaaagctcagctccaccagagatcgaagaatactgcatggaggttttatgcaaggagatggtcacgttcctggataagttaggactttcccaagctgttttcatcggccacgactggggcggaatgctcgtttggtatatggctttattttatccagaacgtgtgcgagcagttgctagtctcaacacacccttcatcccagccaaccccaatatgtccccactcgaaagcattaaggccaaccccgtttttgattatcagctgtattttcaggagcccggtgtcgccgaagccgagctggagcagaatctgtcacggaccttcaagtccctgtttcgggcctccgacgagtccgtattgagcatgcataaggtatgcgaggcagggggcctgttcgtcaactcaccagaggaaccaagtttgtcccgcatggtgactgaggaggaaattcagttctatgtgcagcagtttaagaagtcaggctttagaggtcccctgaattggtatcgtaacatggaacgtaactggaagtgggcctgcaagtctctaggccgaaaaattctcatcccggcactaatggtcactgccgagaaagacttcgtgctggtcccgcagatgagccagcatatggaggattggatcccccacctcaagcgcggccacattgaggactgcggacattggacgcagatggataaacctacagaggtgaaccaaatcctgattaaatggctcgatagcgatgcaaggaaccccccagttgtgtccaagatgtag

SEQ ID NO: 115938 - DNA, 1470 bp, Artificial Sequence
  Description of Artificial Sequence: Synthetic coding sequence
atggaggaaaattgcagaaagtgtagtgaaacagccaaggtctgtctgcccaagaatttctctattaaggagatcttcgacaaagccatcagcgcaaggaaaataaaccggccgatgctgcaagcagccctcatgctacggaaaaaaggctttacaacggctatcctaactaatacctggttggatgatagggcggagagagatggccttgctcaactcatgtgcgagcttaaaatgcactttgacttcctaatcgaaagctgtcaagtagggatggtcaaacctgaaccgcaaatttacaaatttttgctggatactctgaaggcttcaccttcagaggtggttttcttagacgacataggcgcaaatctcaaacctgccagggaccttgggatggtaaccatcctggtccaggacacagacaccgctctgaaggagctggaaaaagtcacaggtattcagctgctgaatacaccggcgcccctccctacaagttgcaatccctctgacatgtctcatgggtacgtaacggtgaaaccccgagtgagactgcactttgttgaactgggatccgggcccgccgtctgtctctgccacggatttcctgagagctggtacagctggagataccaaattccagcccttgcacaggcggggtaccgggtcctggctatggacatgaaggggtacggagaatcctcagccccacctgaaatcgaagagtactgcatggaagtgttgtgtaaggaaatggtgacatttcttgacaagctagggctgtctcaggctgtcttcatcgggcacgactggggaggaatgctggtatggtatatggccctgttttacccagagcgtgtgagggccgtggccagcctcaacaccccatttattccagccaatcctaacatgagccccttggaaagtattaaggctaatcctgtgttcgactaccaactgtacttccaggagccaggcgtagctgaggcagaactagaacagaacctttctagaacttttaagtctctgttcagagcctcagacgagtctgtcctgagtatgcataaggtgtgtgaggccggagggttgtttgtaaactctcccgaggagccgtctctgtccaggatggtgacagaggaagagattcagttctacgtccaacaattcaagaaatccgggttcaggggaccattaaactggtataggaatatggagaggaattggaaatgggcctgtaagagtttgggacgcaagattctaatacccgccctgatggttaccgctgagaaagatttcgttctggtgccccagatgtcccagcatatggaggactggataccccatctcaagcgggggcacatcgaggactgcggccattggacacagatggataagccaaccgaagtgaatcagattctgattaagtggttggactctgacgccagaaacccaccagtggtgtccaagatgtag

SEQ ID NO: 115939 - DNA, 1509 bp, Artificial Sequence
  Description of Artificial Sequence: Synthetic coding sequence
atgactttgcgcgctgccgtttttgacctggacggggttcttgcactgcccgccgtgtttggggtgttgggtcgtaccgaggaggcgctcgcattgccccgtggactgctcaatgacgccttccagaagggtggcccggagggggcaaccactaggctaatgaagggtgaaatcactttgtctcaatggatccccctcatggaggagaattgtaggaagtgctccgagacagccaaagtgtgcctgcccaaaaacttttcaattaaggagattttcgacaaagctattagtgctcgtaaaatcaacagacccatgctccaagccgcactgatgctacggaaaaaggccttctgcagcggcttcacaaccgccatactgaccaatacatggctggacgatagggccgaaagagatggcctggcccagctcatgtgcgagctgaaaatgcattttgactttttaatcgagtcctgccaggtgggcatggtgaagcctgagccccagatctataagttcttgctcgacacacttaaggcgtcaccctctgaagtggtgttccttgatgacatcggagcgaacttgaagcctgcccgggacctcggtatggtgacgatactggtgcaagataccgacacagctcttaaggaactcgaaaaggttacaggaattcaactcttgaatacgccggcgccattacctacaagttgtaacccctctgatatgagccacggttatgttactgttaagccccgggtgcggcttcacttcgtcgagctgggttcaggcccagccgtctgtctctgccacgggtttcctgagtcatggtacagctggcgataccagattcctgcgctcgcccaagccgggtatcgcgttctcgcaatggacatgaagggttatggagagagctcagccccccccgagatcgaagagtactgtatggaggtcctctgcaaggagagcattaaggctaaccccgtcttcgactaccagctctacttccaggaacctggcgtggcggaggctgaattggagcaaaacctgtctcggacgttcaagtctttgttcagggcctccgatgagtctgtactgtccatgcacaaagtttgtgaagcagggggacttttcgtgaacagcccggaagagccttctctctcaaggatggttacagaggaggagatacagttttatgttcagcagttcaaaaagtcagggtttagaggcccccttaattggtacaggaacatggagcgcaattggaagtgggcatgtaagtcgctcggacggaaaatactgataccagccttgatggtgacagccgaaaaggactttgtactggttccacagatgagtcagcacatggaggactggataccccaccttaaacgtggccacatcgaagactgcggccattggacccagatggataaacccactgaggtgaatcaaattctgatcaagtggctggactcagatgctagaaatccaccagtggtgagtaagatgtag

SEQ ID NO: 115940 - DNA, 1668 bp, Artificial Sequence
  Description of Artificial Sequence: Synthetic coding sequence
atgactctgagggccgcggtattcgacctggacggggtcctagcgctgccggctgtgtttggcgtccttggtcgcacggaagaggctctagcattacccagaggcctgttaaatgacgcattccagaaaggcggacctgagggcgccactacccgcttgatgaaaggggaaattaccctgtctcagtggatcccactcatggaggaaaattgccgtaagtgcagcgagaccgcaaaggtgtgtctgcccaagaacttttctattaaagagatatttgacaaagccatctccgcccggaaaatcaacagacctatgctccaagccgctctgatgcttagaaagaagggattcaccacagctatactgaccaacacgtggctggacgatcgggctgaacgagacggcctcgctcagctcatgtgtgaactaaaaatgcacttcgacttcctgatcgaaagctgccaggtgggaatggtgaaaccagaaccccagatttacaagtttttactggatactctgaaagctagcccaagcgaagttgtgtttctcgatgacattggggctaatctcaagcctgccagagatctggggatggtaacaatcctcgtgcaggacaccgacaccgccctcaaggaactggaaaaagtcacaggtatccagcttctaaatacacctgccccactcccgaccagctgtaacccctcggacatgtcccacggttacgtgacagtgaagccccgtgtgaggctgcacttcgtcgagttgggtagtggtcctgccgtgtgcctgtgccatggttttccagagagctggtacagttggcgatatcagattcccgccctagcccaggctggctatcgtgtcctcgccatggacatgaagggttatggcgagagctctgccccacctgaaatcgaggaatattgtatggaggttttgtgcaaagagatggtgacctttctggataagttgggactctcgcaggccgtgttcatagggcatgactggggcgggatgctcgtatggtatatggctttgttttaccctgagcgggtacgggccgttgcaagcctgaacacccctttcatcccagctaatccaaacatgagcccactggagtcgattaaggctaatcctgttttcgattaccagctctactttcaagagcctggtgtggccgaggctgagctggaacagaaccttagcaggacctttaagagccttttccgcgctagtgacgaaagtgtacttagcatgcacaaggtctgcgaagcaggaggactcttcgttaacagtccagaggaaccgtcactgtcccggatggtgacagaggaggagatccagttctatgtccagcagttcaagaaatcgggctttcgcgggccgctgaattggtatcgaaatatggaaagaaactggaagtgggcatgtaaatctttgggacggaagatcttgattcccgcccttatggtaactgctgaaaaagattttgtgctcgtgccccaaatgtcccaacatatggaggattggattccccacctaaaacgcggtcatatagaagattgtggccactggacccagatggacaagcctaccgaggtgaaccagatcctcatcaagtggttggactcagacgcccgaaacccacccgtagtgtctaaaatgtag

SEQ ID NO: 115941 - DNA, 1653 bp, Artificial Sequence
  Description of Artificial Sequence: Synthetic coding sequence
atgagcacttcctctctcagacgccagatgaagaacattgttcataactacagtgaggctgagataaaggttagggaagccacatctaacgatccttggggaccaagctctagtttgatgtcggagatcgctgatttgacttataacgtggtagcattctctgaaatcatgtcaatgatttggaaacgattgaacgaccatggaaagaactggagacacgtttataaagccatgacactcatggagtatctcatcaaaaccggcagtgagcgcgtgtctcagcaatgcaaggagaatatgtacgccgtgcaaacactcaaagacttccagtatgtagaccgggacggcaaggaccagggcgttaacgtccgggaaaaggcaaagcagcttgtcgccctcctgcgggacgaggatcgactccgagaggagagggcccatgcactgaaaaccaaggagaaactggcccagaccgcaaccgctagcagcgccgccgtaggttcagggccaccccccgaagctgagcaagcctggccgcagtcctccggggaggaagaactgcagcttcagcttgccctggcgatgagcaaggaagaggctgaccaggaggagaggatcagacggggagatgacctaagactccagatggccatcgaggagtctaaacgggaaaccgggggaaaggaggagtcatctctgatggatctggccgatgtcttcaccgctccggccccagcgcctacgacagacccatggggcggtcctgctccaatggctgcggccgtgcccactgcagcgcccacctccgatccctggggcggccctccggtccctccagcagcagatccttggggcggtcctgcccctacgcccgcgtccggtgacccatggcgcccggctgccccagcagggccctcagtcgacccctggggtggtacacccgccccagctgcaggggaagggcccacccctgatccatggggatcatcagacggtggggtccctgtgagcgggccctcggcctctgatccatggaccccagcacccgcctttagcgatccatggggaggtagccccgcaaagccctcaacaaatggaactactgcaggcggattcgacaccgagccagacgaattctccgattttgatcgactcagaacagcccttcctactagcggttcaagcgccggggagctcgagttgctcgcaggagaggtgcctgcacgatccccaggtgccttcgacatgtcaggagtgcgggggagcctggccgaagccgtgggaagtccaccgccggcggcgactcccacgccaactccgccaacccggaagactccagagagcttcttaggaccgaacgctgctctagtggacttagactcgctcgtcagccgccccggcccgactccacccggcgctaaggcctccaatccttttcttcctggagggggcccggccacaggaccatccgtaactaatccattccagccggccccacctgccactctcacccttaatcagctccggctgtctccagttccaccagtcccaggagccccccctacctacatttccccattgggaggaggccccggccttccaccaatgatgccccccggtcctccggcacctaacacaaatcccttcctgttatag

SEQ ID NO: 115942 - DNA, 1731 bp, Artificial Sequence
  Description of Artificial Sequence: Synthetic coding sequence
atgtcaacatcctccctgagacgtcaaatgaaaaacattgtacacaattactctgaagcagaaataaaggtgcgtgaggcaacatcgaatgacccctggggccctagcagctcactaatgagtgagatcgccgatcttacctacaatgtagttgccttctctgagatcatgtccatgatttggaagcggctgaacgaccacggtaaaaattggcgacacgtctacaaagccatgaccttaatggagtacttgatcaagacgggcagtgagagggtgagtcaacagtgtaaagagaacatgtatgccgtgcagaccctgaaggatttccagtacgtggatagggacgggaaagatcagggagtcaacgtcagagagaaagccaaacaactggtggcccttctgagggatgaggaccgtcttcgggaggagcgcgcacatgccttaaaaactaaggagaagctggcccagacagcaaccgctagcagcgccgcggttgggtcaggccctccgcccgaagcagagcaggcctggcctcagtcctccggtgaggaggaactacaactgcagctggcactcgcaatgtccaaggaagaggcggaccaacctccaagttgcgggccagaagatgacgcccaactgcagttagcactgtctctgagtcgggaggagcatgataaggaagagagaatacggaggggcgacgatctgcggctccagatggctatcgaggagagcaagagggagactggaggcaaagaggaaagtagcctgatggaccttgccgacgtcttcacagctcccgccccggctcctaccaccgatccatggggcgggccggcgccaatggccgcagccgtccccaccgcagctccaactagtgacccctgggggggacccccagtgccccctgctgccgatccgtgggggggccccgcccccacgcctgcttctggagatccctggcgccctgcagccccggcgggcccttccgtcgacccatggggcggaacccccgcacctgcggcaggggaaggtcctacccctgatccctggggctccagcgacggcggggtccccgttagtgggccctcagccagcgacccttggactccggccccagcatttagtgatccctggggcggctcgccagccaagccaagcacaaatggaactaccgccgccgggggattcgacaccgagcctgatgagtttagtgactttgatcggttaagaaccgccttgccaaccagcggaagtagcgcaggtgagttggagctccttgccggggaggttcccgctaggtctccaggcgcgtttgacatgtccggcgttaggggctccctcgccgaggctgtgggttcacctccaccggccgctactcctactcctaccccgcccactcggaagactcctgaaagcttcttaggccccaatgcagcgctcgtcgacttggattcactggtatctagaccagggcctacacctccaggggctaaagcctctaacccctttttgcccggagggggacctgctacaggaccttccgttacgaatccattccagcctgcccctcccgcaaccctgactttaaatcaattgcgactctcacccgtgccgcctgtgccaggagcccccccgacctatataagtccgctcgggggcggcccaggtctcccacctatgatgccccccgggcctccagcgccaaacaccaacccattcttgttatag

SEQ ID NO: 115943 - DNA, 1989 bp, Artificial Sequence
  Description of Artificial Sequence: Synthetic coding sequence
atgggggatcagagctggttgtggaaccaagccgcacctggggttcgtagtccggtgttcgcctgttcggtggagaaagggaacgtgccgttggtgctgagcgagcaccttgctcattccagggatcccgggtccggcgctgtgagatttctcatttcacccgagccatgggcaagtgcaatcctggggacctccggattactggccagccctgtgttaccagcagccctggatgcagttacgtgccagcaccttccacaacctagttctgggtcgcgccctataagccctaggatcggggcactatgtccccttctcctgcagcccggcaccatgagcacatcctcactaaggcgccaaatgaagaatatagtgcataactacagcgaggccgagatcaaggtgcgggaggcaaccagtaatgacccatggggaccctcaagcagtctgatgtccgaaatcgctgaccttacgtataacgtggtggctttctctgaaatcatgagcatgatatggaagcgactgaacgatcacggcaaaaattggcggcacgtgtacaaggctatgacactgatggaatacctgattaaaactgggtctgaaagagtttcccagcagtgtaaagaaaatatgtacgctgtccagaccctgaaggactttcagtacgtggaccgggatgggaaagaccaaggggttaatgtacgggagaaggctaaacagttggtggccctgctccgcgatgaggacaggctgcgagaagagcgggcgcatgccctcaagactaaagagaagctcgcacagacagcgactgccagctccgcagcagtaggctcaggcccacctcctgaggctgagcaggcatggccacagtcctctggcgaggaggagttacaactccagctggctcttgccatgagcaaggaggaggctgaccaagaagaacgtattcgcagaggtgatgatctgaggcttcaaatggccattgaagaaagcaagcgtgaaaccggagggaaagaggagagctccctcatggacttggcggacgtgttcacggctccagccccagcccccaccacagacccatggggtgggccggcgcctatggccgctgccgtgcccacagccgccccaacctctgatccatgggggggcccacccgtccccccagctgccgacccctgggggggacctgcccccacacctgccagtggcgacccatggcggcctgccgcacctgcgggaccatccgtggacccttgggggggaacgcctgcgccagcagctggagaaggaccaacgccagacccctggggcagttctgatggcggcgtccctgtaagcgggcctagcgcctctgatccttggactcctgcccccgcgttcagcgacccctggggcggatctccggccaaaccaagcacaaacggcacaactgctgctggtggctttgatactgaacccgacgaatttagtgactttgataggcttaggacagccctaccaacttccgggtccagcgcgggcgagctggaactccttgccggggaggtcccagcacgatcaccgggagcattcgacatgtccggggtcagagggtctctggccgaggcggtaggatcccctccaccagccgcaactccaacacccacccctcctacccgaaagacgcctgagtcttttctaggtccgaatgccgctctggtggatctggatagcttagtgtccagacctggccctactccacccggtgctaaggcatcaaatccatttttgccaggaggggggcctgcaaccggccccagtgtgaccaatcccttccagcccgccccacctgccaccctcactctcaatcagttgcgcttgtccccggtacctcctgtccccggagcaccccctacatatatctctccactaggaggaggcccaggactgcctcctatgatgccgccaggaccacctgcccctaacaccaacccttttctgttgtag

SEQ ID NO: 115944 - DNA, 1611 bp, Artificial Sequence
  Description of Artificial Sequence: Synthetic coding sequence
atgtccgagatagcagacctgacttataatgtggtcgctttctccgagattatgagcatgatttggaaacgcttgaacgaccacggtaagaattggcgccatgtgtataaagcaatgaccttaatggagtacttgattaaaactggttcagaaagggttagccagcagtgtaaggagaatatgtatgccgtgcagacgctaaaagattttcagtacgtggatcgggatgggaaagatcaaggagtgaatgttagagagaaggcaaagcaactggtggctctgctccgagacgaagataggttgcgagaagaaagagctcacgcgctgaagaccaaggaaaagcttgctcaaaccgctactgcaagttctgccgccgttggaagtgggccaccgcccgaggcagagcaggcgtggccccagtcttcaggtgaggaggagctccaactccagctggcgcttgcaatgtccaaggaagaagctgaccagcccccatcctgcggtccggaagatgacgcccagctgcagttggcgctgagcctgagcagggaagaacatgataaagaagaacgcatcagacgcggtgatgacctcaggctgcaaatggcgattgaagaaagcaagcgggagactgggggaaaagaggagagcagtctgatggaccttgccgacgtctttactgcgccggcacccgcccctactaccgacccctggggaggtcctgcgccaatggcggctgctgttcctactgccgcccccacttcagacccttggggtggccctcccgtaccccccgcagcggatccctggggcggccccgcgcctacaccggcctctggtgacccatggcgcccagccgcccctgccggcccatctgtcgatccctggggcggcacacctgctcctgctgcaggcgaaggacccacccccgatccttggggaagcagcgacggaggcgtaccggtgtcaggaccttccgcatccgacccctggacacctgctccagctttctccgacccctggggcggaagcccagccaaaccttccactaacggaaccactgcaggcgggtttgacaccgagcctgatgaattcagcgactttgatcgcctccgcactgccctgcccacctctggaagctctgccggagaactggagctcctagccggggaagtgccagctcgctcaccgggtgccttcgatatgagtggcgtccgcgggagtttggctgaagccgtggggtcccctccacccgccgctactcccactccaactccaccaacaagaaagactccagagtcctttttaggtcccaacgctgcacttgtagaccttgattccttggtctctcgacctggaccgaccccacctggagctaaagccagtaacccattcctgccgggaggcgggcccgcaaccggcccaagcgtgaccaatccctttcagccagctcccccagctaccctgactctgaaccagttacgactttcacctgttcctcccgtccctggcgcccctcccacgtacattagccctctaggcggcgggccaggtctccctcccatgatgcctccgggacccccagctcccaatacgaacccgtttctcctgtag

SEQ ID NO: 115945 - DNA, 1926 bp, Artificial Sequence
  Description of Artificial Sequence: Synthetic coding sequence
atgacaacatcttctattcggagacagatgaagaatatcgtgaataactacagtgaagcagagattaaagtcagggaagctacaagtaacgatccatggggccccagctcttccttgatgaccgaaatcgccgacctgacatataacgtagtggccttctccgaaatcatgtcgatggtatggaagcgacttaatgaccatggtaagaactggcggcacgtgtataaggccctgactttgttagattacttgattaaaaccggatccgagcgcgtggctcagcagtgtcgggagaatatctttgcaattcagactcttaaagactttcaatacattgatcgggatggtaaagaccaaggcattaacgtgcgcgagaaatccaagcaactggtggctctactgaaggatgaggaacgccttaaggcagagcgcgcacaagccttaaagactaaagaacgcatggcccaggtcgccaccggcatgggatccaaccaaattacttttggcagaggcagttcacaaccaaatctatcaacctctcactccgagcaggagtacgggaaggccggggggtcgcccgccagttatcacgggagtcccgaggcgtctctctgtcctcagcataggactggcgctccgctcggacagtcagaagagctgcaaccgttgtcccagcgacacccctttcttccccatttggggcttgcctcccgcccaaacggggattggtcacagccatgcttgacctgtgaccgggcagcacgtgcaacgagccctagagtgagctctgagctcgagcaggcaaggcctcagacaagcggggaagaagagctgcagctgcagttggcccttgccatgtctcgcgaggtggcagaacaggaagagaggctgagaagaggagatgatctgaggctccaaatggctctggaagagagccggagagatacagtgaaaatccccaagaagaaggagcacggtagcctgcctcagcagactacgttgctggaccttatggatgccctgccatcttccggacctgccgcacagaaagcggagccatggggaccctctgccagcaccaatcaaactaatccatggggaggcccggccgccccagccagtacttccgatccatggccttcattcggtaccaagcctgccgcaagtatagacccatggggcgtccctacaggcgccaccgtccaatctgtgcccaagaactccgacccctgggctgccagtcagcagccagcctcgagtgccggaaagcgggcctctgacgcctggggagctgtgagtacaactaaacccgttagcgtgtcagggtcttttgaactcttcagtaacttgaacggtaccatcaaggacgactttagtgaattcgataacctgcgcacaagcaagaaaacagccgaaagtgtgacgtcacttcccagccagaataatggtaccacctctcctgatccgtttgaaagtcagcccctcacagtggcttccagcaaaccgagcagcgcgcgaaaaaccccggaatcctttctcggtcccaacgcagccctcgtaaatctggattctttggtaactagacccgcacccccagcacaaagcttaaatccctttctcgcgcccggagcgccagcgacatcagctccagtgaatccttttcaagtgaatcagccgcaacctctgacactgaaccagctccgtgggagccctgtgctcggcacttcaacatcgtttgggcctggcccgggagtggagtctatggctgtcgcctctatgacttccgccgcccctcagccggccttgggcgctacgggttcctccctgaccccgctcggacctgccatgatgaacatggtcgggtccgtggggataccaccaagtgctgctcaagcgacgggcacaaccaacccgttcttgctatag

SEQ ID NO: 115946 - DNA, 1755 bp, Artificial Sequence
  Description of Artificial Sequence: Synthetic coding sequence
atgacaacttcctccatcaggaggcagatgaaaaatattgttaacaattacagcgaggccgaaataaaagtgcgcgaggcaacatccaacgatccgtggggtccatctagttcccttatgacggaaattgcggaccttacttataatgtggttgcattctctgaaatcatgagtatggtgtggaagcggctgaatgaccatggtaagaattggcgccacgtatacaaagctctcactctgcttgattatcttataaagaccgggagcgagcgggtggcacagcagtgtagagagaacatctttgccattcaaactctcaaagacttccagtatatcgacagagacggcaaggatcagggaattaatgtgcgagaaaagtccaaacagctcgtcgctcttctgaaagacgaggagcggctcaaggccgaaagagcccaggccctcaaaaccaaggaaaggatggcacaagtagccacaggcatggggtctaatcagatcaccttcggcagaggctctagccaaccaaacctgtccactagtcactctgagcaagagtatggaaaagccggtgggtcccctgcctcgtaccacggatctacctccccgcgggtgtcaagcgagttggagcaggccagacctcagacaagcggagaggaggaacttcagttgcaattggctcttgctatgtctcgcgaggtagccgaacaggaagagcggttgcgtcgcggcgacgacctgagacttcagatggcattagaggagtctaggagagatacagtcaaaatacctaaaaagaaggaacacggttcacttccacaacagaccacgcttttggatttaatggatgctttgccctcaagcggacccgcagcacagaaggccgagccttgggggcccagcgccagcaccaaccaaacaaacccctggggcggacccgcggctccagcctcaacctctgatccctggccgtctttcgggacaaagcctgcagcctctatcgatccttggggagtccccaccggagcaactgtgcagagtgtcccaaagaactcagacccttgggcagcctcccagcagccagccagtagtgcagggaagagagcaagtgatgcctggggcgctgtctctaccaccaaacccgtctccgtcagcggctctttcgagcttttttcaaacctgaatggtactatcaaagacgacttctccgagtttgataacctacgaacatccaagaagactgcagagagcgtgacctcgctcccctcccagaacaatgggacaacttcccccgacccattcgagagtcagccccttacagtggcctcttcaaaaccaagcagcgctagaaaaactcccgagagtttcctgggtcccaacgccgcactggtgaatctcgattcccttgttacacgccctgcacctccagctcaaagcctgaatcctttcctcgccccgggcgctcccgcaacttccgcaccagtgaaccccttccaggtaaaccaacctcaaccactcaccttgaaccagctccgcggatctccagtgctcggtacaagcacgtcgtttgggcccgggcccggcgtggagtctatggcagtggcctctatgacatccgctgccccgcagccggcccttggggcaaccgggagctccctcacaccgctgggccccgccatgatgaatatggtcggaagcgtagggatcccgccctccgctgctcaggcaaccggaacaacaaacccatttcttctatag

SEQ ID NO: 115947 - DNA, 1071 bp, Artificial Sequence
  Description of Artificial Sequence: Synthetic coding sequence
atgtcacgcgaggtcgcggaacaagaggagcgactcaggcgtggtgatgatctcagactgcagatggccctggaagagtcgcgcagagatacggtgaaaatccccaagaagaaagaacacgggagcctgccacagcagacgaccctgctcgacctcatggatgccctgccaagttccggccccgcggcacagaaggcggaaccctggggacccagtgcaagtacgaatcagacaaatccgtggggaggacctgccgcaccagcttctacctccgatccgtggcccagcttcgggacaaaacccgccgcctccattgacccatggggggtccctaccggggccacagtccaaagtgtgccaaagaattcagatccttgggctgcttcccagcaacctgcgagcagtgccggtaagcgtgcttcagatgcttggggtgcagtttcaactacaaagccggtgtccgtctctggatccttcgagctgttctctaacctgaacggtacgatcaaagatgatttttctgagtttgataatctgagaacaagcaaaaagaccgctgagtccgtgacctctctgccctcacagaacaacggaacaacctcaccagacccatttgagtcccagccactaactgtcgcgagctcaaaaccaagcagtgcaagaaagactcccgagagcttccttggtcctaatgccgcattggtgaatctcgattcattggtgacacgccctgcccctcccgctcagagcctcaacccatttctggcacctggcgctccagctacatccgctccagttaatccatttcaggtgaaccagcctcagccacttacgttgaaccagctcaggggctcacccgttttgggaacgagcacgtcttttggcccgggccctggagtggagtctatggcagtagcctctatgacgtccgccgcaccccagcccgcgcttggcgctactggaagttctctgacaccactcgggcctgccatgatgaacatggtgggcagcgtgggcattcccccctcagctgcgcaagccaccgggactaccaaccccttcctcctgtag

SEQ ID NO: 115948 - DNA, 1755 bp, Artificial Sequence
  Description of Artificial Sequence: Synthetic coding sequence
atgaccaccagcagcattcggcggcaaatgaaaaacatcgttaacaattactctgaggccgaaattaaggtgagggaggctacttcaaacgacccatggggccctagctccagtctgatgacggagattgctgaccttacctataatgtagtggccttcagtgagattatgtctatggtgtggaaaaggcttaatgaccatggcaaaaactggaggcatgtgtacaaagctttaaccctgctggattacttgataaagactggatctgagcgggttgcacaacaatgtcgcgaaaacatcttcgcaatccagacgttgaaggactttcaatacatcgaccgagacggcaaggatcagggaattaatgtgcgagagaagagcaagcaactggtcgccctactcaaggatgaggaacgactgaaggccgagcgggcccaagctctcaaaaccaaggaacggatggcacaggtggccactggcatggggtcaaaccaaattacttttggacgcggaagtagtcagccaaatctgtctactagccatagcgaacaggaatacggcaaggccgggggcagtcccgcctcctaccacggcagtaccagccctagagtgtcaagcgagctggagcaggcccggccacagacttctggagaggaggagcttcagcttcagctggcccttgcaatgtcacgggaagtcgcggaacaggaggagaggctgcgcaggggcgacgatcttcgtctgcaaatggcattggaagagtcacgacgggataccgttaagattcccaagaaaaaagaacatggaagcctgccccagcaaactaccctcctggacttaatggatgccctgccgtccagtggccccgccgcccagaaagccgagccctggggaccatcagcttcaacaaaccagaccaacccttggggaggcccagccgctcccgcctcaacaagcgacccctggccaagctttggaacaaagccagcagcttctatagacccttggggggtgcccactggcgccacagtacaaagtgtgccaaaaaactcggatccctgggccgcctcacaacagcctgcctccagtgcgggcaaacgcgcctcagatgcctggggcgctgtttctacaacaaaacctgtctccgttagtggctcatttgaattgtttagcaacctgaacggtacgataaaggatgactttagcgagtttgataaccttagaacgtctaaaaagacagctgagtctgtcaccagccttccatcccagaacaacggaacaacttctcctgatccatttgagagtcagcctctgactgtagcatcttccaagccatccagcgcacgcaagacaccggagagtttccttggccctaacgccgctctggtgaacttggactcactggtgactcgccctgccccccctgcccaatcactgaatcctttcctcgccccgggggcccccgcaacttccgcacctgtcaacccctttcaagttaaccagccccagccccttactctcaatcagctccggggcagcccagttctgggaacaagtacctctttcgggccaggtccaggtgttgagtcaatggcggtcgcatcaatgacctcagctgcaccgcagcctgccctgggcgccacggggagctcactgaccccactgggacctgcaatgatgaatatggttgggagcgtcggcatccccccttccgcagctcaagctacgggaacgaccaatccctttctactatag

SEQ ID NO: 115949 - DNA, 1455 bp, Artificial Sequence
  Description of Artificial Sequence: Synthetic coding sequence
atgacaacttcctccattaggagacagatgaagaatatcgtgaacaactactccgaggccgagattaaggttcgggaggccacttccaacgatccctgggggccctctagttcgttgatgaccgagatcgcggatctcacttacaatgtggtggccttctccgaaattatgagtatggtgtggaaacgcctgaacgaccacggcaaaaactggaggcatgtttacaaagccctaacgctgctggactacttaatcaagacgggttctgaacgtgtggcacaacagtgccgcgagaacatcttcgctatacaaacactgaaagacttccagtacatcgacagggacgggaaggaccagggtatcaatgtcagggagaaatctaagcagctggtggccctactgaaagatgaggagcggctgaaagccgagagggctcaggctttgaagaccaaagagaggatggcacaggtcgccacgggcatgggctccaaccagatcaccttcgggcgaggctcaagtcagcctaacctcagtacttcacatagcgagcaggagtacgggaaagccggaggtagtcccgcctcttaccacgggtctcctgaggcaagtctgtgcccacagcacaggactggcgcacccctcggacagagtgaagaactccagcctcttagccaaaggcacccgtttctgccgcacctgggcctcgcgtcccgacccaacggagactggtctcagccctgcctcacatgcgacagggctgctcgagccacctcaccacgtgttagcagtgagctagagcaggcaaggccacagacatccggggaagaggagctgcaactgcagcttgcactggcaatgtcaagagaggtggccgagcaggaagaaaggctcaggcggggagatgatctgaggctgcagatggctctcgaggagagccgtcgggatactgttaagattccaaaaaagaaggagcacggctctctgccacaacaaactacgttgctagaccttatggatgcactcccatcctctgggcctgctgcccagaaggcggagccctggggaccgagtgcatccaccaaccagactaatccttggggaggacccgcagctcctgcctccacctctgacccctggccgagttttggcaccaaacctgccgcgagtatcgacccctggggagtaccgaccggggctactgttcaatcggttcccaaaaattccgatccctgggccgcctcccagcagccagcctcctctgccggcaagagagcgagtgacgcttggggcgccgtgagcacaacaaagcctgtgtccgtctcagggagtttcgagctttttagtaatctgaacggcaccattaaggacgattttagcgaattcgataacctgcggacaagcaaaaagactgggatgcaagggttgaccggcctcctatttacaatggagatatag

SEQ ID NO: 115950 - DNA, 1500 bp, Artificial Sequence
  Description of Artificial Sequence: Synthetic coding sequence
atgacaacatcttctatacggcgccagatgaagaatatcgttaataactacagcgaagctgagatcaaagtgagagaggctacttcaaatgatccttggggaccgtccagctcccttatgactgagattgccgaccttacctacaacgtggttgctttcagcgaaatcatgagcatggtgtggaagaggctgaacgatcacggtaagaactggaggcacgtctacaaggcactgactctgctcgactacctgatcaagaccgggtccgagagggtggctcagcagtgtcgggaaaatatttttgccatccagacactgaaggactttcagtatatagaccgggacggcaaggatcagggaattaacgttagagagaaaagtaaacagttagtcgcacttctgaaagatgaggagcgccttaaagccgagagggcccaggccctgaagacaaaggagcgcatggcccaggtggctaccggaatggggagcaatcagataacatttggtcgaggttcctcccagcctaacctgagcacaagccattccgagcaggagtatggcaaagcaggaggatccccagcttcctatcacggcagtacctcacctcgcgtttcatccgaattagaacaggctcggccccagacttccggagaggaagagcttcagctgcagttggccttggcgatgtcgagagaagtggctgagcaggaggaacgcctgcgtcgaggcgacgacctcagactgcagatggccctcgaggaaagtcggcgggatacagtcaagataccgaaaaagaaggagcatggctctttaccacagcaaacaacccttctggatcttatggatgctcttcccagctctggtcccgcagcccaaaaggctgagccttggggtccctccgccagcaccaaccagacaaatccctggggaggacctgctgcacctgcgagtactagtgacccatggccttccttcgggaccaagccagctgcctccatagatccctggggagtcccgaccggcgccacagtgcagtcggtccccaaaaattccgatccgtgggccgcctcccagcaaccagcttcctccgccggtaagcgagcttctgacgcctggggcgcagtatctaccactaagccagtatccgtatcaggcagcttcgagctcttcagcaatctcaatgggacgattaaagatgatttcagtgaattcgacaatctgcgcacctccaagaagaccgcggaatccgtgacatctctgccatctcagaacaacggcactactagccccgatccttttgagtcacagcccctaacggtggctagttctaaaccttcctctgcgcgaaagaccccagagtccttcctgggacccaatgccgccttagtaaatctcgattctctcgttactcgaccagctcctccagcccagagcctgaatccttttctggctcccggcatgcagggactcacagggctgctgtttacaatggagatctag

SEQ ID NO: 115951 - DNA, 1899 bp, Artificial Sequence
  Description of Artificial Sequence: Synthetic coding sequence
atgactaccagtgccctgcgcaggcaggttaagaacattgtccacaactacagcgaggctgagataaaagtccgagaggctacttcaaatgacccctggggcccaccctcctccctcatgagcgaaatcgccgacctcacctttaacacggttgctttcaccgaagttatgggcatgctgtggcgtaggttgaacgacagcggtaaaaactggagacacgtgtacaaggcgttgaccttgttagattacctcttgaagactggatcagagcgggtggcccaccagtgcagggagaatctgtacacaatccagactttgaaggacttccagtatatcgaccgtgatggaaaagaccagggagtgaatgtgagggagaaagtgaagcaggtaatggctcttctgaaagacgaggagaggctccgtcaggagaggacgcatgcattaaaaactaaggagcgaatggccctggagggtatcggcatcgggtccggtcaactcggctttagtcgcagatatggggaggattatagccgaagcaggggcagtcctagctcgtataacagctcgtcttctagccccagatatacctccgaccttgaacaggctcgaccccagacaagtggcgaggaggagctgcagttgcaactggctctggcaatgagccgggaggaggccgaaaaacccgttcccccggcctcgcatagagacgaggacttacagctgcagctggctttgcggctgtctcggcaggagcatgagaaagaagtgcgctcatggcagggagacgggtcccccatggccaatggagccggcgcagtcgtgcatcaccaaagggatcgggaaccagaacgggaggagagaaaggaagaagaaaagcttaagacaagtcagtcatcaattcttgacctggccgacatctttgtccccgcacttgccccccccagcacacactgctcggctgatccctgggacattcccggttttcggccaaacacagaggctagcggctcctcatggggaccatcagcagacccatggagtcctatccctagtggcaccgtgctgtcacgcagtcagccatgggatctcacccccatgctgagttcttccgagccctggggccgcacacccgtgcttcccgctggaccgccaacaacagacccctgggccctgaatagtccacatcataagctcccatccacaggggctgacccttggggcgcgagcttggagaccagtgacacccccggcggtgcctccacctttgatcccttcgctaagcccccagagagcaccgagactaaggaagggctggaacaagcactgccgtccggaaagccatctagccctgtcgaactggatctattcggtgacccttctccatcatcaaagcagaacggtacgaaggaacctgatgccctggacttgggcattctcggcgaggccctcactcagccaagcaaggaagctagggcatgtcgcacgcctgaaagtttcttaggaccatcagcttcctcccttgtaaacctcgacagcttggtcaaggcgccccaagtggccaaaacaaggaatcccttcctgacggggctgagtgcacctagtcccaccaatccttttggcgctggggagccgggacgtcccactctaaaccagatgagaacagggtcccccgccctcggcttagccggcggccccgttggggctccacttggctcaatgacctattctgcatccctccctttgcctctgtcaagtgtgccagcaggattgacccttcctgcaagcgtctccgtttttccacaagctggagcctttgctccccaacccctgctccctacgcccagcagtgccggtcctcgtcccccacccccccagacagggacgaatccattcttatag

SEQ ID NO: 115952 - DNA, 957 bp, Artificial Sequence
  Description of Artificial Sequence: Synthetic coding sequence
atgacaacatctgcactaaggaggcaggtgaaaaatattgtccataattattctgaggcagaaatcaaagtgagggaagccacgtcaaatgatccgtggggcccaccgtctagtctgatgtcggaaatcgccgacctgactttcaatacagtggcattcactgaggtgatgggcatgctgtggcggcgcttgaacgatagcggcaagaattggaggcacgtgtataaggcactgactctgttagattacttgcttaagacagggtccgagagggtcgctcatcagtgccgcgagaacttatacacaatccagacgctgaaggatttccaatacatcgatagagatggaaaggatcagggtgtaaacgtgcgcgaaaaagtgaaacaggtgatggctctcctgaaggatgaagagagacttcgacaggagcgcactcatgcactgaaaacaaaggaacgtatggcgctcgaaggcattgggatcgggtccgggcaactgggcttctctcgcaggtatggagaggactatagccgctccaggggtagtcctagttcttacaattcctcttctagcagcccacgctacacttctgacctggaacaagcccgaccccagactagtggcgaagaggaacttcagcttcagttggctctcgcgatgtctagagaggaggccgagaagccagtccctccagctagtcaccgggatgaagatctccaactgcaactggctctccgcctctcaagacaggaacacgaaaaggaagtaaggagctggcagggagacggatcccctatggccaacggtgccggagccgtcgtgcaccatcaaagagacagagagcctgagcgagaagagcgaaaagaagaggagaagttgaaaacctcgcaggcccccccaacatccgaaccacggttgccgctcccctcaaccgtgctgcacccgggactgggatag

SEQ ID NO: 115953 - DNA, 1725 bp, Artificial Sequence
  Description of Artificial Sequence: Synthetic coding sequence
atggcgttagagaccctaccgcgcctttgcaggccagctgccgcccaggtgggcgggtccccccaacgcctcctgggactggggcttggtccgagagagccggccctagagccccacgtcgagccaaaggacgctgcagccctactgaccaggcagcccatcctgcaggactgcgacctcgccactgtggcattaagtccgcctccgcccgctggggctcgtgcaacccatctccaggtttcatcccacgacgatttgcggacccctgccccaggggaagaacatcgcgcgcagttgctccgaggtcggaatcaggttgctttcaccgaagtcatgggcatgctatggcggcgccttaatgacagcggcaaaaattggagacacgtgtacaaggccctcacgctcctcgactatctcttaaaaacggggagtgaacgcgtagcccaccagtgcagagagaatctgtacacgatccagaccctcaaagacttccagtacatagatagagatggtaaggaccagggcgtgaacgtaagggagaaagtgaaacaagtaatggcgcttctaaaggatgaggagagattgaggcaggaacgaacacatgctctgaaaacgaaggaaagaatggcactcgaaggtattggcatcggctccggccagctggggtttagtcgccgctatggcgaagattattcacgcagtcggggatcacctagctcctataacagttctagctcgagcccacggtataccagcgatctcgaacaggcccgacctcagacctccggtgaagaggaactgcagttgcaactggcattagccatgtcccgagaggaagctgagaaggaggttcgcagctggcagggtgacgggagccctatggcaaatggcgcgggcgccgtggtgcatcaccaaagggaccgcgagcctgaacgggaggagagaaaagaagaagaaaaactcaaaacatcccagtcaagcatcctggacttggccgatatatttgtgcctgccctagcccctccgagcactcattgtagcgctgacccctgggatatccctggcttcaggcctaacacagaagccagtggaagctcctgggggccgagtgcagacccctggtctcccatcccatcaggtaccgtgctcagtcgttctcagccatgggacctgacgccaatgctgtcctcctccgaaccttggggcagaaccccagtcctgcccgccgggccccccacaactgatccatgggccctgaattccccccatcacaagctgccgtcaacgggggcagatccttggggcgcaagtttggagacttccgacacgcccggaggggcatctacttttgatccttttgcaaaacctccggagagtacagagaccaaggagggcctggagcaggcgctgccatctggaaaaccaagctcccccgtcgaattagacttgtttggagacccctcgccatctagcaagcagaacggcaccaaggaaccggatgccctggacctgggcatcctgggtgaagcccttactcagccaagtaaggaagcaagagcctgccggacacccgagagctttctcggcccctctgccagctccctggtgaacttggattccttggtgaaggccccacaggtggccaaaacaagaaacccgttcttgaccggcctgtctgccccccccagattgagaactaggggctgggctggtcggcgctgctag

SEQ ID NO: 115954 - DNA, 507 bp, Artificial Sequence
  Description of Artificial Sequence: Synthetic coding sequence
atgacaacatcagcgctgcggcggcaggttaagaatatcgtgcataactactccgaggcagagatcaaggtgcgagaggcgacatcaaatgacccttggggcccaccctcctcattaatgagcgagattgcagacctcactttcaacaccgtggcgtttacagaggtaatgggtatgctgtggcggcggctcaacgactctgggaaaaattggcggcacgtatacaaggctctcaccctactggattatctgctgaaaacgggctctgaaagggtcgcccaccaatgtcgcgagaatctgtatacaatccagacactcaaggatttccagtatattgatagggacggaaaagaccagggcgttaacgttcgagagaaggttaagcaggttatggctctcctgaaggacgaggaacgcctcaggcaggagaggacgcacgctctaaagacaaaggagcgaatggcccttgaaggaatcggcataggctctggacaattgggattttag

SEQ ID NO: 115955 - DNA, 36 bp, Artificial Sequence
  Description of Artificial Sequence: Synthetic coding sequence
atgacaacgagtgcgctacggaggcaggtaaagtag

SEQ ID NO: 115956 - DNA, 411 bp, Artificial Sequence
  Description of Artificial Sequence: Synthetic coding sequence
atgaccacatccgctctgaggcggcaagtgaaaaatatcgtccacaactactccgaagccgagattaaggtgcgggaggccacatccaacgacccctggggccccccaagctctctcatgtctgaaatcgccgacttgacctttaacacagtggccttcaccgaggtgatgggcatgctctggcgcagactgaatgactccggaaagaactggagacacgtctacaaagccctaacattattagactatctcctgaagaccgggagcgagcgggttgcacaccaatgtcgcgagaacctctacactatacagacactgaaggattttcaatatatcgaccgcgacggcaaggatcaaggcgtaaatgtacgcgagaaggttaagcaggttatggccctgcttaaagattag

SEQ ID NO: 115957 - DNA, 156 bp, Artificial Sequence
  Description of Artificial Sequence: Synthetic coding sequence
atgacaacaagtgccctgcgccggcaagtgaaaaatatcgtccataattactccgaggctgaaatcaaagtcagggaggctacctcaaacgacccttggggaccaccttcgtccctgatgtctgaaatagccgatctgacattcaatactgtctag

SEQ ID NO: 115958 - DNA, 327 bp, Artificial Sequence
  Description of Artificial Sequence: Synthetic coding sequence
atgacaacttctgccctgcgccgccaagttaaaaacatcgtccacaattattctgaggccgaaatcaaagtgagggaggcaacctcgaacgacccctgggggcctccttcttccctcatgtcagagattgcagacctgacttttaacacagtagctttcacagaagtgatggggatgctgtggcgtcgactgaatgattccgggaagaactggaggcacgtctataaagcactgaccctgttagattatcttcttaagaccgggtcagaacgggtcgcccatcagtgcagggaaaacctgtataccatacagaccctcaaagactag

SEQ ID NO: 115959 - DNA, 1983 bp, Artificial Sequence
  Description of Artificial Sequence: Synthetic coding sequence
atggctctagagaccctgccccggctctgtcgcccagctgctgctcaggtgggcggctcacctcagagactcctcggacttggccttggccctagagaaccagcgctggaacctcacgtggagcctaaggatgctgccgccctccttacccgccagccaattctgcaggactgtgatcttgccaccgtggccttgtcccccccaccacctgctggcgcgcgggccacacacctgcaggtctcttcccatgatgatttgcggactccagcccccggcgaggagcaccgcgcgcagctgctccggggaagaaaccaagtggcttttacagaggtcatgggtatgctttggaggcgcctgaacgactccggcaagaattggcggcatgtctacaaagctcttactcttcttgactaccttttaaagacggggagcgaacgtgtggcacatcagtgccgggaaaacttatataccatacagacactcaaggatttccagtacatagatagagacggtaaggatcagggcgtgaatgtccgagagaaagttaagcaggtgatggcccttctgaaggatgaggaacggctaagacaggagagaactcatgcccttaagacgaaggaacgaatggcccttgagggcattggaataggttcagggcagcttggtttcagtaggagatatggtgaagactacagccgatctaggggaagtcctagctcttataattcctccagctcctcccctcgctacacgtccgacttagaacaagccagaccacagacctcaggggaggaggaactgcaactgcaactggccctggccatgtcacgcgaggaagccgagaaagaggttaggtcttggcagggagacggctccccgatggcaaacggggccggcgcagtcgtgcatcatcagagagaccgcgaacctgagagggaagagcgcaaggaagaggaaaagctgaaaacttctcagagttccattctcgacctggctgacatctttgtccccgcattggcgcccccttccacgcactgctccgccgatccttgggatatccctggatttagaccaaatactgaagcctccggctcaagttggggcccctccgcagacccgtggtcccccataccctcaggcaccgtgctatccagatcccagccttgggaccttacacctatgctttcgtcctctgaaccatggggcaggacccccgtcttgcctgccgggccccctacaaccgacccgtgggctctcaactcaccccatcacaaactgccatctactggcgctgatccttggggagcttcgctagagactagtgataccccaggtggcgccagtactttcgatccatttgctaaacccccagaaagtaccgagacaaaggagggtctcgaacaagctttaccgtcaggcaagccctcttccccagtggagctcgacctgtttggagacccatccccctcgtctaaacagaacggcacaaaagagcccgatgctttagacctgggcatcttgggagaagctctgacacaaccttctaaggaggcccgggcctgtagaacacctgagagttttctaggccccagtgcgagtagcttggtgaaccttgattccctcgtcaaagcaccccaagtggccaagacacgaaatccattcctcacaggtctgagtgccccgagcccaacgaatccatttggagccggggaacccgggcggccaacattgaatcagatgagaactggctcccccgcgctcggtctggcaggaggcccagttggggcacccctgggtagcatgacatactctgctagcctgccgctgccacttagcagcgtccccgccggactgaccctcccagcctccgtgagcgtgtttcctcaagctggcgcatttgccccacagcctctgcttccgacacctagtagcgctggtccgcgaccccctcccccacagaccgggacaaatccgttcctgtag

SEQ ID NO: 115960 - DNA, 753 bp, Artificial Sequence
  Description of Artificial Sequence: Synthetic coding sequence
atggggatgttatggagaaggctgaatgattccggcaagaactggcgacacgtgtataaggcactcacgttactggattacctgctaaagactggaagcgaacgcgtggctcaccaatgcagggagaatctgtatacaattcagaccctcaaagatttccagtatatagaccgggatggcaaagaccagggagttaacgttagggagaaagttaaacaagtgatggctctgctgaaggacgaggaacgcctaaggcaagagaggacacacgcgctgaagacaaaggaacgtatggccctggaggggattgggatcggaagcggtcagctgggctttagcagacgctatggagaggactactctcgcagcaggggcagcccctcctcttacaattcgagctctagttctccacggtatactagtgaccttgaacaggccaggcctcagactagcggcgaagaagagctgcagctgcaactggccttggctatgtcccgcgaggaggctgagaaagaggtacgcagctggcagggcgacggaagtccaatggcaaacggggcgggggccgtggtgcatcaccagcgagatagagagcccgagagagaggagcggaaggaagaggaaaaactcaagacctcacaggtgttgggccgaacacagagaccagtagatccacccggtggactgttacaaacaccaggtctccgttccccacaggagccttcctgcccagaggcaagccccggtatctag

SEQ ID NO: 115961 - DNA, 429 bp, Artificial Sequence
  Description of Artificial Sequence: Synthetic coding sequence
atgagccttttacccgtcccctacacagaagccgcttcattgtctacaggctccacagtcactatcaagggccggcccctggcctgtttcttaaacgaaccatacctgcaggtcgacttccacaccgaaatgaaggaggaaagcgacatcgtttttcactttcaggtttgtttcgggaggagagtagtgatgaatagccgggagtacggcgcttggaaacagcaagtggaatccaaaaacatgccctttcaggacggacaggagtttgagctgagcatttccgtcctgcctgataagtatcaggttatggtgaatggccagtccagctacacattcgaccatcggatcaaaccagaagccgtgaagatggtccaggtctggagagatatcagtctgaccaaattcaatgttagctatctgaaacggtag

SEQ ID NO: 115962 - DNA, 828 bp, Artificial Sequence
  Description of Artificial Sequence: Synthetic coding sequence
atgaacatgacgcaggctagagtcctggtcgcagctgtggtgggactcgtggccgtgctcctatacgccagcatccacaaaatcgaggaagggcatctggctgtttattacagagggggtgccctcctgactagtccctccggaccagggtatcatattatgctccctttcattactaccttcagaagtgtgcagacgaccctccagactgatgaagttaaaaacgtgccatgtggaacgtctggcggtgttatgatatatatcgacagaatagaagtggtaaatatgttggcgccctatgccgtttttgatatagtgcggaattataccgccgattacgacaagactctgatctttaacaagatccaccacgaactcaaccaattctgtagcgctcatacgcttcaggaggtctacattgagctgtttgatcagatcgatgagaacctgaagcaggcactccagaaagatctcaacctgatggcccccgggctgactatccaggccgtgagggtgaccaaacctaaaattcctgaagccatcaggagaaactttgaactcatggaggcagaaaaaaccaagttgctcattgcagcacagaaacagaaagtcgtggagaaagaggctgagactgaaaggaagaaggccgttattgaagcagagaagatcgctcaggtggctaagattaggttccagcaaaaagtgatggagaaggagacagaaaagcgtatctccgaaatcgaagacgctgcatttctggcacgcgaaaaggccaaagccgatgccgaatactatgctgcccacaagtatgccacctcaaataaatag

SEQ ID NO: 115963 - DNA, 699 bp, Artificial Sequence
  Description of Artificial Sequence: Synthetic coding sequence
atgatctacatagaccggattgaggtggtgaatatgctggccccctacgcggtgtttgacattgtgcgaaattatacggcagattatgataagaccctaatctttaataaaatccaccacgaactcaaccaattttgtagtgcccacactctccaggaagtatatattgagctgttcgaccagatcgatgagaacctgaaacaggctctacagaaagacctgaatcttatggcacctggactcacaattcaggccgtgcgggtcacaaagcctaaaatcccagaagccatacgtcgcaatttcgagcttatggaggctgaaaaaacgaaactcctgatcgccgcacagaaacagaaagtggttgagaaggaggccgaaacagagcgaaaaaaagcagtgatcgaggcagagaagatcgcccaggtagctaagatccgattccagcagaaagtgatggaaaaggagaccgagaagaggatctccgaaatcgaggatgccgccttcctggctcgggaaaaagccaaggcggacgccgaatattatgctgcccacaaatatgcgaccagcaacaagcataaacttacacctgaatacctagaacttaaaaagtaccaggctatcgcctcaaactccaagatttattttggaagcaacatccccaacatgttcagcatctccagatgcggccctcgaggctag

SEQ ID NO: 115964 - DNA, 1047 bp, Artificial Sequence
  Description of Artificial Sequence: Synthetic coding sequence
atgaacatgacacaagcccgggtcctagtcgcagcagtggtcggactggtggctgtcctgctttatgcttcgatccacaagatcgaagaaggacacttggcggtgtactacagaggtggtgccctgctgacgagtccgagtgggcctggataccacattatgttgcccttcatcaccacctttcgctcagtgcagacaaccctgcagactgacgaggtgaaaaacgttccctgcggaacatccggcggagtgatgatttatatcgatagaattgaggtagtgaacatgctcgcaccatacgccgtattcgatatcgtcaggaactacacagccgactacgacaagacgctgattttcaataagattcaccacgaactgaaccaattctgcagtgcacatacacttcaagaggtgtacattgaactttttgaccaaattgacgagaatctgaagcaggcattgcagaaggatctgaatttgatggctcctggcctcactattcaggccgtgcgtgtgactaagcccaagattcccgaagctatcagaagaaattttgaactgatggaagctgaaaagaccaagctgctcatcgctgctcagaaacagaaggttgtggaaaaggaagcggaaactgaacgcaagaaagccgttatcgaggccgaaaagattgctcaggtggccaagattagatttcagcagaaggttatggagaaggagacagagaaacgcattagtgagatcgaggatgcagctttcctggcgcgagaaaaagctaaagccgatgcagagtattacgcagcccacaagtacgctactagtaataaacacaagctgacccctgaatacctcgaactgaaaaagtaccaggcaatcgctagtaattcgaaaatttatttcggatcaaacatcccaaacatgttcgtagacagcagctgtgccctgaagtactcggacatcaggacggggcgggagagcagccttccctcaaaagaagccctggaaccgtcaggggagaatgtgattcagaacaaggagtctaccgggtag

SEQ ID NO: 115965 - DNA, 1047 bp, Artificial Sequence
  Description of Artificial Sequence: Synthetic coding sequence
atgaacatgacccaagctcgagtactggtggccgcagtggtgggccttgttgcggtgctgctgtacgcgtccatccataaaatcgaagagggacatctagccgtatattatcgcgggggcgccctactgacatctccctcaggtcccggttatcatatcatgttgccctttataaccactttccgctccgtgcagaccaccctccagacagacgaggtaaagaatgtgccttgcggaacgtccgggggcgtgatgatttatatcgaccgaatcgaggtagttaacatgctggcaccatacgctgtcttcgatattgtaagaaattatactgccgattacgacaagacgcttattttcaacaaaatacatcacgaattgaaccagttctgctccgcccacaccctccaggaagtctatattgagcttttcgaccagattgacgaaaatcttaaacaagccctgcagaaagacctcaatcttatggcccccgggttaacgattcaggccgtgagggttacaaagccaaagattcccgaggcaatccggcggaactttgagctgatggaggccgaaaaaactaaactgttgatagcggcgcagaaacagaaggttgttgagaaagaagctgagaccgaaaggaaaaaagccgtcattgaagcagaaaaaattgcccaggtagccaagattaggttccaacaaaaggtcatggagaaagagaccgagaaacgcatctctgagatcgaggacgccgctttcttggccagagaaaaggcaaaagcagacgccgaatactatgcagcccacaagtatgccaccagcaataaacacaaactgacacccgagtacctcgagttaaaaaagtaccaggctatagcttccaatagcaaaatatatttcggaagcaatatcccgaatatgttcgtggactcatcatgtgcattgaagtactccgatatccggaccggccgggaatcctcacttccctccaaggaggcactggaacccagcggagaaaacgttattcaaaataaggagagtacggggtag

SEQ ID NO: 115966 - DNA, 1020 bp, Artificial Sequence
  Description of Artificial Sequence: Synthetic coding sequence
atggcgcagctcggcgctgtggtggccgtggcttcctctttcttttgtgcgtcactttttagtgccgtccataaaatcgaggagggtcatatcggtgtctactatcgcggcggagcactactgacttccaccagtggccctggttttcatctgatgcttccttttattacgagctataagagcgttcaaactacactgcagacagacgaggtaaagaacgtaccgtgcggcaccagtgggggggttatgatttattttgatcggattgaggtcgttaatttcttggttcctaatgcagtgtatgacatcgtgaagaattatactgctgattatgataaggccctgatttttaacaaaatccaccatgagttgaatcagttctgctcagtccatactctgcaggaggtttacattgagttatttgaccaaatcgacgagaacctaaaattagcactgcagcaggacctgacctcaatggcaccagggcttgttattcaggcagtgagagttaccaaacccaacatcccggaggccatcaggagaaactacgagctcatggaatccgaaaaaacgaagctcttgattgccgcgcagaaacagaaggtggtagagaaggaggcggagacggagaggaagaaggccctgattgaggccgaaaaagtggctcaggtcgctgagataacctatggccagaaagtcatggaaaaagaaactgagaagaagatttctgaaatcgaagatgcggcctttctggcacgggaaaaggcaaaagccgatgcagaatgttacacggccatgaaaattgccgaagccaacaaactgaagctcacgcccgagtatttgcagctcatgaaatacaaggcaattgcgtccaatagcaaaatctattttggcaaggacattccaaatatgtttatggactcagcaggctccgttagtaaacagtttgagggcctagcggataaactttcatttggcctggaggatgagcccttggaaactgccactaaagaaaattag

SEQ ID NO: 115967 - DNA, 459 bp, Artificial Sequence
  Description of Artificial Sequence: Synthetic coding sequence
atggcccaactgggggccgtcgtcgcggtagcttcgtccttcttctgcgcctccctattttcggcagtacacaagattgaagaggggcatataggcgtgtactaccgtggcggcgcactgctaacatcaacaagtggacccggtttccatctgatgctgcctttcattactagttacaagagcgtgcaaactaccctgcagacagacgaggttaagaatgtgccctgtgggacttcaggcggggtgatgatctacttcgataggatagaagtggtcaatttcctagtgccgaatgctgtgtacgatatcgtcaagaattatacggccgattacgacaaggcactgattttcaacaaaattcaccacgagctgaatcaattttgcagcgtgcacacactccaagaagtttatatcgagctcttcgggctagagaacgatttctctcaggaaagttcttag

SEQ ID NO: 115968 - DNA, 1020 bp, Artificial Sequence
  Description of Artificial Sequence: Synthetic coding sequence
atggcacagctcggcgccgtggtggccgtggcttcttcttttttttgcgcaagtttgttctccgcggtacataagatagaggagggacatatcggggtctattacaggggcggggctcttctgaccagtacgagcggtccaggattccaccttatgctcccttttatcacctcttataaatccgtgcagaccactctgcaaacagacgaggtaaaaaacgtgccctgtggcaccagcggtggtgtgatgatctacttcgatagaatcgaagtcgtgaactttctcgtaccaaatgcagtgtatgatattgtcaaaaactacaccgcagattatgataaagcgctaatattcaataaaatacatcacgaattgaatcaattctgttctgtgcataccctccaagaggtttacattgagctcttcgatcagattgatgaaaacctgaagctagccctgcagcaggatctgacttccatggcacctggcctagtgatccaggcagtgagggttaccaaaccgaacatcccagaagctatacgccggaattacgaactgatggaatccgagaaaacaaagctgttgattgctgcacagaagcagaaagtagtagagaaagaggcagagaccgagagaaaaaaggccctaattgaagctgaaaaggtggcccaggtggccgagatcacttacgggcagaaggtcatggaaaaggaaacagaaaagaagatttccgagattgaagatgcagcctttctggcaagggaaaaggccaaagctgatgccgagtgttacacagccatgaaaatcgcggaggccaataaattaaagctcacacctgagtaccttcagctcatgaaatacaaagctatcgcttctaattctaagatatacttcggaaaggacattcccaacatgttcatggactctgctgggtcagtgtcaaaacaatttgagggcctggcagacaagctgagttttggactggaagacgaaccactggaaaccgcgactaaggagaactag

SEQ ID NO: 115969 - DNA, 621 bp, Artificial Sequence
  Description of Artificial Sequence: Synthetic coding sequence
atggcccagttgggagctgtggttgctgtggccagctcgttcttttgtgccagcctgttctctgcggtccacaaaattgaagaagggcatatcggggtgtactaccggggaggagcactgctgaccagcacatccgggcccggattccacctgatgttgccatttattacctcctataaaagcgtgcaaactacgcttcagaccgatgaagttaagaacgtaccttgtgggaccagcggaggagtcatgatttattttgacaggatcgaagtagttaacttcctcgtccctaacgcagtttatgacattgtgaaaaattacactgctgattacgataaagccttgatctttaataaaattcaccatgaattaaaccaattctgcagtgtccatactttacaagaagtgtatatcgaactgttcggcaaaaaagtgtcccccgagcatgctgtgctaaagcaaggctcctggaacccagcttccctgcattgcttgaagcctggctgcctgcagggtgtgatggtgacgtacggccaggaaatgctgaaaaacctcgtattaaggtcctggagccagcggtccagttggaggatgctgatcgccatgcaacaagacccatag

SEQ ID NO: 115970 - DNA, 459 bp, Artificial Sequence
  Description of Artificial Sequence: Synthetic coding sequence
atggcacagctgggcgcagtcgtggctgttgccagtagctttttttgtgcgagtctgttctctgccgtgcacaagatagaggagggacatataggagtttattatagagggggtgccctgctgaccagtacatctggaccgggtttccacctgatgctgccattcataacaagctataaaagcgtgcagaccaccctgcagactgacgaggtaaagaatgttccttgcggtacgtccggcggagttatgatctattttgatagaatcgaggtggtcaattttctggtaccaaatgcagtctatgacattgtgaagaactatacagccgattacgataaggcacttatcttcaataagattcatcacgaactgaatcagttttgcagcgtccacaccttacaggaggtttacattgaactatttggacttgagaacgattttagtcaggagtcctcatag

SEQ ID NO: 115971 - DNA, 4239 bp, Artificial Sequence
  Description of Artificial Sequence: Synthetic coding sequence
atgacaacaaaacgtagcctgtttgtgagactcgtgccatgtagatgcttgaggggtgaggaggaaaccgtgactacactggactacagccactgttccttggagcaggtgcccaaagaaatctttacgttcgagaaaactttggaggaattgtacctggacgccaaccagattgaagagttgccaaagcaactcttcaactgtcagtctctccataaactatcattgcctgacaacgacctgacgaccctccccgcttccattgctaacctaatcaacttacgcgaactcgacgtgagcaaaaacggaattcaggagtttccagagaacatcaagaattgtaaggttcttaccattgtggaggcttccgtcaatcccatttcgaaactcccggacggcttctcacagcttctgaacttgacgcagctgtatctcaatgatgcttttctcgaatttttgcctgccaacttcggcaggttaaccaagctgcagattctcgaacttcgcgaaaaccagctaaaaatgctgccaaagaccatgaataggttgacccagcttgaacgtctggatttgggcagtaatgagttcactgaagttcccgaagtgctcgagcaactttctggattaaaagagttttggatggacgccaacaggctgaccttcatccccgggttcattggaagtctgaaacagcttacctatctggacgtcagcaaaaacaacattgaaatggtcgaagagggcatctcaacttgtgagaaccttcaagatctgttactgtccagcaacagcctgcagcagctgcctgagacgatagggtccctaaaaaacattaccacgctgaaaatcgatgagaatcagcttatgtacctccccgacagtatcggtgggctcatttctgtggaggagctcgattgttctttcaacgaggttgaagccttgcccagctccatcggacagcttacgaacctcagaacgtttgcagcggaccataactatctgcagcagctgccgccagaaatcggtagctggaagaatatcaccgtgctgttcttacacagcaacaagcttgagaccctgccagaggagatgggagacatgcagaagttgaaggtaatcaatctgagcgacaaccgactcaaaaacttgccgtttagcttcaccaaacttcaacagctgactgctatgtggctgagcgacaatcagagtaagccactcatccccctgcagaaggaaaccgactcggaaactcagaagatggtactgaccaactatatgttcccccagcagcctaggaccgaggacgtaatgttcatttcagacaacgagtcatttaacccatctctgtgggaggagcaacgaaagcagagagcacaggtggcttttgaatgtgacgaggataaagacgaacgggaagcacctcctcgagaaggcaacctgaagcggtaccccaccccataccccgacgagctcaagaatatggttaagaccgtgcaaaccattgtacataggctgaaagatgaggagaccaatgaggattccggcagagacctaaagccgcatgaggatcagcaggatattaacaaggatgtgggcgtcaaaacctcagaatccaccaccacagtgaaatctaaggtggacgagcgcgagaaatacatgatcggcaattcagtgcagaagatcagcgagcctgaggctgaaataagtccaggctcattgccagttaccgccaatatgaaggccagcgaaaatcttaagcatatcgttaaccacgacgatgtgttcgaggaaagtgaggagctttcttctgacgaagagatgaagatggcagagatgcgtcctccccttatagagacctccattaatcaaccgaaggtagtggcactttccaacaataagaaggatgataccaaggaaacagactcattaagcgacgaggttactcataactcaaaccagaataactctaattgctcttctcctagtaggatgtctgattccgtgagcttaaataccgattctagtcaggacacatctctctgcagcccagtcaaacagactcacatcgatatcaacagcaaaatcaggcaggaagacgagaactttaattctttactgcaaaatggcgacatcctgaactcttccacagaagagaagtttaaagcccatgacaaaaaagactttaacctacctgagtatgatctcaatgtagaagagcggctcgtgttgatcgaaaagtcagtcgacagcacagcaaccgccgatgacacccacaagttggatcacataaacatgaacctgaataaactgataaccaacgatacctttcagcctgaaatcatggagcggagcaagacgcaggatattgtgttgggaaccagcttcttgtctatcaactctaaagaggaaacagagcatctggagaacggaaacaagtatcctaacctggagtcagtcaacaaggtaaatggccacagcgaggagactagccagagtcccaacaggactgaaccccacgattctgactgttctgttgacctcggcatctcaaaatctacagaggatctgtcaccccagaagtcaggcccggtgggatctgtcgtgaagtcacattctattacaaatatggaaattggcgggcttaaaatatatgatatcctttcagacaatggcccgcagcagccatcaacaacagtcaagatcacaagtgccgtagacggcaaaaacattgtacggagtaagtccgcaacgctgctctatgaccagcctctgcaggtttttaccggcagcagttcctctagtgatctcatcagcggtacgaaagctatctttaagtttgacagtaatcacaaccctgaagaacctaatattatcaggggacctaccagtgggccacagtccgccccccagatctatggcccaccgcagtacaatatacagtattccagctcagctgctgtgaaggacacgctctggcacagtaaacaaaacccacagattgaccacgctagtttccctccccagcttctcccccggtctgagtctacggagaaccaatcctatgctaagcactcggctaacatgaactttagtaaccacaacaatgtgcgggcaaataccgcatatcatcttcaccaacgcctaggtcctgccagacacggtgagatgtgggcaatctcaccaaacgataggctaatccccgctgtgacaagatcaactatccaaaggcagtctagcgtctcatcgacagcaagcgtgaacctgggcgatccagggtcaactcggcgcgcacaaattcccgaaggcgactatctgtcttatcgggaattccactcagctggacggaccccacctatgatgccagggagccagcggccgctctctgcacgaacttactccattgacggacccaacgcctcgaggccccagtccgcccgcccttccattaacgaaattcccgaacggaccatgagtgtgagtgatttcaactacagtcgcactagccctagcaaacgcccgaacgctcgagtgggctccgagcactccttattggaccccccagggaagtccaaggtgcctagagactggcgcgaacaggtccttcgccacatcgaggccaagaagttggagaagaagcaccctcaaacatccagttcgggcgacccttgccaggatggtatcttcatcagtggccaacagaattattcatctgcaaccctgtcccataaggacgtgccacctgacagcctcatgaagatgcctttaagtaacggccagatgggccagcccctgagaccccaagcaaactatagccagatccaccatccaccccaggcatcggtagcacggcacccatcaagagagcagttgatcgattacttgatgctgaaggttgctcaccagccgccttacacacaaccacattgttcgcctcggcagggacatgaactcgccaaacaagagattagagtgcgcgtagagaaagacccggagcttgggtttagcatttcgggtggagtcggaggcagaggtaatccatttaggcccgacgatgatggcatattcgtgactcgagtgcagcccgaaggtcccgcatctaagttactccagcccggagataaaataatacaggctaacggctatagtttcatcaacattgagcacggacaggccgtaagtttgctgaagaccttccaaaatactgtcgagttgatcattgtgagagaggtgtcaagctag

SEQ ID NO: 115972 - DNA, 3909 bp, Artificial Sequence
  Description of Artificial Sequence: Synthetic coding sequence
atgaccactaaaagatcactgttcgtaaggctggtaccgtgcaggtgccttcgcggcgaagaggagactgtgacgacactggattatagccactgttctttggaacaggtgcccaaagagatcttcacattcgagaaaaccctggaggagctgtatttggacgctaatcaaatcgaggagcttccaaagcagctttttaattgccagtctttgcataaactgtcacttcccgataatgatctgaccactctccccgccagcatcgccaatctaattaaccttcgggaattagacgttagcaaaaacggaatccaagaattccccgagaatatcaagaattgcaaggtgctaacaatcgttgaagctagcgtcaaccctattagcaaattgccagacggcttttctcaactactaaatttaactcagttgtatttaaacgacgccttcctcgagttcctacctgctaactttggtcgactgaccaagttgcagattctggagctgagggagaatcagctgaaaatgctccccaaaacgatgaatcgcctgacacagctggagcggttagatctcgggagtaacgaatttacagaagtgccagaggtcctagaacagctctccggtcttaaggagttttggatggacgcaaacagattgacatttatcccgggcttcatcggctccttaaagcagctgacctacctagatgtaagcaaaaataacatcgagatggtggaggaggggatcagcacctgcgagaatctacaggacttattgctgtcttccaacagcctgcagcagctgccggagactatcggctccttgaaaaacattaccacactgaagattgacgaaaatcagctcatgtatctcccagatagcatcggtgggctgatatccgtcgaggaacttgactgctctttcaatgaggttgaggcgctcccatcctctattggacagctcactaatctgagaacctttgctgccgaccataactatctccaacaacttcccccagagattggctcctggaagaatatcaccgtgttatttttgcacagcaacaagctggaaactctgccggaggagatgggtgacatgcaaaagctcaaagtgatcaatttgagtgacaataggctgaaaaacttgccctttagctttacaaagctgcaacaactgaccgccatgtggctctccgataaccaatcaaagcccctcatacccctccagaaagaaacagactctgaaactcagaagatggttttgaccaattacatgtttccacaacaacctcgtactgaggatgtgatgtttatcagcgacaacgagagctttaatcctagcctgtgggaagaacagagaaaacaaagagcccaggttgcattcgagtgcgatgaggataaggacgagagggaagctcctccaagggaaggcaacctgaagagatacccaacaccttatccagacgagctaaaaaacatggtcaagactgtacagacaattgtgcatcgcttaaaggacgaagagacgaatgaagactccggccgcgatttgaaacctcacgaggaccagcaggacatcaacaaggatgtaggcgtgaaaacttctgaaagcacaaccacagtcaagagtaaggtcgacgagagagagaagtacatgattggcaactcagtgcaaaaaatctcagaaccggaggccgaaatttctcccggatcactgccagtgactgcaaacatgaaggcctcagaaaaccttaagcacattgtgaatcacgacgatgtcttcgaagaatctgaggaactaagctccgacgaggagatgaaaatggccgaaatgcggccccctctgatcgagacaagcataaatcagcccaaagtggtcgcgctgtcaaacaataaaaaagacgacacaaaggagacagactccctcagtgatgaggtcacccataattcaaaccagaacaactctaactgtagctctccgagccggatgtccgactccgtcagcctgaacactgacagcagccaggacactagcctgtgttcacctgtcaagcagactcatatcgacatcaatagcaaaatccggcaggaggatgagaatttcaatagtttgcttcaaaacggtgacatactgaacagctctactgaggagaagttcaaagcccatgacaagaaggatttcaaccttcccgaatacgacctcaatgtggaagaacgcctggtcctaatcgagaagagcgtcgacagtacggccactgcagatgacactcataagctggaccacatcaacatgaatctgaacaagctgattaccaacgatacgtttcaacccgagatcatggagcggtcgaagacccaggatatagtcctcggtacgagtttccttagcataaatagtaaagaggaaaccgagcacctcgagaacggcaataagtacccaaacctcgaatctgtgaacaaggtcaacggtcatagcgaagagacatctcagagccctaaccggactgagccacatgactctgattgtagtgtggacctagggatttccaaatccacagaagatctgtcaccccagaagagtggaccagtgggtagcgtggtgaagtcccattccatcactaacatggagattggcggccttaagatctatgacattttgagcgacaacggcccacagcagccaagtactaccgtgaaaatcacaagtgcagtggacgggaaaaatatcgtgcggtccaagtctgctacactgctgtacgatcaacctttgcaggtgttcacaggcagttcaagttcaagcgacctaattagtgggaccaaggcaatcttcaagtttgattccaatcataaccccgaggagcctaatataatccgtgggcctaccagcgggccacaatcagctccccagatttatggacccccgcaatacaatattcaatattcctcgtccgctgcagtgaaggacaccctgtggcacagcaagcagaacccacagatcgaccacgcctcttttcccccccagctacttcctcgaagtgaatctaccgaaaatcagagctacgcgaaacacagtgctaatatgaacttttctaaccacaacaacgtgagagctaatacagcctaccacctccaccagcgcctcggccccgccaggcatggggaaatgtgggccatatctcctaatgatcgcctgattccggcagttacacggagcaccatacagcggcagtcctccgtttcaagcacagcatcagttaaccttggagaccctggctcaacccgtcgcgcccagattcccgagggcgactacctatcctatcgggaattccactctgcagggaggactccacctatgatgccagggtcccaaagacctttatccgccagaacctattccatcgatggccctaatgcctcccggccccagtcagctcgacccagcatcaatgaaattcccgagcggacaatgagcgtgtctgactttaactactctagaacatctccatcaaagaggcccaatgccagagtcgggtcagagcactcactgctagatccaccaggaaagtcaaaggtaccccgcgattggcgcgagcaggtcctgcgccacattgaggctaagaaactcgaaaaaatccgtgtgagggtggagaaggatcccgaactgggcttctcgatcagcggaggcgtgggcgggcgtgggaatccttttcggcctgatgatgacggcattttcgtcactcgagtgcagccagagggccctgcctcaaagctgctacagccgggtgataaaattattcaagctaacggttattcattcattaacatcgagcacggccaggccgtgagtttgctgaagacattccagaacaccgtggaattaattatcgtccgcgaggtaagttcttag

SEQ ID NO: 115973 - DNA, 4023 bp, Artificial Sequence
  Description of Artificial Sequence: Synthetic coding sequence
atgactacaaaaaggtccctgtttgtgcgcctcgtcccgtgcagatgtcttaggggagaggaagaaactgtcacgacattggactattcacattgctccttagaacaggtgcctaaggaaatcttcacctttgagaagacccttgaggagctctatctggatgcgaatcagatcgaagaactaccgaaacagcttttcaattgccagagtctgcataaattatccctcccagacaacgatttgacaaccctacccgcctctatcgctaatcttatcaatctccgcgaactggatgttagcaaaaacggaatccaggagtttcccgagaatataaagaattgcaaggtactgactatcgtggaggcctctgtgaatcccatatccaagttaccagacggattttcacagctgctgaatctcactcagctgtatttgaacgatgcttttctggagttcctgccagcaaattttggtagactgacaaagctgcaaattctcgaactgagggagaatcaattaaagatgctgcctaagacgatgaatagactgactcaattagagcgcttggatctaggatccaacgagtttaccgaggttccagaggtgctagaacagctgtccggactcaaagaattctggatggacgccaaccgattgacattcattcccggcttcatcgggtccctgaagcagctgacctaccttgacgttagcaaaaataatatcgaaatggtcgaggaagggataagcacttgcgagaacctgcaggacctactcttatctagcaactcactccaacagctaccagaaaccatcggatccctaaaaaatatcacaactctcaagattgatgagaatcagctgatgtacctacccgacagcatcggcggccttatctccgtagaagagctggattgctccttcaatgaggtagaggcacttcctagcagtatcggacagctgaccaacttgaggacttttgctgcagaccacaattacctccagcaactccccccagagatcggctcctggaagaatatcaccgtgctttttctccacagtaacaagctggagactctccctgaggagatgggggatatgcagaagctgaaggtgattaatctcagcgacaaccgcctgaaaaaccttccatttagcttcaccaaactgcagcagctgacagccatgtggctgagtgataatcagagtaagccactgattcccctacagaaggaaaccgactcagagacccagaaaatggttctgacgaattacatgttccctcagcagccacgtactgaagacgtgatgttcatttcagacaacgaatcatttaacccatccctgtgggaggagcagagaaagcagagggcacaggtcgctttcgaatgcgacgaggataaggacgagcgcgaggctccaccccgagaggggaatcttaaacggtatccaaccccttacccagacgagctgaaaaatatggtgaagaccgtgcagactatcgtgcacagattgaaagatgaggaaaccaacgaggatagcgggagggatttgaaacctcatgaggaccaacaggacattaacaaagacgtcggggttaagacaagtgagtctaccaccactgtgaagagcaaagtcgatgagcgagaaaaatacatgattggaaactccgttcagaaaatttcagaacctgaagctgagattagcccgggatcactgcccgtgacagccaacatgaaagcgtcagagaacctcaagcatattgtgaatcacgacgatgtctttgaggagagcgaagaactgtcttctgacgaggagatgaagatggcggaaatgcgtccacctcttatcgagacatccattaatcagcccaaagtggtggccctgtctaataataaaaaagacgatacaaaagagactgactcccttagtgacgaagtcactcacaacagcaaccaaaacaactccaactgttcctccccaagccggatgagtgatagcgtgtcactgaatacagacagttctcaggataccagcctctgctcacctgtgaaacaaactcacatcgatatcaactctaagattcgtcaggaagatgagaactttaacagcttgctccagaatggtgatatactgaattctagtactgaggagaaattcaaggcccacgataagaaggactttaatctccctgaatacgacctgaatgtcgaagagcgactggtgctgatagagaagagcgttgactcaactgctacggcagacgacactcacaagcttgatcacattaacatgaatctcaacaagcttatcaccaacgatacgttccagcccgagattatggagagaagcaagacacaagacatcgtcttgggcacttcgtttctttccatcaatagcaaagaggagacagagcacctggaaaatggcaataaatatccaaatctggagagcgtgaataaagtcaacggacactcggaggagacctctcagtccccaaatcgcacagagccccacgacagcgactgtagtgtcgaccttgggatctccaagagtaccgaagatctcagcccacaaaagtcagggccggtgggctcagtggtgaagtctcacagtatcactaacatggagatcggcggactgaaaatctatgatatcctctctgataatggaccacagcagccaagtactaccgtaaagattacgtctgcagtcgacgggaaaaatattgtcagaagcaaatccgccacgctgttatatgatcaaccgcttcaggttttcactggcagcagtagcagcagcgacctaataagtggcaccaaagctatctttaagtttgatagtaatcataatccggaagagccgaatataatcaggggcccgacgtccggaccccagtctgccccacagatttacggcccaccccaatacaacatacagtactcttccagcgccgccgtcaaagataccctgtggcactcgaagcagaatccccaaatagatcacgcatctttccctcctcaactcctgccgcgctctgagagcaccgagaaccagtcatatgctaagcacagcgcaaacatgaactttagcaatcacaacaatgtccgcgccaatactgcctaccatctgcatcagcggctgggccccgcgcgccacggcgagatgtgggcaattagcccaaatgatcgtctcatcccagctgtgacccgaagcaccattcagcggcaatccagtgtgtcttcaacagcatcagtgaacctcggagatcccggcagcacaagaagggctcagatcccagagggcgattacttatcttacagagagttccacagtgctggaaggacaccaccgatgatgccggggtcacagcgacctctgtctgcccgaacctatagcatcgatggcccaaatgcttcgcgcccccaaagtgctagaccctccatcaatgagatccccgaaagaactatgtcagttagcgactttaattattctagaacgtctcccagtaaacgccctaatgccagagtggggtcagaacactccctactggacccacctgggaaatctaaagtgcccagagactggcgcgagcaggtgctgcgccacattgaggccaagaaactcgagaaaatgcctctgtccaacggccagatggggcagcccttgcggccacaggccaattacagtcagattcatcatccgccacaggcatctgtggccaggcacccctcccgtgagcagctgatcgactacctcatgctaaaagtggcgcatcagccaccctatacacaaccacactgttcaccacgccaaggccacgagcttgcaaagcaagagggaatcttcgtcactcgggtgcagccggagggcccggcttccaaacttctccaacccggcgataagataatccaggccaatggctatagctttatcaatattgaacacggacaggcagtaagcttgctgaaaacattccaaaacaccgtcgagctgattattgtacgcgaggtttcttcttag

SEQ ID NO: 115974 - DNA, 4041 bp, Artificial Sequence
  Description of Artificial Sequence: Synthetic coding sequence
atgacaacaaagcgatctctgttcgtgagattggtaccgtgcagatgtctcaggggggaggaagagaccgtaaccactctcgactactcccattgttcacttgagcaagtgcctaaggaaatttttacattcgagaaaaccctggaggagctatacctggacgcaaatcagattgaggagctgcccaaacagctatttaattgccaaagcctccataaattgtctttgcccgataacgacctgacaacgctgcctgcttcaattgcaaaccttattaacttacgggagctggatgtgtcgaagaatggaatccaagaatttcctgagaacattaaaaactgtaaggtgctgaccatcgtggaagcgtctgtgaacccaattagcaaacttcccgacgggttttcacaactcctcaatctgacccagctttacctgaacgatgcctttcttgagtttctgccggctaacttcggacgcttgaccaaactgcaaatcctagagctccgggaaaaccaactgaagatgctgccgaagaccatgaatagacttacacagcttgaacggctggatctgggcagcaatgagtttacagaggtgccggaagtcctcgagcagctctccgggttaaaggaattttggatggacgcaaatagactcacttttatccccggtttcataggttctcttaaacaacttacttatttggacgtgagcaaaaacaatatcgagatggtggaagagggaatcagcacctgtgagaatctacaggacctgttgctttcatccaactcactgcagcagctgcctgaaaccataggtagcctgaaaaacattacaacactgaaaattgatgagaaccagcttatgtacctcccagatagcatcggaggtctcatctctgttgaggagcttgactgctcttttaacgaggtagaggccttaccctcaagcattgggcagctcactaacctgcgaacatttgctgccgaccataattacctacaacagcttccccctgagatcgggagctggaagaacattaccgttctttttttacactccaataaactcgagactctcccggaagagatgggcgatatgcagaaattaaaggttatcaatctcagtgataaccgtctaaaaaatctgccattttcctttaccaagctgcaacagttgaccgccatgtggctgtcagacaaccagagcaaacccttaatacccctccagaaggagacagatagcgagacacagaaaatggtgctcaccaactatatgtttccacagcagcctcggaccgaggatgtaatgttcatcagcgacaatgagtcctttaatcccagcctttgggaagagcagcgaaagcagagagcccaagtggctttcgagtgcgacgaagataaagatgagcgcgaggctccacccagggagggtaatctgaagagatatccaacaccgtaccccgacgagctcaaaaatatggtgaagacagtacagacgatcgtccatcgcctaaaggacgaggaaacaaatgaggacagcggacgggatctgaagcctcacgaagaccaacaagatatcaataaggacgtcggtgttaagacatcagaatctacaaccaccgtgaaaagcaaggtcgatgaaagggagaagtacatgatcggcaacagtgttcaaaagatctcagagccagaggctgagatctccccaggaagcctccccgtgactgctaacatgaaagcctcagagaacctgaagcatatcgttaatcacgacgatgtttttgaggagagcgaggaactgagctcagacgaggaaatgaaaatggccgaaatgagacctcccttaatcgagacctcaattaatcagcctaaggtggttgctctctctaacaacaagaaggatgatacgaaggaaacagattcgctctctgatgaggttacgcacaacagcaaccagaataattccaactgtagttctcctagcaggatgtctgatagtgtctccctcaataccgattcctcacaggacactagtctgtgttctccagtcaagcagacacacatcgacattaattccaagatcagacaggaggatgaaaacttcaattctctcctccagaacggcgatatcctgaatagcagcaccgaagaaaagtttaaagcccatgacaaaaaggactttaacctgcccgaatacgatctgaacgtcgaagaaagactggtcttgattgaaaaaagcgttgactctacggctactgctgacgatacgcacaagctggaccacattaacatgaacttaaacaagttgattaccaatgacacctttcagccagaaatcatggaaagatctaagacgcaggacatagtgttagggacctccttcctctctatcaactctaaggaagagaccgagcatttggagaatggtaataaatacccgaacctcgaatccgtaaataaggttaatggccattcagaagaaacctctcagtcccccaaccggacagagccccacgatagcgattgttcggtcgatctgggcatctccaaatctacggaagatctttctccacagaagtctggcccggtcggatctgtggtaaaatcgcacagtatcactaacatggaaattggcgggcttaaaatatatgatatcctctccgataatggaccccaacagccgtctactaccgtcaaaattactagcgctgtagatgggaaaaacattgtcagatccaagtccgcgacattgctatatgatcagcctctgcaagttttcacaggttcaagttctagtagtgatctgatctctggaactaaggccatcttcaagtttgacagcaaccacaaccccgaggagcccaatatcattaggggccctactagcggccctcaaagcgctcctcagatctacgggccgcctcaatataacatccagtattcttcatctgcagcggttaaggataccctttggcactctaaacaaaatcctcagattgaccacgcaagcttcccccctcagctgctgccccgatctgaaagcaccgagaatcaatcatacgccaaacatagtgcaaacatgaacttttctaatcacaataatgtccgggccaacacggcttaccacctgcaccaacgcctgggacctgctagacacggggagatgtgggcgatctcgccaaacgataggctgatccccgctgtaactcgatctactattcagcggcagagcagcgtctccagcactgcaagtgtgaacctgggtgatccaggttcaacaaggagagcacagatcccagaaggcgactacctcagctatcgcgaattccactctgcaggcaggaccccccccatgatgccggggagtcagcgaccccttagcgctagaacttatagtatcgacggtcccaacgcctcacgtccccaaagtgcaagaccttctatcaacgaaatccccgaacgaacaatgtcagtgagcgattttaattactcccgaacaagccctagcaaacgacctaacgcccgggtgggatcggagcacagcctcctggaccccccaggcaagagcaaggtgccaagggactggcgggagcaggtgctgaggcatattgaagctaagaagctggaaaaaatgcctttaagtaatggacagatgggtcaacccctgagaccccaggccaattatagtcagatacatcacccacctcaggctagcgtggcccggcatccctcccgggagcaactgatagactaccttatgctgaaggtggctcatcaacccccctatacccagccccactgttcaccacgccagggccacgagctggccaaacaagagatcagagttcgagtcgaaaaggatcctgagctgggtttctcaattagtggaggtgtgggggggagaggcaacccctttcgccccgacgatgatgcaaatggttacagcttcatcaatatcgaacacgggcaggccgtgtccctgctcaagacatttcaaaacaccgtcgagctgatcatcgtcagggaagtttcttcttag

SEQ ID NO: 115975 - DNA, 4083 bp, Artificial Sequence
  Description of Artificial Sequence: Synthetic coding sequence
atgaccactaagaggtctctgttcgtcaggctggtaccgtgtcgctgcctgagaggggaggaggaaactgtgaccaccttagactattcccactgctcgctggaacaggtccccaaggagatcttcacatttgaaaagacactggaggaactgtatctggatgcaaaccagatagaggagcttcctaagcagctcttcaactgtcaaagtctgcacaaactgtcactcccagacaacgatcttactactctacccgcgtctatcgcaaacttgatcaacttaagagagctggacgtctcaaagaatggcatccaggaatttccggagaacattaagaactgcaaggtgctgaccattgtggaagccagcgtaaatcccattagcaaattgccagacggcttctcccagctgttaaacctcacgcaattgtatttgaatgacgccttcttggagtttttacccgcgaactttggtaggctcacgaagctgcagatcttggagctccgggagaatcagttaaagatgcttccaaaaaccatgaatcggctgacccagctggaacgcctggaccttgggtccaacgagtttacagaagtgcccgaagtgctggaacagctgtcgggactgaaagagttttggatggacgccaataggctaacatttattcccggattcattggaagcctgaagcagctgacctatttggatgtcagcaaaaataatattgaaatggtggaggaagggatatccacatgcgagaatcttcaggatctcctcctctcctcgaattcccttcagcaactgcccgagaccattgggtccctcaaaaacattactactctgaagatcgatgagaaccaactgatgtacctgcctgatagtatagggggtttaatcagcgtggaagaacttgactgctcgttcaatgaagtggaggccctgccctcttcgatcggacagctcaccaacctgaggaccttcgccgccgaccataactatctgcagcagctgccgccagaaatcggttcctggaaaaatatcacagtgctttttctgcacagcaataaacttgagaccctgcccgaggagatgggggacatgcaaaagctcaaagtgattaacctttctgataataggctgaaaaatctcccttttagcttcactaagctacagcagcttaccgcaatgtggctcagcgacaaccaatcaaagcctctgattcctctgcaaaaggaaaccgactcggaaacccaaaaaatggtgctaacaaactacatgtttcctcaacagcctagaaccgaagatgttatgtttatttccgataatgaaagtttcaacccttctctatgggaagaacagagaaaacagagggcgcaggtggcattcgagtgtgatgaagataaggatgaaagagaagctcctcctcgtgaggggaatctgaaacggtacccgaccccataccctgatgagctgaaaaatatggtgaaaacagtgcagacaattgttcataggctaaaagatgaggaaacgaacgaggattcaggacgagatcttaagccccatgaggaccaacaggacatcaacaaagatgttggagtcaagacatcagagagcaccaccacggtgaagtccaaggtagacgagcgcgaaaaatacatgattggaaacagcgtgcagaagatttcagaacctgaagcagaaatctccccagggtctctccccgtaaccgccaacatgaaggccagcgagaatctgaaacacatagtaaatcatgacgatgtcttcgaagaatccgaggagctctcttccgatgaagaaatgaagatggccgaaatgcgaccaccgctgattgaaacaagcatcaaccagccaaaggttgtcgcactgtctaacaataagaaagacgatacaaaggaaacggattccctgagcgacgaggttacccacaacagtaaccagaataatagtaattgctcatcacccagccgcatgtctgacagcgtctccctcaatactgatagtagccaggacacctccctgtgctctcccgtcaagcaaacccacatagatattaactcaaagattaggcaagaggacgaaaactttaattccttgctccagaatggagacatcctgaattccagcacagaagaaaagtttaaagctcatgataagaaagatttcaacttgcctgagtacgacctgaacgtagaggagagacttgtgcttatcgagaagagcgtggacagcacggctaccgccgacgacacacacaaacttgatcacatcaatatgaacttgaataagctgattacaaacgataccttccagcccgaaatcatggagagatcaaaaacgcaggacatagtgctgggtactagtttcctcagcatcaatagcaaagaggaaaccgagcacctggaaaacggcaataagtaccccaatctcgaaagcgtgaataaggtaaatggccactcagaagagacctcgcagagtccaaaccgtacggaacctcacgattctgactgctcagtggatctcggaatcagtaagagtactgaagacttgtctccccagaagagtgggccagtgggtagtgttgtcaagtcgcacagcatcaccaatatggagatcgggggcctgaaaatatatgacattctgtcagacaacggccctcaacagccctcgactacggtgaaaatcactagcgcagtggacggtaagaatatagttcgcagtaagagtgccacactcctgtacgatcagccactgcaggtctttactggtagcagctcctcaagcgaccttataagcggcacaaaagcgatctttaagttcgactccaaccacaatccggaggagcctaacattatccgaggccccaccagtggtccacagtccgccccacaaatctacgggcctcctcaatacaacatccagtatagcagttctgcagctgttaaagataccctctggcattccaagcagaatcctcaaattgatcatgcatcttttcccccacagctcctgccccgatccgagtcaaccgaaaaccagtcatacgccaagcattcagcgaatatgaattttagcaatcacaacaacgtgcgggccaacactgcatatcatctgcaccagagactggggcccgcccgacatggggaaatgtgggccatcagccccaatgatcggctgatccccgccgtgaccaggtcgaccattcaacggcagtcttctgtctcaagtaccgcctctgtgaatctcggggacccaggttctacccgtagggcacagatcccagagggggactacctttcctaccgcgagttccactctgcgggccgtaccccacccatgatgcccggcagccagcgtccactcagtgccagaacttacagtatcgatggcccaaacgctagccgccctcagtctgcccgtccttctatcaatgaaatcccagagcgcaccatgtctgtctcagattttaattacagcagaacaagtccctcaaaaagacctaatgcaagggtggggagcgagcacagcctgttagacccaccgggaaaaagcaaggtgccccgagactggagggaacaggtactcagacacattgaagccaagaaactggagaagatgcctctgagtaacgggcagatgggtcagcccctgcggccgcaggcctctgtggccaggcatcctagtagagaacaactaattgactacttgatgctgaaggttgcccaccagcctccatatacacaaccgcactgctcaccaaggcaagggcacgagcttgccaagcaggaaattagagtgcgggtggagaaagatcccgaattaggcttttccatctctggcggcgtggggggaagaggcaatcccttccggcctgacgatgacggcatctttgtgactcgcgtgcagccggaagggccagcgagtaaactcctccagcccggggataaaataattcaagccaatggatactcttttataaatattgaacatggtcaggctgtaagtcttctcaaaactttccagaacaccgtcgagctgattatcgtgcgagaggtatcgagttag

SEQ ID NO: 115976 - DNA, 4116 bp, Artificial Sequence
  Description of Artificial Sequence: Synthetic coding sequence
atgaccacaaaacgcagtctcttcgtgcgattggtcccgtgcagatgcctgcggggcgaggaagagacagttactactctggactactcgcactgtagcctggaacaggtgcccaaggagatatttacatttgagaagacccttgaagaactttacctagacgccaaccagattgaggaactacccaagcagctgtttaattgccagtcactgcataaactgagccttccagacaatgatcttaccacattgccagcttccattgccaacctgatcaacctcagggaattggatgtttccaagaacgggatccaggagttccccgagaacataaaaaattgtaaggttctgactattgtggaagcttccgtgaatcctatctctaagctgcctgatgggttttcccagctgctgaaccttactcagttgtatctgaacgacgcttttctggagtttttaccagccaacttcggaaggctgacaaaactgcagattcttgagctgcgcgaaaaccagctgaagatgctgcctaaaacaatgaacagactgactcagctcgaaaggctggacttagggagcaatgaatttacagaagtgcccgaagtgcttgagcagctgtccggccttaaagaattctggatggacgccaacaggcttacttttatccccggctttatcgggtcccttaaacagttgacttatctggacgttagtaaaaataacattgagatggtggaagaggggatctctacttgtgagaacctgcaggacctgctcttgtcaagtaatagcctgcagcaactcccagaaactattggcagtctaaagaatatcacgaccctgaagattgacgaaaatcagttaatgtacctgcctgacagcattggaggacttattagtgttgaggagctagactgttctttcaatgaggtagaggcccttccatcatcgatagggcaactcacaaacctgcgaactttcgccgccgaccataattacttgcagcagctaccaccagagataggctcttggaagaacataactgtgctctttcttcatagtaataagttggagacactccctgaggagatgggggatatgcaaaagctgaaggtgattaacctgtctgacaatcgcttgaagaacctccctttttccttcaccaaattgcagcagctgaccgccatgtggcttagcgataaccagtctaagcccctaattcctctgcagaaggagacagatagcgagactcagaagatggtactcactaactatatgtttcctcagcaaccgcgcactgaggacgtgatgttcatttccgacaacgagtcatttaatcctagcctttgggaggaacagcggaagcagcgcgcccaggtggccttcgagtgcgacgaggataaggacgagagagaggctcccccgcgtgaaggcaatctaaagcgctaccctaccccttatcccgacgagctaaagaacatggtcaaaactgtgcagaccatcgtacacaggcttaaagatgaggaaaccaacgaagacagtgggcgggacttaaagccccatgaggatcagcaagacataaacaaggatgtgggggttaaaacatcagagagcactaccactgtcaagagcaaagtggatgagcgtgagaaatacatgatcggcaacagtgtgcaaaagatttctgagcccgaagcagagattagccctggatccctgccagtgactgcaaatatgaaggcttccgaaaatctgaagcatatcgtgaatcatgatgacgtttttgaagaatctgaagagttatcttccgacgaggaaatgaaaatggcggagatgaggccccccctcattgagacctctataaatcagcctaaagtcgtggcgctctctaacaacaagaaggacgatacgaaagaaaccgattccctgagtgatgaggtgacccacaacagtaaccagaataactccaattgttcatcgccttcccgcatgtcagattctgtctcattgaacacagattcttctcaggacacctccctgtgctctcctgtgaaacagacacacattgacatcaactcaaagatccggcaggaggacgagaacttcaactcactcctgcagaatggcgatatcttgaattcctcaacagaagaaaaattcaaggcccatgataaaaaggactttaatttaccagagtacgatctgaacgtggaagagcgcctcgtgctaattgaaaaaagcgtagactccacagcaactgccgacgatactcacaagctagaccacattaacatgaaccttaataagcttatcacaaacgataccttccaacctgaaattatggagcgcagcaaaacacaggacattgtactgggtacctccttcttaagtataaatagtaaagaagagacggagcatctggagaacggcaataagtatccaaacctggagtcagtaaacaaggtcaacggacactctgaggagactagccagagtccaaatcgcacagagcctcatgacagcgattgtagcgtggacctaggcatatctaagagcaccgaggacctgtctcctcagaaatcagggccagtaggatctgtcgtgaagagtcattcgatcactaacatggagatagggggcttgaaaatctatgacatcctctctgataatggtccgcagcagccatccaccaccgtaaaaatcacgagtgctgtggacggcaaaaatattgtcaggtctaagtccgcaacattattatacgatcagccgctgcaggtgtttacaggaagttcttcttcatctgatctgatttccgggaccaaggcaatctttaagttcgattccaatcataaccccgaggagccaaatattatacgcgggcctacctcgggaccacagagtgctcctcagatttatgggccccctcaatataacattcagtattcctcctccgcggctgtaaaggataccctgtggcacagcaaacagaacccccagatcgaccatgccagtttcccaccccaacttctgccacggtctgagtcaaccgaaaaccaatcttacgcgaaacattctgccaacatgaatttctcaaaccataataatgtaagagctaacacagcctaccatctgcatcagaggctgggccctgcccgccacggggaaatgtgggccatttcgccaaatgaccggctaataccggcagtgacaagaagtacaatccagagacagagttccgtgtctagcaccgcctccgtcaacctgggggaccccggaagtacacgccgggctcaaatcccggaaggagactacctgtcttatagggagtttcacagtgcaggtagaactccacctatgatgcccggcagccagcgtcctctgtctgcaaggacatactcaattgacggtcctaatgcctccagacctcagagcgcaaggcccagtatcaacgagattcctgagagaactatgtctgtaagtgatttcaactactccaggacttcacctagtaaaagacccaacgcccgcgttggctccgagcacagccttcttgaccctcctgggaagtctaaggttccgagagattggagggagcaagtgctgaggcatattgaggccaagaagttggaaaagatgcccctctctaacggtcagatgggtcagcccttgcgcccccaggccaattacagccagatccatcatccaccacaggcatccgtggctaggcaccctagccgcgagcaactgatagattatctgatgctaaaggtcgctcatcaacccccttatacgcagccacactgttctccaagacagggtcacgaactggctaagcaagaaataagggtgcgagtcgaaaaagatcctgagttggggttctctatcagcggcggggtgggaggcaggggcaacccattcagaccagacgatgatggcatctttgtgactagagtacaaccggaaggacccgcaagcaaattactgcaaccgggtgataaaattatacaagctaatggctattccttcatcaatatcgagcatgggcaggcagtgtccttgctgaaaacctttcagaacaccgtggaactgattattgtgcgcgaagtctccagttag

SEQ ID NO: 115977 - DNA, 3909 bp, Artificial Sequence
  Description of Artificial Sequence: Synthetic coding sequence
atgaccacgaagcgcagtctattcgtgcgcctggttccctgtaggtgtctacgaggagaggaagaaacagtgaccacccttgattattcccactgcagcctcgaacaggtgcctaaggagatttttacgttcgagaaaaccctggaggagctgtacctggatgcaaatcagattgaagaactgccaaaacagctctttaactgccagtccctgcataagctgtcactgcccgataacgatcttactaccctcccggccagtattgctaatctcattaacctcagagagcttgatgtgtcgaagaacgggatccaagaattccctgagaacatcaaaaattgcaaagttctgaccattgtggaggccagtgtgaatccgatctccaagctgcccgacgggttttctcagctgctgaatctaacgcaactttatctaaacgatgcctttctggagtttctcccagccaactttggaaggctgacaaagttacagatcctggaactgcgtgaaaaccagctaaaaatgttgcccaaaacaatgaataggctcactcaactggagaggctcgatttgggcagcaacgaattcaccgaggttcctgaggtcttagagcaactctctggcctgaaagagttctggatggacgctaacaggctcactttcatcccgggcttcatagggagcctgaaacaactcacctacctcgacgtgagcaaaaataatattgaaatggtagaggaggggatctcaacgtgcgagaatctccaggatctcctgctgagcagtaatagcctccagcagctgccagagacaatcgggtccctgaaaaacataacgacactgaagattgatgagaatcagctgatgtacctgccagattccattggaggcctcataagtgtggaagagctggactgctctttcaatgaagtcgaggctcttcccagttcaatagggcaactgactaatctgagaacctttgcagccgaccataattatttacagcagctgccccccgagatcggcagttggaagaacattacagtgttgtttctgcactcaaacaagctggagaccctgcccgaggaaatgggggacatgcaaaagctgaaggtgatcaacctcagtgacaaccgcctcaagaacctccctttctctttcacgaagttacagcagctaaccgcgatgtggttgtccgataaccaaagtaagccgttgattccgctccagaaagagacggactccgagacacagaaaatggttctgactaactacatgttcccccagcagcccagaaccgaggacgtcatgttcatctccgataatgagtccttcaaccccagcctgtgggaagaacagaggaaacagagggctcaggttgcctttgagtgtgacgaggataaggatgaacgagaagctccacctagggagggtaacctaaaacgctaccccaccccctatcccgatgagctgaagaatatggtaaaaaccgtgcagaccatagtccatcggctaaaagatgaggagactaacgaggactccggacgtgatctgaagccccacgaagaccagcaggatataaacaaggacgtgggggtcaagacatcagagagcaccaccacggttaaaagcaaggttgatgagcgggagaagtacatgattggtaattccgtccagaagatatcagagcccgaagctgagatttctcctggcagcctgcctgtgaccgccaacatgaaggcatccgaaaatcttaagcacattgtgaaccacgacgacgtgttcgaggagtccgaggaattgagttccgatgaggagatgaaaatggctgaaatgaggccaccgcttatcgagacaagcatcaatcagcctaaagtcgtggctctcagcaacaacaaaaaggacgacacgaaagaaaccgactcactttcggatgaagtgacccacaacagcaatcagaacaacagtaattgcagttcccctagtcggatgtctgatagcgtgagtctgaacacagatagctctcaggatacctctttgtgctcacccgtgaagcagacgcacatcgacatcaactcgaagattagacaggaggatgagaacttcaactcattgttacagaacggcgacattctgaacagttccacagaggagaaatttaaggcccacgataagaaggactttaacctgcccgagtatgatctgaacgtggaggaacgcctcgtgctgatcgaaaagagcgttgactcaaccgccactgctgacgacacgcacaagctggatcatatcaacatgaacttgaacaagttgatcaccaatgatacctttcaaccagagataatggaaaggagtaagactcaggatatagtactgggcacgtccttcttgagtatcaattcaaaggaggaaacggaacaccttgagaatggcaataagtacccaaacctggaatcggtgaacaaggtgaacggacactcagaagaaaccagccagagtcctaatcggaccgaaccacacgactcagattgttcagtcgatctgggtataagcaaatccacagaggacctgtccccccagaaatcaggcccagttggctccgttgtgaaatctcattccattaccaatatggaaatcggaggactcaagatttatgacatacttagcgacaacggcccgcagcaaccctctacaacagtgaagatcacaagcgcggtcgacgggaagaatattgtgcgatcaaaatcagcgaccctgctgtacgatcaacccttacaggtcttcacaggaagctcgtcaagttccgacctgatctcgggaaccaaggcgatcttcaagtttgacagcaaccacaaccccgaggaaccgaatatcattcggggacctacatctggaccacagagcgcaccccagatctatggtcccccacagtataatatacagtactccagcagcgctgcggtcaaggacaccttgtggcacagcaagcagaatccacagatagatcatgcgtcgttccccccgcaactcctacctcgaagcgagtcaaccgagaatcagagttacgctaaacacagcgcgaacatgaatttctcgaatcataacaacgttagagccaacaccgcataccacttgcaccagcgccttggaccagccagacacggagaaatgtgggcaatttctcccaatgatagactgattccagcagtgacacgatcaacaattcagaggcagtcttcagtcagtagcaccgcatcagtaaacctcggcgatcccgggagcacgcgacgagcacagatccctgagggggattatttgtcatacagggaatttcacagtgcaggcagaacacctccaatgatgcccggcagtcagcgcccactcagcgctagaacctacagcattgacggacctaatgccagtcgcccccagtcagctaggccgagcataaatgaaattcccgagaggaccatgtcagtttcagacttcaattattccagaaccagtccatctaaacgccccaatgccagggtcgggagcgaacacagccttctcgatcctcctggtaagtccaaagtgcccagggattggcgagagcaggtgttaagacacatcgaagcgaagaagctggagaagatccgcgtgcgagttgaaaaagacccagagctcggatttagtataagtggcggcgtgggcgggagagggaacccttttagaccagacgacgacggaatattcgtcaccagggtccagccagaagggcccgcaagcaagcttctccagcctggcgacaaaataatccaagctaatggctacagctttattaacattgagcacggccaggctgtctctctccttaaaacctttcaaaatacggttgaactcattatcgtcagggaggtgtctagctag

SEQ ID NO: 115978 - DNA, 4260 bp, Artificial Sequence
  Description of Artificial Sequence: Synthetic coding sequence
atgaccactaagagatcgctgtttgtcagactcgttccttgccgctgcctccgtggagaagaggagaccgtcacaaccctggactactcccattgctcactcgaacaagtgcctaaagaaatctttacttttgagaagacgctcgaggaactttacctcgacgcaaaccagattgaggagttgcccaaacagttgttcaactgccagtcgctccacaagttgagcctccccgacaatgacctcactaccctgccagcatcaatcgctaatctcattaatctcagagagctggatgttagcaaaaatggcatacaggagttcccggagaacatcaaaaattgtaaagtgctgactatcgtggaggcgagcgtgaatcccatcagcaagctgcctgacggcttcagtcaattacttaatttaacccaactatatcttaacgatgcctttctggagttccttccggccaactttggcagactcaccaagctgcagatcctggagctaagggaaaaccaactaaagatgctgcccaaaacgatgaatcggttaactcagctcgagcggctggatctgggctcaaatgaatttactgaggtgcccgaggtccttgaacagctgtctggactgaaggagttttggatggacgctaatcggctgaccttcatcccgggattcatcggctcactgaaacagttaacatatctggacgtatctaaaaataatattgagatggtggaggaagggattagtacatgtgagaacttgcaggacctgctgctgtccagtaattcactccagcagcttccagagacgataggcagcttgaaaaacatcactactttgaagatagatgaaaaccagcttatgtacttacccgattccatcggcgggcttatttctgtggaggaattggattgtagctttaacgaggtggaggccctgccatcctctattggccagttgacaaatctcagaacattcgccgcagaccataactacctgcaacagctgccccccgaaataggctcctggaagaatatcaccgtgctcttcttgcacagtaataagctcgaaactttgccagaagagatgggagacatgcagaaacttaaggttatcaatctgtcagacaacagactaaagaatctgcccttctcctttacaaagttgcagcaactgacagctatgtggctcagcgataaccagtccaaacctcttattccattacagaaggaaactgattcagagactcagaagatggtactgacaaattatatgtttccccagcagccacgcactgaggacgtgatgttcatctcagacaacgagtctttcaacccgagcctgtgggaggaacaacgcaagcagagagcccaggtagccttcgagtgcgatgaggataaggacgaacgcgaagccccaccgcgcgagggcaacctcaaaagataccctactccctaccccgatgagctgaagaatatggtgaaaaccgtgcagacaattgtgcacagacttaaggacgaggaaactaatgaggatagtggccgtgacctgaagcctcacgaggaccagcaggatataaacaaggatgttggcgtgaagacaagcgagtctactaccacagtgaagagtaaagtggacgagagggagaagtatatgattgggaattcagtgcagaagatcagcgaacctgaggccgaaatcagtcctggctccctgcccgtgaccgccaacatgaaggcgtctgagaatctcaagcacatcgttaatcatgatgatgtgttcgaggagtctgaagaattgagtagcgatgaagagatgaagatggcagagatgcggccccccctcattgagaccagtatcaatcagcccaaggtggtggccctgtctaacaataagaaggatgataccaaagaaaccgactcacttagcgatgaggtgactcacaactccaatcaaaacaattccaattgctcttctccttcacgcatgtccgattctgtgtcactgaacactgattctagccaggacacttccctgtgctcacctgtcaaacagacccatattgatatcaactctaagatccgccaggaagacgaaaacttcaactctctgcttcagaacggggatatcctgaattcctcaacagaggagaagttcaaagcccatgacaagaaggactttaacctgccagagtacgatcttaacgtggaggaaaggttggtgctcatcgaaaaatcagtggacagtaccgctaccgcagatgacactcacaagctcgaccacattaatatgaacctgaataaactgatcacgaacgacaccttccagccagaaataatggaaaggtccaagactcaggacatcgtgctgggcacgtccttcctgtcgattaactctaaagaggagactgagcatctggaaaacggtaataagtatccaaatctcgaatcagtcaataaggtcaacggccatagcgaggagacctcccagtcccccaatcgaacagagccacatgattctgactgcagcgtagatttgggcatttcaaaatcaacagaagatttgtcacctcagaagagcgggccagtgggatcagtggtgaagagccacagcataactaacatggaaattggcgggctgaagatctatgacattctgtcagataatgggccgcaacagccaagtacaaccgtcaagatcacaagtgccgtggacggcaaaaatatcgtgcggagcaagagcgccacgttgctctacgatcaaccacttcaggtgtttacgggctctagttcctcttccgacctgatctctggaacaaaagccatctttaaattcgactctaaccataacccagaggaaccaaacatcattaggggtcctaccagtggcccacagtccgccccccaaatatacggcccgcctcaatataatattcagtattctagcagcgctgctgtgaaagacaccttgtggcatagcaaacaaaacccccaaatcgatcatgcctcgtttcctccccagcttttgccccgctcggaatccactgagaaccagtcttacgccaaacattcggcaaacatgaattttagcaatcacaacaatgtccgtgccaataccgcttaccatttgcaccagcggttggggcccgcgcggcacggagagatgtgggcgatcagccctaatgacagactcatccccgcagtcacccgcagcacaatccagcgccagagcagtgtcagtagtaccgcctcagtcaatcttggcgatcctgggtcgacgagacgggcccaaatcccagagggcgactaccttagctatagagagtttcactcagcaggacgtacccctcccatgatgccaggttctcagagacccctgtccgccagaacctattcgatcgacggccccaatgcctcgcgcccccagtcagctaggccaagcataaacgaaattccagagcgtactatgagcgtctctgacttcaactattcacgaacttcaccttctaagaggcctaatgcccgggtgggcagtgagcacagccttcttgaccctcctggaaagtccaaggtcccgcgcgactggcgtgaacaagtactgcggcacatcgaggccaaaaaactggaaaaaagcatgttatctaggtccttcaacagcaatttcactacggtaagctcatttcactgcggatccagcagggacctccacggaagccagggatctctggcactgagtgttgccgatcgaaggggtagcggaggtcacatttttcgaatgccactcagtaatggccagatgggccagccgctcaggccccaagccaactactctcagatccaccacccacctcaggccagcgtcgctaggcatccctcgagagaacaattaatcgactaccttatgctgaaagtggcacaccagcccccgtacactcagccccattgctccccccgacagggccacgaattggccaagcaggagatccgggtgagagtggaaaaggacccagaattagggttctctatttctggaggtgtgggaggccgcggcaatcctttccgcccagacgacgacggcatctttgtcaccagggttcaaccagaggggcctgcctccaagcttctccagcccggagataaaatcattcaggccaacggatactctttcatcaatattgagcacggtcaggctgtgagtctcctgaaaacattccagaacacagtcgaattgattatagtccgggaggttagctcctag

SEQ ID NO: 115979 - DNA, 1158 bp, Artificial Sequence
  Description of Artificial Sequence: Synthetic coding sequence
atgaaagaggaagagggctttcccgaggatgaggcgactgaaagtgagacactgtccctggtcaaggagttggatgcatttcctaaggtgcctgagtcgtatgtcgaaaccagtgcctcgggcggaacagtcagcctgattgcctttacaacaatggcccttttaacaataatggagttttccgtgtaccaagacacctggatgaaatatgagtatgaagtagataaggatttttcttctaaactcagaattaatattgacatcactgtcgcaatgaagtgtcaatatgtcggggctgacgtactggacctggccgagaccatggtggcctctgcggacgggctagtgtatgaacccactgtctttgacctgagccctcagcagaaggaatggcagaggatgctgcaactgatccagtcccgattgcaagaagagcattctctgcaagatgttattttcaaatccgcgttcaaatcaacgtccaccgccctccccccacgcgaggatgacagttctcaatctccaaacgcttgcaggatacacggccacctgtacgtgaacaaagtagcgggaaatttccatattacagtgggtaaggccattccccaccctagggggcatgcacatctggccgctctggtcaatcatgagtcatacaatttttctcacaggatcgatcatcttagtttcggagaactcgtacctgccattattaatccgctggatgggaccgaaaaaatcgccattgaccacaatcaaatgttccaatatttcatcacggtggtgccaacaaagttacacacatacaaaataagcgcggatactcatcaattctccgttaccgaaagagagaggattatcaatcatgctgcaggtagccatggagtgagcggtattttcatgaagtatgacttatcctcattaatggtcacagtgaccgaagaacatatgccgttttggcagtttttcgtgcgtctatgcggcattgttggaggaatcttctcaactactggaatgctgcatgggatcggaaagttcatcgtcgaaattatatgctgtaggttcagattgggctcgtacaagcccgtgaatagcgtcccctttgaggatgggcacacagataaccacctgccattactagagaacaacacacactag

SEQ ID NO: 115980 - DNA, 1134 bp, Artificial Sequence
  Description of Artificial Sequence: Synthetic coding sequence
atgagacggctgaatcgtaaaaagaccctaagtctcgttaaggaattagacgcctttccaaaggttcctgaaagctacgtggaaacaagtgcctctggtggaacagtaagcttaatcgcttttacaaccatggctctcttaacaatcatggaatttagtgtctatcaggacacatggatgaagtacgagtatgaagtggataaggatttttcttcaaagctcaggattaacattgacattaccgtggctatgaagtgccagtatgttggagcggacgttctcgatcttgcagagacaatggtggccagtgccgatggtctggtgtacgagcccactgtatttgatctgagtccccagcagaaagaatggcaacggatgctccagcttatacagagcaggttgcaagaagagcacagcctccaggatgtcatcttcaagtcagccttcaaatcaacaagtacagcactgccgcctcgcgaggacgacagcagtcagtcacccaacgcttgtagaattcatggccacctctacgtcaacaaagtggccggcaatttccacatcaccgttgggaaagctatcccacacccccggggacacgcacatctcgctgctctggttaaccatgagagttacaatttttcccaccgcatcgaccacctctcttttggcgaactggtgccggctatcatcaatcctctggacggcaccgagaagattgcgattgaccataaccaaatgtttcagtactttattacagtggtccccaccaagttgcacacctacaagatcagtgccgatacgcaccaattttcagtcacggaacgtgaacgcataatcaaccacgccgcgggctcccacggagtgtcggggatattcatgaagtatgatctgtccagcctcatggtgactgtaaccgaagagcatatgccattttggcagttcttcgtgaggctgtgcggcattgttggcggaatcttttccaccactggaatgctccacggtataggcaagttcattgttgaaattatttgttgcagattcagactggggtcttacaagcctgttaactcagtcccattcgaagatggccacacggacaatcatctgccactgttggagaacaacacccactag

SEQ ID NO: 115981 - DNA, 663 bp, Artificial Sequence
  Description of Artificial Sequence: Synthetic coding sequence
atgcgtcggcttaatcggaagaagacactgagtctggtgaaggagctagacgcatttccaaaggtgccagaatcttatgtagaaacttccgcatccggcggaacagtcagcctgatcgctttcacaacaatggcactactgacaattatggagttctccgtttatcaggatacctggatgaagtacgagtacgaagtcgataaagattttagcagtaaactgagaattaacatcgacataaccgtcgctatgaaatgtcagtacgtaggtgcagatgtgctggatctggccgaaactatggtggcatctgcagacggactggtatatgaaccaaccgtgttcgatctgtctcctcagcagaaagaatggcagaggatgctccaactcattcaaagcaggctccaagaggagcatagtctgcaggacgttatctttaaaagtgctttcaaatctacctcaactgccctgcccccgagggaagacgacagcagccagagccctaacgcttgcagaatccatgggcatctctacgtcaataaggttgcgggaaactttcacatcactgtggggaaagctatcccccatcctagaggccacgcccacctcgccgctctggtgaatcacgagtcttataacttttcacatcggatcgatcatctatag

SEQ ID NO: 115982 - DNA, 216 bp, Artificial Sequence
  Description of Artificial Sequence: Synthetic coding sequence
atgaggcgcctgaaccgcaagaaaaccttaagtttggtcaaagaactggacgcattccctaaggtgccggagtcttacgtagagacttcggcatccggtggcacagtgagcttgattgccttcaccactatggcattgctaaccatcatggaattttccgtttaccaggatacatggatgaaatacgagtatgaggtggacaaggatttcagctag

SEQ ID NO: 115983 - DNA, 528 bp, Artificial Sequence
  Description of Artificial Sequence: Synthetic coding sequence
atgaggagactcaaccggaaaaagactctgtccctcgtcaaagagctggacgccttccccaaggtgcccgagtcctatgtggagacctctgccagcggtggaacagtgtcccttattgcatttaccacaatggctcttcttacaattatggagttcagcgtataccaggacacatggatgaagtacgagtacgaggtagacaaagattttagctcaaagctgcgcattaatattgacattactgtggccatgaaatgccagtacgtcggagccgatgtgttggaccttgcggagactatggttgcatctgcagacggactcgtctacgagcccactgtttttgacctatctccacagcaaaaggaatggcaacgtatgctgcagctgatccaatcccgtctgcaagaggaacactctttgcaggacgtcattttcaagagcgcttttaaatcaaccagcaccgctctcccccctcgggaggacgattcaagccaaagtcctaatgcttgccgcatacacggccactag

SEQ ID NO: 115984 - DNA, 1158 bp, Artificial Sequence
  Description of Artificial Sequence: Synthetic coding sequence
atgcccgaatacaaagggcggaccgtgctggtaagagacgctcaggagggcagcgtgacgttgcagattctggacgttcgcctcgaggatcagggaagctacagatgcctcattcaagttgggaatcttagcaaggaagatacggtaatactgcaagtagctgctccctccgtggggagtttatcaccttccgcagttgcactagcagtgattctgcccgttctcgttctgctgattatggtttgtctgtgcctaatctggaagcagcggagggcgaaggaaaaactcttatatgaacacgtgaccgaggtggacaacctgttatctgatcatgctaaggagaaaggaaagctccacaaagcagtaaagaagctgcgcagtgagctcaaattaaagagggccgccgcaaattcagggtggcgaagagccaggttgcactttgtggccgtgacactcgaccccgacaccgcacacccaaaactcatcctatcggaagatcagcgatgcgtgaggttgggagaccggaggcagcccgtgccggacaaccctcagagattcgactttgtggtatccatcctggggtcagagtactttactacggggtgccactactgggaagtttatgtgggagataagactaagtggattctgggggtgtgttcagaatcagtttctcgaaaagggaaggtgactgcctcccctgccaatgggcactggctgctgcgccagtctagggggaatgaatacgaggctttaacaagtccgcaaacctcctttcggcttaaggagccaccccgctgcgtggggatctttctcgactacgaggccggagtcatctcattctataacgtgaccaacaagtcccacatttttactttcacccacaacttctcaggaccattgcggccatttttcgagccgtgcctccacgacggcggcaagaacactgcaccacttgtcatatgcagtgagctccacaagagcgaggagagtattgtcccgcggccagagggtaagggccatgccaacggagatgtcagtctgaaagtcaacagctcgctgttgcccccaaaggcacccgaactgaaggacatcatactcagtttaccgcccgatctcggacccgctttgcaagagcttaaggccccctccttttag

SEQ ID NO: 115985 - DNA, 1428 bp, Artificial Sequence
  Description of Artificial Sequence: Synthetic coding sequence
atggaaatggcctcctctgcaggatcttggctttcagggtgtctaatccccctcgtgttcctgagactctcagtgcacgtgtctggtcacgccggagacgctggaaaatttcacgtggccctcctaggggggacagccgaactgctgtgcccgctcagtttatggcctggtaccgtacccaaagaagtgcgttggctaagatccccctttcctcagagatcacaagcggtccacatattcagagacgggaaggatcaagatgaagacctaatgcctgagtacaagggaaggactgtgctagtgagagatgctcaggaaggcagtgtgactctccagatcctcgacgtgaggctcgaggaccagggctcataccgatgcctcatacaggtgggtaacctgagcaaggaggatacagtcattctacaggtggccgctccctccgtgggctctctatcaccgtccgccgtggccttggccgtcattttgccggtcctagtactcctgatcatggtttgcctgtgcctcatatggaagcaaagaagggccaaagaaaagctgttgtatgagcacgtgaccgaagtagataacctcctgtccgatcacgcaaaggagaaagggaagttacacaaggcagtgaaaaaactgagatcagagcttaagttgaaaagagccgcagccaactctggctggcgacgcgcacgcctccatttcgtcgcagtgacgttagacccagacacagctcatcccaagcttattctaagcgaagaccaacggtgcgtcaggcttggggataggagacagccagtcccagataatccccagcgcttcgactttgtcgtatccattctcggcagtgagtactttaccaccgggtgccactattgggaagtgtacgtgggcgataaaaccaagtggatcctcggcgtgtgttccgaatcagtgagtcggaaagggaaggtcaccgcatcccccgcaaatgggcattggctcttacggcaatcccggggaaatgaatacgaagcgttaacgagcccccagacctcctttagacttaaggaaccaccacgttgtgtcgggatattcctcgactatgaggcaggtgtaatctctttttataatgttacaaataagtcacacatctttacttttacgcataattttagtggccccctgaggccgttttttgaaccgtgcctgcacgacggaggaaaaaacaccgcccctcttgttatctgttcggagctccacaaatcagaggagtccatcgtcccacgccccgagggcaagggccacgctaacggtgacgtcagtcttaaggttaacagtagtctgctccccccgaaagccccggaattaaaagatataatcctcagcctgcctccagacctcggccccgccctgcaggaactgaaggccccatccttttag

SEQ ID NO: 115986 - DNA, 1428 bp, Artificial Sequence
  Description of Artificial Sequence: Synthetic coding sequence
atggaaatggcgtcatctgctggttcctggctgagcgggtgcctcattcccctcgtcttcctccggcttagtgtgcacgtctctgggcacgctggggacgctgggaaattccatgtggcactgctgggcgggactgccgagctcctgtgtcctttgagcctgtggcctgggacagtgcccaaggaggttcggtggttgaggagcccctttccacagcgatcgcaagctgtgcatatctttagggacgggaaagatcaggacgaggatctcatgccagaatataagggcaggacggtgctggtgagagacgcccaagaagggtctgtaaccttgcagatccttgacgtgagactcgaggaccagggcagctacagatgcttgattcaggttggtaacctgtccaaagaagatacagtcatcctccaagtggccgcaccaagtgtcggctcactctccccgagcgcagttgcattagcagtgattctgcctgtgttagtgctgttaatcatggtatgcttgtgccttatctggaaacagcgcagggcgaaagaaaaactactgtatgagcacgttactgaagtagacaacctgctgagtgaccatgccaaggaaaaaggaaagctgcacaaagcggtaaagaaattgcggtcagaacttaaactcaaacgggctgccgccaatagcggctggagaagggctcgcctccattttgtggccgtcaccctggatccagatactgcccatcccaaattgatactctcagaggaccagaggtgcgtccgtctgggagacagaagacagcctgtccctgataacccccagcgattcgacttcgtggtctctatcctgggatccgaatattttaccacggggtgtcactattgggaagtctacgtgggggacaaaactaagtggatcttaggggtctgctccgaatccgttagcaggaaaggcaaggtaaccgcctcacctgccaatggccattggctcctccgccagagtcgaggcaacgagtacgaggctctgacctcgcctcagacgagctttagattgaaggaacctccacgctgcgtgggcatatttctcgactacgaagctggtgttatctcgttttacaacgtcaccaataagtcccatatctttaccttcactcataatttttcaggacccctgaggccattctttgaaccatgtttgcacgacggcggaaaaaataccgctcccctcgttatttgttcagagctccacaaatctgaggaatctatcgtgccaagaccagagggtaagggtcacgccaatggggatgttagtctgaaggtcaattcttccctgctcccgccgaaagctcctgagctaaaagacataattttgtcattaccccctgatcttgggcccgccctgcaagagctgaaagctccctccttttag

SEQ ID NO: 115987 - DNA, 2595 bp, Artificial Sequence
  Description of Artificial Sequence: Synthetic coding sequence
atgaccacagagaagtccctcgtcactgaagccgaaaattcacagcatcagcagaaagaggagggggaagaggcaattaatagcggccagcaggagcctcagcaagaggagtcttgccagaccgccgcggaaggggataattggtgtgaacaaaagctcaaggcttccaacggtgacaccccgacacatgaggacctcaccaaaaacaaggaacgtaccagcgaatcacgcgggctatctcgcttgttctctagtttcctgaagaggcctaaatctcaagtcagtgaggaggaaggtaaggaagtcgagtccgacaaggagaagggcgagggcggtcagaaggaaattgagtttggcaccagtctcgatgaggagatcatactgaaagcacctattgcggccccggaaccggaactgaagacagacccaagcctggacctgcacagtctgtcctcagcagagactcaacctgcgcaagaggagttacgtgaggaccccgatttcgagattaaggagggtgaaggcctggaggagtgctcaaaaatcgaagtgaaagaggaatctcctcaaagcaaggctgaaacagagctaaaggcaagccagaaaccaattcgaaagcatcggaatatgcactgcaaagtgtctctcctcgacgacactgtttacgagtgtgtggtggagaaacatgccaagggtcaggacctgttgaaacgcgtatgcgagcatttaaatttgctggaggaagactacttcggcttagctatctgggataatgctacttctaaaacgtggctcgatagcgccaaggagatcaagaaacaggtccgcggcgtgccatggaattttacttttaacgtgaaattttaccctcccgatccggctcagctgactgaggacatcactcggtactacctgtgtctgcaactccggcaggacatcgtggcaggcaggctgccctgcagttttgcgacacttgccctgcttgggagctatactatccagtccgagctgggggactatgatcctgaactgcacggggttgactacgtgtctgatttcaaactcgcgcccaatcaaacaaaggaacttgaggaaaaagtcatggaactacacaaatcctacaggagcatgactccagctcaggcggatctggagttcctggagaatgccaaaaaacttagcatgtatggtgtggatcttcataaagctaaggatctggaaggagtggatatcattctgggagtatgttcatcaggcctgctggtgtataaagacaagctgagaataaatcgctttccttggccaaaggtgctcaaaatcagctataagcgcagttccttcttcatcaagattaggcctggcgagcaggagcagtacgaatccacaatcggtttcaagctgcccagttaccgcgctgccaagaagctctggaaagtgtgcgtcgaacatcatacattttttcgtctcacttctacagatactatccccaagagcaagtttctggcattaggaagcaagtttagatactctggacgcactcaggcccagactaggcaggcctcagctttaatcgaccggcctgcccctcattttgaacgtaccgcttctaaacgtgcttcacgaagccttgatggagctgctgcggtggactccgctgatagaagtccgcgccctacgagcgcacctgctattactcaagggcaggttgcggagggaggggtcttggacgcctccgccaagaagaccgtggtacccaaggcccagaaagaaacagtgaaagccgaggtgaagaaggaagatgaacctcccgagcaagcggagcccgaacctaccgaagcatggaaagtcgagaagactcacattgaggttacagtgcccacatctaacggtgaccagactcagaagctcgccgaaaagacagaggatctaattaggatgagaaaaaagaagcgcgaacgcctggatggagagaatatctacatcaggcactctaatttaatgctcgaggacctcgataaatctcaggaggagatcaagaaacatcacgcgtccataagcgaacttaagaagaattttatggagtccgtcccggagccaaggccctctgagtgggacaagcggctcagcacccactccccttttcgcaccctcaatattaatgggcagattccaacaggggaaggacctccccttgtcaagactcaaacagtgactatcagtgataacgctaatgcagttaaatccgagattcccacaaaagacgttcctattgtgcacaccgagaccaaaaccatcacatatgaagccgcacagaccgacgataattctggggatctagaccccggggtgctgttaacagctcagacaataacatccgagacaccatccagcacgacaactacccagataaccaaaaccgtgaagggaggaatctcagagacgcgcattgaaaagagaattgtgattacgggagacgccgacatcgaccacgaccaggtgttggtgcaagcgatcaaagaggctaaagagcaacatccggatatgtccgtaactaaggtcgtcgtgcaccaagagaccgagatcgctgacgagtag

SEQ ID NO: 115988 - DNA, 2328 bp, Artificial Sequence
  Description of Artificial Sequence: Synthetic coding sequence
atgactaccgaaaagagcttggtgacagaggcggagaactcgcagcatcagcagaaagaagaaggggaggaagccataaattctgggcagcaggagccccaacaagaggaaagttgccagacggcagcggaaggcgacaattggtgcgaacagaagctgaaggcctctaacggtgacactccaacccacgaggaccttacaaaaaacaaggagagaacctcagaatccaggggactgagccgacttttctcttcattcttgaagagaccgaaatcgcaggtgagtgaggaagaggggaaggaagtcgagtccgataaggaaaaaggcgagggcggccagaaagaaattgagtttggtacaagcctggacgaagagatcatcctgaaggcccctatagctgccccagaacccgaactgaagacagacccgagccttgatttacattctctttcctcagctgaaacccaacccgcgcaggaagagctgcgggaagaccccgatttcgaaatcaaggaaggtgagggcctggaagaatgtagcaagatagaagttaaggaggaatcaccacaatcaaaagccgagaccgaattgaaggcgagccagaaacccatcagaaaacacagaaatatgcattgtaaggtgtcgcttctggacgacacagtgtacgaatgtgtggttgaaacctggctggactccgccaaggagattaagaaacaggtgcgaggcgtgccctggaacttcactttcaatgtgaagttttacccaccagacccagcccagctgacagaagacatcaccagatattacttatgcctccagctccgccaggacatcgttgctggcagactgccctgctccttcgccacactcgccttgctcgggagctacactatacaatcagagctcggggattacgacccagaattacacggcgtagactatgtgtccgacttcaaactggcacctaatcaaacgaaggagctggaggaaaaggtgatggaactgcacaagagttaccgatcaatgacccctgctcaggctgacctcgagttcctggagaatgcgaaaaaattgtcgatgtatggcgtagatctgcacaaagcgaaggacctcgagggggtggatattatcctgggtgtatgcagctcagggctgttggtctataaggataaactgcgaattaaccgcttcccctggccaaaagtccttaagatttcttacaaacgttcctcgttttttattaagattaggcctggagagcaggaacaatacgagtcaactattggcttcaagctcccaagttatcgagccgcaaaaaaactctggaaggtgtgtgttgaacatcacacattctttcggctgacttcaaccgatactatcccaaagagcaaatttctagcactggggtctaagtttagatacagtggaaggacccaagcccagacaaggcaggcttccgccctgattgataggccggccccccattttgagcggaccgcgtcgaagcgggcaagccgatctctggacggcgctgcggcagtcgattctgccgatcgctctccccgcccaacctcagctcccgcgattacccagggacaggtggcagaggggggcgtgctggatgcgtctgcaaagaaaacagtggtgcccaaagcacagaaagaaacggtcaaagccgaggtgaaaaaggaagacgaaccgcccgagcaggcagagcccgaacctactgaggcttggaaggacttggataagagccaggaagaaataaagaaacaccacgcgagtatcagtgagctaaaaaagaacttcatggaaagtgtgcctgaacccaggccaagtgagtgggataagcgtctgagcacgcactcacccttccgcacgttaaacatcaacgggcaaattcccaccggagaggggcctcctctcgtcaagacacagactgtgactattagcgacaacgctaacgcagtgaagtccgagattccgaccaaggatgtacctatcgtgcacaccgagacaaaaacaatcacttacgaagctgctcaaacagatgataacagcggggacctggatccaggcgtactcctgaccgcacaaaccatcacaagtgaaaccccttcttccaccacaacgactcagatcactaagactgtgaagggtggcatctccgaaacgcgaatcgaaaaaaggatcgtcattacaggagacgctgacatcgatcacgatcaggtgctggtgcaggctatcaaggaagctaaggaacagcatcccgacatgtctgtaactaaggtggtcgtgcaccaggagacagagattgctgacgagtag

SEQ ID NO: 115989 - DNA, 1926 bp, Artificial Sequence
  Description of Artificial Sequence: Synthetic coding sequence
atgcactgtaaagtatccctactggacgataccgtgtatgagtgcgtggtggagaagcatgctaagggccaggatctgctgaaaagagtatgcgagcatctaaatctgctggaggaggattactttgggcttgcgatatgggacaatgccaccagcaagacttggctggactctgctaaggaaataaaaaaacaggtcaggggtgtgccctggaatttcacattcaacgtgaagttctaccccccagaccccgcccagctgaccgaagatatcacgaggtactatctgtgccttcagctgcggcaggacatagtcgccgggagattgccgtgtagttttgcaaccctggcactacttggctcctacactatccagagcgaactcggtgactatgacccggagcttcacggagtagactacgtgtccgattttaagctggcccctaaccagaccaaggaacttgaagaaaaagtcatggagctgcataagtcatataggagtatgacacctgctcaggcagacttagagtttcttgagaatgctaaaaaactgtccatgtacggcgtggacctgcacaaggccaaggatctggagggagtggatatcattctgggcgtttgttcttcagggctgctagtctacaaagataagctaagaatcaatcgattcccttggcccaaagtgttgaagatttcctacaagcggtcctccttctttattaaaatcaggccaggtgaacaggagcaatacgaatctactatcggctttaagctccctagctacagagccgccaagaagttatggaaggtgtgcgtggagcaccacactttcttccggctcacctctaccgataccatccctaagagtaaatttttggctctagggtctaagtttagatacagcggcagaacccaggcccagacgcggcaggcatctgcgctcatagataggccagcaccccatttcgagcgcacagcgtcgaagcgcgccagccggagtctggatggagccgcggccgtcgatagcgccgaccggtccccccggcctacttctgctccggccattacccaagggcaggtagccgagggaggagtgctggatgcatcagccaagaagactgtagttcccaaggctcagaaggagaccgtcaaagccgaggttaaaaaggaagatgagccccccgaacaggccgagccggagcctacagaggcatggaaagtggagaaaactcatatcgaggtgactgtccccacttccaatggcgaccagacacaaaagaagcgggaaagattggacggggagaatatttatatcagacactctaacctaatgttagaggatcttgataagagtcaagaagagatcaagaagcaccatgcgtctatctctgagctgaagaaaaacttcatggaaagcgtgccggagccacggccaagtgagtgggacaagcggttgagcacacactccccgttccggacacttaatatcaatggacaaattccaacgggggaagggccaccactggtgaaaacccagacagtgacaatcagcgacaatgccaacgcggtgaaatcagagattcccaccaaggacgtccctatcgtgcataccgaaacaaagaccattacctacgaagccgcccagaccgacgataattccggagatttagatccaggagtgctgttgaccgcccagaccattacttctgagacgccttccagcaccacaaccacacagattactaagaccgtcaagggagggatttctgagaccaggatagagaagcgtatcgtcataacaggcgatgccgacatagatcatgatcaagtcctagtgcaggccattaaagaggcaaaagagcagcaccctgacatgtcggtaaccaaggtcgtcgtgcaccaggaaaccgagattgccgacgagtag

SEQ ID NO: 115990 - DNA, 2496 bp, Artificial Sequence
  Description of Artificial Sequence: Synthetic coding sequence
atgactactgaaaaatcactggtgaccgaggccgaaaacagtcaacaccaacaaaaggaagagggggaagaagccatcaactccggacagcaggagccacagcaggaggagtcatgccagactgccgctgaaggcgacaattggtgcgaacagaagttaaaggccagcaacggtgacacacccactcacgaggatctgaccaaaaacaaggaacgcacctccgagtcccgtggcctgtcaagactgttcagcagttttctcaagagaccaaagtcacaggtcagtgaggaagagggaaaggaagtggagtccgataaggaaaagggagagggggggcagaaagaaattgagttcggcacctcactcgacgaggaaattatccttaaagccccgattgctgcaccagagccagagctgaagaccgacccttctcttgacctgcacagtctttcgagcgctgaaacacaaccagcccaggaagaattaagggaagatcccgacttcgagattaaggagggggagggcttggaggaatgcagcaaaatcgaagtgaaggaagaaagccctcagagcaaggccgagacggagcttaaagccagtcagaaaccaattaggaagcatcgcaatatgcactgtaaggtgagtctgttggacgatacggtctatgagtgtgtcgtggagaaacatgccaaagggcaggatctgctgaaacgggtttgtgaacatctgaacctgttagaggaagactattttggcctggccatctgggataatgctaccagcaagacctggctggattccgccaaagagatcaagaagcaggtgcggggggttccttggaatttcaccttcaatgttaagttttacccacctgatcctgcccagctcactgaagatataacgcggtattacttatgcctccagctgcggcaagatattgttgccggacgactgccctgttccttcgccacattggccctactcgggagctacacaatccagtctgaacttggtgattacgacccagagctgcacggggtcgactacgtgtccgatttcaaactcgcgccaaatcaaacaaaagagctcgaagaaaaagtcatggagctgcacaaaagttacaggagcatgacacccgcgcaagcagacttggagtttctggaaaatgctaagaagctctctatgtacggcgttgacctgcacaaagctaaggacttggagggggtggacattattctcggagtgtgttctagcggattgcttgtatataaggacaaactccggatcaaccgtttcccgtggccaaaagtactgaagatttcttataagagaagcagctttttcattaagattcgacctggagagcaggaacagtacgagtccaccattggctttaagttaccgtcttaccgcgccgcgaagaaactgtggaaggtatgtgtggaacatcatacgtttttccggctcacatcaacagatacgatcccgaagagtaagttcctggcactgggatcgaagttccgttacagtggacggacacaggctcagactagacaggcctcagcccttatcgatcggcctgctccacattttgagagaacagcgtcaaagcgggcctctcggtcactggatggagctgcggcagttgactccgctgaccgctcccccaggcccacttcggcgccagcaattactcagggacaggtggctgaaggtggagtgctcgatgcaagcgccaaaaagacggttgtcccgaaagcacagaaggaaaccgtgaaagccgaggtcaagaaagaagacgagcctcccgaacaggccgaaccagaacccaccgaagcttggaagaagaagcgggagcggctcgacggagagaatatatatatccggcatagtaacctgatgctggaggatttggacaagtcccaagaagagataaagaaacatcatgcctctatttctgaattgaaaaagaattttatggaaagcgtgcccgagccaaggccatcagaatgggataagagactgagtacgcactctccttttaggaccctgaatataaacgggcaaatcccaactggcgaaggaccccctctcgtcaagacccaaacagtaacaatttctgacaatgctaacgccgttaagtctgaaatcccaacaaaagatgtacccatcgtgcacaccgagactaagactatcacatatgaagctgcccagaccgacgataacagtggggacctggatccaggcgtgctgcttacggcacagaccatcacttcggagaccccttccagcaccaccaccactcagatcacaaaaaccgtgaaggggggcatatcagagactcgcatagagaagagaatcgttataactggagacgccgatattgatcacgaccaggtgcttgtgcaggcaatcaaagaggccaaagagcagcatcctgacatgtccgtcactaaggtggtggtgcaccaagagacagagatcgcagacgaatag

SEQ ID NO: 115991 - DNA, 2484 bp, Artificial Sequence
  Description of Artificial Sequence: Synthetic coding sequence
agagcacgcgctgcacggagccagaatgccgttggacccgtgcccgctgcgccgtctccagagaagtctcttgtgactgaggccgagaattcccagcaccagcagaaagaagagggagaggaggccataaattccggccaacaggagcctcagcaggaagaatcctgtcagacagcagctgaaggtgacaattggtgcgagcagaagttaaaagcttctaatggggatactcctacgcacgaggatttgactaaaaacaaggagaggacgagcgagtctcggggactgagccgcttgttcagttcctttctgaaaagacccaagtctcaagtaagcgaagaggagggtaaggaagtcgagtctgataaagagaagggcgagggcggccagaaggagatcgagtttgggacatctctcgatgaagaaatcatattgaaagctcccattgctgcacctgagcccgagcttaaaacggatccgtccctggacttacattctctgtccagcgcggagactcagcccgctcaggaagagctgagagaagaccccgactttgagattaaagaaggcgagggcctcgaagaatgcagcaaaattgaggtgaaggaggaaagtccccaatctaaagcggagaccgagctcaaggcatctcagaaacctatccggaaacacaggaatatgcactgcaaagtttctcttctcgacgatacggtgtatgaatgcgtcgtggaaaaacacgccaaggggcaagatttgttgaagcgcgtgtgtgagcatctcaacctactcgaagaggattactttggccttgccatctgggataatgccacctccaagacctggctggacagtgctaaagaaatcaagaagcaggtccgcggcgtgccatggaattttacgtttaatgtgaagttttatcctccagatcccgcacagctcaccgaagatatcacccggtactacttgtgtttacagctgaggcaggacatcgtggccggaagattaccatgcagtttcgcgaccctggccttactcggtagctacacaattcaaagcgaactcggcgattacgacccggagctccacggggtggattacgtctccgacttcaaattagcccctaaccagacaaaggaactggaggagaaggtcatggagctgcataaatcttatcgtagtatgacacccgctcaggccgatctcgaattcctggaaaacgctaaaaagctcagcatgtacggagtggatctgcacaaggccaaggatctggagggagttgatattatactgggggtttgctcatccggacttctcgtgtacaaggacaaactgcgcataaacaggttcccttggcctaaggtgctcaagatttcctataaaaggtcctcattctttattaagattagacccggcgagcaggagcagtatgagagcactattggttttaagctgccaagctacagagccgcgaaaaaactgtggaaggtttgcgtagaacaccacactttcttccgcctgactagtacagacacaataccgaaaagtaaattcttagcattgggatcgaaattccggtacagtggcaggactcaggcacagacccggcaggcaagtgccctgatcgaccgccctgccccacacttcgaaagaacggcgagcaaacgcgcttccaggagcctagatggcgctgcagccgtcgattctgccgaccggtcccctaggcccactagcgcacctgctataacgcaggggcaagtggccgaagggggagtactagatgcatctgcgaagaaaaccgtagtgcctaaggctcagaaggagacggtgaaggctgaagtaaaaaaagaggatgaaccacccgagcaggcagagcctgaacccacggaagcctggaaggatctggacaagagccaggaagagattaaaaaacatcacgcctccatcagcgaactgaagaagaacttcatggaaagtgtgcccgaaccgcgcccaagcgaatgggacaaacggctgagcacccactcccccttccgcaccctgaatattaacggtcagatcccaacaggagagggcccgccgctggtgaaaacgcagaccgttacgatctcagacaacgccaacgctgtgaagtcagagatccctacaaaggatgtacctatcgtgcatacagaaacaaaaaccatcacatacgaggccgcgcaaacagacgataactctggggatctggaccctggcgtcttactgaccgcccaaaccataacttctgaaaccccttcaagcaccacaacaactcagataaccaagaccgtgaagggcggcatatccgagacgaggattgagaagaggatcgtgataactggcgacgcggatatagaccacgaccaggttctggtccaggccatcaaagaagccaaagagcagcatcctgacatgagcgtgaccaaagttgttgtgcatcaggagacagagatcgccgacgaatag

SEQ ID NO: 115992 - DNA, 2163 bp, Artificial Sequence
  Description of Artificial Sequence: Synthetic coding sequence
atgacaaccgaaaagagcctggtgacagaggctgaaaattcgcaacaccaacagaaggaggagggggaggaagccattaactctgggcagcaggagccacagcaggaggagtcctgtcaaaccgccgcagaaggggacaattggtgcgagcagaagctgaaagcttcaaatggagacaccccaactcatgaagatctgacgaaaaataaagagcgcacctctgagtctcgaggcctatcccgcctgttcagtagcttcctgaagcgccctaagtcacaggtctccgaagaggaggggaaggaggtcgagtcagataaagagaagggcgaaggagggcaaaaagaaatcgagtttggcacgtccctggacgaagagatcatcctcaaggcgcccatcgccgcgcccgagcctgagctgaaaactgacccaagcctggatctgcactctctgtctagcgcagaaacacagcccgcacaggaagaactgcgcgaagatcctgactttgaaattaaggagggagagggactagaggagtgctccaagattgaggtaaaggaagagagtcctcagtctaaagccgaaacagagttgaaagcctcccaaaagcccatccgcaaacacaggaacatgcattgtaaagtttccctgcttgacgatactgtatatgagtgcgtcgtagagaaacacgcaaagggccaagaccttttgaagagagtttgtgagcaccttaacctgcttgaagaagactactttggactggcaatctgggataacgcaacgtccaagacctggctggacagcgctaaggagataaaaaaacaagttcgcggagtaccatggaattttaccttcaatgttaagttctatcctccggacccagcgcaattaactgaggatatcacgagatattacctgtgcctgcagttgcgacaggacatcgttgcaggaagactaccttgctcgttcgccactttagccttattgggttcttacacaatccagtccgagttgggagactacgaccccgagctgcatggcgtcgactacgtgagtgactttaagctagctcctaatcagaccaaagagcttgaagaaaaagtcatggaactccacaaatcctacagaagtatgactccagcccaagccgatctcgaattcctggaaaacgccaaaaagctctccatgtatggggttgatctccataaggcaaaggacttggagggcgtcgacattatccttggggtgtgctcttccggccttctcgtgtataaggacaagctgaggataaatcgattcccctggcccaaagtgcttaagatcagctataaacgctcctctttctttataaagattcgccccggtgagcaggagcagtacgagagtaccatcgggttcaagctcccttcctatcgcgctgccaagaaactgtggaaggtgtgcgttgaacaccatacattttttcgcctgacgtccacagatacgataccaaagagcaaattcctcgccttgggcagtaagtttcgttacagtggcaggactcaagcccagactaggcaagcaagtgcacttattgatcgtcctgccccacattttgagcggaccgcttcaaagcgggctagtcgttcgctcgacggggctgcagccgtggacagcgccgatagatcaccaaggccaactagcgctcctgctatcacacagggacaggttgccgaaggcggcgtgcttgatgcctccgcaaagaagacagtggtcccaaaagcccaaaaggaaaccgtcaaagccgaagtgaagaaagaggacgagcctccagagcaagcagagccagagcccactgaagcttggaaggtcgagaaaacacacattgaagtaacggtgccaactagcaatggcgatcaaactcagaagaagagggagcgcctggatggagagaacatatacattagacacagtaacctgatgctggaggatctagataagtcccaggaggaaatcaagaagcatcatgcgtcaatcagtgaacttaagaagaactttatggagtccgtgccagaacccaggccgtcggagtgggacaaaagactgagtacccattctccattcagaaccctcaatataaatggccagatccccactggagaaggggtgtctacacttagtacatag

SEQ ID NO: 115993 - DNA, 2595 bp, Artificial Sequence
  Description of Artificial Sequence: Synthetic coding sequence
atgacaacagagaaatcactggtcaccgaggctgaaaatagccagcatcaacagaaagaggagggggaagaggcgatcaacagcgggcagcaggaacctcagcaggaggagagctgccagacagctgcagagggcgacaactggtgcgaacagaagctcaaggcctctaacggcgacaccccgactcacgaggacctgacaaagaataaggaacgaacatctgagagtcggggcctctccagactttttagctctttcctaaaaagaccgaagagccaagtgagtgaggaggaaggcaaggaagtcgaatcagacaaagagaaaggggaagggggccagaaggagattgagtttgggacgtccctggacgaggagattattctgaaagcccccattgctgccccagagcctgagctcaagaccgatccctctctagacctgcacagcctgtcttcggccgagacccaacccgcacaggaggaattaagagaagaccccgacttcgaaattaaggaaggcgaagggctcgaagagtgcagtaaaattgaagttaaagaggagagtccccagtctaaagccgagactgaactgaaggcatcacagaaacctatacgtaaacacaggaatatgcattgcaaggtatcattgctggacgacaccgtgtatgaatgcgtcgtggagaaacacgctaagggccaggaccttctgaagagggtgtgcgagcacctgaatctcctcgaggaggattactttggccttgccatctgggacaatgcaacatcgaagacttggctagactctgccaaggagatcaaaaagcaggttaggggtgtgccttggaacttcacatttaatgtcaaattttatccacccgatcccgcgcaactgacagaggacatcacaagatactacctgtgtctccagctccgacaagatatcgttgcgggaagattgccatgtagcttcgccaccttggcgctcttgggtagctataccatccaatcagagctcggggattatgacccagagcttcatggcgttgactacgtcagtgatttcaagcttgctcccaaccagaccaaagaacttgaggaaaaggtaatggaactgcataagagttacagatctatgacacccgcccaagctgacctggaatttttagaaaacgctaagaagctgagtatgtacggcgtggatttacataaggctaaagatcttgaaggcgtggacataattctgggagtatgtagttcgggcttgttggtgtacaaagataagctgcggattaatcgttttccatggccaaaggtcttaaagattagttacaaaaggtcatccttcttcatcaaaattcggccaggtgagcaggagcagtatgaatccaccatcggattcaagctgccctcctatcgggccgccaaaaagctttggaaggtgtgcgtcgagcaccataccttctttagactcacctctactgatactataccaaaatcgaaatttctcgctctggggagtaaatttcggtactcggggcgcactcaagcccagacacgacaggccagcgctcttattgaccgacccgcccctcattttgaacgtactgccagcaaacgtgcctcacgctcactggacggtgctgcagccgtcgactccgctgaccggagcccacgtcctacctctgctcctgctatcacgcagggtcaggttgccgagggaggcgtactggatgcttctgccaaaaagaccgtggtaccgaaggcccaaaaagagacagtgaaggctgaggtgaagaaagaagatgaacctccagagcaggctgagcccgaacctacagaagcttggaaggtcgaaaagacacatatcgaggtgaccgtgccaacttctaacggggaccagacccagaagctggccgagaagaccgaagacctcatccggatgcgcaaaaaaaagcgcgagcgactggacggagaaaatatttacattaggcactccaatctgatgttggaggatctggataagagccaggaagagattaaaaagcaccatgcctctatctccgagcttaagaagaactttatggagtccgtgcccgagccccgtcctagtgaatgggataagcgcttgtctacccattctccattccggacacttaacatcaatggacagatcccaaccggcgagggaccccccctagtgaaaacccagactgtaacaatctctgataacgcgaacgctgtgaagtctgagatacccaccaaggacgttccaatagtgcacacagaaaccaagaccattacttatgaagccgcgcagacagacgataatagcggcgacttagaccccggggtgctgctgaccgctcagacaattacttcggaaactccttcctcaacgactactacacaaatcactaagaccgttaaaggcggcatctctgaaacacgcatcgagaaacgtattgtcatcaccggcgatgccgacattgaccacgaccaggtccttgtacaggcaattaaggaggccaaggaacaacaccccgacatgtcagtgaccaaagtggtggtgcatcaagaaacagaaattgcggatgaatag

SEQ ID NO: 115994 - DNA, 1767 bp, Artificial Sequence
  Description of Artificial Sequence: Synthetic coding sequence
atgcattgcaaggtaagcctgctggacgacactgtctacgagtgcgtcgtggagaagcacgccaaaggccaagacctgttaaaacgcgtgtgtgaacatctgaatcttctggaggaggactatttcggactcgctatttgggataacgcaacatctaagacttggctcgactctgccaaagagatcaaaaaacaagttcggggagtcccttggaactttacctttaatgtaaagttctacccacctgatcctgcgcagctgactgaggatattacccgttactacttgtgtctgcaactgagacaggatatagtcgcggggcgactcccgtgttccttcgctaccctggcgctcttaggatcatatactatccaatcagagcttggtgactatgatcctgagctgcacggcgtcgactacgtcagcgacttcaaattggcccctaaccagaccaaagaactggaagagaaggtaatggagctacacaagtcatacagatctatgacgcctgcccaggccgacctcgagttccttgaaaatgccaaaaaactaagcatgtacggagttgacctgcataaggcaaaagacctagagggcgtggacataattctcggggtctgcagctccggactgctcgtctacaaagacaaattgcggatcaataggttcccttggccaaaggtgttgaagatcagctataaacgctcttcctttttcatcaaaatccggccgggtgaacaagagcagtatgaaagcacaattggttttaaactgccttcttatagggctgccaagaaactgtggaaggtttgcgtagagcaccatactttctttcgcctgacatccacagacacaattcccaagtcgaaattcctcgctctgggttctaaattccggtacagcggtcggacacaggcacagacccggcaagcatccgcactgattgatagacccgcacctcatttcgaaaggaccgcgtctaagagagcctctaggtccctggatggtgcagcagccgtagacagcgcggacagaagtcctcgcccgacctcggccccagccattactcagggccaggtggctgagggtggcgtcctggatgcaagcgctaagaaaactgtcgtacctaaggctcagaaggaaaccgtcaaagctgaggtgaagaaggaggacgaaccacctgagcaggccgaaccagaaccaacagaggcgtggaagaagaagcgggaacggctggatggcgagaatatctacatccgacactcaaatttaatgctggaggacctggataagtcacaggaagagattaagaagcaccacgctagcatttctgagctgaagaagaacttcatggagtccgtgcctgaacctagaccttcggagtgggacaaacgcttaagcactcactctcccttcaggaccctaaacatcaacgggcagatccccactggcgaagggccccccctcgtcaagacacagacggtgactatttctgataatgccaacgctgttaaatccgagataccaaccaaggacgtccccattgtgcacacagagacaaagacgattacatacgaggcagcccagacagtgaaaggcggtatctcagaaactaggatcgagaagaggatagtaattaccggcgacgcagacattgaccatgatcaagtgctcgtgcaagcaattaaagaggccaaagaacagcacccagacatgagcgtgactaaggtagtggttcatcaggagaccgaaatcgccgacgagtag

SEQ ID NO: 115995 - DNA, 2115 bp, Artificial Sequence
  Description of Artificial Sequence: Synthetic coding sequence
atgaccactgagaagtctctggtgacagaggcagagaactcgcagcaccagcagaaagaagagggcgaggaagcaatcaactcgggccagcaggaaccacagcaggaggaatcttgccagaccgcagccgaaggtgataactggtgtgaacagaaactaaaggcgagcaacggtgacacaccgacacatgaagatttgactaaaaataaggagaggactagcgagagcagagggctcagccgcctcttttcgtccttcttgaaacgccctaagtcgcaggtgtccgaggaagaaggcaaggaggtggaaagcgataaggagaaaggggagggcggccagaaagaaattgaatttgggacaagtctcgacgaagagatcattcttaaagctcccattgccgcacctgaacctgaactaaagaccgatccgtcgctggacttgcacagtctaagctctgctgaaacccagacttggctagacagcgccaaggaaatcaagaaacaggtgcgtggcgtgccttggaactttacgttcaacgtcaagttctacccaccagatcctgcgcagctaaccgaggatataacgcgttactatttgtgtttacagctgaggcaggatatcgtggctgggcggctaccttgttcttttgctaccctggcactcttagggtcttacactatccagagcgagctcggtgactatgatcctgaactgcatggtgtcgactacgtgtcagacttcaagctggccccaaaccaaactaaggagctggaggagaaggtaatggaactccataagtcttaccggtccatgactcctgcacaggccgatctggaattcctggaaaatgcaaagaaactctcaatgtacggagtcgatctgcataaggcaaaggacctggaaggagtggatataattctgggagtgtgttcttccggcctgcttgtgtataaggataagctaaggataaaccgctttccctggcccaaagtgcttaagatttcatacaagaggagttcattcttcataaaaattcggcccggcgagcaggaacagtacgaatctaccattggattcaagttgccttcttacagggctgctaaaaaactctggaaggtgtgcgtcgagcaccatacatttttccgactgacaagcacagatacaattccaaaaagcaagttccttgcactcggcagcaaatttcgctactccggaagaacgcaggctcagacaaggcaagcatccgcactgatcgatcgcccagccccccacttcgagcgcactgcctccaagcgagcctcaagatctctcgatggtgctgccgccgtggattccgctgatcgctcaccgaggccaacgagcgcacctgccataacccaggggcaggttgccgagggtggagtgctggatgcctctgccaagaagaccgtagtccctaaagcacaaaaggaaactgttaaggctgaagtgaagaaggaagacgaaccaccagaacaggccgaacctgagcccactgaggcttggaaggacttggataaatcccaggaagagatcaaaaagcaccacgctagtattagtgaactgaaaaagaacttcatggaatccgtgccagaaccacggccgtcagagtgggacaagcgtctgagcacacatagcccgttcaggaccctgaacattaatggacagatccctacgggggagggccccccactggtgaaaacccagacagtgacgatcagtgacaatgccaacgctgttaagtctgagatccccaccaaagatgttcccatagtacatacagagactaaaaccattacatatgaagcggcacagaccgatgataacagtggcgaccttgatccaggtgttctcttgaccgctcagacgatcacctctgagactccctcatccaccacaaccacccagattacaaagacagttaagggcggcattagtgaaactaggattgagaagagaattgttataactggcgatgctgatattgaccacgatcaggttctggtgcaggcaattaaagaagcaaaagagcagcaccccgacatgagcgtaaccaaggtggtggtccaccaggaaacagaaattgcagacgagtag

SEQ ID NO: 115996 - DNA, 2304 bp, Artificial Sequence
  Description of Artificial Sequence: Synthetic coding sequence
atgacaactgagaaaagtttggttaccgaggcagagaacagccagcatcagcaaaaggaggagggcgaggaggccattaatagcggccagcaggagccgcagcaggaggaaagctgccaaacagctgccgagggagacaactggtgcgagcagaagttgaaggcgagcaatggcgatactcctacccatgaggaccttactaagaataaagaaaggacttcggagagtaggggactgtccagactattctcgagtttcctgaaacgacctaaaagccaggtgagtgaggaagaaggtaaggaagtggaaagtgacaaagagaagggagagggtggccagaaggagattgaattcggaacttcactggatgaggagatcatcctcaaagcgcccatcgctgcaccagagcccgaattgaagaccgatccctctttggatttgcactccctcagcagtgcagagacacagccagcccaggaagaacttagggaggaccccgattttgaaattaaagaaggcgaaggactggaggagtgtagtaagatcgaagtcaaagaagagtctccgcaaagcaaggctgaaactgagctgaaggctagtcagaaaccgattagaaagcatagaaatatgcattgtaaggtgagcctattggatgataccgtttacgagtgcgtggtagagaagcacgccaagggacaggacctgctcaaacgggtttgtgagcacctgaatttgctggaggaggattactttggcctcgctatttgggacaatgctacttccaaaacgtggctggatagcgcaaaggaaatcaaaaagcaggtgcgtggggtgccatggaactttactttcaatgtcaagttttacccacctgaccctgcccagctcacagaggacataacacgctattacttgtgtttgcagctcagacaggacattgttgcaggtagacttccttgtagcttcgcgactctagcactgcttgggtcatacactattcagtcagagctgggagactacgatccagaactgcacggcgtggactatgtgagcgacttcaagttggcaccaaatcagacaaaggagctggaggaaaaagttatggagcttcacaaatcataccgatcaatgactcctgcacaggcagatctagagttcttggaaaacgctaaaaaattgagcatgtatggagtcgacttgcacaaggcaaaagatctcgagggggtggacatcatattgggggtgtgctcgagcggcttgttggtgtacaaagataaactgcgaatcaatcgtttcccatggcctaaggtgctgaaaattagctataaacgttcctcatttttcatcaagatacgtcccggtgaacaagagcagtatgaatcaactatcgggttcaagttgcccagctaccgggctgcaaaaaaactttggaaggtctgtgtggagcaccataccttctttaggctcactagcactgacactatccccaagtcgaaattcttggctctcggtagtaaattccggtattctggtaggactcaggcgcagactcgacaggctagcgcactaatcgatagacctgcccctcactttgaacggaccgcgtctaagcgggccagccggagcctggatggggccgcggcagttgactccgccgatcgatcaccgcggccaacctcggcacctgctattacacaggggcaggtggcagagggcggagtcttagacgcctcggccaagaaaaccgtcgtcccgaaggcgcaaaaagagaccgtgaaggcagaggtcaagaaggaagatgagccaccagagcaggccgagcccgagccaacagaggcatggaaagacttggataaatcccaggaagagatcaaaaagcaccacgcctccatttcagagttgaagaaaaactttatggagtctgtccccgagcctcgtccctcggaatgggacaagaggttaagtacacactcccccttccgtacactcaatattaatggccaaattccaacgggtgaaggcacggatgataactcaggggatcttgacccaggagtgcttttgacggcccagaccataacttcggaaacaccttctagcactacaaccacccagattaccaagaccgtgaagggtggcatcagcgagacaagaatcgagaaaagaatagtgattactggggacgccgacatcgaccatgaccaggtacttgtgcaggccatcaaggaagcaaaggaacaacacccggacatgtccgtgacgaaagtggtcgtgcaccaggaaaccgaaattgccgatgaatag

SEQ ID NO: 115997 - DNA, 2145 bp, Artificial Sequence
  Description of Artificial Sequence: Synthetic coding sequence
atgaccactgagaaatcattagtgacagaggccgaaaatagccagcaccagcagaaggaggagggggaggaggcaattaacagtggtcagcaggagccgcagcaggaggaatcatgccaaacagccgccgagggtgataactggtgcgagcagaagctgaaggcctccaacggcgacaccccgacccatgaagatctgacaaagaacaaagagagaacatctgaaagtcgcgggctgagtagactattttcgtcctttctgaaaagaccaaaaagtcaggtttccgaggaagaaggcaaggaagtggaatccgacaaggagaagggagagggcggacaaaaggaaatagagttcggaacctcacttgacgaggaaattattctcaaagcacctatcgccgctcctgaacccgaactaaaaacagatccaagcctggatctgcacagcttgagttctgccgaaacacaacctgcacaagaagaactgcgtgaggacccggatttcgaaattaaagagggcgagggccttgaggaatgttctaaaatcgaggtgaaagaggagagtccccagtctaaggccgaaacagagctaaaggcctcacagaagccaatacggaaacatcggaatatgcactgtaaggtcagtcttctggatgatacggtatatgaatgcgtggttgaaaagcacgctaagggacaggacttactgaagcgagtctgcgagcatctgaaccttctggaggaggactactttggtttggctatatgggataacgccaccagtaagacatggttggactccgctaaagaaattaagaaacaggtgagaggcgtgccatggaatttcacatttaacgtgaagttctacccgccagatccagctcaattaaccgaggatattaccagatactacttatgccttcagttgcggcaggatattgtggctggcagattaccctgttcctttgctaccttggctcttctcggctcatacacgattcaatccgagctcggcgactatgaccctgagctccatggcgttgactacgtcagcgactttaaactggctccaaaccagaccaaggaactggaagaaaaggtgatggaactgcacaaatcctaccggtcaatgacccccgctcaagccgacctggagtttctggagaatgcaaaaaagctgtcaatgtacggggtcgacctccacaaagccaaagatttagaaggagttgacataatcctcggtgtgtgctcttccgggctccttgtctacaaagacaagttgcggattaatcggttcccctggcctaaggtcctgaagatatcttataaacggagctcatttttcattaagattagaccaggcgaacaggagcagtatgagagcacgattggctttaaactgccttcgtaccgcgctgccaagaaactttggaaagtctgcgtggaacaccacacttttttccgtttaacatcaactgatactatcccgaaaagtaagttcctggccttaggcagcaagttcagatatagtggacgaacccaggcgcaaacccggcaggcttccgcactcattgatcgcccagccccgcacttcgaaagaacggcctcaaagcgcgccagccgctcccttgatggtgcagctgcggtggatagcgccgaccgctctccaagaccaactagtgctccagccataacccagggccaggttgccgagggcggggtgttagatgcgtctgcaaaaaagacggtggtgccaaaggcccagaaagaaacagtgaaggcagaggtcaagaaagaggatgaacccccggagcaggccgagccagagcccaccgaagcctggaaggtggaaaagacgcacatcgaagtgaccgttcccacctctaacggtgatcagacccagaagaaacgggagcggctggacggggaaaatatctacatccggcatagtaatctgatgctggaagacctggacaaaagccaagaagaaattaagaagcatcacgccagcatctcagagctgaagaaaaactttatggagagcgtgcccgagcctcggcccagcgagtgggataaaagattgagcacacacagcccgtttagaaccctcaatattaatggacagattcccacaggcgaggggtag

SEQ ID NO: 115998 - DNA, 2061 bp, Artificial Sequence
  Description of Artificial Sequence: Synthetic coding sequence
atgggctgcttctgcgccgtgcctgaagagttttattgtgaagtgctcttgcttgatgagtcaaaactcactctaacaactcagcaacaaggcatcaaaaaatctaccaagggatctgtcgtgctggaccacgtgtttcaccacgtgaatctggtggaaattgattattttggactcaggtactgcgaccggtctcaccaaacctactggctggaccctgccaagactctggctgagcacaaagagttgatcaatacgggaccaccctacacgctctactttggaatcaagttctatgccgaagatccttgtaagctcaaggaggaaattacccgataccagttttttctacaagttaaacaggatgttctgcaggggcgactgccttgccctgtgaacaccgccgcccagctgggcgcctatgctattcaaagtgaactgggcgactatgacccttataagcatacagcaggctatgtatctgagtacaggttcgtacccgatcagaaggaggagttagaagaagccatagagcgcattcacaaaacacttatggggcaaattccgtcggaggccgagctcaactatttaagaacagctaagtctttggaaatgtacggtgtggatctgcacccagtgtacggagagaacaaatctgagtactttttggggctgacccccgtgggcgtagtcgtatataagaacaagaaacaggtgggaaagtacttctggccccgcatcaccaaggtccattttaaagagacacagtttgaactgagagtcctgggcaaagattgcaacgagactagcttcttttttgaggccagatcgaagaccgcttgtaagcacctgtggaagtgttccgtggagcaccataccttttttaggatgccagagaacgagtctaacagccttagtaggaagttgagcaagtttggatctatcaggtataagcaccgctactcgggccgcaccgcactacagatgtccagggacctgagcattcagctgccaaggccagaccaaaacgttacccgctccagatccaagacctaccctaagcggattgcccaaacacagccagcggaatccaattctatttcccggatcaccgccaacatggaaaatggagagaatgaaggaacgatcaaaatcatcgcccctagtcccgtgaaatcttttaagaaggccaaaaatgagaacagcccagacacgcagcgcagtaagtctcacgctccatgggaggaaaacggcccccagagtggactctacaactctccctcagatcgcactaagagccctaagttcccttatacacgcagaagaaaccctagctgcgggtcggacaacgactcggtgcagcccgtgaggcggcgaaaggcccataactccggcgaagactctgaccttaagcagcgccgacggtctagatcccgttgtaacaccagctccgggtctgaatccgagaacagcaaccgggagtaccggaaaaagagaaaccggattagacaggagaacgacatggttgactcagcaccccaatgggaggcggtcctgcggaggcagaaggagaagaatcaagccgatccgaataaccggagatccaggcaccgcagcagaagccggagccccgatatccaagccaaagaggagctctggaagcacatccaaaaggaattagtcgacccgagcggcctctccgaggagcagcttaaagagatcccgtacaccaaaatcgagacacagggagatcccataagaatcagacactcccacagccctaggtcttaccgccaatacaggaggtcccagtgcagcgacggagagagatccgttttgtccgaggtcaacagtaagaccgacctggtgccacctctcccagtgactagatcatctgatgcacagggctccggagatgccacagtgcaccagagacggaacggctccaaggattcgctgatggaggagaagccgcagactagtactaacaacctggccggtaaacacacagccaagactattaaaaccattcaagcctccaggctcaagaccgagacatag

SEQ ID NO: 115999 - DNA, 1836 bp, Artificial Sequence
  Description of Artificial Sequence: Synthetic coding sequence
atggatttcaaaaaatccaagcttacacttgtagttgtggaggatgatgatcagggacgggaacaggaacacacattcgtgttccgcctagattccgcacgcacatgcaaacacttatggaagtgtgcggtcgagcaccacgccttctttcgcctacggactcccggcaatagcaaaagcaaccggagcgactttattcgactgggaagcagattcaggtttagcggacggaccgaatatcaggccacacatgggagcagactgcgcaggaccagcacattcgaacggaagcctagtaagaggtacccctcccgccggcactcgactttcaaagccagtaatccagtcatagctgctcagctgtgcagcaaaactaacccagaggtgcacaactatcagccacagtaccaccctaacattcaccctagccagccacgatggcatccacacagtcccaatgttagctacccactcccctctccggtgctatcaagttctgaccgacttccctttggcattgaagaaaatggcggcacaccttttctgactgcagctagcggcaggcaccatcatcagcatcagcaccagcaccaacaccagcaccattcaaactatagcctgtcacttacactggaaaataaagagggacccctcaggtcaccgaattcctcaagtaagtctctaacaaagctgagcccaggaacccctgccctattctccgaagccgcggcccatttaaagaaattggagctggaaaccgtgaaggccgctggcccctggccaccgctgcacattaatatcaacaaagcagaggagaagaaggtgagtgagaagacactccagaccccgttgctgccgtcccccgtggccgaccatgtgaagtgtaacattctgaaagcgcagctcgaaaatgcttccagggtcaatatacaaggaggcaaagaggaaagccccttcgtaaatatcaataaaaaaagcagcttacaggatgcgtccgttcggtcgccaattccaattagggtggaaaccgcacaaccagcagtggagaaacctgaaattaagcctccaagggtccggaaactgacccgccagtacagctttgatgaggacgacctccctcccgacttagcggaggccgtcggcgtgactacatctactactaccaataccactaccgccgccacacaagtgtccgtgccattgccatcacccaaagtccaaaacgtgagtagtccccataaatcagaaggtaaaggactgcttagccccggtgcgaagagtcctagtgaccggggtggcgcctttactttggaacccggcgacctgctcatggattttacagaggccacgccattggccgagcccgcctctaaccctcactgtgcgcattcacgatgcagcccacccctaagtttgcccatgaaagaggaaaccaccggcgtgtgcatgtaccctcccattaaaactcgattaattaagaccttccccgtcgacacaatgaatcccttcccggacacattcactacggggccacaattcacagctgattttcgcgattcaaaactgcaatgctgtcccggcccgacttcaccactgattcctgctgccacactgcggcctctcaccgaaactgtacacagtgccgaccacttgcaccacccagaaacatgtttttctgggtcccaatgccgcgatactcccgccgggactggcgagagagaagatgacgagaaaactgtcgacgatcgcacagttaaattctccccttgtcatctggaggacggaatggttccatccgtgcggctcttaagcagcggattcgtatgcagcctgtag

SEQ ID NO: 116000 - DNA, 1323 bp, Artificial Sequence
  Description of Artificial Sequence: Synthetic coding sequence
atgaagtttctgctgatcaaagatgcccctggaaagaaaaagcgtaaaaatttgatgttgagcttcaaaagaaagcacgctaagggacaggacctctttgaccagatcgtctaccatctggatctcgtcgaaacagactactttggtttgcagttcttggattcggcccaagtcgcacattggcttgatcacgctaagcctattaaaaagcagatgaaaataggccctgcctacgcgcttcatttccgggtcaaatactatagcagcgagcccaataacctcagggaagagtttacccgctatctcttcgtgcttcagctgagacatgacatcctgtctggaaaactgaaatgcccctatgaaacagccgtagagctcgccgcactttgccttcaggccgagcttggagagtgtgagttacctgagcatacccccgaactcgtgagcgaattccgattcatccctaatcagacagaagcaatggagtttgatatttttcagcgatggaaggaatgtcggggaaaatccccggctcaagcggaactctcatacctgaacaaagcaaaatggctggagatgtatggtgttgatatgcacgtggtccgcggcagagacggctgcgaatatagtttagggctcacacccacaggcattctgatattcgagggcgctaacaagattggcctttttttctggccgaaaatcaccaaaatggacttcaagaaaagtaagctgaccctggtggttgtggaagatgatgatcagggccgcgagcaggagcacacattcgtctttagacttgattcggcgagaacatgcaagcatctctggaagtgcgccgttgaacaccatgcgttcttccggctgagaacgccaggcaattccaagtctaatcgatcggacttcatccggctgggatccagattccgtttctcagggagaacagagtatcaggcaacccacggtagtagactgcgcagaaccagtacattcgaacgcaaaccgtccaaacggtatcccagcaggaggcactcaacttttaaggctagtaatcctgtcattgccgcccagttgtgcagtaaaactaatcccgaggtgcataattatcagccacagtaccacccaaacattcatcctagtcagcctcgctggcacccgcactctccaaacgttcgtccaagtttccaggacgacagaagtcattggaaagcctcggcaagtggagacgattcacattttgattatgtacacgatcagaatcagaagaatttaggcggcatgcagtccatgatgtatagagataagctcatgaccgccctctag

SEQ ID NO: 116001 - DNA, 1557 bp, Artificial Sequence
  Description of Artificial Sequence: Synthetic coding sequence
atgttgcggttcctgcggaggactttcggcagaagatcaatgcagcgatatgcccggggtgcggccgggcgtggagcggccggcctgggcgacgagagagacggaggaccgcgcggggggcccgcagccgctgcctcaagtagcgcgttgccagccgcccctggcggaagtgtcttcccagctggaggcggtccgctgcttaccggaggggctgctgttcatatttctgccgccggagcagctaaagccaccctgtactgcagagtctttctgctcgatgggacggaggtgtctgtagacttgcctaaacacgctaaggggcaagatctgttcgatcagatcgtctaccacctggacctggtcgagactgactatttcggtctccaatttctcgattccgcccaagttgcgcattggctggaccacgcaaaaccaataaaaaaacagatgaagattggacccgcgtatgctctgcacttccgtgtaaagtattactcttctgaaccaaataatctgcgggaggagttcacgagatacttgtttgttctgcagctgcggcacgatattctttcgggaaagctaaagtgcccttacgagaccgccgtcgagctggctgctctctgcctccaagctgaactaggcgaatgtgaactgccagaacacactcctgaactggtgtccgaattccggttcattcctaaccaaaccgaagctatggagtttgacatttttcagcgatggaaggaatgccgcggcaagagtccggcccaggctgagctgtcctaccttaacaaagctaagtggttggagatgtatggggtggatatgcatgtcgtccgcggacgtgacgggtgcgaatactccctggggctgaccccgacaggtatactcatatttgagggtgcgaacaagattggcctgttcttttggccgaaaatcactaagatggacttcaaaaagtccaaacttacgttggtggtggtggaagacgacgatcaggggcgcgagcaagagcacacgttcgtctttcgcctggactctgcccgcacttgcaaacatctgtggaagtgcgctgtcgagcaccacgcgtttttccggctgcgcacgcccggtaattcaaagtcgaataggagtgactttatccgcctcggatcacgattcagattctcaggccggacagaatatcaggctactcacggaagtcggcttagaagaacaagtacgtttgagagaaaaccatctaaaagatacccttcaaggcgacattctacattcaaagcatcaaatcccgttattgctgctcagttgtgctctaagaccaatcccgaagtgcacaactaccagcctcaatatcatcctaacatccacccatcacagcctagatggcaccctcactcaccgaacgtgaggccaagctttcaggacgataggtctcactggaaagcttccgcgagcggagacgatagtcacttcgactacgttcacgaccaaaatcaaaagaatcttggcggaatgcagagcatgatgtacagggacaaactgatgacggctctttag

SEQ ID NO: 116002 - DNA, 2703 bp, Artificial Sequence
  Description of Artificial Sequence: Synthetic coding sequence
atgctgcgcttcttgcggaggacattcggtcgacgcagcatgcaacgttacgccaggggagccgctggccggggggccgctgggttgggggatgagagggacggtggaccgagaggggggcctgccgctgcagccagctctagtgctttaccagcggccccgggcggatcagtgttccccgccggtggagggccactgctcacgggaggcgccgctgtgcatatatcagccgctggggctgccaaagccactttgtactgccgtgtcttcttgcttgacggcaccgaggtgtcagtggatcttccgaagcacgccaagggacaagatcttttcgaccagattgtttatcacctggatcttgtcgagaccgattatttcgggctacaattcctagactccgcgcaagtagctcattggctggatcacgcaaagccaatcaagaaacagatgaaaatcggccccgcatatgccctgcactttagagtcaagtattattcctccgagccgaacaacttgcgcgaggaatttacacgctatctgtttgttcttcagcttaggcatgacattcttagtggaaaactaaaatgcccctatgagacagcagtggagttggccgcgctgtgcctacaagctgagctcggtgagtgcgagctgcctgagcatacaccggagttggtgagcgaattccggtttataccgaaccaaactgaggccatggagttcgacatcttccagagatggaaggaatgcagagggaaaagcccagctcaagccgaacttagctatctgaacaaggcaaaatggctcgaaatgtacggggtggatatgcacgtggttcggggaagagacggctgtgaatattcactgggcctgacccccacgggaatcctaatctttgaaggcgcaaataagatcggactatttttttggccaaaaatcactaagatggattttaaaaaaagcaaacttacacttgttgtggtggaagacgacgaccagggtagggaacaagagcacacattcgtgtttagattggacagtgctcgtacatgtaagcacctgtggaaatgcgcagtagaacaccacgcattcttccggctgagaacacctggaaacagtaagtccaatcgaagcgatttcatccggctgggctcacgcttccgctttagcggccggactgaatatcaggctacccacggatcacggttgcgacgcacttcaacctttgagcgcaaaccatctaagcgctacccatccaggagacatagtactttcaaggccagcaaccctgtcattgccgcacaactttgttctaagacaaatcccgaggtgcataactatcagccccaataccaccccaacattcacccatcccagccaaggtggcacccacacagtccaaacgtgtcctaccccctcccgagtccagtcctgagtagcagtgaccggctcccattcggaatagaggagaacggggggaccccgttcctgactgcagcttccggccggcatcatcaccagcaccagcaccaacatcagcaccagcaccatagcaattactcgctgtcacttactctggaaaataaagagggtcctctgagatcccccaatagtagttctaagagcctcaccaagttatctccaggcaccccggccttgttttctgaggccgcggctcacctgaagaagctggagcttgaaaccgtgaaggctgccggcccgtggccaccgcttcacattaacatcaataaggcagaagaaaaaaaagtgtctgaaaagacactgcagactccactgctgcctagtccagtagccgatcatgtgaaatgtaatatcttgaaggcgcagctcgaaaatgctagtcgcgtgaacatacagggcggcaaggaggagagcccattcgtgaatatcaataaaaagtcctctctgcaggacgctagtgtgagaagcccaattcccatccgagtggaaactgctcaaccagccgtggagaagccagagataaaaccccctcgggtgcggaagctcacacgccagtacagttttgatgaggatgatctgcccccagacttagccgaggccgtgggagtgacaacttcaacaaccactaacaccacaacagcagccacccaggtgagtgttcccctgccttcccctaaggtgcagaacgtgtccagtccgcacaagtccgagggtaagggactgctgtcccccggggctaaatctccaagcgatagaggaggagctttcacactcgagcctggggaccttcttatggacttcaccgaggccacaccgctagccgagcccgcttcgaacccccattgtgcgcattctagatgctcaccccctttgtccttacccatgaaggaggagacaacaggcgtgtgcatgtacccaccaattaaaacccgcctgataaagacatttccagtagacactatgaacccctttcccgacacttttaccacagggcctcaatttacagccgatttcagagactcaaagctgcaatgctgtccgggcccaacctcgccgctgattccggctgcaaccctgcgacccctaacagagaccgtaagcaccgtccaaacaatctataccacaagaaaaccagtttcgctcgccgcaagtgccgagacacttcgacaagaactcgaaagggaaaaaatgatgaagcgccttctcatgacagagctgtag

SEQ ID NO: 116003 - DNA, 2202 bp, Artificial Sequence
  Description of Artificial Sequence: Synthetic coding sequence
atgctgtccttcttccgaagaacactcggccggaggtctatgaggaagcacgcggaaaaggaacgcctccgcgaggcccagcgggccgccactcacatccctgctgccggcgactcaaagtctattataacctgtcgcgtgtctcttttggatggaaccgacgtctccgtcgatctgcccaagaaagctaagggtcaggaactttttgaccagataatgtaccacttagaccttatagagtccgattactttggcctgaggtttatggattctgctcaggttgctcattggcttgatggtactaaatctataaaaaagcaggtaaagatcggaagcccttactgtctgcacctgcgcgtgaagttttacagctccgagcctaataacctgcgtgaagagctgaccaggtatctttttgttctgcagttgaagcaggatattctcagtgggaagttagactgcccattcgacactgccgtacagctggcagcatataatctgcaagccgaactcggcgattacgacttggctgaacatagccccgagctggtatcggaatttcggttcgtgccaatccagacagaagagatggagctggccatcttcgaaaagtggaaagagtatcgtggccagacacctgcacaggctgagaccaactacctgaataaggccaagtggctggagatgtatggcgtggatatgcacgtggtaaaagcaagggacggtaatgactatagcttaggtcttacaccgaccggtgtgctcgtcttcgagggtgacaccaagattggcttattcttctggcctaaaattaccagattagatttcaagaagaacaaacttactctggtcgttgtagaggatgacgaccaggggaaagaacaagagcatacattcgtcttccgcctcgatcatccgaaggcttgcaagcacctctggaaatgcgccgtggaacatcacgcctttttccgtcttaggggaccagtacagaaaagcagtcaccgaagcggctttatccggctggggtcaagatttcgatacagtggcaagacagaataccagaccacaaagacaaacaaggcccgtcggagtaccagctttgagaggaggccgagcaaaagatattctcgacgcaccctgcagatgaaggcctgcgcgaccaagccagaagagctgagcgtgcataacaatgtgtctacacaatctaacgggagccagcaggcttgggggatgagatctgccctaccggtgtcacctagtatcagctctgccccagtgcctgtcgaaattgagaacctgccccaatctccgggtacggatcagcatgaccgtaaatgtattcccctgaatatcgaccttcttaattctccagatcttctcgaagcaaccattggcgatgtgatcggcgctagcgataccatggaaacatcacaggcactgaatgacgtgaacgtggccacgcgacttcccggcctgggagagcctgaagtagagtacgagacactcaaggacacaagtgagaaactcaagcagctagagatggagaatagccctttgctctctcccagaagcaacatcgatgtcaatatcaactctcaggaggaggtggtgaagctgactgaaaaatgcttgaataacgtaatagagagccctgggctgaacgtgatgagagtccccccagactttaaaagcaatatactgaaggcccaggtggaagccgtgcacaaggtaactaaagaggacagtcttctctctcataagaacgctaacgttcaagatgccgcaaccaatagcgccgtcctcaacgagaataatgtgccgcttcccaaggaaagcctggagaccctcatgctgatcactccagcagactccggatctgtattaaaggaagctacagatgagctagacgccttgcttgctagtcttacagagaatctgattgaccacacggttgctcctcaggtatcttcaacttccatgattactccgaggtggattgtgcctcagtcgggcgccatgtccaacggcctggctgggtgtgaaatgttgttaactggaaaggaaggacacggcaataaagacggaatctcgctcatcagtccgccagcccccttcttggtggacgccgtcacatcctccggcccgattctggctgaggaggcagtgctaaaacaaaagtgccttctcacaacagagttgtag

SEQ ID NO: 116004 - DNA, 1518 bp, Artificial Sequence
  Description of Artificial Sequence: Synthetic coding sequence
atgttgtcgtttttcagaagaaccctcggtcggcggagcatgagaaaacacgctgagaaggaaagactgcgggaggcacagcgcgccgccacacatatcccagccgcaggagacagtaaaagcatcatcacttgtcgggtttccctgctggatggaacagatgtgagcgtagacctgccaaagaaggctaagggccaggagctctttgaccagatcatgtatcacctggacctgatcgaaagcgactacttcggcctcagattcatggactcagcccaggtggcccattggctggatggaacaaagtctatcaagaagcaggttaagattgggagcccctattgcttgcatcttcgcgtcaagttctattcatccgagccaaataacctaagagaggagctcaccagatatttgttcgtgctgcagttgaagcaagacatactttcgggaaagctggactgtcctttcgatacggctgtgcagctggcggcttacaacctgcaggctgaactcggagattacgatctcgctgaacacagtcccgagcttgtaagcgagttcagatttgtgccaattcagacagaggaaatggaattggcaatctttgaaaagtggaaggagtataggggccagacaccagcacaggccgagacaaactacctgaacaaagctaaatggctggagatgtacggagtcgatatgcatgtagttaaggcgcgcgacggtaacgactatagcctgggtctgacccccacaggagttctggtgtttgaaggggacaccaagattggattattcttttggcctaagattactcgcctcgatttcaagaagaacaaactgacactcgtcgtagttgaagatgatgatcagggaaaagagcaggaacatacttttgtctttcgcctcgaccaccctaaggcttgcaaacacctttggaaatgcgcagttgagcaccacgcattctttcgcctgcgaggcccagtccaaaagtcctctcatcggtctgggtttatccgactcggctcccgctttcggtattccggcaaaacagaataccagacgacaaagactaacaaggcacggcgatcaacttcctttgagcgccggccttcaaaacgatattctagaagaacccttcagatgaaggcatgtgctaccaagccagaggagttgagtgtgcacaacaatgtctccacccaaagcaacggctcacagcaggcctggggcatgaggtcagccttgccggtgagcccctccatttccagtgcgcctgtgccagtggagatagagaacctaccacagtctcccgggacagaccagcacgacagaaagtggctcagcgcagcctccgattgttgccagcgtgggggtaatcagtggaatacacgagctctgccccccccacagactgcccacaggaactatactgactttgtgcacgagcataacgtgaaaaatgcagggatccggcatgacgtccactttcccggtcatactgctatgacggagatttag

SEQ ID NO: 116005 - DNA, 1518 bp, Artificial Sequence
  Description of Artificial Sequence: Synthetic coding sequence
atgctgtctttttttagaagaacattgggaagaaggtcaatgaggaaacacgccgagaaggagcggcttcgggaggcccagcgggcagccactcacataccagccgccggggactcgaaaagtattatcacgtgtagggtgagcttgctggatgggactgacgttagtgttgatctgcctaagaaggcaaaggggcaggaactctttgatcagataatgtatcatctggatttgatagagagcgattatttcggtctccggtttatggattctgcacaggtagctcactggttggatgggactaagtctattaaaaaacaggtaaaaataggatctccttattgtctccatcttcgggtgaagttctactcatccgagcccaacaatctgcgggaagagttaactcgttatctgttcgtgctgcagctgaaacaagatatcctgtctggaaaactggactgtccctttgacaccgccgtgcagttggcagcatataatttgcaggcggaactgggagactacgatctcgccgaacatagtcccgagcttgtgagcgaattccggttcgtcccgatacaaactgaggaaatggaattggccatattcgagaaatggaaggagtacagaggccagacacccgcacaagctgagactaactatctgaacaaagccaagtggctggagatgtatggtgttgacatgcacgttgtgaaggcaagggacggcaacgattactctttagggttaactcccacgggagtgttagtatttgaaggggatactaaaattggcctgtttttctggccgaagattacacggctggacttcaagaaaaataagctgaccctagtggtcgtggaagatgatgatcagggaaaagagcaggagcacacattcgtattccggctcgaccaccccaaggcatgtaagcacctgtggaagtgtgcagtggagcaccacgccttttttcggctgcgcggccccgtgcaaaaatccagccatcgctccggttttattcggttgggatccagattcaggtattcaggcaaaaccgagtatcagaccactaagacaaacaaggccaggaggtcaacttccttcgaacgacgccccagtaagagatattctaggcggactctccagatgaaagcctgtgccaccaaacctgaggagttgtccgtgcacaataatgtgtccacccagtccaatgggtcccagcaagcctggggcatgagatcggcgctgcccgtatccccaagcataagcagcgcacccgtgccagtcgagatagagaatctgcctcagagtccagggaccgatcagcacgatagaaagtggttgtccgcagcaagcgattgctgccagcgcggcggtaaccagtggaatacccgcgctctgcctccaccacagaccgcccacaggaactacaccgactttgtgcacgagcataatgtgaaaaacgccggcataaggcacgacgtgcactttccaggccatacggccatgacggagatctag

SEQ ID NO: 116006 - DNA, 2064 bp, Artificial Sequence
  Description of Artificial Sequence: Synthetic coding sequence
atgttgagctttttcaggcgcactctgggaaggaggagcatgcgtaagcacgcagagaaggagaggttgcgggaagcccaacgggctgcaacacatattcctgcggctggcgactccaaatcaatcattacttgtcgagtgagcttactggacggcacggacgtgtctgtggatctcccaaagaaggcaaaaggccaagaactgttcgatcagataatgtaccacctagatctaatagagagcgattacttcggcctcaggttcatggacagcgctcaagttgcccactggctcgacggaactaagtctattaaaaaacaggtgaagataggctcaccctattgtcttcacctccgggtgaaattttactcttccgagcctaacaatctgcgggaggagcttaccaggtatctcttcgttctgcaactgaagcaggatattctgtctgggaaactggattgtccattcgatacggcagtacagctcgctgcctacaacctgcaggcagaactcggcgattacgaccttgctgaacattcaccagaattagtgtctgagtttaggtttgtgcccattcagacagaagagatggaactggccatctttgagaagtggaaggaatatcgcggccaaacacctgcccaagccgagaccaactatcttaacaaagcaaagtggttggaaatgtacggggtggacatgcatgtggtgaaggccagggacgggaatgactacagtctgggtcttacacccacgggagttcttgtttttgagggagacaccaaaatcggtttattcttctggccaaagatcactaggctggatttcaagaagaataagctgacattggtcgtcgtggaagacgacgatcaggggaaggagcaagagcacacgttcgttttcaggctcgaccatccaaaagcgtgtaaacatctctggaaatgcgcggtggagcatcacgccttctttcgtctgcgagggcccgtccagaagtcctctcatcggagcggctttatccggttgggatctaggttcaggtactctggaaagacagaataccagaccaccaagaccaataaggcaagacggtcaactagtttcgagcgccgaccctcaaagcggtatagtagaaggactctgcagatgaaggcttgcgcgacaaaaccagaggagctgagcgtgcataataacgtgtccacacagtcgaacggtagccagcaagcttggggaatgcggtctgctctgcctgtctctccctccataagctccgcaccagtccccgtggaaattgagaatctcccccagtcccccggaactgaccagcacgacagaaagtgtattcccctgaatatcgacttgcttaattcgccagatcttttagaagccacaattggggatgtgatcggtgctagcgatacaatggaaaccagccaggccctaaacgacgttaacgtcgctactaggctccctggtcttggagagcctgaggttgagtatgaaaccctgaaagatacttccgagaaactgaagcagctggaaatggagaatagccctcttttgtcacctcgatctaatattgatgtcaatatcaacagccaagaagaggtcgtaaagctgaccgaaaagtgtctgaacaatgtaatcgagagccctggcctgaacgttatgcgagtaccacccgatttcaaatcaaatatcttgaaagcgcaggtggaggcggtgcacaaggtgaccaaagaagacagtttgctcagccacaagaacgccaatgtgcaggatgccgcaaccaacagcgcagtattgaacgagaataatgtgcccttaccaaaagagagcctagagaccttgatgctgatcactcccgcggacagcggaagcgtgctaaaggaggctacagacgagctcgatgctctcttggcctctttgaccgagaatctgattgaccatacagttgccccgcaagtgtcctccacgagcatgatcacaccacggtggattgttccgctgtggtcccattttggacggcgatcctgccctgaagctgaggttttcaccgaccattag

SEQ ID NO: 116007 - DNA, 2199 bp, Artificial Sequence
  Description of Artificial Sequence: Synthetic coding sequence
atgttgtcatttttcagacgcacactggggcgtagatcgatgaggaaacatgccgaaaaagaaagacttagagaggcgcaaagagcagcaacccatatccctgctgctggtgactctaagtccatcataacttgccgggtttccttattggatggcaccgatgtaagtgtggatctacctaaaaaagcaaagggtcaggaactctttgatcaaatcatgtatcacctcgatctgattgaaagtgattacttcggactgcggtttatggacagcgcccaggtggcccattggctcgatggcactaagagtattaaaaagcaggtgaagatcggctctccctattgtcttcacctgcgcgtcaagttttactcttctgaaccaaataatcttagggaggaactgacccggtatttattcgttttgcagctgaagcaagacattcttagcggtaagctggactgtccttttgacacagccgttcagcttgccgcatataacctgcaggcagagcttggggactatgatctggctgaacactcgcccgagcttgtgtccgagtttcggtttgtccccatacaaaccgaggaaatggagctcgcaatcttcgaaaaatggaaggagtaccgcggacagaccccagctcaggcagagaccaattacctcaataaggcgaaatggctggagatgtatggcgtggacatgcacgtcgttaaagcaagggacggaaacgattactcgttgggcctcacacctacaggcgtactggtcttcgagggagacacgaagatcggactgtttttctggccaaaaattacacgccttgatttcaagaagaacaaactcaccctggtagtggtcgaagatgatgaccagggcaaggagcaggagcacacgtttgtttttagactggaccatcctaaggcttgtaagcacctgtggaagtgtgccgtcgagcatcacgcattttttcggttaaggggccctgtgcagaaatctagccacaggtccgggttcattaggctcggctccaggttcagatactccggaaagacagaatatcaaacaacaaaaacaaacaaggccagacgaagcaccagctttgagaggagaccctctaagcggtactctcggaggactctccagatgaaagcatgtgccaccaaacctgaagagctgtcggtgcataataacgtgtcgacacagagcaatgggtcgcagcaggcgtgggggatgaggagtgctctgccagtgtctccgagcatttcctcggcccccgtgcctgtggagatcgagaacctcccccagtcgcctggaaccgaccagcacgacagaaaatgcatacccctaaacattgacctcctgaattcacctgacttgctggaggccaccatcggggatgtaatcggagccagcgatactatggaaacctctcaggccctcaacgacgtgaacgtagctactcggcttccaggtctaggagagcccgaggttgagtacgaaacgctgaaggacacttccgaaaaactgaaacaattagagatggagaattcacccctcctctcccctaggtctaatatcgatgtgaacatcaactcacaggaggaagtggtcaaactgacagagaagtgcctgaacaacgtgatcgaaagccccggcctgaacgtgatgcgagtgcctccagattttaagtcaaatatattaaaggcgcaggttgaggctgttcacaaggtcactaaggaagactctctgttgtcccacaagaacgcaaacgtgcaggatgcagcaacgaactctgctgtcctgaacgaaaacaacgttccgctccctaaggaatctttagaaacactgatgctcatcactccagccgactcaggctcggtcttgaaagaggctacggatgagctcgacgcactgctagcctccctcactgagaatttaatcgatcacaccgttgctccgcaagttagttctacatctatgatcacccctcggtggattgtgccttccggagccatgtcaaatgggctggctgggtgtgagatgctgcttaccgggaaggagggccacggaaacaaagatggaatttccctcatatccccccccgccccctttctggtagatgccgtgaccagctcgggcccaattctggccgaggaggcggtacttaagcagaagtgcctgctgacaaccgagctgtag

SEQ ID NO: 116008 - DNA, 2340 bp, Artificial Sequence
  Description of Artificial Sequence: Synthetic coding sequence
atggaggagaaagactactcagaggcagacgggctctccgagagaacaactcccagcaaggcccagaagtctccacagaagatcgccaaaaaatataaatccgccatttgtcgagtcacactgctcgatgcgtccgaatatgaatgcgaggtagagaaacacgggagagggcaggttctgtttgatttggtctgtgagcacttgaacctgctcgagaaagactattttggcctgaccttctgcgatgccgacagccagaagaactggctggacccgtcaaaagagataaagaagcaaataagaagctcaccatggaactttgccttcacagtcaagttttatcctcctgatcccgcgcagctgaccgaggatatcacccggtactatctgtgcttgcagctgcgcgctgatatcataactggcagacttccttgctcttttgtgacacacgctttgctcggctcttatgcagtccaagctgagctgggtgactatgacgcagaagagcatgttggcaactacgtgagcgagctgcgctttgctccgaaccaaactcgtgagctagaggaacggatcatggagttacataagacgtacaggggcatgacgcccggggaggcagaaatccactttctggaaaacgctaagaagttatccatgtacggggtggacctacaccacgctaaagactctgagggaattgatattatgctgggggtgtgcgcgaacggtctgttaatttatcgagaccgcctccgtattaataggtttgcctggcccaagattctgaaaatcagctacaaaaggtccaatttctacatcaaaatcagacccggtgagtacgaacagttcgagtccaccatcggatttaaactgcccaatcatcgatctgctaagcgcctctggaaggtgtgtatcgagcatcacaccttctttcgtttggtgtccccagaacccccccctaaaggtttcctggtcatgggaagcaaatttcgttactccggccggacacaggcacagacacgacaggcctctgcccttatcgataggcccgcaccttttttcgaacggtcctcatcgaaaagatacactatgagtcggtctctggatggagcggagttctccagacccgccagcgtgagcgagaatcacgatgccggtcccgatggagacaagagggatgaggatggagaaagcgggggccagcggagtgaggcagaagaaggcgaagttcgcactcctaccaaaattaaagagctcaaattcttagacaaacctgaggacgtgcttctgaaacaccaggcaagcataaacgaactaaaacgcaccctcaaggagccaaattctaagctaattcatagggacagggactgggagagggagaggaggttgcccagttctcctgcgagccctagtcctaaaggaacgcctgagaaagcaaatgagcgcgccgggctgagagagggcagcgaagagaaggtaaaaccaccccgaccacgcgcacccgaatcagacacaggtgacgaagatcaggatcaggaacgcgacacagtatttttgaaggacaaccacctagccatcgaacgaaagtgttccagcattaccgtatcttcaacgtcaagcctcgaagccgaggtggacttcacggtcattggggactaccacggatctgcttttgaggatttcagccgttctctgcccgagttggatagggataagagcgactcagataccgaagggctgctattctccagagatctcaacaagggcgcaccctcacaggacgatgagagcggaggaattgaggactcgcctgaccgcggggcttgttccacgccagacatgccccagtttgagcccgtgaaaacagaaaccatgactgtcagcagcctggctatccggaagaagatcgagccagaagcagtcctacagacgcgcgtgagtgccatggacaacacccaagagaattctctcaagtctggaaagggcgctgccgcaatgatccctggccctcagaccgtggccacagagatccgttctctgtcacccattatcgggaaagacgtgctcacctccacatacggggcgaccgctgagaccctgagtacttcaacaacaacacacgtgacaaaaactgtgaagggtggattcagtgagacgcgaatcgaaaagcgaatcatcattacaggtgatgaggacgttgatcaggaccaggctttggcactggccattaaggaggccaagctgcaacaccccgacatgctcgttacaaaggcagtcgtgtacagagaaactgatcccagccctgaggaacgggacaaaaagcctcaagaatcctag

SEQ ID NO: 116009 - DNA, 2646 bp, Artificial Sequence
  Description of Artificial Sequence: Synthetic coding sequence
atgaccaccgagaccggtcctgatagcgaggtgaaaaaggcacaggaagaagcaccacagcagcctgaggctgccgctgcagttacaacacctgtgacccctgccggacacggacacccagaggccaacagcaatgaaaagcatccttctcagcaggatactcgacctgccgagcagtcccttgacatggaagagaaagattactctgaggccgatgggttgagcgagaggaccaccccctctaaagcacagaagtctccccaaaagatagccaaaaagtacaaaagtgctatctgtagggtgacattgttagatgcgtccgagtatgaatgcgaagtggaaaaacacgggcgaggacaagtcctgttcgacctcgtctgcgagcatctaaatctgctggaaaaggactactttggcttgaccttttgcgatgcggacagccaaaaaaactggcttgatccgagcaaagaaatcaaaaagcaaattaggagcagtccctggaacttcgcattcacagtaaagttttacccccccgatccggcccagttaaccgaagatattacacgatattacctgtgcctgcagcttagagccgatattattacgggacgccttccatgcagcttcgtgacacatgcattactgggatcttacgccgtgcaagccgaactcggcgattacgatgcagaagagcacgttggcaactatgtgtctgaactgagattcgctcccaatcaaacacgcgagctggaagagcgcataatggaactccataaaacatacagggggatgacacctggggaggccgagatccatttcctggaaaatgcaaaaaaactttccatgtacggcgtcgaccttcatcatgccaaggactcggaagggattgacattatgttgggagtgtgtgccaatgggctgcttatctaccgggaccggctgcggatcaatcggtttgcctggcctaagatactgaagatctcctataaaaggtccaatttctatatcaaaattagacccggagagtacgagcaatttgaatctaccattggatttaaattgcccaaccaccggtccgctaagcgactgtggaaagtgtgcatagaacatcacaccttctttagactcgtcagtccagagccccccccaaaagggttcctcgtgatgggaagcaagtttcgttactccggtaggacacaggctcagacacggcaggcctccgccttgatcgatcggcccgcacctttttttgagcggtcttcaagcaaaagatacactatgtcccggtcgcttgacggggccgaattttcccggcccgcaagtgtttcggagaatcatgatgcaggaccggacggggataagcgtgatgaggatggggaaagtgggggccagcggtccgaggctgaagagggcgaggttcgtacccctaccaagattaaggaactcaagcctgaacaagagacgaccccccgacacaagcaggagttcctggataaaccagaagacgtactcctgaagcaccaggcatctattaatgaacttaaacgcacgctgaaagagcccaattcgaagttgattcatcgagatagagactgggagagggaacgcagattaccaagcagccctgctagtccatccccgaaggggacccctgaaaaggcaaacgagcgtgccggcctccgcgaaggatcagaagaaaaagttaagcctccccgacctcgagcgcccgaaagcgacacaggagatgaggaccaggatcaggaaagagacaccgtctttctgaaagataatcacctggcgatagaaagaaaatgcagtagtatcactgtgtctagtacttcatcgcttgaagctgaggtagacttcaccgtgatcggtgattatcacgggtctgcatttgaagacttctctcgctccctgccagagctggatagagacaagagcgacagcgatactgagggactcttattttcccgcgatttaaacaagggcgcccctagccaagacgatgagtccggtgggattgaagatagccccgaccgcggagcatgctccacaccagatatgccccaattcgagcctgtgaagaccgagacgatgacagtgtcatctcttgcgatcaggaaaaagatcgaaccagaggctgttctgcagaccagagtgagcgctatggacaacacccagcaggtggacggatccgcgtctgtcggcagggaattcattgcaactacaccctcaatcaccaccgaaacgatatccacgaccatggagaatagccttaaaagcgggaaaggtgccgcagccatgatccccgggccacagacagtggccactgagatccggtcccttagcccgattatcgggaaagatgttctgacgagtacttacggggctaccgctgagaccctgtccacctcaacgaccactcatgtgactaagactgtgaaaggcggatttagcgagactcggatagaaaagcgtatcattattacaggagatgaggatgtggaccaggaccaggccttagccctagcaattaaggaagcaaaactgcagcatccagacatgctggtgaccaaggccgtcgtctaccgggagactgatccaagccccgaggagagggacaaaaagccacaggagagctag

SEQ ID NO: 116010 - DNA, 2877 bp, Artificial Sequence
  Description of Artificial Sequence: Synthetic coding sequence
atgtcgagatcattggatggtgctgaattctcacggccagccagtgttagtgagaatcacgatgctgggcctgatggtgacaaaagagatgaggacggggagtccgggggccagcggtctgaggccgaggaaggagaagttcggacccctactaaaatcaaagagttgaaaccagaacaagagacaactccgcgccataagcaggaatttctggataagccagaggatgtgctgctgaaacatcaggcttcgataaatgagctcaagcgaacactgaaagaacccaatagcaagctgatccatcgcgacagagattgggaaagggagcgccggctccctagcagcccagcttccccttctccgaaggggacccccgagaaggctaacgaaagtcagagaacacaggatatctcgcagcgcgacctggtacccgagcccggggccgcggccgggttggaagtattcacacagaaatcccttgccgcaagccccgagggcagtgagcactgggtctttatcgaaagagaatacacacgacccgaagaactgggcttgcttaaagttacaacgatgcagcaggaggagaggcaggcaggcctggccggaatcttagctaacggccgtttatccaaggtggacgttttggtagataaattcaaagtagaagttgctaccgaggagatggtcggaaatcgaagggctaacacgcaacagcagggtaagatgatcgcctcacctgaggacttcgagtcagtaggtgaagagggaccgtggatcagggagtcacctgggggggcggccctggctagtggtagaacgctagccgaaaagttgctggaaggctctgaactgagggcggacacccgtgaagccactatacgaaacagatgcatgtctgatggccagcctgagggccaaaccgaactccgtaagggcctggaagaaccgcacacctgcgggaggcccaccgcacccggaacccgacccgctgaagtggacgtactgtctcctgctagcgacaagggagggctgcaatctttcctgctggatcctgcacatgccgaggcgcgcgcggagctgtccaacgagacagatacctccttcgccgagcgtagcttctatcttaactatgaggagaaagactctgaggaccaggttctgccaccccccctggaagagcgaaaggggagactggatgcacctcctggaggtgagcctcgccctacgctgaactctctcgacttgcgagtttctgccgcagctagcagccggtcaaaagacgaggcacatatgacctcccctaaggaaggggctggtacacccaaaaatcacgggggaccaggtgatctgaaaggatctcccgctggtcagacatttgctgagggctgggaagatgcacagtggggggtagaaggcgaatttcctcaccttacagctagtgccgcacgagaggaaggaacgccggtatccggagatctgttagggaaggctgaggagtctcccactgaagagctgaaaaagcatcctcctcacagaggtcaaggtgtccatcccgaccctcaagcctgtgctctgcccagggccatcccactcaacgtgcgaaaacccgtaaaaccggatcgcggtaactttccgccaaaagagcggggcgtggtccctacgcagaagggtggcgcagagctcaaagatcgagaggcttctgcttttctgcacatggaggtaattattccactgcccgcctcaccaggtcactcagaggatctcgcagcactggaggaggcatctcccagtcctacctctcatgggtctggggagccttccgagcttcgagaaccattcctaagacacgtgcacctgagcaaagccagcccagaacccaaagatcaggtgggcttcgtcgtgtcacccgccaccgggggagagcgccggcccccgcctatcacttcccggaagccccgtgtggttcccgaggaggccgaaggccggatcccacttggtttcggattcccctccggtaagcgcagagaaatgacaagcttccaggccggagaccaggaagggtccctagaggacatctcaaaaacctccgtggctaacaagatccgcatcttcgagacacacggggctgaaacccgcaggatgtcagaaggtgaagctcgcagcttgcccaacgacgtgtctagcgaggcacccgtgggccaagcggagcagcagcggtccacactgtctgaccttggtttcgcacaacttcagccaccaggggacttcgcctctcctaaggctacacactcaaccgtaatacctctcgcgacccggcattttagagaggacacaagtgcaagctaccaggaggctcataccgagctcgagcctgtttcaccaaattccgggtgtgaaaccacactggccgaggccacgggtactggcaacaaaagtggagatgcagtgagagaggagaagcggtccacaaacctcgccgcaaacacacccggcaaaggtgggcgccttagattcgcctcgccctccgggccacagcgggctggtctgcgggaaggaagtgaagagaaggtaaaacccccgcggcctcgcgcccctgaaagcgacaccggcgacgaagatcaagaccaagaacgcgatacagttttcttaaaggacaaccacctcgccatagagcgcaaatgtagcagcattactgtgagctccacctcaagtctcgaggctgaagtggatttcacagtgataggggactaccacggtagcgcgttcgaggacttcagccgttccctccctgagctagatagagataagagtgactcggacacagagggactgctgttcagccgcgatttaaacaagggcgccccaagccaggactag

SEQ ID NO: 116011 - DNA, 2643 bp, Artificial Sequence
  Description of Artificial Sequence: Synthetic coding sequence
atgaccactgagacaggtcccgatagcgaggtgaagaaagcacaagaggaagcgcctcagcagccagaggctgcggccgccgtaactactcctgtcaccccagccggccacgggcatcctgaggctaatagcaatgagaagcacccatcgcagcaggatacgaggccggccgaacaatctctggatatggaggaaaaggactattctgaagcagacggcctctctgaaaggaccactccttctaaggctcagaagtctcctcagaagatagctaagaaatacaaaagcgcgatctgcagggtcactctcttagatgctagcgagtatgaatgtgaggtcgagaaacatggtagaggacaagtcttgttcgacctcgtgtgcgagcatttgaacctgctggagaaagactactttgggctgactttctgcgacgctgattcccagaaaaactggctggacccctccaaggagattaagaaacaaattagatcttccccatggaactttgccttcaccgttaagttctacccacccgatcccgcacagctgaccgaggatatcacacgatactatctgtgtctgcagctgcgggcagacattataaccggccgattgccttgcagctttgtcacccatgctttactcggatcctacgctgtgcaggccgaacttggcgactatgacgccgaggagcatgtcggaaactacgtctccgaactgaggttcgctcctaaccaaactagagagctagaagagcgcataatggagcttcacaagacgtatcgtggcatgacacccggcgaggcagagatccacttcctggaaaacgcgaagaaactaagcatgtacggggttgacttacaccatgcaaaggactcagagggcatagatataatgcttggagtgtgcgccaatggactattgatttaccgcgatcggcttcgaattaatcggttcgcgtggcctaagatcctgaagatttcttataagcggtccaacttttacattaaaatcagacccggcgagtatgagcagtttgagtccacaataggattcaagctgcccaatcatcgatctgccaagcgcttatggaaagtctgcatcgaacaccacaccttctttcgcctggtttcacctgagccccccccgaaaggcttcctcgtgatggggagtaaattcagatactctggacgcacccaggctcagacacgccaagccagcgctctcattgacagacccgcaccattctttgagagatctagtagcaaacggtatactatgtctaggtcccttgacggcgccgaattcagtcgccccgccagcgtctcagaaaaccacgatgctgggcccgacggggataaacgcgatgaagacggggagtctggtggtcagcgctctgaagccgaagaaggcgaggttcgcaccccaaccaaaatcaaagagcttaagcctgagcaggaaacaacacctaggcataaacaggaattccttgacaaaccggaggacgtgttgcttaagcaccaggccagcattaacgagctgaagcgcaccttgaaggaaccaaattcaaaactgatccacagagaccgggactgggagcgcgaacgtagactgccatctagtccggctagtccctcaccgaaggggacacccgaaaaggcaaatgaaagagccggcctgagggagggctcagaagagaaagtgaagccaccacgacccagagcaccggagtctgacacaggcgatgaagaccaggatcaggagcgggacaccgtattcttgaaagataatcacctggcaattgagcgcaaatgctcaagtatcactgtcagctccacctcttcactagaagctgaagtcgatttcacagtcatcggcgactatcacggcagcgcctttgaggacttctcgcggtcccttcctgagttggacagggacaaatccgacagcgacaccgaaggactactgtttagccgggatttgaataagggagctcctagtcaggatgatgagtctggaggtattgaagattctcccgatcgtggtgcctgctctactcccgacatgcctcaatttgaacctgtgaaaactgagactatgaccgtgtccagtttggctatcagaaaaaaaatcgagccagaggccgtgctccagacacgcgtctctgccatggataacacccaagtggatggaagtgcttctgtcgggcgggagtttatcgcaaccaccccctccattacaaccgagactatttcaacaactatggagaattcccttaagagcgggaagggcgctgccgccatgatccctggcccgcagaccgttgctacagaaatccggtcgctgtctccaatcatcggaaaagacgttctgacttcgacctatggggccacagctgaaactctgtccacttctaccaccacacacgtgaccaaaacagtcaaaggagggttttccgagacacggatcgagaagcgaattatcattacaggagacgaagatgtggaccaagaccaggccctggccctggctataaaagaggctaagctccaacatcctgacatgctcgttacaaaagctgtcgtttatcgcgagacagatccaagccctgaagagcgcgataagaaaccacaggaatcatag

SEQ ID NO: 116012 - DNA, 600 bp, Artificial Sequence
  Description of Artificial Sequence: Synthetic coding sequence
atggaggaaaaagattatagtgaagctgatgggctatcagaacggacaacaccgagcaaggctcagaaatcaccacagaagatagctaagaagtataaatcagccatatgtcgtgtgacactgctggatgctagcgaatacgaatgcgaagttgaaaaacacgggcgcggacaggtactgtttgacctggtgtgtgagcacctgaacttactggagaaagactatttcggcttgacgttttgtgacgccgattcacagaagaactggttggacccatctaaagagataaagaagcagataaggtcctcaccctggaattttgctttcacagtgaagttctaccctccagaccccgctcagctaacagaggacatcactcgctattacctgtgtcttcagctgagagccgatatcataacagggagactgccctgtagtttcgtgacccatgcgctgctgggatcttacgccgtgcaggcagaactgggcgattatgacgccgaagaacacgtgggtaactatgtgagtgagctgcggttcgccccgaaccagaccagagaattagaggagagaattatggaactgcataaaacctactag

SEQ ID NO: 116013 - DNA, 2106 bp, Artificial Sequence
  Description of Artificial Sequence: Synthetic coding sequence
atggttttcctaggacgaattaatgaggtagagcccgccaaaggactagcggaatctcttgcccctactgaacgctctgttaaatccctcgacatggaagagaaagattactccgaggcagatggactgagtgagagaacaacaccttccaaggctcagaaatccccccagaaaatcgccaagaagtataaatccgcaatctgtcgggtgacactgctagacgcttccgagtacgagtgcgaagtggaaaagcacggtagaggtcaagtgctgttcgacctggtgtgtgaacacctgaatctgctagagaaggactacttcggcctgacgttttgcgatgccgactcacagaaaaattggctggatccatcaaaggagatcaagaaacagatcagaagcagtccctggaatttcgcttttactgtcaagttttatcctcccgaccccgcccagctcaccgaggatataacacgatattacctgtgtctacaattgcgggccgatattattacgggcagactgccttgcagctttgtcactcacgcactcttgggctcatacgccgtgcaggctgagctgggagactacgacgcagaggaacacgtcggcaattacgtttccgaactcagatttgcgccaaatcagaccagggaattggaggagaggatcatggaattacataagacctacagggggatgacacccggagaggctgagatccacttcctcgaaaacgccaagaaactttcaatgtacggggtcgacctgcatcatgctaaggacagcgaaggaatcgacattatgcttggtgtctgcgccaacggactcctgatctatagagatagactccgaatcaatcggttcgcatggcccaagatccttaagattagttacaagaggagtaacttttatattaaaattcggcccggcgagtatgaacagtttgagagcaccatcggctttaagctgcctaaccaccgttctgctaagcggctgtggaaggtgtgtatagaacatcacacgttctttagactggtgtcacctgaaccacctccgaagggctttctggtgatgggctcaaagttccgatacagcgggagaacccaggcacagacacgacaggcctctgcactcatagaccggcccgcccccttctttgagaggagttcttccaaacggtatacaatgagtcggtccctcgacggcgcagaattcagcagacctgcgtctgtatccgaaaaccacgacgccggaccagatggggataaaagagacgaagacggcgagtccggcggccagcgcagtgaggcggaagaaggggaggtgagaacacctacaaagattaaggagctgaagtttcttgacaagcccgaagatgtcctgttgaaacaccaggcctcaattaatgagctgaagcggactctcaaggagcccaattctaagctgattcacagagaccgagactgggaacgtgagagacggctccccagttctcccgccagccctagccccaaggggacccccgagaaggctaatgaacccgtgaagacggagacaatgaccgtgtcctcattggctatccgcaaaaaaatcgaacctgaggccgtgctgcagactcgggtaagcgccatggataatacccaacaggtggatgggtctgcttctgtcggacgggaatttatagccacgaccccatccatcactaccgaaaccattagcacgactatggagaactccctgaaaagcggaaagggcgcagctgccatgattcccggcccccagactgtcgcgactgagattcgctctctgtcccctatcattggcaaagacgtcctgacttctacttacggtgcaaccgccgaaacactctccaccagtacaaccacacatgtcacgaaaaccgtgaaaggcggcttttcagagactagaattgaaaagaggattatcatcacgggcgacgaggacgtggatcaggatcaggcacttgccctggccatcaaggaggcaaagttgcagcatccagatatgctcgttactaaagctgtggtttaccgtgagactgatccatctcccgaggagagggacaagaagccacaggagtcatag

SEQ ID NO: 116014 - DNA, 2319 bp, Artificial Sequence
  Description of Artificial Sequence: Synthetic coding sequence
atggaggagaaagactactctgaagcggacggcctgtccgagaggactactccttcaaaggctcaaaagtccccgcagaaaatcgccaagaagtataaaagtgccatttgcagggtcaccttactagacgcttccgagtacgaatgcgaagtggagaattggctcgatcctagtaaggagatcaagaagcagattaggtccagtccatggaatttcgccttcacggtgaaattctacccccccgatcccgcccaactcacggaggatatcaccaggtactatctgtgcctgcagctgcgggccgatatcatcactggaaggctcccttgttctttcgttacacacgcattgttgggatcatatgccgtccaggctgaactcggcgactacgatgccgaagagcatgttggcaactatgtcagcgaactccggttcgcccccaatcagacaagagagctggaagagagaataatggagttgcacaaaacctatcgcgggatgacaccaggggaggccgaaatacacttcctggagaatgctaaaaagctgagcatgtatggcgtggatcttcatcacgctaaggactcggagggcatcgatattatgctcggggtgtgcgccaatggtctcctcatttatagggaccgccttcgcattaatcgtttcgcctggccaaaaatcttgaaaattagctacaaacggagcaatttttacatcaaaatacgccctggagagtacgaacagtttgagtccactattggatttaagctccctaaccatagaagcgcgaagcgactgtggaaggtgtgtatcgagcaccacactttctttcgcctggtgagcccagaaccaccccctaagggctttctggtaatgggttccaagttccgctattcaggaaggactcaggcgcagacaagacaggcgtcagctctgattgaccggccagccccttttttcgagcggagcagctccaaacgatacacaatgagtagatcattggatggtgcagagtttagtcgtcctgcttccgtgtccgaaaaccacgatgcgggacccgacggcgataaacgggatgaagatggagaaagcggtgggcagaggagcgaggcagaagagggcgaggtgcgaacgccaacaaaaattaaagagctcaaattcttggacaaaccagaggacgtcctgctgaagcaccaggcttccattaatgagctcaaacgcaccctgaaggaacctaactccaagctcattcaccgtgatcgcgattgggaacgagagcgccgcctgcccagttcaccagcaagtccttctcccaaaggcacaccagagaaagctaacgagagggctggacttagagagggctcggaggaaaaagttaagccaccaaggccccgggctccagagtccgacacaggtgacgaggaccaggaccaggaacgcgacaccgtctttctgaaggataaccatctggccatagagcgtaaatgcagctctattaccgtgtcttccacttcctcccttgaggctgaagtggactttaccgtgattggagattaccacgggtcagccttcgaggacttcagccgctcactccctgagctggatcgggataaatccgactcagacactgaggggctcctcttctcccgcgatctcaataagggcgctcccagccaagatgatgagtccggcggcatcgaggatagccccgacagaggggcctgttcgactccagatatgcctcagtttgagcccgtcaaaaccgagacaatgaccgtgtctagccttgccatccgcaagaaaattgaacccgaggccgtgttgcagaccagggtgtctgcaatggataatacacagcaggtggacggtagcgccagcgtgggtcgggagttcatcgcaaccacaccttctatcacgaccgagaccatttctacaaccatggaaaatagcctgaagagcggtaagggggccgccgctatgatcccggggccccagactgtagcgaccgagatccggagcctcagcccaatcatcggcaaggacgtcctgacctcgacctatggcgctactgccgaaactctaagcacaagcacaaccacccacgttacaaaaacggtcaagggtgggttctcggagacccggatcgaaaagagaattattatcacgggggacgaggacgtcgatcaagaccaagcacttgccttggccatcaaggaggcgaagctccaacatcccgatatgctcgtcaccaaggcagtcgtgtatcgcgaaaccgatccttctcctgaggagcgagataagaagccgcaagaatcctag

SEQ ID NO: 116015 - DNA, 2319 bp, Artificial Sequence
  Description of Artificial Sequence: Synthetic coding sequence
atggaagaaaaagactactcagaggcagacggtctaagtgaaaggaccacgcccagcaaagcccagaagagtccccagaagatcgcaaagaaatacaaatctgccatttgccgcgtcacactcctggatgcatctgagtacgagtgtgaagtggagaattggctggacccatccaaggagatcaagaagcaaatcagatcttccccttggaacttcgcctttactgtgaagttctatccgccagaccctgcccagctgaccgaggacattacccggtactacctttgtctccaacttagagccgatataattaccgggcgcctgccgtgttcttttgtaacccatgcgctcctggggtcctacgccgtgcaggccgaattaggcgactatgacgcggaagaacatgtgggaaactatgtgtctgagctgagattcgcaccaaatcaaacacgcgaattggaagagagaataatggagttacacaaaacatacagagggatgacaccaggcgaagctgagatccactttctggagaacgccaagaagttgtctatgtacggtgttgacctgcaccatgctaaagactccgagggcattgacataatgcttggcgtctgcgccaatggtctgctgatttacagggaccgactgagaattaatcggttcgcatggcctaagattcttaaaatttcctacaaacgcagtaatttctacataaagattagaccaggggagtatgaacagttcgagtcgaccatcggtttcaagctgccgaatcatcggtccgctaaacggctgtggaaagtctgcattgaacatcataccttctttcgacttgtgtctcctgagccgcctcccaagggctttctggtgatgggatcaaagttccggtactcaggtcggacacaggcgcagacgcgacaggcgtctgcactcatcgatagaccagcccctttttttgagcggagtagttcaaaacgctatacgatgtcgcggtcactggatggagccgagttctcacggccagccagtgtgagcgaaaaccacgacgcaggccccgatggtgacaagagggatgaggacggagagtctggggggcagcgtagtgaggctgaagaaggcgaggtgcggaccccaaccaagatcaaggagttaaaatttctcgataaacccgaggatgtgttgctcaaacatcaggcctcaataaatgaactgaaaaggactttgaaggaaccgaacagtaaactgattcatagagacagggactgggaacgagagcgacgcttgccgagcagccccgccagccccagccctaaaggaactcccgagaaggccaacgagcgagccgggctcagggaagggagtgaggagaaggtcaaacccccgcgaccgagggcacccgagtctgatacaggcgatgaagatcaggaccaggagcgtgatacagtgtttctgaaggataatcatcttgccatagaaagaaaatgctccagtattacagtttcttcaaccagcagcctagaagccgaggtcgactttacggtcattggtgactaccacggctctgccttcgaggacttctcccggtctcttcctgagctggaccgggacaagtctgactcagacacagaaggtcttctattttcacgagatttgaataaaggcgccccctcacaggacgatgaaagtgggggtattgaagactcccctgaccgcggcgcttgttcgaccccagatatgccccagttcgaaccagtgaagacagaaaccatgactgtgtcgtcactggccatcagaaagaaaatcgagccagaggctgtgctccagacacgggtatcggccatggacaatacccagcaggtggatgggtccgccagcgttggccgagaattcattgctactacaccatccattacaactgagaccatctccacaacaatggagaacagtttaaagagcggcaagggagccgctgccatgataccaggaccacagacagttgctacggaaattcgcagtctctcccctatcattggaaaggacgtgctgactagcacttatggagccacagccgaaaccctgagcacgtcaaccaccacacatgtcacgaagaccgttaaagggggattttctgaaaccaggattgaaaaaagaattattattaccggtgatgaagacgtggatcaggaccaggcgctcgccctcgccataaaagaagctaagctgcagcaccccgatatgctggttacaaaagctgtagtgtatcgggagaccgacccgtctcccgaagagcgggacaaaaaacctcaggagtcttag

SEQ ID NO: 116016 - DNA, 600 bp, Artificial Sequence
  Description of Artificial Sequence: Synthetic coding sequence
atggaggaaaaggattactctgaagcagacggactgtccgagcgtactactccctctaaagcccagaagtctcctcagaaaatcgctaagaagtataaatccgctatatgtagagtgactctgctggatgcctcagagtacgagtgtgaagtggaaaagcatggtcgcggccaggtcctgttcgacctcgtgtgcgaacacctcaacttgctcgagaaggattattttgggctgaccttttgtgacgctgattcacagaagaactggctggaccccagtaaggagatcaagaagcagatacgatcgagtccctggaattttgcttttaccgttaaattctaccctcccgacccggcccagctcacagaggacatcacacgatactacctttgcctccaactgcgtgccgatatcattaccgggcgtttgccttgttcattcgtcacacatgctcttctgggatcctacgcagtccaggccgaactgggcgactatgatgccgaggagcacgtcggaaactatgtctcagagctacgcttcgctcctaaccagacaagagagctagaagaacggataatggagcttcataagacctattag

SEQ ID NO: 116017 - DNA, 2385 bp, Artificial Sequence
  Description of Artificial Sequence: Synthetic coding sequence
atgacgactgaaactggccctgatagtgaagtgaagaaggcccaagaagaggccccccagcagcctgaggccgcagcggctgtgactaccccagtcacccctgcaggacatggccacccagaggctaacagcaatgagaaacaccccagccaacaggacacacgtcctgctgagcagtctctggacatggaagaaaaagactattcggaagcagacgggctgtccgagcgaaccaccccttccaaagctcagaagtctccacaaaagatcgcaaagaagtataaatccgccatatgtcgggttactctcctcgacgcctctgaatacgaatgtgaagtggaaaagcatggtcgggggcaggtcttgttcgacctggtgtgcgaacacctcaacctgctcgagaaagattactttggtctgacattttgtgatgcggactctcaaaaaaactggttggatccttccaaggagatcaagaaacaaatacgaagcagcccatggaatttcgcattcactgtaaaattttacccacccgaccctgcccaacttacggaagatattacacggtactacctgtgtctgcaattacgcgccgacatcatcactggccgcttgccctgttcttttgtgactcacgccctcctggggtcctacgctgtgcaggcagagttgggtgattacgacgccgaagagcacgtggggaactacgttagtgaattaaggtttgcccccaatcagactcgcgaactggaggaacgcatcatggagctgcacaagacgtacaggggaatgacgccaggagaagctgagatccattttttggagaatgcaaagaagctgagcatgtacggagtggatctgcaccacgctaaggactcagaaggcattgatatcatgttgggagtgtgtgccaatgggttgctaatataccgtgatcgccttaggatcaaccggtttgcttggccaaagattctaaaaatctcctataagcgctccaatttttacatcaagatccgacctggtgagtatgaacagttcgaaagcactataggctttaaactgcccaatcataggtcggctaagcggctgtggaaggtttgcattgaacaccatacctttttcaggcttgtaagccctgagcccccgccaaagggcttcctggttatgggaagcaagtttcggtattctggtcggactcaggctcaaacccggcaggccagcgcactgatcgatcgcccagctccattttttgagagatcatcctcaaagcgatacacaatgtcacgatccctggacggggccgagttcagccgcccagcctcagtcagcgagaaccatgacgctggaccagatggagacaagcgggacgaagacggtgagtcgggcggccagaggtccgaggccgaggagggcgaggtgaggacaccaaccaaaataaaggagctcaagcccgaacaggaaaccacccccagacataagcaggaattcctagacaaacccgaggacgtgttactgaagcaccaggcttccatcaatgaactcaagcggacactcaaggagcctaattcgaaactcatccacagggaccgagactgggagcgagaaaggagactaccatcgtcccccgcctcacctagtcctaaggggacccccgagaaagcaaacgagagggctggcctgcgcgagggaagcgaggaaaaggtgaagcctcctcggccacgagcccctgagagcgatacaggcgacgaggaccaagaccaggagagagacactgtattcctgaaggataatcatctggctatcgagaggaagtgctccagcataacagtctccagcacgtcctccctggaggctgaagttgatttcaccgttatcggagattatcacgggtcagccttcgaggatttttcccgatccctgccggagctggatcgggacaagagtgattctgacaccgagggcctgctgttctcccgggacctgaacaaaggggctccctcacaggacgacgaatctgggggtattgaggattcaccggatcggggagcctgcagtacaccagacatgccccagttcgagcccgtgaaaaccgagacgatgacggtcagctctctggccatccgcaaaaagatcgaacctgaagctgtccttcagaccagagtcagtgcaatggacaacacgcaagagaactcgctgaaaagcggaaagggagccgctgccatgatcccaggtccgcaaactgtggctaccgaaataagatccctgagcccttccgcagatcaccgggagagatgcccacatcagcaccttagaaggcattgtgggaatccgctcaatctgcaccaccacccctgtcaccagaattgtgaacggcgcgtgttctag

SEQ ID NO: 116018 - DNA, 507 bp, Artificial Sequence
  Description of Artificial Sequence: Synthetic coding sequence
atgactactgaaacagggccagatagcgaagtcaaaaaggcgcaggaagaggctccccaacaacccgaggctgccgccgccgtcactaccccagtgacacctgcgggccacggccacccagaagctaacagcaatgagaaacaccccagccaacaggacactagacctgcagaacagtccctcgatatggaagaaaaagactatagtgaggccgacggcctgagtgaaagaacaacgcctagtaaagctcaaaagagcccacagaaaatcgcgaagaagtacaaatcagctatttgcagagtaacactactggacgcctccgagtatgaatgtgaggtagagaagcacggtagaggacaggtcttgtttgaccttgtctgtgaacatctgaatctgctcgagaaggactactttggacttaccttttgcgacgccgatagtcagaagaactggctggacccttccaaggagattaaaaaacaaatcagaagttccccctggaactag

SEQ ID NO: 116019 - DNA, 180 bp, Artificial Sequence
  Description of Artificial Sequence: Synthetic coding sequence
atgactaccgaaacagggcccgacagcgaagtcaaaaaggcccaagaagaggctcctcagcagcctgaggctgccgctgccgtgactacgcctgtaaccccagcaggtcatggacatcccgaggctaattccaatgaaaaacaccctagtcagcaggacactagacccgcagagcagtag

SEQ ID NO: 116020 - DNA, 774 bp, Artificial Sequence
  Description of Artificial Sequence: Synthetic coding sequence
atggaagaaaaagactacagcgaggcagacggcttgtccgagaggactacccccagtaaggcacaaaaatcgcctcaaaaaatagcaaagaagtataaatctgcaatctgccgggtgacccttctcgatgctagcgagtacgagtgtgaggttgagaagcacggaagggggcaggttctgtttgacctagtctgcgagcacttaaacctcctggagaaagattacttcgggttgactttctgtgatgccgatagtcagaaaaactggttggatccttccaaagagatcaagaagcagatccgaagctctccctggaatttcgcatttacagtgaagttttacccacctgaccccgcccagcttacagaggatattacccggtattacctttgcctccagttgagggctgatatcatcactggccggctgccatgcagtttcgtgacccacgccctactaggatcttacgcagtccaggctgaattgggtgattacgacgccgaagagcacgtgggcaactatgtgagcgaactaaggttcgcacccaaccagacgcgggaattggaagagcgcatcatggaactgcataaaacctaccgaggaatgacccccggggaggctgaaatccacttccttgaaaatgctaaaaagttgtctatgtacggggtagacctccaccacgccaaggacagcgaaggcatcgatatcatgctaggtgtctgtgcgaacggactgctaatctacagggatcggctgcgaataaacagattctag

SEQ ID NO: 116021 - DNA, 114 bp, Artificial Sequence
  Description of Artificial Sequence: Synthetic coding sequence
atggaagagaaggattacagtgaagcagatggactctccgaaagaacaacaccaagcaaggcacagaaatctccccagaagatcgccaaaaagtacaaatcagccatctgctag

SEQ ID NO: 116022 - DNA, 360 bp, Artificial Sequence
  Description of Artificial Sequence: Synthetic coding sequence
taaagcgtggggagagaatttattgccacgactcctagtataaccacagagacaatttccaccaccatgattattggcaaggacgtcctgacctctacctacggtgcgacagcagagaccctgagtacatcaaccacaactcatgtcaccaagactgtcaagggcggtttttctgaaacgcgcatagagaagcgcataatcatcacgggagacgaggatgtcgaccaggaccaggccctggcactggctattaaggaagctaaactgcagcatcctgacatgctggtgactaaggcagtggtctaccgcgagacggacccgtcccccgaggagcgcgacaaaaaaccccaggagtcttag

SEQ ID NO: 116023 - DNA, 2340 bp, Artificial Sequence
  Description of Artificial Sequence: Synthetic coding sequence
atggaggagaaggattacagcgaagctgatgggctcagcgagaggaccacaccttctaaagctcagaagtctccccagaaaattgcaaaaaagtacaaatccgctatctgtagagtcactcttctggatgcaagcgagtacgaatgcgaggtcgaaaaacatggccgggggcaggtcctgtttgacctggtgtgcgaacacctcaaccttctggaaaaggactatttcggcctcactttttgcgacgcggactcccagaagaattggctggacccgtctaaggagatcaagaagcagatccgctcttccccctggaattttgccttcactgtgaagttctaccctcctgatcctgcccagttgactgaggacataacccgctactatctttgcctgcagctgcgcgccgatatcattaccggtcgtctgccatgttccttcgtgacccacgcattgctgggaagctatgccgtgcaggccgaactgggagattacgacgccgaagagcatgtgggcaactatgtaagcgaactgcgattcgctcccaatcagactagggaactggaagagcggatcatggagttacataaaacttaccgaggcatgacgcccggagaagctgagatacacttcttagagaatgcaaagaagttgtccatgtacggcgtggatctacaccatgcaaaggattctgagggtattgacatcatgctcggcgtgtgcgctaacggcctcttgatttaccgggaccgtctacgtataaatagattcgcatggccgaaaattctgaagatttcttacaaaaggtcgaatttctacatcaaaatccggccaggcgagtatgaacaattcgaatcaaccattggatttaaactgccaaaccatagaagtgccaagagactgtggaaagtctgcatcgaacatcacacattttttcgtctagtcagtcccgaaccaccgcctaagggatttctcgtcatgggcagcaaatttcgttatagtggtaggacccaggctcagacacgtcaggccagtgcactcatcgatcggccagccccttttttcgagcgctcatccagcaagaggtataccatgtctaggagcctcgatggcgctgagttcagcaggcccgccagtgtgagtgagaaccatgacgctggacctgacggcgacaaacgggatgaagacggagaaagtggtggtcagcgatctgaggccgaggagggggaggtaaggactcccactaagattaaggaactgaagtttctagacaaacccgaggacgtgcttttgaaacaccaagcctcaattaacgaattgaagcggacccttaaggagcctaatagcaaactgatccacagggacagagattgggaaagggagcggcggttaccttccagcccggcctccccatcccctaagggcacccccgagaaggctaacgaacgtgccggactacgagagggtagcgaagagaaagttaaacccccccgcccccgcgcaccagagagtgatacaggagacgaggaccaggaccaggaacgggacactgtcttcctgaaagataaccaccttgcgatcgaaagaaagtgtagcagtatcacagtctcatccacgtcgtctctggaagccgaagtggactttaccgtcattggagattaccacggttcagcctttgaagatttttcacgcagcctgcccgaactggatagagacaagagcgactccgacacagaaggtctcctgttctcccgggatctgaataagggagccccaagccaggatgatgagtctggcgggatcgaggactccccagatcgtggagcctgttcaacacccgacatgccacagtttgagcccgtaaagaccgagaccatgactgtgtcatcccttgcaatccggaaaaaaattgagcctgaggctgtcctgcaaacccgagtgtcagcaatggacaacacccaggagaactccctgaaaagcggaaaaggggccgccgctatgatccctggcccacagacagtcgcaacagaaattcggtctttgtccccaattattgggaaagatgtcttaaccagtacatacggcgccacggccgaaaccctttctactagcacgactacccacgtgacaaaaaccgtgaagggcgggttcagtgagacacgaatcgagaagcgtattatcatcaccggagatgaggacgtggaccaggaccaggctcttgcactggcaatcaaagaggcgaaactacagcatcccgatatgcttgtcaccaaggcagtggtgtaccgggagacagatcctagccccgaagaacgggataagaagccgcaagaatcctag

SEQ ID NO: 116024 - DNA, 345 bp, Artificial Sequence
  Description of Artificial Sequence: Synthetic coding sequence
atgaccacagagaccggtcccgactctgaggtgaaaaaggctcaggaagaagccccccagcagcctgaggccgcagccgccgttaccacccctgtcacaccggcaggccacggccatccagaggcaaactctaacgaaaagcatccttcacaacaggacacacggcctgccgagcagtctctggatatggaagagaaagattattcggaggctgacggtctcagtgaacggaccacccctagcaaggcgcaaaaaagcccgcagaagatcgccaaaaaatacaagtccgccatctgcagagtgacactcttagacgcctcagaatatgaatgcgaagtggagtag

SEQ ID NO: 116025 - DNA, 567 bp, Artificial Sequence
  Description of Artificial Sequence: Synthetic coding sequence
atgacgaccgaaactggccctgactctgaagtgaagaaggcacaggaagaggccccccaacagcctgaggccgccgcagcggttacaaccccggtcacccctgccgggcacggacacccggaggccaactccaacgagaagcacccctctcagcaagacaccaggccagcagagcagagtttagacatggaggaaaaggactactcagaggccgatggattatctgaacggaccacaccctcaaaagcacaaaagtccccacagaagatagctaaaaagtacaagtccgccatttgtcgagtgactctgctggatgcaagcgagtacgaatgtgaggttgagaagcacggaaggggccaggtgcttttcgatttggtctgcgagcacctgaatctactcgagaaagactattttggactgacattctgcgatgccgactctcaaaaaaactggttggatccaagcaaagagattaagaaacaaatccgtagcagtccctggaattttgccttcaccgttaaattctatccaccagaccccgcacagctcacagaggacattacctag

SEQ ID NO: 116026 - DNA, 705 bp, Artificial Sequence
  Description of Artificial Sequence: Synthetic coding sequence
atggagtcgacacctgagccgaggcccaacgagtgggagaagcgcagaattacgccactctccttacagacccagggtagaaaaggggaccacctcttcaaggacatcctgagcgtaaaggaaaagtacctgatgccaactatatggacagtcgaggagaaagcgcaagaaactgataaaactcgcgcacccgagtctgaaggcccctgtaccggagctagggacgcggtgaagtctagccacgagacgctgaatattgtggaggagaaaaagcgcgctgaggtgggaaaggacgaacgggtcatcactgaggagatgaatgggaaggaaataagtcccggctctgggccaggggagattcggaaagtggagcctgtgacacagaaggattccactagcttgtcatcggagtcttccagctcttcatcagaatctgaggaagaggacgtgggagaataccgaccgcaccaccgagtcacagaggggactattcgggaagaacaggagtacgaggaggaggtggaagaagagccacggccagccgccaaagttgtagagcgcgaagaagcggtacccgaggctagccccgttacgcaagccggcgctagtgtaatcaccgtagaaactgtaatccaggagaacgttggtgcccagaaaattcctggcgaaaagagtgtacatgaaggagcactgaaacaggactag

SEQ ID NO: 116027 - DNA, 3018 bp, Artificial Sequence
  Description of Artificial Sequence: Synthetic coding sequence
atgacaactgaggtcggctctgtgagcgaagtgaaaaaggattcatctcagttaggcacagatgcaaccaaggaaaagccgaaggaggtcgccgaaaatcagcaaaaccaaagcagtgaccccgaggaagaaaagggtagtcagcctccacccgcagccgaaagtcaatcaagcctcaggaggcagaagcgggagaaggagaccagtgagagccgcggcatttccaggtttattccaccgtggctgaagaaacagaagagttacaccctcgttgtagcaaaggatggaggcgacaaaaaagaacccacacaggccgtggtggaggaacaggtcttggataaagaggagcccctgcctgaagaacaacgacaggccaaaggcgatgccgaggaaatggcccagaaaaagcaggagatcaaagtcgaagtgaaagaagagaagcccagtgtctccaaggaagagaaaccatccgtaagtaaggtcgagatgcagcctacagaactggttagtaaggaaagagaagagaaggtaaaggaaacccaagaggacaaactggagggcggcgcggctaagagagaaactaaggaagttcagacaaacgagcttaaggccgagaaggcaagccagaaggtgacaaagaaaacaaagacagttcaatgtaaggtcaccctgctggatggaaccgagtattcgtgtgacctggagaaacatgccaaaggccaggtgctcttcgacaaagtctgtgaacacctgaacctgttggagaaagactatttcggcctgctttttcaggagtccccagagcagaaaaattggcttgaccccgccaaagagattaagagacagctcaggaacctcccatggctgttcacctttaatgtgaagttctatccgcctgatccctcgcagttgactgaagacattacgcgatactttctctgcctccagttgcggcaggatatcgctagtggcaggctgccctgctccttcgtgactcatgcactcctcggtagttataccctacaggctgagcttggggactatgatcccgaggagcacggtagcattgacctctccgagttccaattcgcaccaacccaaacgaaggagctggaagagaaagttgcggagcttcataagactcaccgaggcttgagtcccgcacaggccgactcccagtttctggaaaacgcaaaaaggctcagcatgtatggcgtggatctccaccacgccaaggatagtgagggagtggatatcaaactcggcgtgtgcgcaaacggattactgatatacaaagataggctgcgaattaaccgctttgcatggcccaaaattctgaagatctcatataaacgcagcaacttttatatcaaagtacgtcccgcagaactggagcagttcgagagtaccattgggtttaagctaccgaaccatcgcgccgcaaaaagactgtggaaggtttgtgtcgaacaccatactttttaccgccttgtgtcgcccgagcagcctccaaaggccaagttcctgacactgggcagtaagtttaggtactcgggtcgcactcaggctcagactcgacaggcatccactttgatagatcggcctgccccccactttgaacgaacctcatctaagagagtcagtaggagcctggatggagcgccaatcggcgtcatggaccagtcgctcatgaaagactttccgggagcggcaggggaaattagtgcctacggacctggcctcgtatccatagcagtggtccaagacggggatggacgaagagaggtaagatccccaacgaaggcaccacacctgcagctaatcgaagggaaaaagaatagccttcgggtggagggcgataatatctatgtgcgacattcaaatctgatgctagaagagctggacaaagcacaggaagacatcctaaagcaccaggccagtatatcagagttgaagagaaactttatggaatcaacccccgaaccgaggcctaatgaatgggagaaacggaggattacccccctatctttacaaacacaaggctccagtcacgagaccctgaatattgtcgaagagaagaaaagagctgaagtcgggaaggatgaaagagtcattaccgaggagatgaatggcaaagagatatcaccgggatccggtcctggggagatcagaaaagtggagcccgtgacccagaaagattccacctctctgagttctgagagctcctcatcgtccagcgagtccgaggaagaagatgttggggaataccgaccgcatcacagggtcaccgaagggactattagggaggaacaagagtatgaggaagaggtggaggaggagcccaggcccgcggctaaggtggtggagagggaggaagccgtgccggaggctagtcctgtcacacaggccggagcaagtgtcatcaccgttgaaaccgtcattcaggaaaacgtgggggcacagaagattcctggagagaagagcgtgcatgagggggcactgaaacaggatatgggtgaagaggctgaggaggaaccacagaaggttaatggtgaagtgtcacacgtcgacatagacgtgctgccacagattatctgctgcagcgagccccccgtcgttaaaactgaaatggttactatcagcgatgcctctcagcgtaccgagatctctactaaggaggttcccattgtccagaccgaaaccaaaactataacctatgaatcaccccagatcgatggaggggcgggaggagatagtgggactctcttaaccgcccagactattacctccgaatccgtatccaccacgaccactacgcacataaccaagaccgttaaaggggggatcagcgagacgaggattgaaaaaagaatcgttattacaggagacggcgatatcgaccacgaccaggctctggcccaagccatccgggaggcacgggagcagcatcccgacatgagtgtcacccgcgttgtggttcataaggaaactgagctggccgaggagggcgaggactag

SEQ ID NO: 116028 - DNA, 3018 bp, Artificial Sequence
  Description of Artificial Sequence: Synthetic coding sequence
atgaccactgaagtagggtcagtttctgaagtgaaaaaagattccagccagctcgggacagatgccaccaaagagaaacctaaggaggttgccgagaaccagcaaaatcaaagcagcgaccctgaggaggagaaaggctctcagcccccccctgccgccgaatcgcagagtagtctgaggcgccagaagagagagaaagagacctctgagagccggggaatctctagattcatacccccctggctaaaaaagcagaagtcctacacacttgtggtagcaaaggacggcggcgataagaaggagcctactcaggctgtcgtggaggaacaggtgctggataaggaggagcccctgccagaggagcagaggcaggcgaagggggacgccgaggagatggcccaaaaaaagcaggaaatcaaggtggaggtgaaggaggagaaaccttcggttagtaaagaagaaaagcctagtgtctcgaaagtggaaatgcagccaaccgagctggtgagcaaagaacgtgaagagaaagtaaaagagactcaggaggacaaactcgagggcggagcagccaagcgggagaccaaggaagttcagacaaatgagcttaaagcagaaaaagcgtcccaaaaagtgactaagaaaacaaaaacagtgcagtgtaaagtcacactgctcgacgggacagaatattcttgcgacctcgaaaagcacgccaaaggacaggtcctgtttgataaagtgtgcgaacatctgaaccttttagaaaaagactactttggcctgctcttccaagagtcccccgagcaaaagaattggctggaccctgcaaaggaaatcaagcgccagttgaggaacctgccttggctgttcacctttaatgtgaagttctacccccccgacccttcacagctgactgaggacattacccgttatttcctgtgtctgcaactccggcaggatattgcctctggacgcctcccatgtagctttgttacccacgccttactcggaagctacacattacaggcagagctgggcgactatgatcctgaggagcacggatccatcgatctctccgaatttcagttcgctcccacccagacaaaagagctggaggaaaaagtggcggaactccacaagacccatcgtgggctgtcccctgcccaagcagacagtcaattcctcgaaaacgcaaagcgactcagtatgtatggggtagacttgcaccacgctaaggattctgaaggtgtggacatcaagctcggggtctgtgccaacggcctcctgatttataaagatagacttcgaataaatcggtttgcttggccaaaaatacttaagatttcctacaaacggtcaaatttttatattaaggtgcgcccagcagagttggaacagtttgaatcaaccatagggttcaagctgccgaatcatagggccgccaagagactgtggaaagtgtgcgtggagcaccacaccttctatcggctagtgtctcctgaacagccacctaaagcgaaatttttaaccctgggaagcaaattcaggtatagcggccggacccaggcccagacccgacaggcttctacactcattgaccggcccgcgccccacttcgagcgcacttcctccaaacgagtgagcagatcgctggatggcgcccctatcggggtgatggaccagtcactcatgaaggatttccctggcgccgcgggtgaaatctccgcatatgggccaggactggttagcatagcggtcgtgcaggacggtgatggaaggcgagaggtgaggtccccaacaaaagcccctcacttacagctgattgaggggaagaaaaactccttgcgggtcgagggggataatatatatgtgaggcattccaatttaatgttggaggaactggacaaagctcaggaggacatactcaagcaccaggcgagtattagcgaactcaaaagaaattttatggagtccacacctgaacccaggccaaatgagtgggagaaaaggagaatcacccctctctctctccaaactcaaggcagctctcatgaaacactgaacattgttgaagaaaaaaagagggcagaggtggggaaagacgagcgagtaatcaccgaagagatgaacggcaaggaaattagccccggcagcggccccggggagatacggaaagttgaaccagtaacgcagaaggattcgacttcactcagcagcgaatcaagttcctcaagcagtgagagtgaggaggaagacgtcggggagtaccggccccaccacagggtaacagaaggcactatccgcgaagagcaagagtatgaggaagaggtcgaagaagagccgcgccctgctgctaaagtggtcgagcgggaggaggcggttccagaggcctctccagtgacgcaggcgggagcctccgtcatcacagttgaaaccgttattcaggagaatgtgggggcccagaagattccaggagagaaatcagtccacgagggtgcactgaagcaggacatgggcgaggaagcagaggaggaaccgcagaaagtgaatggggaagtttcccatgtagatattgatgtcctgccccagattatttgctgctcggaaccccctgtggtgaagacagagatggtcacgattagcgacgcctctcaaaggaccgaaatatcaacgaaagaagtgcccatcgtacagacggaaaccaagacgattacatatgagagcccacagatcgacggaggagctggcggagacagtggaacactactgacagctcaaactattacttcagagagtgtgagtacaactacaacaactcacattactaaaaccgtcaaggggggaatttctgaaacccgcattgagaaaaggattgtcatcacaggagacggagacattgatcatgaccaggcactcgcccaggcaatccgggaggctagggaacagcacccagacatgtctgtgactcgggtagtcgtccacaaggaaactgagctggccgaggaaggcgaggattag

SEQ ID NO: 116029 - DNA, 2022 bp, Artificial Sequence
  Description of Artificial Sequence: Synthetic coding sequence
atgaccaccgaggtgggaagcgtgagtgaagtcaaaaaagacagctctcagctaggaactgacgctacaaaggaaaagccaaaagaggtggccgagaaccagcaaaatcagagttccgatcctgaggaagagaaaggctcacaacccccccccgcagctgagagccagagttcattgagacgacagaaacgggagaaggagacatccgaatcccgaggaatatcacggttcattcccccctggctgaagaagcagaaatcctacacgctggtagtggcaaaagacgggggcgacaaaaaagaacccacacaggccgtggttgaggaacaggtgctcgataaggaggagcctcttcccgaagagcagaggcaggccaagggcgatgcagaggaaatggcccagaagaagcaggaaatcaaggtggaggtcaaggaggagaagccatcggttagcaaagaggagaagccttccgtgagcaaggtggagatgcagcccacggagcttgtgtccaaggagagagaagaaaaggtgaaagaaacacaggaagacaaactagaaggaggagcagccaaaagggagacaaaggaggttcagaccaacgaactaaaagccgagaaagcaagccagaaggttaccaagaagactaaaacagtccagtgcaaagtgacattattggacggaaccgaatactcctgtgatctcgagaaacacgctaagggccaggtgctctttgacaaggtctgtgaacacttgaacctcttggagaaggactattttggcctcctgtttcaggagtctccggagcagaagaactggttagatcccgccaaagagatcaaaaggcagttaaggaatctgccatggctttttaccttcaacgtgaaattttacccccccgatcctagtcagctgactgaggatattaccagatatttcttgtgtctgcagctgaggcaggatatagctagtgggcggctgccttgttccttcgtcacccatgctctgctgggatcctacacgctgcaggctgaactgggtgattacgatcccgaagaacatggctcaatcgatctgtctgagtttcagtttgcacctactcagaccaaagagctggaagagaaagtggctgaactgcacaaaactcaccgcggattaagccccgcccaggcagattcccagtttctcgagaacgctaaacgtctctccatgtatggcgtggatctgcaccatgccaaggatagcgagggagtagacattaaactgggcgtttgtgcaaatggactcttgatctacaaagatcgactcagaatcaatcgttttgcctggcctaaaattttgaaaatcagttataaacgctctaatttctatataaaggtgagaccagcagaactagagcagtttgagtcaactatcggattcaaacttccaaaccaccgcgccgccaaaaggttgtggaaagtatgcgtggagcatcatacattctatcggctggtgagccctgagcagccacctaaggctaaattcctaaccctgggaagcaagttccggtacagcggccgaacccaggctcagaccaggcaagcttcaactctgattgaccgaccagctccacacttcgaacggacttccagcaaacgcgtgagccgctccttggatggggcgcctattggtgtcatggatcaaagcctcatgaaggattttcctggtgccgctggggaaatttccgcttatggccctgggctcgtgtcaattgccgtggttcaagatggggacggacggcgggaggtccgctcacccaccaaagccccccacctgcagttgatcgagggcaaaaccgttaagggaggcatttctgaaaccaggattgaaaagcggattgtgattactggagatggggacatcgaccacgatcaagcgcttgcccaggcgattcgggaggcccgcgagcaacacccggacatgagtgtaactagggtggtggtgcacaaggagactgagcttgctgaagagggagaggattag

SEQ ID NO: 116030 - DNA, 1902 bp, Artificial Sequence
  Description of Artificial Sequence: Synthetic coding sequence
atgaccactgaagtaggatctgtctccgaggtcaaaaaggattctagccagcttgggactgacgcaactaaagaaaagcccaaagaggtggccgagaaccagcagaatcagagttccgatcccgaagaagagaaagggtctcagccaccgccagcagctgaatctcagagctcccttcgtaggcagaagcgcgagaaggagacgtcggagtccagaggcatcagccggttcattcctccttggctgaaaaagcagaagagctatactctagtggtggctaaagacgggggcgacaagaaagagccaacacaggcggttgtcgaggaacaggtgcttgataaagaggaaccactccctgaagagcaacgccaggcaaaaggcgatgccgaggagatggcacagaagaaacaggaaataaaggttgaggtcaaagaggagaaaccctctgtctcgaaggaggagaagcccagcgtgtcgaaagtagagatgcagccgaccgagcttgtgtctaaggaacgggaggagaaggtgaaggagactcaggaggacaagttggagggaggggctgctaaacgcgagactaaggaagtacagacaaacgagttgaaggccgagaaggcttcccagaaagtcacgaaaaaaaccaagacggtccagtgcaaagtaaccctgctggacggcaccgagtattcgtgtgacctggagaaacatgccaaaggccaggttttattcgataaggtgtgcgaacaccttaatctgcttgaaaaggactactttgggcttctcttccaagaaagcccagagcaaaagaactggctggaccctgccaaggaaattaaacgccagttgaggaatctcccgtggttgtttacattcaatgtaaagttctacccacctgatccatcccagctgacagaggacataacgcggtatttcctttgtctgcagcttcgtcaggacattgcaagtggcaggctcccctgcagctttgtcacacacgctttgctgggcagctacacactgcaggccgagcttggcgactacgaccctgaagagcacggcagcattgacctctcagaattccaattcgctccaacccagactaaggagctggaggagaaggttgcagaactgcataagacccaccgagggttatccccagcccaagccgacagtcagttccttgaaaacgctaagcggctcagcatgtatggcgttgatttgcaccatgcaaaagacagcgaaggcgtagacattaagctcggtgtctgcgcaaatggtctgcttatttataaggaccgcctgcggatcaaccggtttgcctggccaaagattctaaagatcagctataaacggtctaatttttacattaaagtgaggcccgccgagttggagcaattcgagtctaccataggcttcaagctgcccaaccatagagccgccaagcgtttgtggaaggtgtgtgttgagcaccacacattctacagactagtgtccccagagcaacctccaaaagccaagtttctgacactggggtccaaattcagatactccgggcgtacgcaagcacagaccaggcaggcatctactctgattgatcgcccggcgcctcactttgagcggacatcaagcaaaagagtaagtaggagcctggatggagcgccaattggggtcatggaccagtccctgatgaaagatttccctggcgccgcaggcgagatcagcgcctatggaccgggcttggtttcaattgctgtcgtgcaggatggcgatggtcgccgcgaggtaagaagccccactaaggctccccacctccagctgattgaagggaaatctagtcatgaaactctcaatatcgtggaggagaagagcggacagcggctcggaaagactaaggagtag

SEQ ID NO: 116031 - DNA, 2244 bp, Artificial Sequence
  Description of Artificial Sequence: Synthetic coding sequence
atgactactgaagttggcagtgtatcagaagtgaaaaaggattctagccagctcggcacagacgctaccaaggaaaagcccaaagaggtcgccgagaaccaacagaaccaatccagcgatccagaggaggagaaaggctcacagccgcccccggccgccgagtctcaatcgtctctgagaagacagaaaagggagaaggaaacgtccgagagcaggggtatttccagattcattccgccttggctgaaaaaacaaaagagttataccttagtggttgcaaaggatggcggagataagaaggagcctactcaggctgtggtggaggaacaggtgctcgacaaggaggaaccccttccagaggaacagcgacaggctaaaggcgatgccgaagaaatggcacagaagaagcaggaaatcaaggtggaagtcaaggaggagaagccttccgtgagcaaagaagaaaaaccctccgtgtcgaaggtggagatgcagccaaccgagctggtaagtaaagagcgggaggagaaggtcaaggaaactcaggaagacaagctcgaaggcggagcagctaagagagaaacgaaagaggttcagaccaatgagttaaaagcagagaaagcatctcagaaggttacgaagaaaactaagacagtgcagtgtaaggtaacattactggatggaaccgaatatagttgtgaccttgaaaaacatgccaaggggcaggtgctgttcgacaaagtctgtgagcatctgaatctccttgaaaaggactactttgggttgctgttccaggaaagtcctgaacaaaagaattggctggatccagcaaaggagatcaaacggcagctgcggaacctcccttggttgttcacctttaacgtgaagttttatcctcccgacccctcgcagctgacagaagacatcaccaggtacttcttatgcctgcaactcaggcaagacatcgctagcggcagactgccttgttccttcgtgacccacgcactgctgggaagctacaccctccaggcggagttgggcgactatgatccagaggagcacgggtcgatcgacctgtctgagttccagtttgcacctacacagaccaaagaactggaggaaaaagtggctgagctgcacaagacccaccgcggattatcccctgcccaagccgactctcagtttctggagaacgcgaagcgattgtcgatgtatggtgttgacctgcaccacgccaaagatagcgagggtgtggatataaagctcggagtgtgcgccaacgggctgctgatttataaggatcgactgcggatcaaccgcttcgcctggccaaagatcctcaagatatcttacaagagaagtaacttctacatcaaagtgcggccagctgagctggagcagttcgaatccaccattggctttaaactccccaaccaccgcgctgcaaaaaggctgtggaaagtctgcgtcgagcaccatactttttacaggctggtctccccagagcaacctccaaaagctaagttcctcaccttaggaagtaagttcaggtattccggcaggacccaagcccagaccagacaggcatccactctgattgacaggcccgctcctcattttgagcggacttcctccaaaagagtttcgcgatcactggatggagccccaatcggtgtcatggaccagtctctcatgaaggattttcctggcgctgccggcgaaatctcggcctacgggcctggtttagtgtctatcgcagtcgtacaggatggagacggacggagagaggtccggtcgcccaccaaagctccgcatttgcagctcatcgagggtaaaccccccgtggtaaagaccgaaatggtgaccatttccgatgcatcgcagagaaccgaaatttctaccaaggaagtgccaattgtccaaactgagactaagaccataacatacgaatcaccgcagatagatggtggggccgggggggattctggcactctcctcactgcccaaactatcacatctgaatcagtgtccaccaccacaactacccacattactaaaactgtgaagggaggcatttcagaaacacgcattgaaaagcgaatcgtgataaccggcgacggggacatcgaccacgaccaggcactggcccaggccatcagggaggcaagggagcagcaccctgacatgagtgtgactcgcgtcgtagtccataaagagacagaactggctgaggagggtgaggattag

SEQ ID NO: 116032 - DNA, 1143 bp, Artificial Sequence
  Description of Artificial Sequence: Synthetic coding sequence
tgactggggtcaaaatttcgctactccggacggactcaggcgcagacgcggcaggctagtacactaatcgaccgtcccgctcctcacttcgagcggaccagctctaaacgggttagcagaagcctggacggggctcccatcggcgtcatggatcagtcgcttatgaaggacttcccgggggccgccggcgagataagcgcgtacggacccgggttagttagcatagccgtcgtccaggatggtgatggcaggcgagaagtgcgttcccccacgaaggctccccacctgcaactaatagagggcaagaagaactctctgcgagtcgagggcgataacatctatgtgaggcatagtaatcttatgctggaagagcttgacaaagcacaagaggatatcttaaagcaccaagcttctatctctgagttaaaacggaacttcatggaaagtacccctgaaccaagacctaacgaatgggaaaagaggaggattacaccactgtctcttcagacacagggccggaagggggaccatctctttaaggacattctgtctgtgaaagagaaatacctgatgcccaccatttggaccgttgaagaaaaagcacaggaaaccgataagacccgggctcccgagtcggaggggccgtgtaccggggcccgggatgcagtgaaaagtagtcacgagacacttaacattgtcgaggaaaagaaacgcgctgaagtgggcaaagacgaacgagtgatcaccgaggagatgaacggaaaagaaatttcaccagggtctggaccgggggagattcggaaggtggagccagtaacgcaaaaagatagcacaagcttgagtagtgaaagttcatcgagcagtagtgagagcgaagaggaggacgtgggggagtatagacctcaccatcgagtgactgaggggaccatccgggaggaacaggagtatgaagaggaagtggaggaggagcccagacctgccgctaaggtcgtagagagagaggaggccgtaccggaggcttctccagtgacacaagctggagctagcgttataaccgtcgaaaccgtaatccaggaaaacgttggggcacagaagatcccgggagagaagtcagtgcacgagggcgctctaaaacaagactag

SEQ ID NO: 116033 - DNA, 1152 bp, Artificial Sequence
  Description of Artificial Sequence: Synthetic coding sequence
atggaagaagaggaaacacagcttgaagaggagctagacaaggcacaggaggacattctaaaacatcaggcatcaatatctgagctcaaacgaaactttatggagtcgactccggagccccggcctaatgaatgggaaaaacgccggattacccctctctcactccagacccaaggaagtagccatgaaactctcaatatcgtcgaagagaaaaagcgagctgaagtcggcaaggatgaacgtgtgataacagaggaaatgaacgggaaggagatatccccaggatcaggcccaggtgaaatccgcaaggtcgagcccgtgacacaaaaggattcaacttctctatcttcagagtcatcttcatcgagctcggagtccgaagaagaagatgtgggggagtatcggccccaccaccgagtcactgagggtaccattcgggaagagcaagagtatgaggaagaggtggaggaggaacctagaccagcagcaaaagtggtggagcgggaagaagcagtgcccgaggccagtcccgttacccaagcaggtgcaagcgtaatcacagttgaaacagtcatccaagagaacgtcggagcacagaagatcccaggagaaaagtctgtgcacgagggcgcactgaaacaggatatgggcgaggaagcggaagaggaaccacaaaaggtcaatggagaggtaagtcacgtggatatagacgttctcccacagattatttgctgtagtgagccacccgtggtcaagacggagatggtgacaattagcgacgcttcccagaggacagaaatctccacaaaggaagtgcccattgtacagacagaaactaagacaattacctacgagagcccccaaattgacggtggggctggcggtgattctggcacactgcttaccgcacagactatcacatctgaaagcgtatcgacaactacgaccactcatattacgaagactgtgaagggcggaatttccgagacccggatcgagaagcggattgtcattacaggagatggggatatagatcatgatcaggccttagcccaggccatccgcgaggcgagggagcagcatcctgacatgagtgtcactagggtggttgtgcacaaggaaacagaactggccgaggagggcgaggactag

SEQ ID NO: 116034 - DNA, 2022 bp, Artificial Sequence
  Description of Artificial Sequence: Synthetic coding sequence
atgactacagaagttggctccgtgagcgaagtgaagaaagattctagtcaactgggtaccgacgctactaaagaaaaaccaaaggaggttgccgaaaaccagcagaatcagtcctccgatcctgaggaggagaaaggctcccaaccaccacccgccgcagaatcccaatcttctctccgccggcagaagcgagaaaaagagacatccgagagcagagggatttcgaggtttataccaccgtggctcaagaaacagaagtcttacaccttggtggtggcaaaggacgggggagataagaaggagccaacgcaggctgttgtggaagaacaagtgctggacaaagaggaaccgctgcctgaagaacaaaggcaggccaagggagacgcagaagagatggcccagaaaaaacaggagatcaaagtggaggtgaaagaagagaaaccaagcgtaagtaaggaagagaagccatctgtcagcaaggtggagatgcagcccacagaactggtctctaaagaaagagaggagaaagtcaaggagacacaagaggataaactggaagggggagcggcaaagagggagaccaaagaagtgcaaaccaatgaactcaaggccgagaaggccagccagaaagttactaaaaagaccaagactgtccagtgtaaggtcacattgctcgatggcactgagtactcgtgtgacttggagaagcacgctaaaggtcaggtgctgttcgacaaggtatgcgagcatctgaacttactcgaaaaggattacttcggtctactgtttcaggagtcccctgagcaaaaaaactggcttgatcccgcaaaggagataaagcgccagctccggaatctaccctggctgtttacattcaatgtaaagttttatcctcccgatcccagccagctcaccgaggacatcacccggtactttctgtgcctccaattacggcaggacattgcatcgggccgattgccatgtagctttgtgacacacgctctactgggctcctataccttgcaagccgagctaggggattacgaccctgaggaacatggctctattgacttatcagagtttcagttcgcccctacccagacgaaggagctggaggaaaaggtggccgagctgcacaagacccaccgtggtctgtccccagctcaggccgatagccagttcctggaaaatgccaaacggctgtcaatgtacggggtggacctgcaccatgcaaaggacagtgaaggtgtggatatcaagctgggcgtgtgcgccaatggtctgctcatctacaaagaccgactgcgaatcaaccggttcgcctggcccaaaatactcaagattagttataaacggtccaacttttatataaaagtgagaccagctgaactggagcagttcgaatcgacaatcggattcaaactccccaaccatcgtgcagctaaacgactttggaaagtatgcgtagaacaccacactttttatcgactggtttcccccgaacagccccccaaggcaaaatttcttaccctaggctccaagtttaggtattctggccgtacccaggcccagacgaggcaggcatctacacttattgatcggcccgctccccacttcgagcggacttcatccaagagggtctcccggtccctggacggggccccaattggcgtcatggaccaaagtctcatgaaggatttccctggcgcagctggggagataagcgcttatgggcctggccttgtgagcatcgccgtcgtccaagatggtgatggccgaagggaggtgaggtctccaaccaaagcccctcatctgcagctgatcgaggggaaaacagtgaagggaggaatctccgaaactcggatcgagaaaaggatcgtaatcactggcgatggagatattgaccatgaccaggcactagcccaggcaatccgagaggctagagagcaacatcccgatatgagtgtcactagggttgtggtccacaaggaaacggaacttgccgaggaaggcgaagattag

SEQ ID NO: 116035 - DNA, 462 bp, Artificial Sequence
  Description of Artificial Sequence: Synthetic coding sequence
atgacaacagaggtggggagtgtctcagaggtgaagaaggattcgagccagctgggaaccgatgccacgaaggagaagcctaaggaagtggcggaaaaccagcagaaccagagttcagaccctgaggaagagaaaggaagtcaacctccacccgccgcagagtcccagtcctctctgagacgccagaagcgggagaaagaaacatcggagagccgcggcatttcacgtttcatccctccctggctgaagaagcagaaatcttatacgctggtggtcgcaaaagacgggggagacaaaaaggagccaacacaggctgtggtggaggagcaagtgctggacaaagaggagccactcccggaagagcagcggcaggccaaaggtgatgcagaagagatggcacagaaaaaacaggagataaaagtcgaggtgaaggaagagaagccctccgtctcaaaagagtag

SEQ ID NO: 116036 - DNA, 2244 bp, Artificial Sequence
  Description of Artificial Sequence: Synthetic coding sequence
atgacgactgaagtgggctctgtgagcgaagtgaagaaggacagtagccaactagggaccgacgccaccaaagaaaagccaaaggaggtcgcggagaaccagcagaaccagtctagcgacccagaggaagagaaaggctcacagcccccccctgcagccgaatctcagtccagccttagacggcagaaacgggaaaaagaaacaagcgaatcgcggggcatctctcggtttatcccaccttggctgaaaaagcagaagtcctatactcttgtggtggctaaggatggcggcgataaaaaagagccaacacaggccgtggtcgaggagcaagtgttagataaggaagagccactcccagaagaacagcgccaggccaagggcgacgccgaagagatggcccagaagaaacaggagatcaaagtggaagttaaggaagagaagcctagcgtctctaaggaggaaaaacctagcgtgtctaaggtcgagatgcaacccaccgagctggtgtccaaggaacgggaagagaaggtcaaagaaacacaggaagataaactggaaggcggggcagcaaaaagagaaacaaaggaggtgcagaccaacgagctcaaggccgaaaaggcatcccagaaggtaaccaagaagactaagacagtgcagtgcaaggtgaccctgctggatggcacagagtattcttgtgatttagagaagcatgcgaaagggcaggtgctgtttgataaggtttgtgagcacttgaatcttctggaaaaggactacttcggcctgctcttccaggagtcacctgaacagaaaaattggctggacccagctaaggaaatcaaacgccagctgagaaacttgccttggttatttacctttaatgttaagttctatccgccagatccaagtcagctgacggaggatataacgcggtacttcctgtgcctccagttgcgccaggatatcgcttccggacgcctcccatgctcctttgtcacacacgcattgctgggaagctacacacttcaggccgaacttggagattatgaccctgaagaacacgggtctattgacttaagtgaattccagttcgcgccaacccaaacgaaggagcttgaagagaaagttgctgaattgcacaagacacacagggggctttcccccgcccaggctgattctcagttcctagagaatgctaaacggctcagcatgtatggagttgatcttcaccatgccaaggattcggaaggcgtggacataaagctaggcgtgtgcgcgaacggtttattgatttataaggaccgtctcaggatcaataggtttgcgtggccaaagatcctgaaaatttcttacaaaagaagtaacttttatatcaaagtgcgacccgccgaactggaacagttcgaaagtactatagggtttaagctgcctaatcaccgagcggcaaaacgtttgtggaaagtttgcgttgagcaccacacattctaccgcctggtttctccggagcagccaccaaaagcaaagttcctaaccctgggctccaaatttaggtatagtggacgaacacaagctcaaacaagacaggccagcacgctgattgaccggcctgcccctcatttcgaaaggactagtagcaaacgcgtatccaggtctctggacggggcaccaataggggtgatggaccaaagtctaatgaaggacttcccaggagctgccggtgagatctcagcatacggcccaggactggtttcaatcgccgtggttcaggatggcgatgggagaagggaagtaaggtcacctaccaaggctccccacctgcagctgatcgaaggcaagcctcccgtcgttaaaacggagatggtgacaatatccgacgcctcccagaggaccgagataagcaccaaagaagtaccaatagtccagacggagacaaaaactatcacctacgaatctccccagatcgacggcggcgctggcggagattctggcactttgctgacggctcagacaattacaagcgagagcgtgtccaccacaacaaccacgcatatcactaagaccgtgaaagggggtatctctgagacacgcattgagaaaagaatcgttattacaggggacggagacatagaccacgaccaggctctcgcgcaggccatcagagaggcccgggaacagcaccctgacatgtcagtcacccgggtcgtggtccataaagagactgagcttgctgaggagggtgaggactag

SEQ ID NO: 116037 - DNA, 540 bp, Artificial Sequence
  Description of Artificial Sequence: Synthetic coding sequence
atgacaactgaggtgggctccgtctctgaagtgaaaaaggacagtagccagctgggcacggacgctacaaaggaaaagcctaaggaggtggccgagaaccagcagaatcagtcttcagaccccgaggaggaaaagggaagccagcctccacctgccgctgaatctcagtcctctcttaggcgccagaaacgtgaaaaggagacctctgaaagcaggggcatcagtcgcttcatccctccatggttgaaaaaacagaaatcttacaccctagtggtcgctaaagacggaggcgacaagaaagagccaacccaggcagtagtcgaagaacaggtgttggataaggaggaaccgctccccgaggagcaacgccaggcgaagggagacgcagaagaaatggcacagaaaaagcaagaaattaaagtggaagtcaaggaggagaagccctccgtctccaaagaggagaagcccagtgtgtccaaagtggaaatgcagcctacagagcttgtatctaaagaacgtgaagagaaagtgaaggaatag

SEQ ID NO: 116038 - DNA, 2559 bp, Artificial Sequence
  Description of Artificial Sequence: Synthetic coding sequence
atgaccaccgaggtgggctctgtatctgaggtgaagaaggacagctcacagctgggaaccgacgctaccaaagagaaaccgaaagaggtggctgaaaaccagcagaaccaatctagcgacccagaggaagagaaggggagtcagccaccacctgcagccgaaagccagagttcactgcgcagacagaagagagagaaggaaacctccgaatccaggggcatcagtcgcttcattcctccctggcttaaaaaacaaaagtcgtacacattagtggtggccaaggatggaggggataaaaaggaacctacccaggccgtcgtggaggaacaggttctggataaagaggaaccactccccgaggagcaacgccaggcaaagggggacgcagaggaaatggctcagaaaaaacaggagatcaaagtggaggtgaaagaagagaaaccttcagtttcaaaggaagaaaaaccttctgtctccaaggtggaaatgcagcctacggagcttgtatcaaaggagcgtgaggaaaaggtgaaggagacgcaggaggataagctcgaggggggggccgctaaacgagagaccaaggaggtccagacaaacgaattgaaagccgaaaaagcctctcagaaggtgactaaaaagaccaagacagtgcagtgcaaggtcaccctgctcgatggaaccgaatactcatgtgatctagagaaacatgccaaggggcaagtgctgttcgataaggtgtgtgagcacctgaatctgctcgaaaaggactacttcggactcctgtttcaggaatcacccgaacaaaaaaactggcttgaccccgctaaagagattaaacgccagttgcgtaatctcccgtggctgtttactttcaacgttaagttctatccccccgacccaagtcagctcacagaagatattacaaggtatttcctgtgtctgcaactgagacaggatattgcaagcggccgcctgccatgctcattcgttacacatgccctgctaggttcttacaccctgcaagcggagttgggtgactatgacccagaagagcacggttccatcgatttatcagagttccagtttgcgccaacccaaacgaaggagctggaagagaaggtcgcagagctacacaaaacccatcgcggactgtcaccagcccaggccgacagccagttcttagagaatgccaagcgcctgtctatgtatggtgtggacctgcatcacgcaaaggattccgagggggttgacatcaagcttggagtctgtgctaatggcttactcatttacaaggatagactgcgtataaataggtttgcatggcctaagatcctgaaaattagttacaagcgctcaaacttctacatcaaagtaaggcctgcggaactggaacagttcgaaagtacaattggcttcaagctcccaaaccatcgcgcagccaaaaggctctggaaggtgtgcgtagagcatcatacattctataggctggtgtcaccagagcaaccacctaaagccaagtttctgacattaggctccaagtttaggtattccggaaggactcaggcacagacgagacaggcaagcaccctgatagacaggcctgcacctcactttgagagaacgtcatcaaagcgggtctcaaggagcctggatggcgctccaattggcgttatggatcaatctctcatgaaggacttccccggggccgcaggggagatctctgcttacggccccggtctggtaagcattgcagtagtccaggatggcgacggtagaagagaggttcgcagccctaccaaggcaccccatctccaactcattgaagggaaaagctcacacgagacattaaatattgtggaggagaagaagcgcgcagaagtggggaaagatgagagggtcatcaccgaagagatgaacgggaaggaaatctcccccggcagcggccctggagagatccggaaagtggaaccagtcactcagaaggactcaacaagcctgtcctctgagagctcctcatctagtagcgagtcagaagaagaggatgtgggagagtatagaccgcaccaccgcgtgactgaaggcactattcgggaggagcaggagtacgaggaggaggttgaggaggaacctcgtccagccgctaaaccacccgtcgtgaaaactgagatggtcaccatcagcgatgcatcccagagaacggagatttcaactaaagaggtcccaatcgtgcaaaccgaaacaaaaaccattacctacgaaagccctcagatcgatggcggagcaggcggcgattcaggaacactgctcaccgctcagaccatcacctcagaatcagtctcgacaacaactactacacacatcacaaagacagttaagggcggtatcagcgaaacgcgcattgaaaaacgaatcgtcattactggagacggggatatcgatcatgaccaagctctggcccaggccatcagagaggcaagagaacaacacccggacatgtcagttacccgagtggtggtacacaaagagaccgaattggccgaggagggggaggactag

SEQ ID NO: 116039 - DNA, 357 bp, Artificial Sequence
  Description of Artificial Sequence: Synthetic coding sequence
atgaccacagaggtcgggtcagtgtctgaggtgaagaaggatagcagccagctggggaccgacgccactaaagaaaagcccaaagaggtggccgaaaaccaacagaaccaaagctccgaccccgaggaagagaagggaagtcagccgcctccggccgctgagtcccaatcgtcattacgtagacaaaaaagggaaaaggaaacttctgagagtcgtggcattagcagatttattcctccttggctgaaaaagcagaagagctacactttagtcgttgcgaaggatggaggcgacaaaaaagagcctacacaggccgtcgtcgaggaacaggtgctcgacaaggaggagccactctag

SEQ ID NO: 116040 - DNA, 606 bp, Artificial Sequence
  Description of Artificial Sequence: Synthetic coding sequence
atggaggaagaggagacccaactggaggagaagaacagcctcagagtggaaggtgataatatttacgtgcgacattctaaccttatgttggaggagctcgacaaggcacaagaagacatccttaagcaccaggcttcaatcagtgaactgaagagaaactttatggagtccacacctgaaccccgcccaaatgaatgggagaagcgtaggatcactccactgagcctacagacacaggggaccagggcaccagaatccgaaggcccatgtaccggggcacgcgacgccgtgaagcccccggtggtgaagactgagatggtcaccatcagcgatgcaagccaacgcaccgaaatttctactaaggaggtccccatcgtgcagactgagacaaaaactatcacttacgaatctccacaaaccgtcaaaggaggcatcagcgagacccgcatagagaagaggattgtcatcactggagacggcgatattgaccatgatcaggctctggcccaggcgatccgggaagcacgcgagcagcaccccgacatgtcagttacgagggtagtggttcacaaggagacggaactggccgaagaaggggaggattag

SEQ ID NO: 116041 - DNA, 384 bp, Artificial Sequence
  Description of Artificial Sequence: Synthetic coding sequence
atgacgaccgaggtgggatccgttagcgaggttaagaaggactcatcacagcttggaaccgacgcaactaaagagaagccaaaagaggtagccgaaaaccagcagaatcagagttcagatcccgaggaggaaaaaggatcgcagccacctcccgctgcagagtctcagtcttctttaagacgccaaaagcgcgagaaggagacttctgagtcccgcggaatttctaggtttatcccaccatggctcaaaaaacagaaaagctacaccttagtggtggcgaaggatggaggtgataagaaagaaccaacccaggctgtggtggaggagcaagtgctcgacaaagaggagcccctccctgaggaacaacgacaagcgaaggggtag

SEQ ID NO: 116042 - DNA, 489 bp, Artificial Sequence
  Description of Artificial Sequence: Synthetic coding sequence
atgacaaccgaagttggcagcgttagcgaggtcaagaaagattcatcccagctggggactgatgcaacaaaagaaaaacccaaagaggtggcagaaaatcaacagaatcaaagtagtgacccagaggaggagaaaggatcacagcccccaccggctgctgaatcccaatccagcctgcgccgtcagaaacgcgagaaagaaacctctgaatcgcggggcatctctcgttttatacccccctggctgaaaaaacagaagtcctacacactggtcgttgcaaaggatggaggagataaaaaagagcccactcaagcagtggtcgaagaacaagtgctggacaaagaggaaccattgccagaagagcagcgtcaggctaaaggcgacgcagaggagatggcccagaaaaagcaggagattaaggtcgaagtcaaggaagaaaaacccagcgtatccaaagaggaaaagccctctgtgtccaaagtggaatag

SEQ ID NO: 116043 - DNA, 3264 bp, Artificial Sequence
  Description of Artificial Sequence: Synthetic coding sequence
atgactaccgaatctggctcggattccgaatcgaaaccagaccaggaggcggaaccgcaagaggcagcgggagcccagggcagggctggggcgccagtcccggagcctcccaaggaggaacaacagcaggccctcgaacagttcgccgctgctgctgcccattcgacccccgttagacgggaggtgactgataaagaacaggaatttgcagcaagggctgccaagcaactcgaatatcagcagttagaagatgacaagctgagccagaagagctcatcctccaaactgtctcgttctcccctcaagattgtcaaaaagccaaagagcatgcaatgcaaggtaattcttctggatggctccgagtacacctgcgacgtggagaagcggtccaggggacaagtactttttgacaaggtatgtgagcacctcaacctgcttgagaaagactatttcggactgacttatagagacgccgaaaatcagaaaaattggctcgacccagccaaagaaatcaagaaacaggtgcgaagcggagcctggcactttagtttcaacgtgaagttttacccaccagacccagcgcagctcagcgaagacatcacacgctattatctatgtcttcaactgcgggatgacatcgtctccggtcgactgccctgcagcttcgtgactctcgccctcttggggtcctacactgtccagtccgagcttggggattatgatcctgatgagtgtggaagtgactacatctccgagttccgcttcgctccgaaccataccaaggagctagaagacaaggtcatcgaattgcacaagtctcaccgcggaatgacacctgccgaagctgaaatgcatttcttagagaacgccaagaagttaagtatgtatggcgttgacctgcaccatgctaaggattccgaaggggtggaaatcatgctcggcgtctgcgcttcaggtttactgatctacagggaccgcctcaggatcaacagattcgcctggcctaaagtgctgaagatcagctataagcgaaataacttttatattaagattcgtccaggggagttcgagcagtttgagtccaccattggtttcaaactgccaaaccacagagctgccaaacgactgtggaaggtttgtgtggagcatcacaccttcttccgcctgcttctgccggaggccccaccgaagaagttcctgaccctgggctctaagttcagatattctggccgtacccaggcccagactcggcgagccagcgcattaatagatcggccagctccttatttcgagaggagttcaagtaaaagatacactatgagtaggtcactagatggcgaggttggaaccggccagtacgctacaacaaaggggatttctcagaccaatctgattacaacagttacgccagagaaaaaggccgaggaggaaagagatgaagaagaggacaagagacgtaagggcgaagaagtgacgcctatttccgccatccgacatgaaggcaagagtcccggcttggggacagattcttgtcccttgtcccccccgtccacccactgtgctccaacaagccccacggagctgcgacgccgctgtaaggagaatgattgtaaattgcctgggtatgaaccctcgcgtgccgaacatctgcctggcgaacctgccctggactcagatggaccgggtcgcccttacttgggcgatcaggatgtggctttttcttaccgccagcagacaggtaagggcaccacactcttttctttttccttgcaattgcccgagtccttcccttcattgctggacgacgacggctaccttagctttcctaatctctccgagacaaacctgcttccccagagtttgcagcattatctcccaatcagaagcccgtccctcgttccatgctttctgtttatttttttcttcctcctttccgccagtttcagtgtgccctacgccctgacgctcagcttcccattggctctctgtctatgctacctggagcccaaagcagccagcctaagcgcgtccctggacaacgacccaagtgatagtagcgaggaggagaccgattcggaaagaactgataccgcagcagatggcgaaacgaccgcaaccgaatccgaccaagaggaggatgctgaacttaaagcacaagagctggagaaaacccaagacgatctcatgaagcaccagacaaacatttcagagctgaaacgtacattcctcgagacctccactgacacggccgtgacaaacgaatgggagaaacgactcagcactagcccggtccgcctggccgccaggcaagaagacgcccctatgatcgaacctctggtaccagaggagaccaagcagtcatcaggcgagaagctcatggacggctctgaaatcttctcattgcttgagtcggcaagaaaacctacagagtttataggcggggtcacgagcacctcccagtcctgggtgcagaaaatggaaaccaagacagagtcatccggcattgagaccgagcccaccgtgcaccatttgcctctgtccacggagaaggtggtgcaggagacggtgctggtggaggaaaggcgcgtggtgcatgcctcaggagatgcatcctactccgccggggacagtggtgacgccgctgctcagccggctttcaccggcattaaaggcaaggaaggcagcgcgttaacagaaggggccaaagaagaaggtggagaagaggtggccaaggccgttctcgaacaggaggagaccgcagccgccagccgcgagagacaagaagagcagagcgccgcaatacacataagcgagactttagagcaaaaaccccattttgagagtagcaccgtgaaaactgaaaccatctcttttggcagcgtttccccaggtggagtcaaacttgagatcagtaccaaggaggtgcccgtggttcatactgaaacaaagacaatcacatacgagtcaagtcaagtggatcctggaaccgacctagagccgggcgtgttgatgtcggcccaaacaataaccagcgagacaacaagcacaacaacaactacacacatcacaaagacagtcaagggtggaatcagtgaaacaagaattgagaagcgtatagttataaccggcgatgctgatatcgaccatgaccaggcactggcccaggccatcaaggaagctaaagaacagcacccggacatgagtgtgaccaaagtagtcgttcacaaggagacggagatcactccagaagatggtgaagactag

SEQ ID NO: 116044 - DNA, 3264 bp, Artificial Sequence
  Description of Artificial Sequence: Synthetic coding sequence
atgacaactgaaagtggtagcgactccgagtcaaaacccgatcaggaggccgagcctcaagaggccgcaggtgcccagggaagagccggggcccctgtgccagagcctcccaaggaggagcagcagcaagctctggaacagttcgctgctgcagcagcacatagtactccagttaggcgagaggtcaccgataaagagcaggaatttgcggcgcgagcagccaagcagctggaataccagcaactggaggacgacaagctaagccagaagtccagctcaagcaaactctcgagaagcccacttaaaattgtgaaaaagcccaagtcaatgcagtgcaaggtgattctactggatggcagcgagtacacctgtgatgtcgagaaaagaagcaggggccaagtgctgttcgataaggtgtgtgagcacctgaatcttctggagaaggactactttgggctcacatacagagatgccgagaaccagaagaattggctggatcccgccaaggagattaagaaacaggttagatcgggggcttggcatttctcgttcaatgttaagttctaccctccagaccccgcacagctgagtgaagacattacacgctactacctttgtctccaactccgcgacgatatcgtgagtggtcggctgccttgttcttttgttaccctggccctgctcggtagttacacggttcaatccgaattgggcgactatgatccagatgagtgtggctctgactacattagcgagtttagatttgccccaaatcacaccaaagagttggaagacaaggtgattgaactgcataaaagccacaggggaatgacacctgccgaagcagaaatgcacttcttagaaaatgccaagaaactcagtatgtacggagttgacttacaccacgccaaggactctgaaggtgtcgaaattatgctaggcgtgtgcgcaagcggactcctgatatatcgcgatcgactccgcatcaaccggttcgcctggcccaaagttctgaaaatttcctacaagaggaacaacttttacatcaagattcgccccggagaattcgagcagttcgaatctaccatcggatttaaattgccaaaccacagagcggccaaacgcctgtggaaggtttgcgttgagcatcatacttttttcagattgctcctgcccgaagctccgccaaagaaatttctgacgctgggctccaaattcaggtactccgggagaacccaagcccaaactcgtcgcgcatctgcgctaattgatcgtcccgccccatatttcgaacggtctagtagtaaacgatacaccatgagcagatctctggatggggaggtgggaacaggccagtacgccactactaaaggcatcagccagaccaacctgattactactgtgaccccagaaaagaaagcagaggaggagagagacgaagaagaggacaagaggaggaagggcgaagaggtgacacccatcagtgctatcagacatgagggcaaaagccctggcttgggcaccgattcatgtcccctttcacccccaagtactcactgcgcccccacgtctcccaccgagctgagaagacgctgtaaggagaacgactgtaaactgcccggctatgagcccagtcgagctgagcacctgccaggcgaaccagcactagattcggacgggcccggtcgcccgtatttgggggatcaggatgttgctttttcctataggcagcaaacggggaaaggaacaacattgttttctttttctcttcagctccctgaatcgttcccatcgcttctcgatgacgatggatacctgtcctttccaaatctttctgagactaaccttctacctcagtcattgcagcactatttgccaattcgaagcccttccttagttccctgttttttgtttatcttcttctttcttctgagtgcaagtttcagcgtcccatatgcacttacactttcattccctctcgcactttgtctatgttacctcgagcccaaggcagcaagcttaagcgcgagcctggataatgaccctagtgattcttctgaggaggagaccgattctgaaaggacggacaccgccgccgacggggaaactaccgcaactgagtctgaccaggaagaggacgccgagctgaaagcccaggagttagagaaaacacaggatgacttgatgaaacatcagaccaatatctccgagctcaaacgaaccttcctggagacatccacagatacagccgtgacaaatgaatgggagaagcgtctcagcacgagtcctgttcggttggccgccaggcaagaggacgcccctatgatcgaacctctcgtcccagaggagaccaagcagtcttctggggagaagctgatggatgggagcgagatctttagtctgctcgagtcggcccgcaagcctactgagtttattggcggtgtgaccagcacgtctcagtcttgggtgcagaaaatggaaacaaaaaccgagtcttccggtatcgagacagaacccacggtgcaccacctaccgttgtctaccgagaaagtagtccaagagacagtgctggtggaagagcgcagagtcgtgcatgcgagtggtgatgccagctactccgccggtgattccggagacgcggcagcacagccggcatttacggggatcaagggtaaggagggtagcgcccttaccgaaggcgccaaagaggagggtggagaagaggtagcaaaggccgtactggaacaggaggagacagctgcagctagcagagagcgacaggaggagcagtctgcagccatccacattagcgagaccctggaacagaagcctcactttgaatccagcacagtgaaaactgagacaatatccttcggatcagtcagcccaggtggagtcaaactggagatcagtacaaaagaggtgcccgttgttcacaccgagaccaaaactatcacatatgagtcatcacaggtcgatcctggcaccgatctcgaaccaggagtgctgatgagtgcccaaactatcaccagcgagacaaccagtacaaccacgactactcacattacgaaaaccgttaagggcggaatttccgaaacccgcatcgagaaaaggattgtaataaccggagacgccgatatcgaccacgaccaggccctcgcgcaggccatcaaagaagcaaaagaacagcatccagatatgtctgtgactaaggtcgtggttcacaaggagactgagattacgcctgaggatggcgaagattag

SEQ ID NO: 116045 - DNA, 2598 bp, Artificial Sequence
  Description of Artificial Sequence: Synthetic coding sequence
atgacgaccgagtccgggagtgattccgagagcaagccggaccaggaggctgagccccaagaggctgctggagctcagggcagggcaggcgcacctgtgccggagccccctaaagaagaacagcagcaggccctcgagcagttcgcagctgcagctgcacactctacacctgttcgtcgagaagtcactgacaaggagcaggagttcgcggctcgagctgccaagcagctggaataccagcagcttgaggacgacaagctgtcccagaagtcgtctagctccaagctgagtaggtctcccttgaaaatagtcaaaaagcctaagagcatgcagtgtaaagtgatcctattggatggctcggaatatacgtgcgacgttgagaaacggtcaagaggccaggtgctgtttgataaagtttgcgaacacctcaatctgctggagaaggattacttcggattgacttatcgggatgctgaaaaccagaagaactggctcgaccctgccaaggagatcaagaaacaggtgagatccggagcgtggcatttttcgttcaatgtgaaattctatccccctgacccggcacagctgtcggaagacatcactcgctattacctgtgtttgcagttgcgggacgatatcgtttctggccggctcccctgctccttcgtgaccctagccttattgggctcatacactgtgcaaagtgagttgggcgattatgatcccgatgaatgcgggtccgactacatttccgaatttagattcgctccgaatcatacaaaggagctcgaggataaagtgatcgagctgcacaagagtcacagaggcatgacccctgctgaagctgagatgcacttcctcgaaaacgcaaaaaagctaagtatgtacggagtggatctgcaccatgccaaggactctgagggggtcgaaatcatgctcggggtatgtgccagcggtcttctgatttatcgagaccgcctgcgcatcaaccgcttcgcttggccaaaagtgctcaaaatctcatataagcgtaataatttctacattaaaatcagacctggtgaatttgagcagttcgaatcaaccatcggatttaaactcccaaaccatcgagcagcgaagagactgtggaaggtttgcgttgaacaccacacgttcttccgactgctgttgccggaggcgcctcccaaaaagtttctgactctgggctcgaagttccggtattccggtagaacccaggctcagacaaggcgtgccagtgccctcatcgataggcctgcaccttattttgaaaggagcagctccaaacggtatactatgtcccggtcattggatggcgcttcagtgaacgagaaccacgaaatatacatgaaggacagcatgtccgccgctgaagtgggaacaggacagtacgccacaacaaagggaataagtcaaacgaatctgataactaccgttaccccggaaaaaaaggcagaggaggagagagacgaagaagaagacaagagacgtaaaggagaggaggtgacacccatctccgctattcggcatgaaggtaagaccgatagcgaacgcactgatactgccgctgatggagagaccacagcaaccgaggaactcgagaaaactcaggatgacctgatgaaacaccagaccaatattagcgaactgaaacgcaccttcttggagacctccacggatacagctgtcaccaacgagtgggaaaaaagactgtccacatcccctgtgcgtcttgccgcacgccaagaagacgccccaatgatcgagcctttggtgccagaggagaaaatggaaacgaaaaccgagagttcagggattgagacagaaccaaccgtccatcatctgcccctgagcacggaaaaagtggtgcaagaaactgtactggtcgaagaaagaagggtggtacatgccagtggcgacgcaagctatagtgcaggtgacagtggcgacgcagctgcccagcccgcatttacgggaataaaaggtaaggagggctccgcattgaccgagggggcaaaggaggaaggcggcgaggaagtggccaaggccgtgctggaacaggaagaaaccgccgccgccagccgcgaaagacaggaggaacagagcgccgcaatacacatctcagagactctagagcagaaaccccattttgagtcatcaactgtgaaaaccgaaaccatctcatttggatcggtctctcccgggggagtgaaactcgagatcagcactaaggaggtgcctgtggtgcacaccgaaaccaaaacgatcacgtacgagtcctcacaggtagacccaggcacagacttggagccaggtgtactgatgtccgcccagaccatcacaagcgagacaactagtacaactacgaccacacacattaccaagactgtgaagggaggcatatccgagaccagaatcgaaaaaaggatcgtcatcacaggcgatgcagatattgaccacgaccaagcacttgctcaggccatcaaagaagctaaagaacagcatcccgatatgagtgtcacgaaagttgtagtgcacaaagagactgaaatcacccctgaggatggcgaagactag

SEQ ID NO: 116046 - DNA, 1155 bp, Artificial Sequence
  Description of Artificial Sequence: Synthetic coding sequence
atgaaacatcagactaacatttcggagttgaagcggacctttctggagacatcaaccgatactgccgttaccaacgaatgggagaagcgcctgagcacttccccggtacgactggcagcccgccaagaggatgcacccatgatcgagcctctggtgcccgaggagactaaggaagagaccgagatctctgaaaaagttatctttctccagcagggatctgctccctttctggagagtcagacgaagcaatcttcgggagaaaagttgatggatggatccgagatcttctcactgctagaatctgcacggaagccgaccgagttcataggcggagtgaccagcacttctcagagttgggtacagaaaatggagacaaagacggagagttcaggcatagagaccgagcctacagtgcatcatctaccattgagcacagaaaaagtggtacaggagaccgtgctcgtcgaggaaaggcgcgtggtgcacgccagcggcgacgcaagctatagcgctggggacagtggtgatgctgccgcccagcccgccttcaccggaattaaaggaaaggaaggcagcgccctgacagagggagcgaaagaagaaggcggagaggaagtggcaaaggctgttttagaacaagaggagaccgcagctgcctcacgagagcgtcaggaagaacagtccgcagccattcacatctccgagaccctcgagcagaagcctcatttcgagagttccacggtgaagaccgagaccatcagttttgggtcagtgagtcctgggggggttaagctggagatttccactaaggaagtgcccgtcgtccacacagaaacgaaaactataacgtatgagtcttctcaggtggaccccggcaccgatctcgagccaggtgtcctgatgtcggctcagaccatcacatcggaaacaacatctaccaccacaaccactcatattacaaaaactgtcaagggggggataagtgagacgagaatcgaaaaacgtatagtgatcactggagatgccgacattgatcacgaccaagccctggcccaggctataaaggaggccaaggagcagcaccccgatatgtccgttactaaggtcgttgtgcacaaagagaccgagataactccggaagacggagaggattag

SEQ ID NO: 116047 - DNA, 2271 bp, Artificial Sequence
  Description of Artificial Sequence: Synthetic coding sequence
atgcaatgcaaagtgatccttttagatggttccgagtatacgtgcgatgtagaaaagcgatccaggggtcaggttctttttgataaggtatgtgagcacctgaacctgctggagaaagactactttggattaacgtaccgtgatgccgaaaatcagaaaaactggctggaccccgctaaggagattaagaaacaggttagaagcggcgcctggcactttagctttaatgtgaaattttatccacccgaccccgcacagttatcagaggatataacgcgatactatctgtgtcttcagctgagggatgacattgtaagtggaagactgccgtgttcatttgtgacgctggccctgttaggcagctataccgtgcagagcgagttaggagactatgatccagacgagtgtggctctgattatattagcgaattccggtttgctccaaatcacacaaaggaattggaagacaaagtgatcgaacttcataagagccaccgtggcatgacacccgcggaggcagaaatgcatttcctagagaatgccaagaagctgtctatgtatggcgtcgacctgcaccacgctaaggacagcgaaggggttgaaatcatgttaggtgtctgtgcctctggactgctgatttaccgggataggctgcggatcaaccggtttgcctggcctaaggtgttgaagatatcatacaagaggaataacttctacatcaaaataaggccaggagagttcgagcaattcgagagcactatagggtttaagcttcccaaccaccgggctgctaagcgattgtggaaggtgtgcgtggagcaccacactttctttaggctcctgcttcctgaagctccccctaagaaatttctgactttgggcagtaagttcagatattccgggcggactcaggctcagactcgccgtgcttcagctctgattgataggcctgccccatattttgagcggtccagtagcaaacggtatacaatgagccgttcactcgacggcgcgagtgtcaatgagaaccacgaaatctacatgaaagattccatgagtgcagccgaagtgggtactggtcagtacgctaccacaaaagggattagccagacaaatctcataacaaccgtcacacctgagaagaaggcagaggaggaaagggatgaggaggaggataaaaggagaaaaggcgaagaagtaacaccgatatcagccattcgtcatgagggtaaaaccgattcagaacgcaccgataccgccgcggacggcgagactacagcaactgaggaattagagaaaacccaagatgacctcatgaagcatcaaacaaatatcagcgagctgaaaagaacttttctggaaacgtctaccgacaccgctgtgaccaacgaatgggagaaacgcctgtctacttctcctgtgagactagcggcccggcaggaagatgcacccatgatcgagcctctggtacccgaggagaagatggaaactaagaccgagtctagcgggatcgaaaccgaacccacagtgcatcacctcccactgagcacagaaaaggtggtgcaggagaccgtcctagttgaagaacggcgcgtagtccacgcatccggggatgcttcttacagcgcaggagattcaggcgatgcagccgcccagcctgcttttaccggcattaagggcaaggaaggatccgccctcaccgaaggggctaaggaagagggtggagaggaagtggcgaaggcagtgttggagcaggaagagacagcagcagctagtagagagaggcaggaagaacagtccgcagccatacatatcagtgaaaccctcgagcagaaacctcactttgaaagctccactgtgaagactgagaccataagttttggctccgtgagccccggcggggtcaaactagaaatttcaacaaaggaagtgccagttgttcatactgaaaccaagacaatcacatacgagtcaagccaggtggaccccggcacagacttagaacctggtgtcttgatgagcgcccagacaatcacttcagaaactaccagcactactacgacaacccacattacaaagaccgtgaaggggggaatatcagagacacgaattgagaaaaggatagtcattacgggcgatgctgacattgatcacgaccaggcattagcacaggctatcaaagaagcaaaagagcagcatcccgacatgtcagtcacaaaggtcgtcgttcacaaggaaaccgagatcacaccagaagacggtgaagactag

SEQ ID NO: 116048 - DNA, 1179 bp, Artificial Sequence
  Description of Artificial Sequence: Synthetic coding sequence
atgaaacatcagaccaacatatctgaactcaagcggaccttcctggaaacaagtactgataccgccgtgactaacgagtgggagaagcgcctgtctacatctcctgtgcgacttgcagcaagacaggaagatgcacctatgatagagcccctggtgcccgaagaacccagcgtgatcaaaaaaatgcaggagggagatagtgccgatagtgtggtgaccagccgccagattatcttccagaagaccgtgccttctactctggagacaaagcagtcctcaggtgaaaaactgatggatggtagtgaaatcttctcgctgctggaaagcgctagaaagccaacggagtttatcgggggagttacttccacatcacaaagttgggtgcagaagatggagacaaagacggaatccagcggaattgaaacagaaccgaccgtgcatcacctgcccctaagtaccgagaaagtcgtgcaggagacggtgttagtcgaggaacgtcgggttgtgcatgcttctggcgacgcgtcgtattctgccggagattccggcgacgcagctgcccagccagctttcactggaatcaaaggcaaggaaggatctgctctgaccgagggagccaaggaagagggcggggaagaggtggcaaaagctgtccttgaacaagaagagactgcagccgccagtagggagcggcaggaggagcagagtgccgctattcatatctcggagacactggagcaaaaaccacatttcgagtcatctacagtcaagacagagaccatttctttcggctctgtttcccctggcggcgtaaagctcgagattagcactaaggaagtgcctgtcgtgcatacagagaccaagactatcacctacgaaagttcccaggtggaccccggaacggatctggagcctggcgtgttaatgagtgcgcagacgatcacaagcgagacaaccagtaccacaacaacaacccatatcacgaaaactgtcaagggcggcattagcgagactagaattgagaaacggattgtaatcaccggtgatgccgacatcgaccacgaccaggcactcgcccaagctataaaagaggctaaagaacagcatccagatatgtccgtgacaaaagtagtggtgcataaggaaacagagattacccctgaggatggggaggattag

SEQ ID NO: 116049 - DNA, 936 bp, Artificial Sequence
  Description of Artificial Sequence: Synthetic coding sequence
cgctggcagttgggcggcgcagcgactgctgccgctggcggagctcgggtctggcgaccactccccgcctcccgttcctcctttcctcccccttccccgagattggatcccggggagtttgaaggaaagtctccctgtggggggacctgtgaacagccttacctgtcgcttcccctccgctacttctttagcccaaggaaagtggttccagcaggctgcgaacaagcaccaggaggcgccccaaaagaagggttcggtgattcagattccgagtcgaagccggaccaggaggctgagcctcaggaagccgcgggcgcacaaggaagggccggtgcacctgtgcccgagccaccgaaggaggagcagcagcaagctcttgagcagtttgcagcagcggcagctcacagcactccggtccgccgcgaagttaccgataaagaacaggagttcgccgcgcgagccgcgaagcaactggaatatcagcagctggaggacgataagctgagccagaagtcatcatcctccaagctatctcgaagccctcttaaaatcgtgaaaaagcctaaaagtatgcagtgtaaggttattctgctggatgggagcgagtatacttgcgacgttgaaaaaaggagccgcggacaggtactgtttgataaagtgtgcgaacatctcaatctgctcgagaaagattactttggcctcacgtaccgcgatgcggagaatcagaagaactggctcgaccctgccaaagagataaaaaagcaggtgagaagcggggcttggcactttagtttcaatgtgaagttctatcctcctgacccagctcagttatctgaggacataacaagatattacctgtgcctgcagctacgcgatgatatcgtatcagggcggcttccctgctcattcgtcaccctggctctcctaggcagctag

SEQ ID NO: 116050 - DNA, 2652 bp, Artificial Sequence
  Description of Artificial Sequence: Synthetic coding sequence
atgacaaccgagagcggaagcgatagcgagagtaagccagatcaagaggccgaacctcaggaggccgctggagctcaaggccgggccggcgcccccgtcccagaacccccaaaagaggaacagcaacaggctctggaacaattcgctgcagccgccgcacactctactcccgtgcgcagagaggtgacggacaaggaacaagagtttgcggccagagccgccaaacagctagagtatcagcagctagaagacgataaactgtcacagaagtcctcctcttctaaattgagtcgctcacccttaaagattgtcaaaaaaccaaagagcatgcaatgcaaggtgatcttgctggatggatctgaatatacatgtgatgtcgagaaaagaagccgcggccaggtgcttttcgataaagtgtgtgagcaccttaacttgttagagaaagactacttcggtctcacctatcgggacgcagagaatcagaaaaactggcttgatcccgctaaggagatcaaaaagcaggtgagaagtggcgcttggcacttcagcttcaacgttaagttctaccccccggatcccgcccagctctctgaggatattacaagatactacttatgcctgcagctgcgcgacgatatcgtttctgggaggctgccctgtagcttcgtcacactcgccctgctaggttcatacaccgtgcagagcgagctgggagactacgaccctgacgagtgtggaagtgactacattagcgaattccgttttgcgccaaaccacacgaaggagcttgaagacaaggtcatcgaattacacaaatcccatagggggatgacccccgcggaagccgagatgcatttcctggaaaacgccaaaaaactgtctatgtacggagttgacctgcatcacgctaaagatagcgagggggtcgagattatgctgggagtgtgtgcgtccggcttactgatctatcgagatcgcctcagaatcaaccgatttgcctggcccaaagtgttaaagatcagctacaaaaggaacaacttttatattaagattaggccaggggagttcgagcagtttgaaagcacaattggattcaaattgcctaatcatagagccgctaaacggctgtggaaagtgtgtgtggagcaccatactttcttcagactgctcctcccagaagctccaccgaagaagttcttgactctgggttccaagttccgctacagcggacgcactcaggcccagacaaggagagccagcgcgctcattgacaggccggcaccatacttcgaaaggtcttcttctaagcgatacactatgagccgatctctggacggagcatccgttaatgagaatcatgagatctacatgaaggactctatgtcggctgccgaggtgggaaccggtcaatacgcaacaaccaaagggataagtcagaccaacctaatcacaactgtgacgcccgagaagaaggcagaagaagagagggacgaggaagaggacaaaaggcgaaagggggaggaggtgacgcccatttcagcaattcgccatgagggaaaaacagattcagagcgcactgataccgctgctgatggggagaccacagctaccgagtcagatcaagaagaggacgccgagctgaaagcccaggaactggaaaagacgcaggacgacttgatgaaacaccagactaacatttctgaactgaagcggacttttctggaaacttctactgacaccgctgtgacaaacgagtgggagaaacggctctccacctcccccgtccggctagcagcgcgccaggaggatgcccctatgatagagcctctcgttcccgaggaaacaaagcagagctccggtgaaaaactgatggatggaagtgagatattcagtctccttgagtctgcacggaagccgacagagtttattggcggtgtcacctccacctctcagtcctgggttcagaagatggagactaagacagaaagttctggaattgagactgagcctaccgtgcaccacctacccctgagcacagaaaaggtggtgcaggaaactgtgttggtggaggaaagaagggtggtgcatgcatctggagatgcgagctactccgctggcgatagtggcgacgctgcggcacagccagcctttacaggcatcaaaggtaaggaaggcagcgcactcaccgaaggcgccaaggaggagggaggtgaagaggtggccaaggccgtcctggaacaggaggaaaccgccgccgctagtcgcgagcgtcaggaggagcaatctgccgctatacacattagcgagaccctggaacaaaagcctcatttcgagagcagcactgtgaagaccgagactattagcttcggtagcgttagtcccggaggtgttaagctcgaaatcagtactaaagaggtccctgtagtacacacagagactaaaaccattacatacgagtcttctcaggttgaccccggcactgatctcgaacctggtgtgctgatgtcggcccagacaattacatccgagacaactagcaccaccaccaccacacatattactaaaacagtaaaaggcggtatctctgaaacccgtattgaaaaaaggattgttattacaggagacgccgacatcgaccatgatcaggagtag

SEQ ID NO: 116051 - DNA, 2271 bp, Artificial Sequence
  Description of Artificial Sequence: Synthetic coding sequence
atgcagtgcaaagttatactactggacggatccgaatatacctgtgatgtcgagaaacgaagccgcggtcaggtgttatttgacaaggtctgtgagcatcttaacctcctcgagaaagattattttggtctcacctaccgagacgcagaaaatcaaaaaaactggctggaccctgcaaaggagatcaagaaacaagtcagatctggagcatggcatttctccttcaacgttaagttttacccacctgacccagctcagctatcagaagacattactcgatactatctttgcctccaactgcgcgatgacatagtatcaggacgactgccctgctcattcgtgacgctcgcattgcttgggagctacactgtccaaagtgagctgggtgattacgacccggacgaatgcggttctgactacatttccgagttcagatttgctcccaatcacaccaaggaactggaagataaggtgatcgaactccacaagtcacaccgcggcatgaccccagctgaggcggaaatgcacttcctggaaaacgccaaaaaactgtccatgtatggcgtcgatctccatcatgccaaggacagcgagggtgtggaaattatgcttggcgtttgtgctagcggattactgatctaccgggacaggctcagaatcaatcgcttcgcctggcccaaagtgcttaaaatcagttataagaggaataacttctacattaaaatcagacccggagaattcgaacagttcgagtctaccattggattcaagctgcccaaccacagggcagcgaaacgactttggaaagtttgtgtggagcaccacacattttttagactgctactgccagaggcacctcctaagaagttcctgaccttgggaagcaaatttcgctactccggccgtactcaagctcagaccaggcgggcttcagccctgatcgatagaccagctccctactttgagagaagctctagcaagcgctacactatgagcagatccctcgatggagcttcagtgaacgaaaaccacgaaatttacatgaaagacagtatgagcgccgcagaagtggggactggacagtacgccacgaccaaaggcatcagtcagacgaacctcattaccaccgttacccctgaaaaaaaggctgaggaggagcgcgatgaggaggaggacaaaagaagaaagggcgaggaagttacccctattagcgctatccggcacgaggggaaaacagattcagagcgtaccgacacagccgcggatggggagacaacagccacggaagagctcgagaagactcaagacgatctgatgaaacaccagacaaatattagcgaactgaagcgcacattccttgagacttcaacggacaccgcggtcacgaacgagtgggagaagcgcctgagtacttcgccggtgcgactggccgcacgccaggaggatgcccctatgatcgagccgttggtgccagaagagaagatggaaacaaagaccgagagctcagggattgaaactgagcccacagtccaccacctgcccctgagcacggagaaagtggttcaagaaactgtgttagtggaagaaagaagagtcgttcacgcctccggcgatgcctcttacagtgccggtgactcaggcgatgccgctgcacagcccgcattcaccggcatcaaaggtaaagagggcagcgccttaacagaaggcgcaaaggaagaggggggggaggaagtggccaaagcagtcctggaacaagaggagaccgctgccgccagtcgggagaggcaggaagaacagtccgccgccatccacatctcagagaccctcgaacagaaacctcactttgagtcttcgaccgtcaaaacggagaccatcagcttcggatcagtttctccaggcggcgtgaaacttgaaatttccaccaaggaggtccccgtggtgcatacagagaccaaaacaataacctacgagtcctcacaggtcgatcccggaacagatctggaaccaggcgtcctgatgagcgcccagaccatcacaagtgaaacgacctctactacaaccacgacccatattactaaaacagttaagggaggaatcagcgaaacccgcattgaaaagcgtattgtgataactggtgatgctgacattgaccacgatcaagctctcgcccaggctatcaaggaagctaaggagcagcacccagatatgtccgtcacaaaagttgtggtacacaaagagacagaaatcactcctgaggatggagaggactag

SEQ ID NO: 116052 - DNA, 2166 bp, Artificial Sequence
  Description of Artificial Sequence: Synthetic coding sequence
atgggccagggcgagccctcccagagatcgactgggttagctggcctttatgctgcacccgcggcatcacccgtatttattaaaggcagcgggatggatgctctgggtattaaaagttgcgacttccaggcagctcggaataacgaggaacaccacaccaaagccttatcatcccgcagattgtttgtgagaaggggccagcctttcactattattctgtactttagagcccctgtgagggcttttttacctgccctaaagaaagtggctcttaccgcacagacaggtgagcagccctccaagatcaatcgcacacaggctacattccctatcagcagtctgggtgatcgcaagtggtggtctgcagttgttgaggagagagatgcccagtcatggacaatctccgttactacccctgcagacgcagtgataggccactactctttgttactgcaggtgtctggaagaaagcaacttttgttgggccagttcactctgctgttcaatccatggaacagggaggatgcggtgtttctcaagaacgaggcccagcggatggagtacctcctgaaccaaaacgggctgatttatctggggaccgcagactgcattcaggccgaatcgtgggacttcgggcagttcgagggcgacgtgatcgacctgtctctgcgtcttttgtctaaagataaacaggtggagaagtggtcacagcctgttcatgttgcccgtgtcctgggcgcgttattgcactttctaaaggaacagagagtgctgccgaccccgcagacacaggcgacccaggaaggcgccttgctgaacaaaagaaggggcagtgtcccaattcttagacagtggctgaccggtcgcggcaggcccgtctatgacgggcaagcctgggtgctggcggctgtggcttgcacggtgctgaggtgtcttggaattcctgcacgcgtggtcaccacatttgcctccgcacaagggaccggaggccgcctgctgatcgacgagtactacaacgaggaagggctgcagaatggagagggtcagcgcggacggatttggatttttcagacatcaacagagtgctggatgacccggcctgctctgccacaggggtacgatggatggcagattctgcatcccagtgctccgaacggtggaggcgttctgggctcttgtgacctcgttccggtacgggcggtcaaggagggtacgttaggactgactccagccgtctcagatctgttcgccgcgattaacgcctcctgtgtggtctggaagtgctgtgaggatgggactttggaactgacagactccaacacaaagtacgttggcaacaacatcagcaccaaaggggttgggtctgatagatgcgaagacatcacgcagaattataagtaccctgaagggtcccttcaagaaaaagaagtcctggaaagggtagagaaggaaaagatggaacgggaaaaggacaacggaatccgtcctccaagcctggagaccgcatcgccactgtatctgctgctgaaagcccccagctctttgccactccgcggcgacgctcaaatctcagttaccctggtcaaccacagtgagcaagagaaagctgtccagctcgcgatcggcgtgcaggcagtgcactacaacggcgtgttagctgcgaaactctggaggaagaaactgcatctaactctgtccgctaacctcgagaaaattatcaccatcggcctgttctttagcaattttgagcgcaatcccccagaaaatacatttttgcggctgactgcaatggccactcacagcgagtccaacctgagctgttttgcacaggaggatattgctatatgtcgcccgcatctggccatcaaaatgccagagaaagcggagcagtaccagcctctgacagcctcagtttcccttcagaactcactggacgctcccatggaggattgcgtcatctctattctggggcggggcttaatccatagagagaggagttaccgttttaggagcgtttggccagagaacacaatgtgtgccaaattccagtttacacccactcacgtgggcctgcagaggctcacagtcgaagtcgactgtaacatgttccagaatttaaccaactacaagagcgtgactgtggtagctccggaattgtctgcctag

SEQ ID NO: 116053 - DNA, 1860 bp, Artificial Sequence
  Description of Artificial Sequence: Synthetic coding sequence
atggggcaggcactagggattaagtcttgtgatttccaggctgcccggaataatgaagaacaccacaccaaagccttaagttctcgtcgtctgtttgtccggagaggccaacccttcaccatcatcctctacttccgggcacccgtaagagccttcttacccgctttgaagaaagtagcactgaccgcccagacaggagagcagccctctaaaatcaacagaacccaggccacatttccgatttcatcattgggggataggaagtggtggtcggccgtggtggaagagagagatgcacaaagctggacaatttccgtgacaacaccagccgatgcagtgatcggacactatagtctgctgctgcaggtgtccggtagaaagcagctgctactggggcaattcacactgctgttcaatccttggaaccgggaagacgccgttttcttgaagaacgaggcgcagcggatggagtatctgctgaatcaaaatggcctgatctacttggggactgccgattgtatccaggccgagtcgtgggatttcggtcagttcgagggtgatgttatcgacctttctttacgcctgctgtccaaggacaagcaggtggagaaatggagtcagcctgtgcatgttgctcgagtgctcggcgcactgctgcacttcctgaaagagcagagagttctgcccaccccccagacccaggctactcaggaaggagcgctcttgaacaagcgaagaggcagcgtgcctatcctgaggcagtggctaactgggcgaggtaggccggtgtacgatggtcaggcttgggtcctggctgcagtggcgtgtactgtccttaggtgccttggcatccccgcccgcgtggttaccactttcgcatctgctcaggggactggcggaaggcttctgatcgatgagtattacaacgaagagggcctccagaatggagagggacaacggggccggatctggaagtgctgcgaagatggcaccttagagctgaccgattctaataccaaatatgttggaaacaacatttccacgaagggtgtcgggagcgataggtgcgaggatatcactcagaactacaagtatccagagggctccctgcaagagaaggaggtgctggaacgtgtggaaaaagagaaaatggaacgcgagaaagataatggaatccggccgccttcactggagacagcctcccctctgtacctgttattgaaagctccatcatctcttccactaagaggggatgcacaaatttccgttacactggttaatcactctgagcaagaaaaggctgtccagcttgcaatcggagtgcaagctgtccactataatggcgtgctagccgcgaaactgtggaggaaaaagcttcacctgacactgtccgctaacctggaaaagattattaccataggcctctttttcagcaacttcgaacgcaatcctccagagaatacgttcctccggctgactgccatggcaacccattcagagtcaaatctctcatgttttgcccaggaagatatcgcaatctgcaggcctcacttagcaattaagatgccagagaaggccgaacagtatcagcccttgaccgcctctgtgtcacttcaaaactctctggatgcaccaatggaagattgcgtcattagcatccttggccggggtctcatccaccgcgaacgcagttacagatttaggtctgtgtggccagaaaacaccatgtgcgctaaattccagttcacacccacccacgtcggcctgcagcggctcaccgttgaagtggactgcaacatgttccaaaacttgacgaactacaaatcggtgaccgtggtggcccctgaattgagcgcctag

SEQ ID NO: 116054 - DNA, 2076 bp, Artificial Sequence
  Description of Artificial Sequence: Synthetic coding sequence
atgggccaggctctgggaatcaaatcatgtgattttcaggcagctcgaaacaacgaagaacaccatactaaggctctgagcagccgcagactctttgtacgccgagggcagccattcactataatcctgtattttcgcgctcctgttagagcttttctccccgctctcaaaaaggttgctctgacggcccaaacaggagagcagcctagcaagatcaatcggacccaggcaacctttcccatttcatccctgggtgataggaagtggtggagcgctgtagtcgaagagagggacgcccagagttggaccattagcgtgaccacccccgctgatgcagtgataggtcactatagcctattactacaggtctctggtcgcaagcagctcctactgggtcaattcacccttttgttcaatccatggaatcgtgaagacgcagtgtttctgaagaacgaggctcagcggatggaatacctcttaaatcaaaacgggttgatctatctggggacggcagactgtatccaggccgaatcttgggattttggacagtttgaaggtgacgtaatagacctgtccctgcgcctgctctcaaaagacaaacaggtggagaaatggagtcagcctgtgcacgtggctagggtgcttggtgctctcctacactttctgaaagaacagagagtgctaccgaccccgcaaacgcaggccacccaggaaggagccctgctgaacaaacgccgagggtcagtcccaattttgagacaatggttaactggcaggggacgcccagtatatgacgggcaggcctgggtgctagccgccgtggcctgtactgttctgcggtgcctgggtatcccagctagagtagtgaccaccttcgcatctgcccagggaaccggtggacgactgcttattgacgagtattacaacgaggaggggctgcagaacggagaaggacagaggggaaggatatggatctttcagacaagtactgaatgttggatgacccgcccggcccttccacagggctacgacggctggcaaatactgcaccccagtgcccccaatggaggtggtgtgctcggatcctgtgacttagttccggtaagagctgtcaaggaaggaacgttgggtctaaccccagctgtatcggacctctttgctgccatcaatgccagttgcgtagtctggaagtgctgcgaagacggcacactagaactaactgattcaaacacgaagtatgtagggaataacattagtactaaaggcgtggggagcgatagatgtgaagacattacccagaactacaagtacccggaaggctcattgcaggagaaggaggtgctggaacgcgtcgagaaggaaaaaatggaaagggagaaggataacggcatcagaccgccctctttggaaacagcctcccctctatacttgctgctcaaggctccaagtagtctgccgctgaggggggacgcgcaaatcagtgtgactctcgtcaaccattctgagcaggagaaagctgttcaactggccattggtgtgcaggccgtacattataatggcgtcctcgccgccaagctgtggcgcaagaaactgcatttaactctgagcgccaatctggaaaagatcatcacgatagggttattcttcagcaacttcgagaggaatccaccagaaaacaccttcttaagactgacggcgatggccacccattccgagtctaatctgtcatgtttcgcacaagaggatattgcaatctgcaggcctcatctcgcaattaagatgccagagaaggccgagcagtatcagcccctgacggcctctgtcagcctccaaaacagcttggacgcaccgatggaagactgcgtgatttcgattctgggccgcggcctgattcaccgtgagaggtcgtataggttcagatctgtatggcccgaaaacactatgtgtgcaaaattccaattcaccccaacccatgtcggcctccaaagattaaccgtcgaggtagattgcaacatgtttcaaaaccttaccaactacaaatccgttacagtcgttgcccctgagctgtccgcttag

SEQ ID NO: 116055 - DNA, 1842 bp, Artificial Sequence
  Description of Artificial Sequence: Synthetic coding sequence
atgggtcaggcactgggcatcaaatcttgtgactttcaggcggctcgaaacaacgaagaacatcataccaaggctctgtccagccgacgtctgtttgtgcgtcgtgggcagccttttactatcatcctgtatttccgcgcacctgtcagggcgttcctgccagccttgaaaaaggtggccctgacagctcagactgaagatgctgtgttcctgaagaatgaagctcaaaggatggaatatcttctcaaccagaacggcctgatctacctgggcacagccgattgtattcaggcagagtcctgggactttggacagtttgaaggagacgtcatcgacttgtcactcaggcttctttccaaagataaacaagtggagaagtggtcccagcccgttcatgtggctcgggttttaggggccctccttcacttcctcaaggaacagagagtcctgcccacaccacagacccaagcgacccaggaaggcgctctactcaataaaagacggggctcagtgccaattctgcgccaatggctgaccgggcgcgggcgtccggtgtacgacggtcaagcctgggtcttagctgctgtcgcctgtaccgtgttaaggtgcctcggaattcctgcacgggtggtgactacgtttgcctctgctcagggaacaggtggtagattactgatagacgaatactacaacgaggagggactgcaaaacggagaaggccaaaggggtagaatctggatttttcagacatccacagaatgttggatgacccgacccgctttaccgcaaggctatgacgggtggcaaatcttacacccaagtgccccaaatgggggcggggtcctcggctcttgtgaccttgtgccagtcagggccgtgaaggagggcacccttggactgacccccgctgtctccgatctctttgctgcaatcaatgctagttgtgttgtgtggaaatgctgcgaagatggcaccctggaactcaccgatagcaacacaaaatatgttggaaataacatttccacgaagggcgtgggatcggacaggtgcgaggatatcacacagaactataaatacccagagggatccctccaggagaaggaagtgctcgagagggttgaaaaggaaaagatggagcgcgaaaaggataatggcattaggcctccttcactggaaaccgccagcccactttacctcctgcttaaggccccttcttccctgcccctcaggggtgatgcccaaatttccgtaaccttagtgaatcatagcgagcaggaaaaagccgttcagctggcgatcggtgtgcaagccgtgcattacaacggtgtcctggcagctaagctttggcggaagaagctccacctgaccttgagcgctaacctggaaaaaattattactattggtctcttttttagcaatttcgaacgcaatcctccggaaaatacattcctcaggctgacggcaatggcaacacactcagagtccaacctgagctgcttcgcacaagaagatatagctatctgtcgccctcatttagccattaaaatgccagagaaggctgagcaatatcagccactcacagctagtgtgagcctccagaatagcctggacgcgccgatggaggactgcgttatatccattctgggccgggggcttatacatcgggagcggtcctaccgcttccgttcggtctggcctgaaaacaccatgtgtgcaaaattccagttcacacctactcacgtaggtcttcagcgcttgacagtagaggttgattgtaatatgttccaaaatttaacaaattataaatccgtgaccgtggtcgctccagaattgagtgcctag

SEQ ID NO: 116056 - DNA, 1218 bp, Artificial Sequence
  Description of Artificial Sequence: Synthetic coding sequence
atggagcggctgcaaaaacagcctcttaccagtccaggctccgtatctccaagccgggactcaagtgtacctggctcgcctagctccatcgttgccaagatggataaccaggtcttgggttataaagacctcgcagccatcccaaaggataaagccattttagacatagaaagaccggaccttatgatctacgagccacacttcacttattccctgctcgagcatgtagagttgcctcggtcccgagaaaggtctctgagccctaaaagtaccagcccccctccgtctccagaggtttgggcggatagccgttcacctgggataatctcacaggccagcgcccctcgcaccacagggaccccgcggacatccttgccgcactttcaccaccccgaaacatctcgccccgattccaacatatacaagaagccccctatatacaagcagcgggaatcggtgggcggctccccccagactaagcaccttatcgaggatctgatcatagagtctagcaagttcccagccgcccagccacccgaccctaatcagccggccaaaatagagaccgactattggccttgcccaccatccctcgcagtggttgaaacggagtggcgcaagcgcaaggcatccaggcggggagccgaagaagaagaagaggaggaggacgatgatagcggcgaagaaatgaaagccctgagggaaaggcaaagagaagagttaagcaaggtgacaagcaatctgggtaagatgattctgaaagaagaaatggagaaatcgttgcccattaggagaaaaacaaggtcactgccagataggactccatttcatacaagcttgcatcagggcactagcaagagcagtagcttgcccgcatacgggagaacaaccctcagcagattgcagtcaactgagttttccccttccgggagtgaaactgggtcgccaggattgcagaatggggaggggcagagaggccgaatggaccgcggaaatagcctcccttgcgtattggaacagaaaatctatccctacgaaatgctggtggttactaacaagggccgtactaagctgcccccaggcgtggaccgtatgcgcctggagagacacctttctgccgaagacttttcccgcgtgttcgccatgagtcctgaggaatttgggaaactggccctgtggaaaaggaacgaactgaagaagaaagcctcactattttag

SEQ ID NO: 116057 - DNA, 1218 bp, Artificial Sequence
  Description of Artificial Sequence: Synthetic coding sequence
atggagcggttgcaaaagcagccgctcacctctcctggttccgtatcccccagcagggatagctccgtgcccggtagtccgtcatccatcgttgccaaaatggataaccaggtcctggggtacaaagacctggctgcaattccaaaagacaaggccatactcgatatagaacggccagatttaatgatctacgagccccactttacctatagcctccttgaacacgtggagctcccacgctccagggaacgcagcctgagccctaagtcaacctctccccccccatcccctgaggtttgggctgatagccgcagtcctggcattatctctcaggcctcagctccccgcacaactggaactcccagaacaagtttgccacatttccaccatcctgagacatcccggcctgactccaatatctataagaagccacctatttacaaacagcgcgaatccgtgggcggatctccacaaactaaacacctgattgaagacctaattatcgaaagttccaagtttcctgcagcccagccgcccgaccctaaccagcctgccaaaattgaaactgattattggccatgccctccatctctcgccgttgtagagactgagtggagaaagcggaaggcaagtagacggggggctgaagaggaagaggaggaagaggatgacgattctggagaggagatgaaggcactgcgagagaggcagagggaagagctcagcaaggtgactagcaatctcggcaagatgattctcaaggaggagatggagaagtctctgccaatccggagaaagacaagatctctccccgaccgaacaccattccacacaagtcttcaccaaggtacttccaagagctcctccctgcccgcctacggccgcacgacgctgagtaggctgcagagcacagagttctctcccagcggtagcgagaccggatcgccaggcctgcagaacggagaaggacaacgggggagaatggaccggggcaattcactgccctgcgtgctcgaacagaaaatttatccttacgagatgctggtggttacaaacaagggcagaacaaagctgccacctggcgtggatcgcatgcgcctcgagagacacctgagtgccgaagatttttccagagtgtttgctatgagccccgaagagttcgggaaactggctctgtggaagcggaatgagctcaagaagaaggcttcactcttctag

SEQ ID NO: 116058 - DNA, 1626 bp, Artificial Sequence
  Description of Artificial Sequence: Synthetic coding sequence
atgatttacgagccacacttcacttactcattgctggaacatgtggagttgcctaggtctcgcgagcggtcgttgtctccaaaatccacgagcccaccccctagccctgaagtctgggctgactctaggtcaccaggaataatctctcaggcttctgcccctagaacaactggaacgcctcggacttctctgccccacttccaccaccccgaaacaagccgtcctgattccaacatatacaaaaagccgcccatttacaagcagcgggagagtgtcggagggtcaccccagacaaagcacctgatcgaggacttgattattgagagcagcaaattccccgcagcgcaaccaccggatccaaaccagcctgctaaaattgaaaccgactactggccctgtcccccttcactagcagtcgtggagacagagtggagaaagcgtaaagcctccagacgaggcgcggaggaagaagaggaggaggaggacgacgactccggcgaggaaatgaaggccctcagggagcggcagcgagaggagttaagcaaagtgacatctaaccttgggaagatgattcttaaagaggaaatggagaaaagtctgccaatcaggagaaaaacccgatccctccccgataggacaccttttcatacgtccttgcatcaaggaacttccaaatcctcctctcttcctgcttacggccgaaccactcttagtcggttgcagtccacggaatttagtccatccggatcagaaactggaagtccaggcctgcaaaacggcgagggccagaggggtaggatggacagaggtaatagtctgccatgtgtgctggagcagaaaatttacccgtacgagatgcttgttgtcactaacaagggtagaaccaaattgccacccggagtcgacaggatgaggctggagaggcatctaagcgccgaggatttctccagagttttcgcaatgtctcctgaggagttcgggaagctggccctttggaagcgcaacgagctcaaaaagaaggcttctctgtttggggcactggtggtgcggccggtgggttgtctagaacagctcgaggggcgctgccgaggtggaaaacgacccgggcggaagagttctagactgctctgccgtccaccatctccccccattcttaccccagacagctttcctgctcttcagccccctgccccccttacgctagttggaaccggcccgagcagtgcttccggaagggaggtcactccaccacttcagctggctctgacaagtgctcgaaagccccgcgcctctaagccctttgcacccgctctcaggctgccacagaagccaggactgcgagttgaaatgcccccgactcacgatcctggacccccgccagctagcagacctaggaatggcaatagctcgaccaaacctggtacaggccagaaacttggcctgccgccaccactggatggagtaaaacggcccgggctggcccatttcggcgttagctggttacccgccctgacttatacacacgcaccccctcacaccctctgctcactgaaaaacgtcatatactggggccccccgtcctgctttccccacctccccttaccttacctcacccctccagcatag

SEQ ID NO: 116059 - DNA, 1152 bp, Artificial Sequence
  Description of Artificial Sequence: Synthetic coding sequence
atggagaggctccagaaacaaccactgacaagtcctgggtccgtgtccccctcaagggactcgagcgtcccaggatcaccgtcttctatcgttgcaaagatggacaatcaggtgttaggttacaaagacctggctgccattcccaaggataaagcaatcctggacatcgagagacctgacctgatgatttatgaaccccattttacatacagcctgttggaacatgtcgagcttccacgcagtagggaaaggagtctgagtccaaagtctaccagcccaccaccatcacccgaggtgtgggccgacagcagatctccaggcatcatcagccaggcgagcgcgccaaggacaacgggcacaccccgaaccagcctgcctcattttcatcaccccgagacaagccgtcccgattcaaacatctacaagaagccacccatctacaagcaaagagagtccgtcggaggcagcccacaaacaaagcacctaatcgaggatcttattatcgaaagttcgaaatttccagcagcccaaccacctgatccaaatcagcctgcaaagatcgaaacagactactggccatgccccccctcactggccgttgtggagacagagtggaggaaaagaaaagcctctcgccggggtgccgaggaagaagaagaagaggaggatgacgactctggggaagagatgaaggctttgcgtgaaaggcagcgagaagaactctcaaaggtgactagtaacctgggcaaaatgattctcaaggaggagatggagaaatccctaccgattaggagaaaaacccggtcactgcctgacaggactccttttcatacaagtctgcatcaaggcacaagtaaaagctctagtttgccagcatatggcaggactaccctgagtaggttgcagagtaccgaattcagcccttcagggtcggagacgggatcgcctggcttgcagatctacccctacgagatgctcgtggtcacaaacaaggggcggacgaaactgccacccggagtggaccggatgaggctggaaagacatctgtctgctgaagacttcagtagagtcttcgccatgagcccagaggagttcggcaagctggctctgtggaaaagaaacgagctcaaaaagaaggccagcttgttctag

SEQ ID NO: 116060 - DNA, 1152 bp, Artificial Sequence
  Description of Artificial Sequence: Synthetic coding sequence
atggagcggctgcaaaaacagcccctaacatcccccgggagtgtatccccttcaagagactcaagtgtcccgggttccccaagtagcattgtcgctaaaatggacaaccaggtcctggggtacaaggacttggctgcaattcctaaagacaaggcaatactcgacatagaacgccccgatctgatgatctatgagccccacttcacctacagcttgctggagcacgtcgaactacctcgatcacgggagcgatcgctgtccccgaagagcacctccccccctcccagccctgaagtatgggccgacagtcgctctccggggatcatctcacaggcctcggctccccgaacaacagggacaccccggacctccctcccccattttcaccacccagagacctctcggcccgactcaaatatatataaaaagccccctatttataagcagcgggagagtgtcggaggctcgccccaaacaaagcaccttatcgaagacttgatcatcgagtcaagtaaatttcccgccgctcagccacccgacccgaaccagccggctaagattgagacggactattggccatgtccccccagcttggcagtagtggaaaccgagtggagaaagaggaaagctagccgaagaggggcagaagaggaagaggaggaggaggatgatgatagcggagaggagatgaaggcgctgcgggaacgtcagagggaagaactgtccaaagtcacttctaatctggggaagatgattctgaaggaggagatggagaagagtttacctatccgccgaaaaacgagaagtttacctgaccggaccccgtttcacacttcgctccatcagggaactagtaaaagctcctcactcccggcttacggccggactacgttaagccgcctgcagagtaccgaattctctcccagtggaagtgagaccggcagcccagggctgcagatttatccctatgaaatgctcgtggttaccaataagggccgcaccaaactacctcctggggtggaccgcatgagacttgagagacatttgtccgcagaggacttcagccgggtgttcgcaatgagccccgaggagtttggaaaattggctctgtggaagaggaatgagcttaagaagaaggctagtctgttctag

SEQ ID NO: 116061 - DNA, 1218 bp, Artificial Sequence
  Description of Artificial Sequence: Synthetic coding sequence
atggagaggttgcagaagcaacccctgacatcacctggtagcgttagtcctagccgggattcaagcgtcccagggagtccctcctccatcgtagcaaagatggacaatcaggttcttggctacaaagacctggctgccatccccaaggacaaggccatcctggacatcgaacggcctgacctaatgatttacgagccccactttacttacagcttactggaacacgtggaactgccccgcagccgcgaaaggagcctgagtccaaagtctacatctccacctccctcgcctgaggtctgggccgattccaggtcaccaggaatcattagtcaggctagcgcaccaagaaccactggaaccccccgcacctccttgccccacttccaccatcccgagacaagccggccggactctaacatatacaaaaaaccccctatttataagcaaagggaaagcgttggggggtctccacagactaaacacctgatcgaggatctaattattgaatccagcaagttccccgccgcccaacctcctgatcctaaccagcctgccaaaattgaaaccgattattggccctgtcccccgtctctcgccgttgtggagacagagtggcggaaacggaaagccagcagaaggggcgccgaggaagaagaggaagaagaagatgatgactccggagaagagatgaaagccctgcgggagagacagcgggaagagctgtccaaggttacgtcaaatcttgggaaaatgatcctgaaagaagagatggagaaaagcctcccgatacggcgcaagacccgctctctgcccgacagaacaccttttcatacctctttacaccaggggacatctaagtcaagctctctgcctgcctacgggagaacaaccctgtcacgactccagtctaccgagttctccccttcagggagcgagacaggttcgccaggactccagaatggagaggggcaacgcggacggatggatcgaggcaacagtctcccctgcgtgctggagcagaaaatctacccgtacgagatgctggtcgtcacaaataagggacggacaaaactgccaccaggtgttgacagaatgaggctcgaacgtcacttgtcagctgaagacttctctcgcgtgttcgctatgtccccagaagagtttgggaaactggctttatggaaaagaaatgagctgaagaaaaaagccagcctgttctag

SEQ ID NO: 116062 - DNA, 1077 bp, Artificial Sequence
  Description of Artificial Sequence: Synthetic coding sequence
atggaacggttacagaaggctaagatggataaccaggtgttgggatataaagatctagccgcgattccgaaggacaaggcaatcctggatattgaaagacctgatctgatgatttatgagccgcacttcacctattcactcctggaacacgtagagttacctagaagcagagagaggagtctgtcaccaaaatcgactagtcctcccccctctccagaagtgtgggccgactcacggtcaccggggattatttcacaggctagcgcaccgagaaccaccggcaccccccgaacaagtctccctcacttccaccaccctgagaccagcaggccagatagcaatatttacaaaaagcctcccatctacaagcagagggagagcgtgggaggaagcccccagacaaaacatctgatagaggacctaatcatcgagagtagcaaattccccgctgctcagcctcccgatccaaaccagccagccaagattgagacagactactggccatgtcctccttccctagcagtggtggagacagagtggcgaaagagaaaggcatccagacgcggcgctgaggaagaggaggaagaggaggatgacgactccggcgaggagatgaaggccctgagagagcgacaacgtgaggaactctcaaaagtcacatctaatctgggtaaaatgatcctgaaagaggagatggagaagtctctcccgatccgcaggaaaacgaggtctctgcctgatcggactcccttccacacctccctgcatcagggcacatccaaaagctcttctctgcccgcgtacggtcgcaccacccttagcagacttcagtctaccgaattcagtcccagtggctcagagaccggctcaccaggactacagatctacccatatgagatgctcgtcgtcacgaacaaaggtcgcaccaagctgccccccggcgtggataggatgcgcctcgaaaggcatttgagtgctgaggatttctccagggtgtttgcaatgtcccccgaagagttcgggaaacttgccctctggaaacgaaacgaactcaaaaagaaggcatccttattctag

SEQ ID NO: 116063 - DNA, 1152 bp, Artificial Sequence
  Description of Artificial Sequence: Synthetic coding sequence
atggagcgcctgcagaagcagcctctgacgtcacccggtagtgttagcccatcacgggattccagtgttcccggttctcctagttcgatcgtcgcgaagatggataaccaggtgctgggctataaggacctggcagccatccctaaggacaaggccatcctggacatcgagagaccggatttgatgatctacgagcctcacttcacgtactctctacttgagcatgtcgaattaccccgatctcgggagcgctcactatctcccaagtcgacatcaccacccccttctcccgaggtgtgggcagacagtcgatctcccggcattatcagccaggctagcgcgccacggacgaccggaactccgcggacgagcctgccccacttccatcatcccgagacctcacggcctgacagtaatatttacaagaagccacctatttacaagcagcgagagtccgtgggcggtagcccccagactaaacatctcatagaagaccttataattgaatcatccaagttccccgccgctcagcctccagatcccaatcaaccagctaagattgaaactgattactggccatgcccaccttcccttgccgtcgtggaaaccgaatggaggaagcgtaaggcctcacggcgcggcgctgaagaagaggaagaagaggaggatgacgactcaggggaggaaatgaaagccctcagggaaaggcaacgagaagagctgtcaaaggtcactagcaaccttggcaaaatgatacttaaagaagagatggaaaagtccttgccgatcagaagaaagacacggtctctgcccgatcggacacctttccacacaagcctgcaccagggcacttccaaaagctcaagtctgccagcctatggccgaaccacattgtctagactccagagtaccgagttttcacccagcggcagtgagactggtagcccaggattacagatctacccctatgagatgcttgtggtgacgaacaagggtcggacgaaactgcctcccggagtggaccgtatgaggctggaacgccacctctctgcggaggatttttcccgcgtgtttgccatgagccctgaggagttcgggaagttagccctgtggaagcgaaacgagctcaagaaaaaagcatctctgttttag

SEQ ID NO: 116064 - DNA, 1218 bp, Artificial Sequence
  Description of Artificial Sequence: Synthetic coding sequence
atggagcggctgcagaagcagccacttacctcgccaggctccgtgtccccttccagggactctagcgtgcccggctccccctcaagtatcgtggccaaaatggataaccaggtcctgggatacaaggacctggcagccatccccaaggacaaagccatcctggacatagaacggcctgacctgatgatctatgaaccacacttcacatactcgctgctggagcatgtcgagctaccccggtcccgcgaacgctcactcagccccaaatccaccagccctccgcccagtccagaggtctgggcagactctagatcgcctggaatcatcagtcaggcttcagccccccggacgaccgggactccgcgcacctcgctcccccactttcatcaccccgagaccagtcggcctgactccaatatatacaaaaagcccccgatttacaaacagcgggagagcgtcgggggcagcccccagactaaacacctcatcgaagacctgattattgagtcttctaagtttcctgccgcgcagcccccagaccccaatcaaccggccaaaatcgagactgattactggccttgccctccttccctcgcagttgtggaaacggaatggaggaagcgaaaagcatccaggagaggggctgaggaagaagaagaggaggaggatgacgattctggagaggagatgaaggctctccgggagcgacaacgcgaggagctgtctaaggtgacatctaatctcggcaagatgatcctcaaagaggagatggagaagtcccttcccattagaaggaagaccaggagcctcccggaccgcacccctttccacacctcccttcatcaaggtacgtcaaaatccagttcactcccagcctacgggagaactacattgtccaggcttcagagtaccgaattctcacccagtgggtccgaaacgggcagtcccggactgcagaatggagagggccagcgtggccgcatggacagaggaaactctcttccctgtgttctggaacagaaaatctacccatacgagatgctggtggtaactaataagggcaggacaaaacttccacctggagttgacaggatgcgcttggaacgccacctgagcgcagaggattttagcagggtgttcgccatgagccctgaggaatttggcaagttggctctgtggaaaaggaatgaattgaaaaaaaaagcatcattgttttag

SEQ ID NO: 116065 - DNA, 1098 bp, Artificial Sequence
  Description of Artificial Sequence: Synthetic coding sequence
atggagcgtttgcagaaggcaaaaatggataatcaggtgcttggctacaaggacctcgctgcgatacccaaggataaagctatactggatattgagagacctgatttgatgatatatgagccacatttcacttatagcttgctggagcatgtagagctaccgcggagtagggaggtctgggctgattcaagatcgcctgggataatcagccaagcaagtgcccctcgaacaaccggaacaccacgcacttctctgccacatttccaccaccctgagaccagccgaccagattctaatatatacaagaaaccgccaatctacaaacaaagagagtccgtgggtggcagcccacaaaccaagcatctgatcgaggatctcatcattgagtctagtaagttcccagcagcccaaccgcccgaccccaaccagccagccaagattgaaacggattattggccctgcccaccgagtcttgccgtcgtagagacagagtggaggaaaaggaaagccagcaggaggggtgctgaggaagaggaagaggaagaggatgatgacagcggggaggaaatgaaggcgctgcgggagcgtcaaagagaagaattatcaaaggtaacatctaatctggggaaaatgattctaaaagaggagatggagaaatcgctgcctatcaggcgaaagaccagaagcttgccagataggactccatttcacaccagtctgcaccaggggaccagcaagtcttctagcttgcccgcatacggccgtaccacactgtctcgattacagagtactgaattcagcccatctgggagcgaaaccgggtctccaggtcttcagaacggggaaggccagagggggagaatggacagggggaacagtctgccgtgtgtcctggagcagaagatctatccttacgagatgcttgtcgtgacaaataaggggcgaactaaactgcctcctggagtcgaccgtatgaggcttgagagacatcttagtgccgaagattttagtagggtctttgcgatgagccccgaagaatttggcaaactcgccctgtggaagaggaatgaactcaagaagaaggcatccctgttttag

SEQ ID NO: 116066 - DNA, 570 bp, Artificial Sequence
  Description of Artificial Sequence: Synthetic coding sequence
atggacgcagtggacgcaaccatggagaagcttagagctcagtgcctcagccgcggggcatctggtatccaaggcctcgctcggtttttcaggcagctggacagggacggtagccggtccctggatgcggacgaattccgtcaaggccttgccaagttaggtctggtacttgatcaagccgaggctgagggggtgtgccggaaatgggatcgtaatggctctggaaccctggacttggaagaatttctcagagcactgaggccacctatgtcacaggctagggaagcggtcattgccgcagcatttgcaaagctcgatagaagtggtgatggcgtagtgacagtggatgacttacgcggggtgtactctggccgcgcccacccgaaagtgagatctggtgagtggacagaggatgaggttctgaggcgatttttggataatttcgacagcagtgagaaggacggtcaagtaacattggccgagttccaggattactattcaggagtgtctgcaagcatgaacacggacgaggagttcgtggcaatgatgacctccgcatggcagctttag

SEQ ID NO: 116067 - DNA, 2565 bp, Artificial Sequence
  Description of Artificial Sequence: Synthetic coding sequence
atggccttggagcaggccctgcaagccgcacgccagggggagttagacgtgttacgcagcctccacgccgcaggtctcttgggcccttctcttcgtgacccattggatgcactgccagtgcaccatgccgccagggccggcaaactccactgcctccgctttttggtggaggaagcagcgcttcccgctgctgcacgagcgagaaacggcgccactcctgcccatgatgcatcggctaccggccatctcgcttgcctccaatggctgctttcacagggaggatgtcgcgtgcaggacaaagacaatagcggtgcaactgtcctgcacctggcagctcgctttggtcaccctgaggtagtcaattggctgctgcaccacggtggtggggatcctacagccgcaaccgacatgggcgccctacctatccactatgccgccgcgaagggtgactttccttcactccgactgctggtagagcattatccagagggagttaacgcgcaaacaaagaacggggctactccattatacctcgcttgccaagaggggcacctggaggtcacccagtatctagtgcaggagtgtggcgctgaccctcacgcccgggcccacgacggtatgacccccctgcatgctgccgcgcagatggggcacagccccgtgatcgtctggctggttagttgcaccgatgtgtcattgagcgagcaagataaggacggggccacggccatgcactttgccgccagccgagggcacacaaaggtcctcagctggctgctgttgcacgggggtgaaatctccgcagacctctggggtgggaccccacttcatgacgctgccgaaaacggggaactagagtgttgccagatattggtggtaaacggggccgaattagacgtccgggatcgcgatggctatacagcggcagatttgtcagattttaatgggcacagccattgcacacggtacctgcgtactgtggaaaatctgtctgtagagcatagagtattatctagagatccctccgctgagctcgaggcaaagcagcctgacagtggcatgtcttctccaaatactacagtgtccgtgcaacctcttaattttgatctctccagtcccacctcgacactgtccaactacgactcctgcagctccagccattctagcattaagggacaacaccctccctgcggcctttccagcgccagggctgccgacatacagtcatatatggacatgctgaatccagagttaggactcccaagggggacaatcggaaagcccacacctccccccccacccccctcatttcccccccctcccccaccacccggtacccagttacctccacctccacccgggtaccccgcgccaaaacctcccgtcggcccgcaagctgcagacatttatatgcaaaccaagaacaagctccgacatgtggagaccgaagcgctgaaaaaggaattgtcctcttgcgacgggcacgatggtctccgaaggcaggattcatctcgcaagccacgcgccttttctaaacagccatccactggtgactactaccgacagctgggaagatgcccaggcgaaacgctagctgctcgtcccggtatggcccacagtgaggaggtacgggcccggcaacctgcacgtgccggatgtccaaggctgggacctgcagctcggggctcccttgaaggaccctctgcacctccccaagctgctctattacctggcaatcatgttccaaacggctgtgctgcggaccccaaggccagtcgcgagcttcccccgccccccccgccgccaccaccccccctgccagaggcagcctctagccctcctcccgccccaccactgcctctagagagcgcaggtcccggatgcggtcagcggcgaagttcatccagcaccggctcgacgaaaagtttcaacatgatgagtcccactggggataattccgagttgctggctgagatcaaggctggcaaatccctcaaacctacgccacagagtaagggcctgactacagtctttagcggtattggccagcctgcatttcagcctgactcaccactccccagtgtttccccagccctaagccccgttcgatccccaacacctcccgcggctggcttccagccgctcctgaacggaagtttggtcccagtccctcctacaacacccgccccaggcgtgcagctggatgtagaggcactaatcccaacccatgacgagcagggacgccctatcccagagtggaaacgacaggtcatggttaggaaaatgcagctgaaaatgcaagaggaggaggagcagcggagaaaagaagaagaagaggaggctcggctcgcttccatgcccgcatggagacgggatctgttgcgtaaaaaactcgaggaagaaagggaacagaagcggaaagaagaagagaggcaaaagcaagaggaactgcgccgggagaaggagcaatccgaaaagctgaggacattgggctatgacgagtctaaactcgccccctggcagaggcaagtcattctgaagaagggagacattgcaaaatattag

SEQ ID NO: 116068 - DNA, 867 bp, Artificial Sequence
  Description of Artificial Sequence: Synthetic coding sequence
atggcacactcagaagaggcggccttactcccaggcaatcatgttcctaatggctgcgcagccgaccctaaagcatccagggaattaccacctcctcctcctcccccaccccccccattacccgaggcggctagtagtcctcccccagctccgccactgcccctggaatcggctggccccgggtgtggacaaaggcgatcctcatcttctacagggtcaactaagagtttcaacatgatgtctcctaccggcgataattctgagctcctcgcggagataaaagcagggaaatccctgaagcccaccccccagagcaaaggattaactacagtattttctggcatagggcagccagcgttccagcccgattctcctctcccatcggtcagtcctgctttatcacctgtgaggtctcctaccccccctgctgctggatttcagcctttgctgaatggatccctggtgccggtaccccccaccaccccagcccccggagtccaattagacgtggaagcgctcattcccacgcacgacgaacagggaagacccatcccggaatggaaaagacaggtaatggtccgcaagatgcagttaaagatgcaggaggaggaggaacaaaggagaaaagaagaggaggaagaagcaaggcttgcgagcatgccagcttggcgccgggacctactgcggaagaagttggaggaggagcgggagcagaaacggaaagaagaagagagacaaaagcaagaggagctgcgacgcgaaaaagagcaatctgagaagctgcggacacttgggtacgacgagagtaagttggcgccttggcagagacaggttattctgaaaaagggggacatcgctaaatattag

SEQ ID NO: 116069 - DNA, 645 bp, Artificial Sequence
  Description of Artificial Sequence: Synthetic coding sequence
gacgggatgactccattgcatgccgccgcacaaatgggtcactcccccgtgatcgtctggttggataaagacggggcaacagccatgcacttcgctgcgagccgaggccacaccaaggtactctcttggttactactgcatgggggcgaaattagcgccgacctttgggggggcacacctctgcacgacgctgccgagaatggcgagctggagtgctgccaaatcctggtggttaacggggctgagttggatgtgcgggatcgagacgggtataccgccgccgatttgagcgacttcaatggacatagccactgcacgaggtatttgagaaccgtagagaatctgagtgtggagcaccgggtcctgtccagagatccgtccgctgaactggaagctaaacagccggactctggcatgtcctctccaaatactaccgtgagcgtccagccccttaatttcgacctgtcatctcccaccagtaccctctctaattacgattcatgttccagctctcactcctccatcaagggccagcaccctccatgcggactgagcagtgcacgtgcagccgacatccagtcttatatggatatgttaaaccccgaactgggcctgccccggggtacgataggaaaacccacatag

SEQ ID NO: 116070 - DNA, 567 bp, Artificial Sequence
  Description of Artificial Sequence: Synthetic coding sequence
tgagaaataaaagctggcaagtcgctgaaaccaaccccccagagcaaggggttgactactgtgttttctggaatcgggcagcctgccttccagcctgattccccgttaccctccgtttcaccagccctgagccccgtcaggtcccctacaccacccgcagctggttttcagcctttgttgaatggttccctggtaccagtgccccccacaacccccgctcctggtgtccagctggacgtcgaggctctcattccaacccacgatgagcaaggacgccctatacctgagtggaagcgccaagtgatggtgcgcaaaatgcagctgaagatgcaagaggaggaggaacagcggcgcaaggaggaggaagaggaggccagactcgcctcaatgcctgcttggagacgagacctcctgagaaagaaactggaggaggaaagggagcaaaagcggaaagaagaggagaggcagaaacaggaggaactgcggcgggagaaggaacagagcgagaaactcagaaccctcggctacgatgagagtaagcttgccccatggcagcgacagatttag

SEQ ID NO: 116071 - DNA, 1335 bp, Artificial Sequence
  Description of Artificial Sequence: Synthetic coding sequence
atggctcgagtcggtcccggccgagcaggcgtcagttgccagggaagaggccgtggtcgtggtggctctggacagagaagaccacctacgtgggaaatttcagattccgacgcagaggattccgctggcagtgaggccgccgcccgggcccgggatccggcaggcgaacggagagcagctgcagaggctctgcgcctcctgcggcctgagcaggtcttgaagcggttggccgtgtgtgtggatacggctattctggaggatgcaggggccgatgtgcttatggaagccctggaggctctggggtgcgagtgtcgtatcgaacctcaaaggccagccaggagtctgcggtggaccagggctagtccagacccttgcccgcggtccctgccccccgaggtttgggcagccggagaacaggaactactgctccttttagagcccgaagaattcctccagggagtggccactctgacacagatcagtgggcctactcactgggttccttggatcagtccagaaacaactgccagacctcacctcgcagtgatcggactggatgcttatctgtggtatcggtccttgtcatgtcctcagcaaggatggctcggccggggttttcgcgggggaggcctgtggcagcgacctagctccgggagggccgggcccatggggtccggagaagagtggtctcccctcttacggtcacgtcagcacgtgagcagaggcacccagcaacctgagtcccctaaggtggccggcgcggaggttgcggtgtcatggcccgaagttgaggaggtgagggcttgcctgagctgggctctggtgctgttgcagctgtgggccaacttagatgtgctgctggtggcctcctggcaggaactttcccgccatgtttgcgctgtaacaaaagcgctcgcccagtatcctctcaagtgtgtgatgccaaggctgaaggggggacgcattactagtcgacagtatagagagagccaggcatttagtttctgcactgctgggagatgggccgccggagagcccgttgccagagatggtgctgggttacaggccgcatggaggagacagatacgccagttttccagggtctcacccgcagtcgccgacgctgtggtcactgcctttccctcaccaaggctcctgcagcaggccctagaggcttgctcgactgagcgcgagcggatgggcctgttggctgacctgcctgttcccccaagcgagggggggcggcctagaagggtcggtccagacctatctcgccgaatttgccttttcctgaccaccgctaatcccgatctgttgctcgatctaggctcctag

SEQ ID NO: 116072 - DNA, 1161 bp, Artificial Sequence
  Description of Artificial Sequence: Synthetic coding sequence
atggctagggttggcccaggcagggcaggcgtttcttgtcaggggcgaggaagaggtaggggtgggagtggacagagacgcccgccgacctgggaaatctcagacagcgacgctgaggattccgcggggagcgaagctgccgcccgggcccgggatccggccggagagcgaagagcagccgccgaagcactgagactgctgcgcccagagcaggttctgaagcggctcgcagtgtgcgtggacaccgccattcttgaggatgctggtgctgatgtgctgatggaggcactcgaggccctaggttgcgagtgccgaatcgagcctcagcgtccagctcgctctctcaggtggacccgcgctagccctgacccatgtccccggtccctgccccctgaggtctgggccgctggcgagcaagaattactcctgctcttagagccagaggagttccttcagggagtcgcgaccctgacacaaatctctggaccgactcactgggtgccatggatctcaccagagactaccgccagaccccacctcgccgtgattgggctggacgcttacctctggagtcgccagcatgtgagcagaggcactcaacagcctgagtcacctaaggtagctggcgcagaggtggcagtcagctggccggaagtcgaggaggtcagggcctgcctctcttgggcgctggtgctcctccagctctgggctaatttagatgtcctgttggtggcttcctggcaggagctgtcccggcacgtgtgtgccgtgaccaaggccctagcacaatatccactgaagtgtgtgatgccaaggttgaagggtggtagaattacttcccgtcagtacagggaaagccaggccttcagtttctgcacggctggccgatgggccgcaggtgagccagttgcccgcgacggagcaggtcttcaggcagcgtggagacgacagatccggcagttctcaagggtgagccctgcggtggctgatgcagtggtgactgctttcccttccccaaggctgctgcagcaggccctggaagcctgtagcacagagcgcgaaaggatgggactgctcgctgttggccctgacttgtctcgtagaatttgcttgtttctgaccaccgctaacccagaccttttgctcgatctgggatcctag

SEQ ID NO: 116073 - DNA, 2523 bp, Artificial Sequence
  Description of Artificial Sequence: Synthetic coding sequence
atgatgagcattcaggaaaagagcaaggaaaatagttctaaggtgacgaagaaaagcgatgataaaaattctgagactgagatccaagacagccagaaaaacttggccaaaaaatcaggtccaaaagaaactataaaatcccaggcgaagtcgtctagtgagagtaagataaatcagccagagctcgaaaccaggatgagtacaaggtctagtaaagccgctagtaacgataaggctacaaagtctatcaacaagaatacagttacagtccgcggatattcccaagaatcaaccaaaaagaaactgtcccaaaaaaaactagtgcacgaaaatccaaaggccaatgaacaactgaatcgcaggtcacaacgcctgcagcagctgaccgaggtgagcaggagatcactgcgcagtcgagagatccagggacaggtgcaggccgttaagcagagcctcccgcctaccaagaaggagcagtgcagctcgacgcaatccaaatccaacaaaacgtcccaaaagcacgtaaagcgaaaggtgttggaggttaaatctgacagcaaggaagatgaaaatttagtgattaatgaagttatcaactcccccaagggtaagaaaagaaaagtagagcaccagaccgcctgcgcatgtagtagccagtgtactcaagggtccgagaagtgtccacaaaaaaccacacgcagagatgagacaaagccggtgcccgtaacttctgaggtgaaaaggtcaaagatggcaacgagtgtggtaccgaagaagaacgagatgaagaagtccgttcatacccaggtcaacacaaatacaaccctccccaaaagcccccagcctagtgttcccgagcaatctgacaacgagctggaacaagcaggtaaatcaaagaggggcagcatcctgcagctctgcgaggagatcgcaggggaaattgagagcgacaatgtcgaggtcaagaaggagtcttctcagatggagtctgtgaaggaggagaagcctaccgagatcaagctcgaggaaacctcggtagagcgccagatcctccaccagaaagagactaatcaggatgtccaatgcaatcgctttttcccctcccgaaagaccaagcctgtgaaatgtatcctcaacggaatcaattcttccgcaaagaaaaactcgaattggacaaagataaagttatccaaatttaatagcgtacagcacaacaagcttgactctcaggtgagtccaaagcttggtctgctgagaacctcattctcccctcccgccttagagatgcatcaccctgtgacacagagtacttttttagggacaaagctccatgatcgtaacattacatgccaacaggaaaaaatgaaggagatcaattccgaggaggtgaaaatcaatgatattaccgttgagattaacaaaacgacagagcgcgcccccgagaattgccacttggcaaacgagattaagccatctgatccgcctttggacaaccagatgaagcactcatttgacagcgcctccaataagaatttttcccagtgcttggaatctaagctcgaaaattcccctgtcgaaaatgtgactgcagctagcactttgttgtctcaggcgaaaatcgacacgggcgagaataagttccctggatctgccccccagcaacactcaattctgagtaatcagacttcaaaatcatctgataatcgggagacaccaaggaatcactcactccccaaatgcaacagtcatctggagattacaatccccaaggatttgaaactgaaagaggcggagaaaacagacgagaaacagctcattattgatgcgggccagaaacgatttggcgctgtaagttgcaacgtttgcggtatgctgtatacagcctccaatcctgaagacgagacccaacatttgctgttccataaccagttcatctccgctgtcaagtatgtcggctggaagaaagagagaattttggcggagtaccctgacgggagaatcatcatggtcttgccggaggaccccaagtatgcccttaagaaggtggatgagatccgggaaatggtggacaatgatctgggctttcaacaggcacctctgatgtgttactctaggacaaagactttgctgtttatctcgaatgacaaaaaggtcgtagggtgcttgattgccgagcatatccagtgggggtacagagtcatcgaggagaaacttccagtgatccgatccgaagaagagaaggtgaggttcgaaaggcaaaaggcttggtgttgttctactctgccagaacctgcaatctgcggtattagtagaatctgggtattttcaatgatgagaagaaaaaagatagcctcccgcatgattgagtgtctgaggagtaacttcatctacggtagctaccttagcaaagaggaaatcgccttctcagacccaactccagacggaaagttgttcgccacacagtactgtggcacagggcagtttctggtatataattttatcaacggccagaacagtacctag

SEQ ID NO: 116074 - DNA, 2106 bp, Artificial Sequence
  Description of Artificial Sequence: Synthetic coding sequence
atgatgtccatacaagagaaatctaaggaaaactcaagcaaagtgaccaaaaaaagcgacgacaagaactctgagacagagatccaggactctcaaaagaacctggcaaagaagtctgggcctaaagaaactattaagtctcaagctaaaagtagttccgaatccaagataaaccaacctgagttggagacgcgaatgagtacacggtcaagcaaagctgcgagcaacgacaaggccactaagtccatcaataagaataccgtcacagtgaggggttattctcaggagagtaccaaaaagaaactgtctcaaaagaaactcgtgcacgagaatccaaaagcgaatgagcagctgaacaggcgcagccagaggttacagcaactgacagaggttagccgccgaagcctgcggagtcgtgaaattcaaggccaggtccaagctgtcaaacagtcgctacctcccactaagaaagaacagtgtagtagcacccagtccaaaagcaacaagacatctcagaaacatgtgaagcgcaaggtcctcgaagtgaagtcagattcaaaggaagacgagaatctagtcatcaacgaggtcataaactcccctaagggcaagaaacggaaagtggagcatcagaccgcatgtgcgtgttctagtcaatgcacccagggatctgaaaagtgcccgcagaaaacaacacggcgggacgaaactaaaccagttccagtgacatccgaggtgaagagaagcaagatggccacctctgtggtgccaaagaaaaacgagatgaagaagagtgtgcatacccaagtcaatacaaacaccacgttaccaaaatctccacagccgagtgtgcctgaacagtcagacaatgaattggagcaggcagggaagtcgaaaagaggatctatccttcagttatgcgaggagattgcaggagaaattgaatctgacaacgtggaggtgaaaaaggaaagcagtcagatggaatctgtgaaggaggagaagccaaccgagatcaaattagaggaaacatctgtggaaaggcagatcctacaccagaaggagaccaatcaggatgtccagtgtaaccggttcttccccagccggaagactaagcccgtgaaatgcatcctgaatggaatcaattcttccgccaaaaaaaacagcaattggaccaagattaaactgtcaaagttcaattcagttcaacataacaagctggactcccaggtgagcccgaaactaggcttgctgagaacgtctttttcaccgcctgccttggaaatgcaccacccagtgacccaatccactttcctgggaaccaaattgcacgatagaaatatcacctgtcagcaggaaaaaatgaaggaaatcaatagcgaggaggtcaagatcaacgacatcacagtcgagatcaataaaactaccgaaagagccccggagaactgtcacttggctaacgagatcaagccttcagatccgccacttgataatcaaatgaaacacagctttgactccgcgtccaacaaaaatttttcccagtgtcttgagagcaagttagagaactcaccagtggaaaatgttaccgccgcctccacattactgagtcaggccaagattgataccggtgagaacaagttccccggctcggctcctcaacagcacagcatactgagtaaccagacatcaaaaagctccgacaatcgcgagacacctcgtaatcactccttgcctaagtgcaactcacacctggagatcaccattccaaaggacctaaagctgaaggaagctgaaaaaaccgatgaaaagcaattgatcatcgatgccggccagaagaggttcggcgccgtatcctgcaatgtatgtgggatgctgtataccgcctctaatcctgaagatgaaacccagcacctactttttcacaaccaatttattagcgcagtgaaatatgtggtcctgctgattaatcaccatgaatgtgggagtgaggaggagtttattacaagtctgtttctgagcatgttcaattttaggtatacccagcggtctttttccttcccaattaggtttcttgaaggtctggaagagcggaagaattctggctag

SEQ ID NO: 116075 - DNA, 1806 bp, Artificial Sequence
  Description of Artificial Sequence: Synthetic coding sequence
atggctgccctgacaccacggaagcggaaacaagattctctcaaatgtgatagtctcctccacttcacggagaacctatttcccagccctaacaaaaagcattgtttttaccagaactcggataagaatgaagaaaacttgcattgttcacagcaagaacactttgtcctaagcgcacttaaaacaaccgagataaaccgtttgccctccgcaaaccagggttcccctttcaaatcggcactaagtactgtgagcttttacaaccagaacaaatggtacctgaatccccttgaacgtaaattaatcaaggagtcacggagcacctgtttgaaaaccaacgacgaggataagtcattcccaatcgttactgaaaaaatgcagggaaagccggtgtgttccaagaaaaacaacaagaagcctcagaagtctttaacagcaaagtatcagcccaagtatcggcacattaagccagtgagccggaattcccgaaatagcaagcagaaccgagttatctataagccaatcgtcgagaaagagaataactgtcacagcgccgaaaacaactcaaacgctcccagagtgctctcgcaaaagattaagccccaggttaccttgcagggaggggctgctttctttgttcgcaagaaaagctctctccgaaaaagttccctcgaaaacgagccttccctgggaaggacccagaaaagcaagtccgaggtcattgaagattctgatgtcgagacagtgagcgaaaaaaaaacttttgcaaccaggcaggtacccaaatgccttgtgttggaggaaaaactcaaaataggcctgctctcagcttcatcgaaaaacaaagaaaagctcataaaagactctagcgacgaccgggtgagttcaaaggaacacaaagtggataaaaatgaagccttctcgtcagaggatagcctaggggagaataaaacaatcagcccaaaatccaccgtgtaccctatcttctctgcctcgtcagtgaactctaagcgtagtcttggagaggagcagttctctgtgggctccgttaatttcatgaagcagaccaatatccaaaaaaatacaaatacgcgggatacttccaaaaaaacaaaggatcagctcataattgatgccgggcagaaacattttggggccaccgtatgtaagagctgtggcatgatctacacagcaagcaacccagaggacgagatgcagcatgttcagcatcaccaccgctttttggaggggattaagtacgtcggctggaagaaggagagggttgttgcagaattttgggacggcaaaatcgtgctggtgttgccgcatgacccctcttttgccattaagaaagtggaggacgtgcaggaactcgtggacaacgagctgggcttccaacaagtggtgccaaagtgcccaaacaaaatcaaaacgttcctgttcatcagcgatgagaaacgggtcgtcggatgcttaatcgctgagcctattaaacaggcattccgtgtcctgtcagagcccataggtcctgaatccccctcttccactgagtgtcctcgggcctggcagtgttcagacgtaccagaacctgcagtttgcggcatctctagaatttgggtgtttcgactgaaaaggaggaaacgcatcgcgcggagactcgtggacaccctgcgaaactgtttcatgttcggatgttttctctccacagatgagatcgcgttcagtgacccgacgcctgatggaaaactgttcgccaccaaatactgcaatacccccaattttctggtgtacaattttaattcctag

SEQ ID NO: 116076 - DNA, 720 bp, Artificial Sequence
  Description of Artificial Sequence: Synthetic coding sequence
atgaagcagacaaacatacaaaagaacacaaatactagagatacctccaagaagactaaagatcagctaatcatcgatgctggacagaaacacttcggagctacagtgtgtaagagctgcggaatgatatacacagcctctaacccggaagatgaaatgcagcacgtacagcaccaccaccgattcctcgaaggcattaagtacgtggggtggaagaaggagagagtggtggcagaattctgggacggcaaaatcgttctggtgcttcctcacgacccttctttcgctattaagaaggtagaagacgtgcaggaacttgtcgataacgaattgggtttccagcaggtggtccccaaatgcccaaataagatcaagactttcttgttcattagcgatgaaaagcgcgtggttggatgcctcatagcagagccgattaaacaggccttcagagtcttgtctgagcccatcggtcccgaaagcccctcatcaactgagtgtccacgagcttggcagtgcagcgatgtccctgaacccgcggtttgtggaataagtaggatatgggtgtttcgactgaagagacgcaagcggattgctagaaggctggtcgataccctcagaaattgttttatgtttggctgcttcttgagtacggatgagatcgcgtttagtgatcccacgcccgatgattgtagacgcttgaatagatatcaggagacgtag

SEQ ID NO: 116077 - DNA, 849 bp, Artificial Sequence
  Description of Artificial Sequence: Synthetic coding sequence
atggcactgaaacagatctcatcaaataagtgctttggcggcctgcagaaagtctttgagcacgacagcgtggagctgaactgcaagatgaagttcgctgtgtaccttcctcccaaggccgaaactggtaaatgccccgccttgtactggctgtctgggcttacctgtactgagcaaaactttatctcaaaatctggataccaccagagtgccagtgaacacggcctcgtcgttattgcaccggacacatccccacgtgggtgcaacattaaaggggaggacgaaagctgggatttcggaacgggagcaggattctacgtggatgccaccgaggacccttggaaaacaaattataggatgtatagctacgtgaccgaggagcttccacagttaattaatgcaaacttcccggtagatccacaacgcatgtctatatttggacacagcatgggggggcacggggctctcatctgtgccctgaagaatcccggtaaatacaaaagcgtttcagccttcgctcccatatgtaatcccgtgttgtgcccatggggtaaaaaggccttcagtggatacttgggtaccgaccagagtaagtggaaagcgtacgacgccactcatctcgtgaagtcataccctgggagtcaattggacatccttatcgatcaaggaaaggatgaccagtttctattggacggacagctgctgcctgacaatttcatcgccgcgtgtaccgaaaagaagatcccagtggtcttccggctacaggagggatatgaccactcttattactttatagccactttcattaccgatcacattagacaccacgctaagtacctgaacgcttag

SEQ ID NO: 116078 - DNA, 642 bp, Artificial Sequence
  Description of Artificial Sequence: Synthetic coding sequence
atggccattactcagttcagacttttcaagttctgtacatgcttagccactgtctttagctttctcaaacgcctgatttgccgttctggccgggggcggaagttgtccggagaccagattaccctacccaccaccgtcgactactcctcagtgccgaagcaaacggatgttgaggaatggacctcatgggacgaagatgcaccaacttctgtgaaaattgaaggcgggaatgggaatgtagccacacaacagaactcgttggagcagcttgagcccgattattttaaggatatgaccccaacaatcagaaagacgcagaaaatcgtgattaagaaacgggagcctttgaatttcggtattcccgacgggtccaccggattctctagtcgccttgctgccacacaagacctgccattcatacaccagtccagcgagctcggagacttagacacctggcaggaaaacactaacgcgtgggaggaagaggaagacgcagcctggcaggctgaggaagtcctgcgtcagcagaagcttgctgatcgcgaaaagagggcagccgagcagcagagaaagaagatggaaaaggaagcacagagacttatgaaaaaggagcagaacaaaatcggggtcaagctctcatag

SEQ ID NO: 116079 - DNA, 642 bp, Artificial Sequence
  Description of Artificial Sequence: Synthetic coding sequence
atggctattacacaatttcgtctgttcaagttctgcacatgcctcgctactgtgttcagtttcctgaaacggctcatttgccggagcggcaggggacgcaaactgagtggtgaccagatcaccctgcccacaacagtggactacagcagcgtgcctaaacagacagacgttgaggaatggacgagttgggacgaagacgctccaacatccgtaaagatcgaaggcggcaacggaaatgtagccactcagcagaatagtctggaacagctggaacccgactatttcaaggacatgacccccactattagaaagacacagaaaattgtcataaagaagcgggaacctctgaattttgggataccggacggatctaccggcttctccagccgactggctgccactcaagacctcccgttcattcatcagagttccgaactcggcgatttggacacctggcaggagaacacaaatgcctgggaagaagaggaggatgccgcctggcaagctgaagaggtgctcaggcagcagaaattggccgacagagagaaaagggcggcggagcagcaaaggaaaaagatggaaaaagaagcccaacgcctgatgaaaaaagaacaaaataagatcggggtgaaattatcatag

SEQ ID NO: 116080 - DNA, 594 bp, Artificial Sequence
  Description of Artificial Sequence: Synthetic coding sequence
atggccattacccagtttcggttatttaaattctgcacatgcctggcaaccgtgtttagtttcttgaagcggctgatttgcagatcagggcgtggccggaagctctcaggggatcagatcaccctccccactaccgtggattactcttctgttcccaagcaaactgatgtggaagaatggacaagctgggatgaggacgccccaacatcagtgaagatcgagggcggcaatggtaatgtggcaacgcagcaaaattctcttgagcagcttgagcccgactacttcaaggacatgacccctaccatcagaaaaacacaaaaaatcgttatcaaaaagcgggagcctttaaatttcggcattcctgacggtagcaccgggttcagctcaagactggccgcgactcaagatctgcctttcattcatcaaagttcggagctgggagacctggatacttggcaggaaaatactaatgcatgggaagaagaggaggatgctgcctggcaggccgaggaggttctccgtcaacagaaacttgcagaccgcgaaaagcgggctgctgagcaacagaggaaaaagatggagaaggaggcctag

SEQ ID NO: 116081 - DNA, 777 bp, Artificial Sequence
  Description of Artificial Sequence: Synthetic coding sequence
atggctatcactcaattccgcctcttcaaattttgcacctgcctcgccacagtcttctctttcttgaagcggctgatttgccgctctggacggggcaggaagctgagcggcgaccagataacccttcctaccactgtggactattccagcgtccctaagcaaactgacgtcgaagagtggacaagctgggatgaagatgcccccacttccgttaaaattgaaggaggcaacggtaatgtcgcaacgcaacagaacagtctcgagcaacttgaacccgactatttcaaagacatgaccccaactattcgaaaaacccagaaaatcgttatcaagaagagggagcctttgaatttcggcattcctgacggctccactggcttctcctccagattagcggccacccaggacctgccttttatccatcagtcctctgaattgggtgacctggacacttggcaggaaaatacaaatgcctgggaagaagaggaggacgcagcatggcaggccgaggaagttctgcgctcacgcaccaatgtttgtcttctgtgctcactgctattccatcatccaacacctacctcaacaccttacattaatcagagcgtgaaaattgagcgggtgtctcttggtcagtggagctacgggaagtccaaggagcagcagaagcttgccgatagagaaaagcgggctgccgaacagcaacgaaagaagatggaaaaggaggcacagaggcttatgaaaaaggagcagaataagattggcgtgaagctttcctag

SEQ ID NO: 116082 - DNA, 237 bp, Artificial Sequence
  Description of Artificial Sequence: Synthetic coding sequence
atggctatcacccagttccggctgtttaagttttgcacttgtcttgccactgtattctcatttctcaagaggctgatatgcagaagcggtcgagggaggaaattgagcggcgatcagatcaccctgccaaccaccgtcgactactcatcagtgccaaaacagactgatgtcgaagaatggacaagctgggacgaggacgcccccacttccgtgaaaattgaaggggggaatgggtag

SEQ ID NO: 116083 - DNA, 1272 bp, Artificial Sequence
  Description of Artificial Sequence: Synthetic coding sequence
atgtcatctcaggttgtgggcatcgaaccactgtatatcaaggccgaacccgcgagcccagatagccctaaaggatcttccgaaactgagactgaaccacctgtagccttggcccccgggccagctcctactaggtgccttccaggacataaagaggaagaagacggagagggtgccggcccaggggaacagggcggagggaaacttgttttgagtagcctgcctaaaaggctgtgcctggtttgcggcgatgttgcttctggttaccattacggagtggctagctgcgaggcctgcaaagccttctttaagcgcacaatccagggttccatcgaatacagttgtcccgccagtaacgaatgcgaaattacaaagaggcgcaggaaggcatgccaggcatgccgcttcaccaagtgcctgagagtgggcatgcttaaggagggtgtgcggcttgatcgggttcgggggggcagacagaagtacaaaagacgcccggaggtggatccgcttccttttccaggtcccttccctgcgggccctctggcggtcgccgggggacccagaaagactgctgcccccgtcaacgccttagtgagccacctacttgtagtagagcctgaaaagctctatgctatgcctgatccagctggccccgatgggcatctcccagctgtggctaccctttgtgatcttttcgatagagagatcgtcgttacgatttcctgggccaaaagcatcccaggcttcagtagtctctctttatccgaccagatgtccgtcctccagtcagtttggatggaggttctcgttcttggcgttgcacaacgttccctaccactccaggacgaattagcctttgccgaagatttggttcttgacgaagagggggcaagggccgctggactgggtgagctcggagctgctctgctccaactggtaaggcggctccaagctctgagactggaacgagaggaatatgtgttactaaaggcactggccctggcgaactcagattccgtgcacatcgaagatgccgaagccgtagagcagctccgggaagcactgcacgaggccttgctcgagtacgaggcgggaagagccggacctggtggaggggctgagcggaggcgggcgggaagactcttactaacacttccgttacttaggcagacagctggaaaggtactcgctcatttctatggagtgaaactcgagggaaaggtgcctatgcataaactgtttcttgaaatgttagaggctatgatggactag

SEQ ID NO: 116084 - DNA, 1272 bp, Artificial Sequence
  Description of Artificial Sequence: Synthetic coding sequence
atgtcaagccaggtagtcggaatcgagcctctatatatcaaggccgagcccgctagccctgacagcccaaagggttcaagcgagacagagacagaaccgccagtcgccctggctcccggccctgcaccaacacggtgtctgccaggccataaagaggaagaagatggcgagggcgccggtcccggcgaacagggcggtggtaaactcgttctgagttctctgcccaagcggctgtgcctggtgtgcggcgatgtcgcatctggatatcactacggggttgctagttgtgaagcctgcaaagccttcttcaagcgcaccatccaaggctccattgaatattcgtgcccagcctccaatgaatgtgaaataactaagcggagaaggaaggcgtgtcaggcttgccggttcaccaaatgtctgcgggtgggcatgctaaaggagggggtacggctggatagggtacgcgggggtaggcagaaatataaaagaagaccagaggtcgacccactcccctttccgggaccattcccagcgggacccctggcagtggcgggaggcccccgtaagactgccgcgcccgttaatgctctggtctcacacctcttagtggtagaaccagaaaagctttacgcaatgcccgacccagccggtcctgacggacatctgcccgctgtggcgaccttatgtgatctcttcgacagagaaatagtcgtgactatcagctgggccaaatctattcctggctttagtagcttgtcgttatcagatcagatgtcagttctgcaaagcgtctggatggaagtcctggtcctaggggtcgcccagcggagcctgccgctccaggatgagctggctttcgctgaggaccttgtgttggacgaggagggggcaagggccgccgggttgggggaactgggtgcagccttgctgcagctcgtccggcgcctacaagccctacgactcgaacgagaagagtacgtacttctgaaggctctggctctggctaacagcgatagcgtccacattgaagacgccgaagcggtggagcaattaagagaagcattacacgaggccctcctggagtatgaagccggacgcgcaggaccaggcggtggagccgaacgcagacgagcaggacgtctcctcttaacccttcccttgctgaggcagaccgccggaaaggttctcgcgcacttttatggagtgaaactcgagggcaaagtcccgatgcacaagctgtttctcgaaatgcttgaagcaatgatggattag

SEQ ID NO: 116085 - DNA, 1269 bp, Artificial Sequence
  Description of Artificial Sequence: Synthetic coding sequence
atgagttcccaggtggtcggcatcgaacctctatacataaaagctgagccggcttcacccgacagtccaaaaggctcttctgagactgaaaccgagccgcccgtggctctcgctccagggccagccccaacacgatgcttaccaggccataaggaggaggaggatggcgagggtgccggcccaggtgaacagggcggcggcaagctggtcttgtcatctctgcctaagaggctgtgcctggtttgtggggacgtggcatccggatatcactatggtgttgcttcttgcgaagcctgcaaggccttcttcaaacgtaccatccagggtagcattgaatactcttgtccagcgtctaacgagtgtgaaattaccaagcgccgaagaaaagcttgccaggcttgcagattcaccaagtgtttgcgagtgggtatgttaaaagaaggtgtcagactggatcgcgtgagaggggggcgccagaaatacaagagacgtcctgaggtggatcctctgccgtttcctgggcctttcccggccggcccactggcagtggctgggggcccgagaaagactgcaccggttaacgccctggtgtcccatttgcttgtggtggagcccgagaaattgtatgccatgcccgatcctgctggaccagatggccatctgcccgctgttgcaactctgtgcgacctctttgatcgagaaatagtggtcacaatctcttgggctaagtcaatcccaggattttctagcttatcgttgtcagaccagatgtccgtcctgcaaagtgtgtggatggaagttttggtgttgggggtggcccagaggtctttaccactccaagatgaactcgcctttgccgaagatctggtgttagacgaagaaggagcccgggcggccgggctgggcgaactcggagccgccctgttgcagttggtgcggcgattacaggctctccgcctggaacgcgaggaatacgttctcctcaaggctctcgcattagccaacagcgattcggtgcacattgaggatgccgaagcagtagagcagctgagggaagcattacacgaggcacttctcgaatacgaggccggacgggccggacccgggggaggtgccgaacgcagacgcgccgggcgtttactcctgaccctgccgttactcaggcagacagccggaaaggttctggcccatttctatggcgtcaagctggaggggaaggtgcctatgcacaagctcttcttagagatgctcgaggctatgatggattag

SEQ ID NO: 116086 - DNA, 330 bp, Artificial Sequence
  Description of Artificial Sequence: Synthetic coding sequence
atgtccagccaagtggtcggaatagaacccctctacataaaggctgagccggcctccccggactcgccgaaaggtagttccgaaactgaaactgagccaccggtggctctggcccccggacccgcaccaacacgctgtttgcctggtcacaaggaagaagaggacggagaaggggcaggccccggcgaacagggaggcgggaagctagtgctaagcagcttgcccaagcgcctatgtctggtttgtggcgacgtggcaagcggataccactacggagttgccagctgcgaggcatgtaaagcattcttcaagcggaccatacaaggctag

SEQ ID NO: 116087 - DNA, 1503 bp, Artificial Sequence
  Description of Artificial Sequence: Synthetic coding sequence
atgtccagcgatgacagacacctgggctccagctgtggaagcttcatcaaaacagagccatcaagtccatccagtgggattgacgccctgagtcaccactcaccaagcggttcgagcgacgccagtggaggttttggattagccctgggcacccatgccaacggcctggacagcccacctatgtttgccggagccggcctgggcgggactccttgtcgaaaatcctacgaggactgtgccagcgggataatggaagacagcgctattaagtgcgagtatatgctgaacgcaatacccaaacgcctttgtcttgtgtgcggggacatcgcctccggatatcattacggcgtcgcctcttgtgaggcttgcaaagccttttttaagagaaccatccagggaaacatcgaatactcttgcccagcaactaacgagtgcgaaatcaccaaacgccgacgtaaaagctgccaggcctgtcgctttatgaagtgccttaaggttgggatgcttaaggaaggcgtaaggctcgatagagttcgcggggggcggcagaaatataagcggcggctcgattccgagtcttctccatatttgtcgttacagatctctccacctgccaagaaacccctcactaagatagtgtcttacctgctggtagctgaacccgacaagctgtacgctatgccccctccagggatgcctgagggtgatatcaaagctctgactactctttgtgaccttgccgatagagagcttgtcgtgatcattggctgggccaaacacattcccggcttttccagccttagtctgggcgatcagatgagcctactccagtctgcctggatggagatcctgattctcggaatcgtctatcggtccctgccctatgatgacaaactggtctatgcagaggactatatcatggatgaagagcacagccgtctggccggactcctagagctctatcgagcaatcctgcagcttgtgcgaagatataaaaagctgaaggtcgaaaaggaagagttcgtcaccctgaaagccctggcactcgcaaacagtgactccatgtatattgaagatcttgaggctgttcagaagctgcaagatttgctgcatgaggcgctccaggactacgaattatcccagaggcacgaagaaccctggaggacgggaaaattactgctcacgctcccgctcctccgacagaccgcggctaaggccgttcaacatttctatagcgtaaagctacaggggaaagtcccaatgcacaagctgtttctcgagatgctggaagctaaggcgtgggcccgcgccgactctctccaggaatggaggccactggaacaagtcccatctcctctgcacagggccacaaaacgccaacacgtacattttttgacccccttaccaccccctccctcagttgcatgggtggggactgcacaggccgggtatcatctggaagtgttcctgccgcagcgagccggatggcctcgagccgcctag

SEQ ID NO: 116088 - DNA, 1527 bp, Artificial Sequence
  Description of Artificial Sequence: Synthetic coding sequence
atgtctagtgatgacaggcatctgggcagttcctgcggaagtttcattaagactgaaccttcatcaccttccagcggcatagatgccctttcacaccacagtccgagcgggagcagtgacgccagtgggggatttgggctcgctctgggaacacacgcaaacgggctggatagtcccccgatgttcgcaggggctggacttggcggaacaccctgcaggaagtcatatgaagattgcgcatctgggattatggaagattctgctatcaaatgcgagtacatgctgaatgctatccccaaaagactgtgtctggtgtgcggggatatagcaagcggataccattatggcgtggcatcttgcgaagcctgtaaggcgttttttaagcgcacaattcagggaaatattgaatatagttgccccgcgaccaatgaatgcgagattaccaaaaggcgcagaaaatcttgccaggcatgtcgtttcatgaaatgtctgaaagtgggaatgttgaaagagggagtgcgactggatcgagtgagaggggggagacagaagtataagcgccgacttgactcagagtcatccccatatctttcactgcagatctcaccccccgctaagaaacccctgaccaaaatcgtcagttacctcctagtcgctgagccagataaactatatgccatgcccccccccggaatgcctgaaggagatattaaagccctcacaaccctttgtgaccttgccgaccgcgaattagtggtgattatcggatgggctaagcatatccctggtttctcgagcctctccctgggagatcagatgtccctcttgcagtccgcttggatggaaatcctcatattaggcatcgtttatcgaagtctcccatacgacgataaattggtatatgcggaagactatattatggacgaggagcactctagattggccggattactggagctgtacagggcgatcttgcagttagtgagaagatataaaaagctgaaggttgaaaaagaggagtttgtaacactcaaggccctggctctggccaacagtgacagcatgtacattgaagatttggaggcagtgcagaaactccaggacctactgcacgaggccttgcaagattatgagttgtctcagcgacacgaggagccttggcgcaccggcaaactgctgctcacactgcccctcttacggcagaccgccgcaaaagccgtgcagcacttctattcagtgaagttgcagggtaaagtgccaatgcacaagctatttctggagatgctggaggcaaaagtggggcaggagcaactgcggggtagtccaaaggatgagaggatgagctcacatgacgggaagtgcccatttcagagcgctgcttttacctcccgtgaccagagtaacagcccgggaatcccaaatccgaggccctcaagtccgacaccactaaacgagcgagggaggcagatttcacctagtactaggaccccaggaggccaaggcaagcacctgtggctgacaatgtag

SEQ ID NO: 116089 - DNA, 1503 bp, Artificial Sequence
  Description of Artificial Sequence: Synthetic coding sequence
atgtcttctgatgaccggcatctaggctcatcctgcggatcttttattaagacagagccctcttctccctcttccgggatcgatgccctgagtcaccactctccctccggaagttccgatgcttccggcggattcgggttggcgcttggaactcatgctaatggcctggacagcccgcccatgttcgccggagccgggttgggaggaaccccgtgcagaaagtcatatgaggattgcgcctccgggattatggaggattctgccattaaatgtgagtatatgctgaacgctatcccaaaaaggctgtgtcttgtgtgtggggacatagcatcgggttaccattatggtgtagcgtcgtgcgaagcatgcaaagccttctttaagcggaccatccaagggaacatagaatactcctgcccggctacaaatgaatgcgaaataacaaagaggaggcgtaagtcctgccaagcgtgtaggtttatgaagtgtcttaaagtgggaatgctgaaagaaggcgtgcggcttgacagagtgagagggggccgtcaaaagtataagaggcgccttgattctgagagcagtccgtacctgagtctgcagatcagcccgccagccaagaaacccctcactaagattgtctcctacttgcttgtggcagagcctgataaactgtacgctatgcctcctcctggaatgcctgaaggagatattaaagcactgacaactctgtgtgacttggcggatcgcgaactggtggtgattatcggctgggctaaacacatccccggcttctcttcattgtctctgggcgaccagatgtccctgctgcagtctgcttggatggagatcctaattctcgggatagtgtatcgctccttgccctacgacgataagctggtgtacgccgaggactacatcatggacgaagagcattcacgactggcgggtcttctagagttgtaccgggctatactgcagttagtgcgtaggtacaagaagctaaaggtcgagaaggaagagtttgtgacactgaaagcgctcgccctcgccaatagcgatagtatgtatatcgaagatctggaggccgtccaaaaattgcaagatcttttacacgaagcgctgcaagattatgagctcagccaaaggcacgaggagccttggcggaccggaaagctcctgctgactctgcctttactacgacaaaccgcggccaaagctgtgcagcatttttattcggtcaagcttcaggggaaagttcccatgcacaaactgttcctcgagatgttggaggcgaaggcatgggcgcgggccgattccctgcaggagtggcgaccacttgagcaagttccctcacctctccacagagctaccaaaagacagcacgtccactttctgactccactgcccccccctcctagcgtcgcctgggtgggcacggcccaggcaggataccatctggaagtcttcctgcctcagagggccggctggccaagggctgcatag

SEQ ID NO: 116090 - DNA, 1527 bp, Artificial Sequence
  Description of Artificial Sequence: Synthetic coding sequence
atgtcctccgatgataggcacttgggcagctcctgcggcagctttataaagacagagccctctagcccgtcttctggcatagacgccttgtcacatcactctccaagcggctccagcgatgcatccggaggatttggtctggccctgggtactcacgccaacgggcttgactccccgcctatgttcgctggtgccggattggggggaacaccttgcaggaagtcatatgaggattgcgcgtctggcattatggaagactccgccataaaatgcgagtacatgctcaatgcaatcccgaagcgtctctgcttagtctgcggtgacattgcctccggataccactacggtgtggcatcctgcgaggcttgtaaggctttcttcaagcgcacgattcagggcaacatagaatactcctgtcctgctaccaacgagtgcgagattacaaaaagacgccggaagagttgccaagcctgtcggttcatgaaatgcctaaaagtgggtatgctaaaggaaggcgttcgattagatcgtgtccgcgggggacgccagaaatataagcgaagactggactctgaaagctcaccctatctttccctccagatatcaccgcccgcaaagaaaccactcactaaaattgtttcataccttttggtggcggagccggataaactctatgccatgcctcctcctggtatgcccgaaggcgacatcaaggccctcacaaccttatgcgaccttgcggatcgtgagctagtggtaattatcggttgggccaaacacataccagggttttccagcttgagcctgggagatcagatgagcttacttcagtctgcatggatggagattttaatcctaggcatcgtctaccggagcctaccatatgatgataagctggtttacgcagaggactacataatggatgaagaacacagtcggttagctggcctgctggagctctacagagccatactgcagctggttcgccgctacaaaaaactgaaagtcgagaaggaggagttcgtgaccctcaaagcactggctttggcaaattcagactcgatgtatattgaggatctggaagccgtgcagaagctgcaggacttactgcatgaggctttgcaggattatgagttgtcacagcggcatgaggaaccctggcggactggcaagctcctcctcacacttcccctgctgcgccagacagcagccaaggcagtccaacatttctactctgtaaagcttcaggggaaggttccaatgcataagctgttcttggaaatgttagaggcaaaggtggggcaggaacagcttagaggctcccccaaggatgagcgcatgtcaagtcatgatggcaaatgcccatttcagagcgccgcattcacgagccgcgaccagagtaactctcccggcataccaaaccccaggccctcctctccaaccccactgaacgagcgtggacggcagatttctccctctacccgcacgccgggcggacagggaaaacacctgtggcttacaatgtag

SEQ ID NO: 116091 - DNA, 1527 bp, Artificial Sequence
  Description of Artificial Sequence: Synthetic coding sequence
atgctcctcaacaggatgagttcagacgacagacacctgggcagtagttgtggatcgtttattaagaccgaaccaagctcaccttcatccggcattgatgctctgagtcaccattctccgtctggtagctctgacgcttctggcggttttggacttgcattgggaacccacgccaacggcctggacagcccacccatgtttgctggcgccggcctggggggcaccccttgccggaagagttacgaggactgtgcctcgggtataatggaggactccgcgatcaagtgcgaatacatgctcaacgcaatcccaaagaggctgtgcttggtgtgcggcgatatcgcctccggttaccactacggcgtagcttcttgtgaagcctgcaaggcttttttcaagagaaccattcagggtaacatcgagtactcttgcccggctaccaacgagtgcgagataaccaagcggcggcgaaagagttgtcaagcctgccggttcatgaagtgtttgaaagttgggatgctaaaggagggggttcgactggaccgggttcgaggagggaggcagaagtataaaaggagactcgatagcgaatcttctccctatttgagtttgcagattagtcctcccgctaagaagcccttaaccaagatcgtctcgtacctcctggtcgccgagcccgataagctgtacgctatgccccctcctggtatgcctgaaggggatattaaggcattaacaactctgtgcgacttagcggatagggagctcgtggtgattattgggtgggctaagcatattccaggattctccagcttgtccctgggagatcaaatgagcctgcttcagagcgcttggatggagatcctcatcctcggaattgtctataggagtttgccttacgatgacaagcttgtgtatgccgaggactacatcatggatgaagaacactccaggctggcagggttactggagttatatcgtgctattcttcaactcgtgcgcagatataagaagttaaaggttgaaaaggaggaattcgtcaccctaaaggcgctagcgctcgcaaacagcgattcaatgtacatagaggatttggaggccgtgcagaagctccaagacctgcttcacgaggctctccaagattatgagctttcgcagaggcacgaagagccctggcggactggcaaactgctacttaccctgccgttgctaaggcagaccgctgcaaaggcagtgcaacatttctactctgttaagctccaaggtaaagtaccaatgcacaagctcttcctcgagatgctggaagcaaaggtcggacaagaacagcttagaggttcaccaaaggatgagagaatgtctagccatgatggaaagtgcccctttcagagtgccgcttttacctctcgggatcaaagtaactcgcccggcatccccaatcctagacccagctctccgacccccctgaacgagaggggacgccagatcagcccctccacgcggacacccggaggacagggtaagcactag

SEQ ID NO: 116092 - DNA, 1302 bp, Artificial Sequence
  Description of Artificial Sequence: Synthetic coding sequence
atgagctctgatgatcgacacctcggctcaagttgcggctctttcattaagacagagccttcttctccatcctctggcatagacgcgctctctcatcacagcccatccggatcaagcgacgccagtggcggcttcgggttggcccttggcacccacgctaatgggctggatagccctcctatgtttgcgggggccggactggggggcaccccctgtcgcaagtcgtatgaggactgcgccagcggcattatggaagactcagctataaaatgcgagtacatgctaaatgccatccccaaacgtctatgcctcgtttgcggcgacattgcgagtgggtaccactatggggtcgctagctgtgaggcgtgcaaagctttttttaagcggactatccaggggaatattgagtattcttgcccggccaccaacgagtgcgagattaccaaacgtagaaggaaaagttgtcaggcttgccgctttatgaaatgccttaaggtcggaatgctgaaggaaggggttcgcctggacagggtgcgcggaggacgtcagaagtataagaggcgccttgacagtgagtcgtccccgtaccttagcttgcaaatcagccccccagcgaagaagccccttaccaaaattgtaagctacttgctggtcgcagagccggacaaattgtacgcaatgccgccacccggcatgcccgaaggagatattaaggcgctgacgaccctgtgtgatctcgccgacagagagctcgtggttatcattgggtgggccaaacacatcccaggattctcatccctgagtcttggtgaccagatgagcctcctgcagtcagcctggatggaaatattaattttgggcatcgtctaccgaagcctcccttacgacgacaagctggtgtatgcagaggattacattatggacgaagaacatagtcggttggcgggtctcctagaactgtaccgcgccatcctccaattagttcgaaggtataaaaagcttaaagttgaaaaagaggagtttgttactcttaaggctctggccctagctaattctgactctatgtatattgaagatctagaagccgtccagaagctgcaggatctattgcatgaagctctccaggattacgagctgagtcaacgacacgaagaaccctggcgcactggtaaactcctgcttacattaccattgttaagacaaaccgcggccaaagccgtgcagcacttctattcggtgaaactacaggggaaggtgccaatgcacaaactttttcttgaaatgttagaggccaaggtgtag

SEQ ID NO: 116093 - DNA, 1311 bp, Artificial Sequence
  Description of Artificial Sequence: Synthetic coding sequence
atgagcaacaaagaccgacacatcgacagttcatgctctagctttatcaagaccgagcctagttctcccgcatccctgaccgactcagtcaatcatcatagccctggaggctcttctgacgccagcgggtcctacagctccacaatgaacggacaccagaatggcttggactcacctccactgtaccccagcgccccaatcttaggaggctcaggtcccgtgcggaaattgtacgacgactgttccagcactatcgtggaggatcctcagactaaatgcgaatatatgctcaattccatgccaaagcggttatgtctcgtttgcggcgatatagccagcggttaccattatggcgtcgcctcctgcgaggcctgcaaagcatttttcaagaggaccattcaagggaatatcgaatattcatgcccagccacgaatgaatgcgagatcacgaagagaaggagaaagtcttgccaggcctgtcggttcatgaaatgtctcaaggtgggaatgcttaaggagggtgtgcgcctcgaccgggtcagaggcggtcgccaaaaatacaagaggcgaattgacgcagaaaacagtccctatctgaaccctcagctggtgcagcccgcgaaaaagccctacaacaaaattgtgtcccacctgctcgtcgcagagcccgagaaaatctacgcaatgcccgatcctactgtccccgactcagacatcaaggctctgaccacactatgtgatctggcagatagagagctggtggtcatcattggttgggccaagcacatccctggtttcagtacactaagtctcgctgaccaaatgtccttgcttcagtcagcatggatggaaatcctgatcttaggggtggtgtaccggtcactgtcattcgaggatgagctcgtttacgctgacgactatataatggacgaggaccagagtaagctcgctgggctgcttgatcttaacaatgctatcctccagctcgtgaagaagtataaatctatgaagctcgaaaaggaggagttcgtgactctgaaggccatcgctcttgctaactccgattcgatgcatatagaggacgttgaggcggtccagaagctccaggatgttctgcacgaggcgctgcaagattacgaggctggacaacacatggaggacccaagacgggccggcaagatgctgatgacccttcccctgctgcgacagaccagtactaaggccgttcagcatttttacaatataaagctggaggggaaggtgcccatgcacaaactctttttggaaatgctggaagcaaaggtctgctag

SEQ ID NO: 116094 - DNA, 1308 bp, Artificial Sequence
  Description of Artificial Sequence: Synthetic coding sequence
atgtcaaataaagaccggcacatagatagctcatgcagcagcttcataaagactgagccttcctcacccgccagccttaccgattctgtaaaccaccattctcccggcggctcgtcagatgcatctggcagttatagttctaccatgaacggacatcagaacggactagatagtccacctctgtacccctcggcaccaatcctgggaggcagtgggccagttagaaagctgtacgacgattgcagctctaccatcgtcgaagatccccagactaagtgcgaatacatgctgaactccatgcctaaacggctgtgtctggtttgtggcgacatagcatctgggtatcactatggggtggccagctgcgaagcatgtaaggcctttttcaagcgcacaattcaagggaatattgaatacagttgccctgcaaccaacgagtgcgaaattacaaagcgcagaagaaagagttgccaggcttgccgattcatgaaatgtttgaaagtggggatgcttaaagagggcgtgcgactcgatcgggttaggggaggtaggcagaaatataaaagacggatcgatgccgaaaactcaccctacctcaatccacagcttgtgcaacccgccaaaaaaccatacaacaagattgtttcccacctcctcgttgccgaaccagagaaaatttatgccatgccagatccaactgtccctgatagcgatatcaaggctctcacaaccctgtgtgatctggctgatagagagcttgtggtaattataggatgggctaagcacataccggggttctctaccctgtcattagctgatcagatgtctctgctacaatccgcctggatggaaatcttgatcttgggcgtcgtctaccggtccctcagcttcgaggacgagctggtctacgcagacgactatatcatggatgaggatcagagtaagcttgcaggcctgttggaccttaacaatgctattctacaactagtaaaaaagtataaaagcatgaaattggagaaggaagagtttgtgaccctgaaagctattgccctcgccaattcagactccatgcacatcgaagacgtggaagctgtgcagaaactgcaagatgtcctgcacgaggcgctgcaggattacgaggccggacaacacatggaggatccacgtagagctggtaaaatgttgatgactcttcccttgttgcgtcaaacctcaacgaaagctgtccagcatttctacaatatcaagctggaaggcaaagttccaatgcataagctgtttctggagatgctcgaggccaaggtgtag

SEQ ID NO: 116095 - DNA, 1308 bp, Artificial Sequence
  Description of Artificial Sequence: Synthetic coding sequence
atgtccaacaaggatcggcacattgacagcagctgctcttcctttatcaaaaccgaaccaagtagcccagcttccctgaccgactctgtgaaccaccattcacccggcggatctagtgacgcatctgggtcttactcttccactatgaatggacaccagaacggcctggacagcccccccctgtacccgagcgcacctatcctgggaggctccggccctgtgaggaagttgtacgatgactgttcgtctacaattgtggaagaccctcaaactaagtgtgaatatatgctcaactcgatgcccaaacggctgtgcctcgtgtgtggcgacattgcaagcgggtaccactatggcgttgcctcttgcgaagcctgtaaggcattctttaagcggacaattcaggggaacattgaatattcatgtcctgcaactaacgagtgcgagataacaaagcggcgtaggaagagttgccaggcctgccggttcatgaaatgtctgaaagtgggaatgcttaaggagggggtaaggctggatcgggttagaggtgggcgtcagaaatataagaggcgcatcgatgcggagaactccccttacctgaatccgcagttggtgcagccagcgaaaaagccctacaataagattgtgagccacctcttagtcgcagaacctgaaaaaatctacgcgatgcccgatcctaccgttccagactcagatataaaagctttgacgaccttatgcgatctcgccgatcgggagctggtggtgataataggttgggctaaacacatcccagggttcagcactctcagtctcgctgatcaaatgagcctattgcagtcagcctggatggaaatcctgatattgggcgtggtataccggagtctgtcgttcgaggatgagctcgtctatgctgacgattatatcatggatgaagaccagtccaaacttgctgggttgctcgatctgaacaatgccattctgcagcttgtgaagaagtacaagtctatgaagctggaaaaagaggaatttgtgaccctgaaagccattgccctcgctaacagtgattccatgcacatagaagacgttgaagcggttcaaaagctccaagacgttctacacgaagctttacaagactacgaggccggacagcacatggaggacccgcgtcgcgcgggaaagatgctcatgaccttacccttactgcggcagacctccacaaaggccgtccaacacttttacaacatcaagctggaaggcaaggtaccaatgcacaaactattcttggaaatgctggaggccaaggtttag

SEQ ID NO: 116096 - DNA, 1308 bp, Artificial Sequence
  Description of Artificial Sequence: Synthetic coding sequence
atgtcaaacaaggatagacacatcgactcgtcctgttccagctttattaagactgaaccatcctctcctgcatctcttacagacagtgtgaatcaccatagccctgggggaagttctgacgcctctggaagctattcctcaacaatgaatggtcatcagaatgggctcgactctccacccctgtatcctagcgctcccatcttaggcggaagcggtcctgtgcggaagctgtacgatgattgctcttctactatagtggaggatccgcaaactaagtgcgagtacatgctcaatagcatgccgaagcgactttgtctggtgtgtggcgatatagccagtggctaccattacggagtggccagttgtgaggcctgtaaggccttttttaagaggaccattcagggaaatatcgaatatagttgtcccgccactaatgagtgtgaaatcactaaaagaagaagaaagtcatgccaggcatgcaggtttatgaagtgcctgaaggtggggatgctgaaagagggcgttcgccttgacagggtacgcgggggcaggcagaaatacaaacggagaatcgacgctgagaacagtccttacttgaatccacagcttgtgcaaccagccaaaaagccctataacaagatcgtgtcacacttactggtcgctgagcctgagaagatctacgctatgcccgaccccacagtccctgattcagacatcaaagctctgacaaccctttgcgaccttgcggaccgcgaattagtggtgattattggctgggcgaagcatataccgggcttcagtaccctctctcttgctgaccagatgtctctgctgcaatcggcctggatggaaattctaatactgggggtggtctacagatcgctgtcctttgaggacgagctcgtctacgctgatgactatatcatggacgaggaccagagtaagttggcggggctactcgatctgaacaatgcaatccttcaactggttaaaaagtacaaatcaatgaagctggaaaaggaggagtttgtgactctaaaagccatcgctctggcaaattccgacagtatgcacattgaggacgtggaggcagtgcagaagctccaggacgtgctccacgaggctcttcaggactacgaggccggccaacatatggaggacccgagaagggcaggcaaaatgctgatgactctacccctgctgcgccagacctctacgaaggccgtgcaacatttctacaatattaagctggaaggtaaggtacctatgcataagctattcctggaaatgcttgaggccaaggtgtag

SEQ ID NO: 116097 - DNA, 1308 bp, Artificial Sequence
  Description of Artificial Sequence: Synthetic coding sequence
atgtccaacaaagaccggcacattgacagcagctgttctagtttcattaaaaccgagccctcgtctcccgctagtctgacagattccgtgaaccatcactccccagggggcagctccgatgcatctggctcttattctagcaccatgaacgggcaccaaaacggcctcgatagcccaccactatacccttccgcgcccatcttggggggctctggaccggtgcgcaagttgtatgacgactgcagctccacaatcgtggaggacccacagacaaagtgtgagtacatgttgaacagtatgcctaagcggctctgtctggtttgcggggacattgctagcggctatcattacggcgtggcttcctgcgaagcttgcaaggcctttttcaaacgaactattcagggtaatatcgagtattcgtgtccggccactaacgaatgtgaaattaccaagaggaggagaaagagttgtcaggcatgtcggttcatgaagtgtcttaaggtcggcatgctcaaggaaggagtccgactggatagggttcggggcgggcgtcagaaatataagagacggatagatgccgagaatagcccgtatttgaacccgcagctcgttcagcctgcaaagaagccctacaataagattgtttcacacttgctggtggcagagcctgagaaaatatatgccatgccagacccaacggtgccggattccgacatcaaagctctaacgacactctgcgatctcgctgatcgtgaactggttgtcattattggctgggcaaaacacattcctggattttctacgctgtctctcgctgaccagatgtctttgctgcagtcggcctggatggaaattctgatactgggagtcgtgtaccggagtctatccttcgaagacgagctcgtctacgcagacgactatataatggatgaggatcagtccaagttggccggacttctcgacttaaacaacgcgatcttgcagcttgtcaagaagtacaagtcaatgaaactggagaaagaggagttcgtgacactgaaggctatagccctcgctaactctgactcgatgcacatcgaggacgtagaggctgtgcagaagctgcaggacgtcctacatgaggcactgcaggactacgaggccggccagcacatggaggatcctaggcgggctggcaagatgctaatgactctgccattactacggcagacctctaccaaggccgtacagcatttctacaatatcaaactcgagggaaaggtgcctatgcacaaactttttttggaaatgctcgaggccaaggtgtag

SEQ ID NO: 116098 - DNA, 1308 bp, Artificial Sequence
  Description of Artificial Sequence: Synthetic coding sequence
atgagcaacaaagatagacatatcgacagcagctgctcctcatttatcaagacagaacctagttcaccagcatccttgaccgacagtgtgaaccaccacagtcccggtgggtctagtgacgcctccggctcctattcatcaaccatgaacggacaccagaacggcctggattccccccctttgtatcccagtgctcctatccttggaggaagtggacccgtgaggaaactctatgatgattgttcctctacaattgtagaggacccccaaacaaagtgtgaatacatgctcaactcgatgcctaagcggttgtgtctggtctgtggcgacatcgccagtggctatcactacggggtcgcaagctgtgaggcctgcaaggctttcttcaaaagaaccatccaggggaatattgagtatagctgccccgctactaacgaatgtgaaatcaccaaacgtagacggaagagctgccaggcgtgtcgtttcatgaagtgcctcaaagtcggtatgctcaaagaaggtgtgaggctggacagggtcagaggagggcgacagaagtataagaggcgtattgacgcagagaattccccttacctgaatccacaactggtccagcctgccaaaaaaccatacaacaaaattgtttcacacctgctcgttgcagaaccggagaaaatttatgcaatgccagatccgacagtgccagactcagatataaaagccctaacaacgctctgtgacctggccgaccgggaattggttgtaatcattggctgggccaagcatatcccagggtttagcaccttgtccctcgcagatcagatgagcctcctgcagtcagcgtggatggaaatcctgattctcggcgtggtgtaccggtcattaagctttgaggacgagctcgtgtatgcggatgattatataatggatgaagaccagtccaagctggctggactgctggacttaaacaatgcgatccttcaactggtcaagaagtacaaatctatgaagctggaaaaagaggaatttgtgactttgaaggccatcgccttagccaactctgattctatgcatatcgaagatgttgaagccgttcaaaagcttcaagatgtactgcacgaggcactgcaggattacgaggctggccaacacatggaggacccaagaagggctgggaagatgttgatgacccttccacttttgagacagacgtcaacaaaggcagtgcagcacttctacaacatcaaacttgaaggtaaagtccctatgcataaattgttcctggagatgctcgaagcaaaagtgtag

SEQ ID NO: 116099 - DNA, 1308 bp, Artificial Sequence
  Description of Artificial Sequence: Synthetic coding sequence
atgagcaataaagaccgacacatcgacagcagttgctcatcatttattaaaaccgagccgtcttcaccagcttcccttaccgattctgtaaatcaccactctccaggtgggagctcagacgcatctggcagctattcatctaccatgaatgggcaccagaacggtctcgactcaccgccgctgtacccgtccgctcctatcttaggcgggtctgggcccgtccgtaagctgtatgacgattgctccagcaccatcgtggaggacccccagaccaagtgtgaatatatgctcaactcaatgccgaaacgactgtgcctcgtttgcggggatatcgcctctggttaccattatggggtcgcctcttgtgaggcgtgcaaggccttctttaagcgaaccatacagggcaacatagagtattcctgtcccgccacgaatgagtgtgaaattaccaaaagacggcggaagtcctgccaggcctgtaggtttatgaagtgcttaaaggtaggcatgcttaaagaaggggtgaggctggatagggttcgtggcgggcggcaaaaatacaaacggaggatcgacgcagaaaattccccttatctcaacccccagctggtgcagccagcgaagaagccttataataaaatcgtctctcacctgttggttgccgagcccgagaagatctacgctatgcctgatcccactgtgccagactccgatatcaaagcactgacaactctttgtgaccttgcggatagggagcttgtggtaatcataggctgggccaagcacatccctggtttctccacgctgtctctggcggatcagatgtccctgcttcagtccgcctggatggaaatcctaattttaggagtggtatacaggagcctctcttttgaggacgagttagtgtacgccgatgactacataatggacgaggaccagagcaagctcgccgggctcctggatctaaacaatgctattttgcagctggtgaagaaatataaaagtatgaaactggaaaaagaggagtttgtgacactgaaagctattgctctcgccaacagtgattcaatgcacatcgaagacgtggaagctgtgcagaagcttcaggacgtgctgcacgaggctctacaggactatgaggcgggacagcacatggaagaccctcgaagagccgggaaaatgctcatgacactgccactcctgcggcagacctccacgaaagcagtgcaacatttttacaacattaagctggaaggcaaagtaccaatgcacaaattatttctggaaatgttggaggccaaggtgtag

SEQ ID NO: 116100 - DNA, 1329 bp, Artificial Sequence
  Description of Artificial Sequence: Synthetic coding sequence
atgtccaacaaggacaggcacattgacagttcttgctcttcctttatcaaaaccgaaccaagctccccagcaagtttaacagattccgtgaatcaccactccccgggtgggtctagcgatgcttctggctcatatagttccacaatgaacggccaccaaaacggcctggacagccccccactgtacccatctgccccaatcctgggtggtagtggcccagtacgaaagctgtatgacgactgctcctccactatcgtggaggacccacagactaagtgcgaatacatgctaaactccatgcctaaaaggctgtgcctcgtctgcggcgacatcgcttctggttaccactatggcgttgcatcctgtgaagcctgcaaagcgttcttcaaaaggaccatccaggggaatatagagtactcgtgtccagctactaatgaatgcgagattacgaaaaggcgaaggaaaagctgccaagcttgcaggtttatgaaatgcctgaaggtaggcatgctgaaagagggggtgcgtctggacagggtgagaggtgggcggcagaagtacaagcgccgtatcgacgcagaaaactcaccttacctgaatcctcagctggtccagccagcaaaaaagcctctcctctggagcgaccctgcggacaacaaaatcgtttcacacctactggtggctgagccagagaagatttatgccatgcctgaccccaccgtgcccgacagtgacattaaagccctgacaacgctttgtgacctggccgaccgcgagctggtggtcataattggctgggccaaacatataccaggtttctccactctcagcttggccgaccagatgtcattgctgcagagtgcatggatggagatcctaatccttggggtcgtgtataggtccttgtctttcgaagatgaactggtgtacgctgatgattacattatggacgaagatcagtccaagctcgccgggctcctggacctgaacaatgccatcctgcagctggttaagaagtacaagtcaatgaagctggaaaaagaagagtttgtcaccttaaaagctattgctttggctaatagcgactccatgcacatcgaggatgtggaagccgtccagaaactgcaggatgttttacacgaagctctgcaggattacgaggccgggcaacacatggaagacccaaggagagccgggaaaatgttgatgacactgcctctcctacggcaaacaagcacaaaagcagtccagcacttttataacatcaaacttgagggaaaggtccctatgcacaaactttttctcgaaatgctggaggctaaagtctag

SEQ ID NO: 116101 - DNA, 1377 bp, Artificial Sequence
  Description of Artificial Sequence: Synthetic coding sequence
atggattcggtagagttgtgcctcccagaatctttcagtctgcattatgaggaagaattactgtgcaggatgtccaataaggataggcatatagactcatcatgctcaagttttattaaaaccgaacctagtagccccgcttctctaactgacagtgtcaatcaccactcacctggcgggtcttctgacgcgagcggcagctactccagtacaatgaacgggcaccagaatgggctggatagcccacccttatatccttcagcccccattttaggaggaagtggtcccgtcagaaagctctatgatgattgcagctcgactattgtggaggaccctcagactaagtgcgagtacatgctgaacagcatgccgaaacgcctttgtctggtttgtggggacattgcctccggctatcactatggtgtggctagctgcgaggcatgcaaggctttttttaagagaaccattcaggggaatatcgaatattcctgcccagccactaacgaatgcgaaatcaccaagagaagacggaagagttgtcaggcatgccgattcatgaagtgtctcaaagttggcatgctcaaagagggtgtccgcctggacagggtgagaggtggccggcagaaatataagcggcgcattgacgcagagaactctccatatctcaatccccagctggtccaacccgctaaaaagccctacaataagatcgtctcccaccttctcgtggccgagccggagaagatttatgccatgcccgaccctactgtgcccgatagtgatattaaggcactgacgactttgtgcgacctggctgacagagaactggtggtgatcataggatgggccaaacacattccaggattctccaccttgtccctggctgatcagatgagcctcttacaatctgcgtggatggagatcctgatcctaggcgtggtgtatcggagtctgtccttcgaggatgaactggtctacgcagacgattatattatggatgaagaccagtctaagctggccggactcctagacctcaacaatgctatcctccagctggtgaagaaatataaatccatgaagctcgagaaagaagagttcgtgaccctgaaagccatagcactcgccaatagtgatagcatgcacattgaggatgtggaagctgttcaaaagttacaggacgtgcttcacgaagccctgcaggattacgaggctggtcagcacatggaagacccccgtcgcgcagggaaaatgttgatgaccttacccctcctgcggcagaccagcacgaaggcggtgcagcatttttataatatcaaacttgaagggaaagtgcctatgcataagctttttctcgagatgctcgaagcgaaagtatag

SEQ ID NO: 116102 - DNA, 171 bp, Artificial Sequence
  Description of Artificial Sequence: Synthetic coding sequence
atgagcaacaaggacaggcatattgactcaagctgctcatccttcattaaaaccgaaccctcgtctcctgcatctttaactgatagcgtaaaccatcattctcccggcgggagctctgatgcctctggaagttactcatccaccatgaacggtcatcagaacggtttgtag

SEQ ID NO: 116103 - DNA, 279 bp, Artificial Sequence
  Description of Artificial Sequence: Synthetic coding sequence
atgagtaacaaagaccggcacattgacagtagctgctctagttttataaagacagagccttcaagtccagcctctctgactgattctgttaaccatcactccccaggcggcagcagtgacgcctcaggctcatattcgagtaccatgaatgggcaccagaatgggctggattcccctccattgtaccctagcgccccaatcctgggcgggagcggacctgtgaggaagctgtatgacgactgttcttccacaattgtcgaggatccacagaccaagtag

SEQ ID NO: 116104 - DNA, 1065 bp, Artificial Sequence
  Description of Artificial Sequence: Synthetic coding sequence
atgagcaataaggacaggcatattgattcttcttgttcatccttcatcaagactgaaccttctagcccagcctccctgacagattctgtcaaccaccactcccccggtggctctagcgacgcaagcggttcctattcctcgactatgaatggacaccagaacggtctggattctcctccactgtacccctccgcaccaatcttgggtggcagtgggccagtgcggaaactgtacgacgactgttcatcaactattgtagaggatcctcaaactaaatgtgagtatatgctcaactcaatgcccaagagattgtgccttgtatgcggtgacattgccagtgggtaccactacggggtggctagctgcgaagcatgcaaagcattctttaaacgcaccattcaggggaatattgaatactcttgtcccgccaccaatgagtgcgagattacaaagcggcgaaggaagtcctgccaggcttgtagatttatgaaatgcctgaaggtggggatgctgaaggaaggcgtgcgactcgatcgcgtgcgaggcggcaggcagaaatataagcgacgaattgacgcagagaattcgccgtacttgaacccacaactggtccaaccagctaaaaaaccatataataaaattgtttcgcatctgctggtggccgaaccagaaaaaatttatgccatgcctgaccctaccgttccagattctgatataaaagctctgaccactctgtgcgacctcgccgatagggagttggtagttattatcggatgggctaagcacatccctggtttcagtacattgtccctcgctgaccaaatgagcctcttgcagagcgcttggatggagattctcattctgggcgtcgtctatcgtagcctatcatttgaagacgagctggtgtatgcagatgattatatcatggacgaggaccaatccaagctggctggcttgctggatcttaataacgccattctgcagctggtcaaaaaatacaagtccatgaaactcgagaaggaagagtttgtgaccctaaaagcaatcgcattggcaaactcttag

SEQ ID NO: 116105 - DNA, 153 bp, Artificial Sequence
  Description of Artificial Sequence: Synthetic coding sequence
atgtccaacaaggaccggcacatcgacagttcctgctctagcttcattaagacagaaccttctagccccgcaagtctgaccgattctgtgaatcaccactccccggggggctcatccgacgcatccgggtcctacagttctactatgaactag

SEQ ID NO: 116106 - DNA, 1308 bp, Artificial Sequence
  Description of Artificial Sequence: Synthetic coding sequence
atgtcgaacaaggatcgtcacatcgatagttcgtgtagctccttcataaaaactgagccttcaagccctgcctcacttaccgactcagtcaaccatcactctcctgggggttcgagcgatgccagcggtagctacagttccacaatgaatgggcaccagaatgggctggactctcctcccttgtacccttctgccccaatcctgggcgggagcggacctgtgagaaagctgtatgacgactgttctagtactattgtcgaggacccccagacaaaatgtgaatatatgctcaattctatgcctaagagattgtgcctggtctgtggagatatagcgagtggttatcactacggggtcgcgagttgtgaggcctgtaaagctttttttaagcggacaatccagggaaatatcgagtattcatgccctgccaccaacgagtgcgagatcacgaagcggcggagaaaaagttgtcaggcgtgcaggtttatgaaatgcctgaaggtgggaatgttaaaggaaggtgtaaggttagatcgcgttcgtggcggccggcaaaagtacaagcggcgcattgacgctgagaactccccatacctgaacccgcagctggtccagccggcaaagaagccgtacaacaagatagtttcacatctgctcgtagcggaacctgaaaagatatacgccatgcccgacccaactgtgcctgactccgacataaaagctcttaccaccctttgtgatttagcagatcgtgagctggtcgtgatcatcgggtgggctaaacatattcctggatttagcacactctccctggcagatcagatgtcactgctccagagcgcatggatggagattctgattctgggtgtggtctacagaagcctgtcatttgaagatgaactcgtgtacgcggatgactacatcatggacgaggaccagtcgaagcttgccggtctactggacctgaacaacgctattttacaattggtgaagaaatacaaatccatgaaactggaaaaagaggagttcgttacgctgaaagcaatcgcgctggccaactccgactcaatgcacatcgaagatgtagaggcagtgcaaaaactgcaggacgtactgcacgaggcgttacaggattatgaagccgggcagcatatggaagatccaaggcgcgctggaaagatgctcatgaccctgcccctcctgaggcagacctccaccaaggctgttcagcatttttataatatcaagctcgaggggaaggtacccatgcacaaactcttcctggagatgctggaggcgaaagtgtag

SEQ ID NO: 116107 - DNA, 1308 bp, Artificial Sequence
  Description of Artificial Sequence: Synthetic coding sequence
atgagcaataaggacaggcacattgatagcagctgcagttctttcattaaaactgaacccagttcgcccgcatcgctgactgatagtgtgaaccatcatagtccggggggctctagcgatgccagcgggtcatactcctccacaatgaatgggcaccagaatgggctggactctccccctctgtacccaagcgctccaattttagggggatccggccctgtacgcaaactgtatgacgattgtagtagtacaatcgtggaagacccccagacgaagtgtgagtatatgcttaactcaatgcctaaacgcctctgtctggtctgcggtgacatcgcatcagggtaccattacggcgtcgcctcttgcgaggcttgcaaagctttctttaaacgcacgatccagggtaacatcgaatactcatgccctgctacaaacgagtgtgaaatcactaagcgtaggcgaaaatcttgccaggcgtgcagatttatgaaatgcctgaaggttggtatgctcaaagaaggagttcggcttgacagagttagggggggtagacagaaatacaagagacggatagatgctgagaattcaccttatctcaacccccagctcgttcagccagcgaagaaaccatacaacaaaattgtgtcccatctgctggtcgccgagcccgagaaaatctacgcaatgccggaccctaccgtccccgacagcgacatcaaggccctgaccacgctttgcgatctggcagaccgagaactcgtggtgatcatcgggtgggctaagcacatcccaggattcagcacgctatcactggccgatcagatgagcttattgcaatccgcctggatggagatccttatcctgggcgtcgtgtatcgaagcctcagttttgaagacgaactagtgtatgccgacgattacattatggatgaggaccagagtaaactcgccggactcctcgacttaaataacgccattttgcaactagtaaagaaatataaaagcatgaaacttgagaaggaggaattcgtcacacttaaagcaatcgctctggcgaatagtgattcaatgcacatcgaagacgtcgaggcggtgcaaaagttgcaggatgtgctccacgaagccctgcaggattacgaagccggtcaacacatggaagatcccaggcgcgctggaaaaatgctcatgacactgccattgttgaggcagacctctaccaaagcagtccaacacttctataacatcaagttggaaggtaaagtgcctatgcacaagctcttcctggagatgctggaggctaaggtgtag

SEQ ID NO: 116108 - DNA, 1308 bp, Artificial Sequence
  Description of Artificial Sequence: Synthetic coding sequence
atgtcaaataaggatcgacatattgacagcagttgttcatctttcataaaaactgagccaagtagtccagccagccttacagactcagtgaaccatcattcacccggcggcagttccgacgcaagcggatcctattctagtaccatgaatggacatcaaaacggattagacagcccaccactgtatccctctgccccgatccttggaggtagtgggcccgtgaggaaactctatgacgactgctctagcactatcgtagaagatcctcagactaagtgcgaatacatgctgaatagcatgccgaaacgcctctgcctggtgtgtggggatattgcctccggctaccactacggcgtcgcaagctgcgaggcctgcaaagcctttttcaaacgcactatccagggcaacatcgagtactcctgccccgctacgaacgagtgtgagattactaagagacggcgaaagtcctgccaggcttgccgattcatgaagtgtctaaaggttggcatgcttaaggagggagtgcgtctggacagggttagaggcggtaggcagaagtacaaaaggagaatagacgccgaaaatagtccatacctcaatccacagcttgtacagcccgctaagaagccctataacaagatcgtatctcacctgctcgttgcggaacccgaaaagatttacgcgatgcctgacccaaccgtaccagactcagatattaaggctttaaccacgctctgtgacctggctgaccgcgagctggtggtaattataggttgggcgaagcacatccccggcttctccactctgagcctcgccgaccagatgtctctcttacagtccgcttggatggagatattgatcctcggagtggtgtaccggagtctgagttttgaagacgagttagtttacgccgacgactacatcatggacgaggaccaatccaagctcgcaggactgctagacctgaacaatgcgatattgcaactcgtcaagaaatacaagagtatgaagctggagaaggaggagtttgtgactctgaaagccatcgcattagctaactcagattccatgcatattgaggacgtggaagccgttcagaagttgcaggatgtcctgcatgaggcactgcaggactacgaagcaggccagcacatggaagaccccaggcgagccggaaaaatgctgatgacccttccacttctgaggcagacctcgaccaaagcagttcagcacttctacaacatcaaactggaggggaaggtgccaatgcataagctgtttttagagatgctggaggccaaggtctag

SEQ ID NO: 116109 - DNA, 1413 bp, Artificial Sequence
  Description of Artificial Sequence: Synthetic coding sequence
atgtggagagagtgcgattggggtctcggcgcggttaagtcagatctcgcatgtgtgccatcagccaaacggcttctatgccgaatgagtaataaagatagacacatcgactcctcctgcagcagttttatcaagaccgaacccagctccccagcatcccttaccgatagcgtgaatcaccacagtcctggtggtagttcggacgcctcaggcagctattcatccacgatgaatggccaccagaatggactcgactccccaccactttatccttcagctccaattttgggcggtagcggtccagtccgcaagctgtacgacgactgttcatccaccatcgtggaagatccacagacaaaatgtgaatacatgctgaatagcatgcccaagagactgtgcctggtatgcggtgatatcgcctccgggtatcactacggggtcgcttcctgcgaggcctgcaaggcttttttcaagcgcacaatccagggcaacattgagtactcttgcccggctactaacgagtgcgaaataacgaaaaggcgacgcaaatcctgtcaggcgtgccggttcatgaagtgcttgaaggtgggcatgctgaaggagggagtccgcctcgatcgcgtacgtggcgggagacaaaaatataaacggagaattgatgccgaaaactcaccgtacctgaatccacaattagttcagcctgcgaagaagccattgctgtggagcgaccccgccgataataagatcgtcagccacttgcttgtcgcagaacccgaaaagatctatgccatgcctgatcctacagtacccgatagcgacatcaaggccctaacaaccctatgcgatttggccgaccgggagctggtggtcatcatcgggtgggcaaagcacattcccggtttcagcacgctctctcttgctgaccagatgagcctgctccagtcggcttggatggagatactcattttaggcgtggtttacagaagtctgtccttcgaggatgaactggtatatgcggatgactatatcatggacgaagatcagtcaaaacttgcgggtttattggatctcaacaatgctattctgcaactggttaagaaatataaatccatgaagctcgaaaaggaggaatttgttacactgaaagcaatcgccctggccaattccgactcaatgcatatagaagatgtcgaggcggtccagaagcttcaggacgtgcttcacgaagcattgcaggattatgaggctggccaacatatggaagatcctcggcgagcaggcaagatgcttatgaccctccccctcctcaggcagacgagcacaaaggccgtgcagcacttttacaacatcaagctagagggtaaggtgccgatgcacaagttatttcttgagatgttggaggctaaggtctag

SEQ ID NO: 116110 - DNA, 1359 bp, Artificial Sequence
  Description of Artificial Sequence: Synthetic coding sequence
atgctctgtggccggcccaggagttcctcagacaataggaactttctgcgagaaagagccggtctcagctctgctgcagtccagacccggatagggaactccgcagcctctcggaggtcccccgcggcccgtcccccagtgccagcgccccctgcccttcctcggggtcgcccgggaactgaaggaagcacttcacttagcgcccctgccgtcctggttgtcgctgtagcagtcgtggtcgttgtggtgagcgctgtggcatgggctatggccaactacatccacgtgccacccggatccccagaggtgcccaaactgaatgtgactgttcaagaccaggaagagcatcgatgtcgcgaaggcgccctgtcattattgcagcatctacgccctcattgggatccgcaggaggtgactttacagctgtttacagatggaattaccaacaagttgattggttgttacgttggtaatactatggaagacgtcgttctcgttaggatatatggtaacaagaccgaactcctggtagaccgagacgaagaggtgaagtcattccgagtactgcaggcccatggctgcgctccgcagctgtactgtacgtttaacaacggactgtgttatgagttcatccagggcgaagctttagatccaaagcatgtctgcaatcctgcaatctttagactaattgcccgtcaactggctaaaatccacgctattcacgcccacaatggttggatccccaagtctaacctctggctcaagatggggaagtatttctccctgatccccaccgggtttgcagacgaggatattaacaagcgtttcctaagcgacatcccttctagccagatactacaggaagagatgacgtggatgaaagagatcctgtcgaacctgggatctccagtcgtgctatgccacaatgacctgttgtgtaagaatataatttataacgagaaacagggtgatgtgcaatttattgattacgagtacagcgggtacaattatctggcgtacgatataggaaaccacttcaatgagtttgcgggggtctccgacgtggactatagtctttatcctgacagggagctgcagagccagtggctccgggcgtacctggaggcctacaaggaattcaaagggttcgggaccgaggttaccgagaaagaagtggagatcctcttcattcaggtgaatcagttcgccctggcatcacattttttctggggactgtgggctctcatccaagcaaagtactcaaccatcgagttcgattttctgggatatgctattgtgcgattcaaccagtacttcaagatgaagcccgaggtgaccgctcttaaggtgcccgaatag

SEQ ID NO: 116111 - DNA, 777 bp, Artificial Sequence
  Description of Artificial Sequence: Synthetic coding sequence
atgctctgtggacggcctagatcctcatctgataaccgcaatttcctgcgtgaacgcgccggtttgtccagcgccgccgtgcagacccgtatcggaaacagcgcagcttcccgaagaagccccgccgctagaccacccgtgcccgctcctcccgctcttccacggggaaggccgggaacggagggcagtacgagtttgtccgcccccgccgttcttgtggttgcagtcgctgtcgtcgtggtggttgtctcagccgtcgcttgggccatggccaattacatccatgttccacctggatcaccggaagtgccaaagcttaatgttacggtgcaggaccaggaggagcacaggtgcagagagggtgctctgagcctcttgcaacacctgagaccacactgggacccacaggaagtaaccttgcagctgttcacagatggaatcactaataagctgattggttgttacgtggggaacaccatggaggatgtagtcctcgtgcgtatctatggtaacaagacggaactattggtggacagagatgaagaggtcaaatctttccgggtgctgcaggcacacggatgcgcccctcagctgtactgcacttttaacaatgggctatgctacgagtttatccagggagaagctctggatccaaagcacgtgtgcaacccggccattttcagtcttagcagcttgacactgtgcaaaggcaagacaactcggtgcttcggtctgactggttgccggggctcacggttactcctctccttcttctag

SEQ ID NO: 116112 - DNA, 1305 bp, Artificial Sequence
  Description of Artificial Sequence: Synthetic coding sequence
atgctgtgtggccgcccccgctcttcaagcgataaccggaacttcctccgggagcgcgccggtctgtcctctgctgcagtgcaaactcggataggcaattctgccgctagccgccggagccctgccgctcggccccctgtgcccgccccacctgcgctgcccagaggtcggcctgggacagagggaagcaccagtctgagcgcacccgccgtactcgtagtcgcagtcgccgtcgtggtggttgtcgtgtccgccgttgcctgggccatggccaattatatacacgtgccacctgggagtcccgaggtacccaaacttaatgtaaccgtccaggaccaagaggagcaccgctgcagagaaggtgccctgtccctgctacagcacctgagacctcattgggatccccaggaggtcaccctgcaactttttaccgacgggatcaccaataaacttattggatgttatgtggggaacacaatggaagacgtcgtcctggtcagaatttacggcaacaaaaccgaactcctggtcgatagagacgaggaggtgaagtcattcagggtcttgcaagcacatggttgcgccccgcagctctattgcaccttcaacaatggactctgctacgagtttatccagggcgaagccttggatcccaaacatgtgtgtaatcctgccatcttccgcctgatcgctagacagctggccaaaatccacgcaatacacgcgcacaacggctggatccctaagtccaacttgtggctgaaaatgggaaagtatttctcattaatcccgaccggatttgctgacgaggatatcaataagcgttttctatctgacataccctctagccaaattctgcaggaggaaatgacctggatgaaagaaattctgtccaatttagggtctcccgtggtgctttgccataatgacttgctttgcaagaacataatctacaatgagaaacagggcgacgtccagtttatagattatgaatactccggctacaactatctagcatacgacatcggcaatcatttcaacgaatttgccggtgtgtccgacgtggattatagcctttacccagatagggaattacagtcccaatggctgcgagcctacctggaggcttataaagaatttaaaggcttcggaacggaggtgactgagaaggaagtcgagatactatttattcaggttaatcagtttgcactgggcgaaaaccttaattttataataggaaacaagtactgccagctcttttctctaaagtggcttctgattagttttggcgattgcggactctag

SEQ ID NO: 116113 - DNA, 627 bp, Artificial Sequence
  Description of Artificial Sequence: Synthetic coding sequence
atggcaaaaattcacacaatccacgctaacggatcactgcccaagcctatcctttggcataagatgcacaattactttactcttgtcaagaacgaaattaatccatcactctctgcagatgtccccaaagtcgaggttttggagagagagctggcctggctgaaagaacatcttagtcagctggaatctccggtggtgttctgccataacgatctgctttgcaagaacattatatatgatagcataaagggacacgttagattcatcgattatgaatatgccggctacaattaccaggcgttcgacatcggaaaccatttcaatgaatttgccggggtaaacgaagtggactactgcctctacccggccagagaaacacagttgcaatggctccattattatcttcaggcgcagaaggggatggccgtgacccccagagaggtgcagcggctttatgtgcaggttaataagttcgctctcgcatctcacttcttttgggcactttgggccctgatccaaaatcaatattccacaatcgattttgacttcctcaggtatgctgtgattaggtttaaccagtacttcaaggtgaagccccaggccagtgctctggagatgccaaagtag

SEQ ID NO: 116114 - DNA, 954 bp, Artificial Sequence
  Description of Artificial Sequence: Synthetic coding sequence
atggaagaaaaggcagccgccagcgcttcatgtagggagcccccaggaccgcctcgggcagccgcagtggcctacttcgggatctcagtagaccccgatgacattctcccgggcgcattaaggctgatacaggagttgcggccccattggaagcctgagcaagtgcgtacaaaaaggttcaccgacggcatcactaacaagcttgtggcctgctatgttgaagaagacatgcaggattgcgtccttgtgcgggtctacggcgaacgcactgagctcctcgtagatagggaaaatgaggtgcgaaattttcagctacttcgggctcattcctgcgcaccaaaactatattgtacgttccagaacgggctttgttacgaatacatgcagggggtcgcactggaacccgagcatatacgggagcctcggctatttagcttatccgctgatgtccccaaagtggaggtgctcgagcgcgaactcgcctggctgaaggagcacctgtcgcagctcgagagccctgtggtattctgtcataatgacctgctctgcaaaaatatcatctatgattccatcaagggtcatgtgcgttttatcgactacgagtatgctgggtacaactaccaggccttcgacatcggcaatcatttcaacgaatttgctggggtgaacgaggtagattactgcctgtaccctgctcgagagacacagctgcagtggctgcactactatcttcaggctcaaaaagggatggcagtgacccctagggaagtccagagactttacgtgcaggtgaacaagttcgcgttggcctcccactttttttgggctctttgggccctcattcagaaccagtacagtacaatcgatttcgatttcctgcgatatgctgtgattagattcaaccagtacttcaaagtcaaaccacaggcctctgccctcgagatgccgaaatag

SEQ ID NO: 116115 - DNA, 1185 bp, Artificial Sequence
  Description of Artificial Sequence: Synthetic coding sequence
atggcagtccctccttccgccccacagcccagagccagcttccacctgcgacgccatacgccctgcccacaatgtagttgggggatggaggaaaaggccgccgcatccgcttcctgcagagagcccccaggcccaccaagggcagcagccgtggcctactttggcatttctgtggaccccgacgacattctgcctggcgcgctgcgtctgatacaggagcttagaccacactggaagccagagcaagtgcggacaaagaggttcaccgatggaattacgaataaactagtggcttgctacgtggaagaagacatgcaggattgtgtgctggtgagggtgtatggtgagaggactgagctcttagttgaccgcgaaaatgaggtgcggaactttcagttgttacgggcccactcctgcgcccccaagctttactgtacctttcagaacggcttatgttatgaatacatgcagggcgtggccctggagcctgaacatatacgggagccaaggcttttccggctgatagccttggagatggcgaagatccatactatacatgccaatggctctttgcccaagccaattctgtggcacaagatgcacaattatttcaccctggtcaagaacgaaatcaatccctccctctccgcagacgtccccaaggtggaagtgctggaaagggaactcgcttggttaaaggagcatctttcccagctggagtcccccgttgtcttttgccataacgacctgctgtgcaagaacatcatttatgatagcataaaaggccacgtccgctttatagactacgaatacgccggatacaattatcaagcgttcgacataggaaatcacttcaatgagtttgctggggtcaatgaggtggactactgcctgtatcctgctagagaaacccagctccagtggctgcactactatctgcaagctcagaaaggcatggccgtgacaccgcgagaagtccagcgactgtatgtccaagtcaataagttcgcattaggaccaagttgtgtctcgagcactatgaccgcgtcactccaatgctgtcgggttggtaatagacacggggagatagcccgtctcactctgtcaggactctttccaggtgtctcgctgttactgggcagcctcggaccccatccagagccggtactgcatcaccggctgtag

SEQ ID NO: 116116 - DNA, 1161 bp, Artificial Sequence
  Description of Artificial Sequence: Synthetic coding sequence
atggccgtaccccctagtgccccccaaccccgagctagctttcatttgcgaaggcacacaccatgcccccagtgctcatggggaatggaagaaaaagctgccgcttctgcctcctgtcgagaacccccaggacccccccgggcggccgcagtcgcctactttggcattagcgttgacccagatgatatcctgcccggcgccctgcgccttattcaagaactgaggccccattggaaacccgaacaggtgcggaccaagcggtttactgacgggatcaccaacaagctggttgcttgttacgtagaggaggatatgcaagactgtgtgctcgttagggtatatggcgaacgaacggagctgcttgtggatcgtgagaacgaagtcagaaacttccaactcttgcgggcacacagctgtgcgcctaaactgtactgcacctttcagaacggcctgtgctacgagtatatgcagggtgtggcccttgagcctgagcacattcgcgaaccaagactgtttcggctcattgcactcgaaatggccaaaatccacaccatacacgcaaacggctctttacctaagcccattctgtggcacaaaatgcacaactacttcacacttgtgaagaacgaaatcaacccatccctgtcagctgacgtgcctaaggttgaggtactggaacgggagttagcctggctgaaagaacatctgtcccaactggagtcacccgttgtcttttgtcacaacgacttactgtgtaagaacatcatctatgattccatcaaaggtcacgtgagattcatcgactatgaatatgccggctacaactatcaagcttttgacattgggaaccattttaacgaatttgccggcgtgaatgaagtcgactattgcctttatcccgccagggaaacccagctgcaatggcttcactattacctacaggcccagaagggtatggctgtcactccgcgggaagtgcagcgcttgtacgttcaggtgaataaattcgccttagccagtcactttttctgggccctgtgggcactgattcagaatcagtacagcacaatcgatttcgacttccttagatatgcggtgatccgattcaaccagtacttcaaagtcaaaccccaggcgtccgcactggaaatgccaaaatag

SEQ ID NO: 116117 - DNA, 759 bp, Artificial Sequence
  Description of Artificial Sequence: Synthetic coding sequence
cgccggttgggtgggggaaccgctgaagggaaaacggggcggggattagggggtccatcttgggatactgggccgagagcaatgggatcactcagtagaccttctttttccgatcggcttattgcactggaaatggctaagatacacaccattcatgcgaacggctctctgccaaagccaatattatggcataaaatgcacaactactttaccttggtgaaaaacgaaatcaatccttcgcttagcgctgatgtgccaaaagtggaagttcttgaacgagagcttgcatggctgaaggagcacctttcacagctcgaatctccggttgttttctgccacaatgaccttctgtgcaaaaacattatctatgattcaataaaggggcacgtgcgatttatcgactatgagtacgcggggtataattaccaggctttcgatattggcaatcattttaatgaatttgccggagtgaacgaggtggattattgcctgtatcctgccagggagacccagttgcaatggctgcactactacctacaagcgcagaaaggtatggctgtgactcctcgcgaggtgcagagactctatgtgcaggttaacaaatttgccctggccagccatttcttctgggcactatgggccttgatccagaaccagtactccacaattgactttgattttctcagatacgccgtcatacgcttcaatcagtactttaaagtgaagccacaggcaagtgctctcgagatgcctaagtag

SEQ ID NO: 116118 - DNA, 765 bp, Artificial Sequence
  Description of Artificial Sequence: Synthetic coding sequence
atggccgaagctgtgttgcgagtggctcggagacagttgtcccagagaggtgggagcggcgcacctatcctcctgcggcaaatgtttgagccggtcagttgcactttcacctatctgctcggtgacagagagtcaagggaggccgtgctgatcgacccagtgctcgagacggctcctcgagacgcacagctgataaaggagctgggattgcgcctgttatatgccgtgaacacacactgtcacgccgaccacataacaggaagtggtttgctgaggtccctgctgcccggatgtcagagtgtgattagcaggctgtcgggcgcccaggctgacctgcatatagaggacggagacagcattcgatttgggcgctttgccttggagactcgagccagccccggacatacccctgggtgtgtgactttcgtgttgaatgatcattcgatggcatttacaggagacgccctcctaatccgtggttgcggacggaccgactttcaacagggctgtgcaaagacactgtatcactcagtccacgagaaaatatttactctgccaggtgactgtctaatttaccctgcccacgattaccatggttttacagtgtccacggtggaagaggaacgcacactcaacccacgtctgacactttcgtgcgaagagttcgtgaaaatcatgggaaaccttaatctccccaaaccgcagcagattgacttcgccgttcccgccaatatgaggtgcggagtccaaacccctacagcctag

SEQ ID NO: 116119 - DNA, 1020 bp, Artificial Sequence
  Description of Artificial Sequence: Synthetic coding sequence
atggcagattcagtgaaaacctttctgcaggatctggcccgtggcataaaagattccatttggggtatctgcacaatatccaaactagacgcccggatccagcagaaacgagaagaacagagaagaaggagggcgtcctccgtcctggcacagcgtcgggctcagagtattgaaagaaagcaagagtctgaacccagaatagtgtctagaattttccaatgctgtgcctggaatggaggcgtgttctggttcagcctccttctcttctatagggtgtttatacctgtgttgcaatccgttaccgctagaatcatcggtgaccccagccttcacggggacgtgtggagctggctggagttcttcctgacctccatcttctctgcgctatgggttctgccgctgttcgtgctctcgaaagtggtcaatgccatatggtttcaggacattgctgaccttgccttcgaggtctccggacgaaagccacaccccttccctagtgtttccaaaatcattgcggatatgctcttcaacctattgcttcaggcactctttctcattcaaggcatgttcgtgagcctgtttcccatccatctggtaggacagctggtgtcccttctgcatatgagtctgctgtactctctttattgttttgaatatcggtggttcaataaagggattgaaatgcatcagcgtctctctaacattgaacgcaactggccttactacttcggattcgggctgcccctggcgtttctgacagccatgcagtccagctatataatctcaggatgcctcttcagtatactatttcccctcttcatcatatcagcgaatgaggcaaagccgggtaaagcttacctgtttcagttgaggctattctctctcgtggtttttctgtctaacaggctctttcataagaccgtgtacctgcagtcagccctttccagctcgacatcagcagaaaagttcccatcccctcacccatctccagccaaactaaaagccaccgccggacactag

SEQ ID NO: 116120 - DNA, 786 bp, Artificial Sequence
  Description of Artificial Sequence: Synthetic coding sequence
atggctgattccgtgaaaacgtttttacaggacctggccagaggtatcaaagacagtatttgggggatttgcaccatctccaagctggacgccaggattcaacagaaacgcgaggagcaacgccggaggcgggctagttccgttctcgctcagcgtagagctcagtcaatcgaacgtaagcaggagagtgagcctcggattgtgtctcggatcttccagtgttgtgcttggaacggcggagtgttctggttcagcctgcttctgttctacagggtgttcataccagtgctccagtctgtgacagcccgcattatcggtgatccttccttgcacggtgatgtctggtcctggttggagtttttcctgaccagcatatttagcgctctgtgggtccttcccctgtttgtactctcaaaggtagtgaacgcaatttggttccaagatatcgcagatctcgcgttcgaggtgtcaggacggaaacctcacccttttccttcggtcagtaagattattgccgatatgttgtttaacctgctgctgcaggcactgttccttatccaagggatgtttgtctcactctttccaatccacctcgttggccaattagtgtctcttctgcacatgtcccttttgtattctttgtactgtttcgagtatcgttggtttaacaaggtggccgcctttagtctcagcagttttttgtacagtttatctgccccaatgaagcagagacctgctaagcatatcagctcaagctgtgctagtagcccatggtggtcaagttag

SEQ ID NO: 116121 - DNA, 903 bp, Artificial Sequence
  Description of Artificial Sequence: Synthetic coding sequence
atgatcctggagggaggcggagtcatgaaccttaaccccgggaataatcttctccaccagccccctgcgtggacggacagctattcgacatgtaacgtgtcaagtggcttcttcggaggtcaatggcatgagatccaccctcagtattggactaagtatcaagtgtgggagtggctgcaacacctgctggacaccaatcagctggatgcaaattgtattccgttccaggagttcgacattaatggggagcatctttgctctatgtccttacaggagttcacaagagcagccggcactgccggacaactgttgtacagcaatttgcagcatctcaagtggaatggccagtgttccagcgatctgttccaatccacacataatgtgattgtgaagaccgagcaaaccgaacctagtatcatgaatacctggaaggatgagaattacctgtatgataccaactacggctccacagtggacctgctcgactctaagacattttgcagggcacagataagcatgaccacaacaagccacttgcctgtggctgaaagtcctgacatgaaaaaggagcaggatccccctgccaaatgtcacactaaaaagcacaacccacgtggaactcatctctgggaatttatcagggacatactactcaatccggacaagaatccaggcctcatcaaatgggaggacagatcagaaggcgtgtttagattcctcaaatccgaagctgtggcccagctctggggaaagaaaaagaataatagtagtatgacatacgaaaagctgagcagggcaatgcgctactactacaaacgcgagattctcgaacgcgtggacggccgcagactggtttataagtttggtaagaatgcaagagggtggagggagaatgaaaattag

SEQ ID NO: 116122 - DNA, 903 bp, Artificial Sequence
  Description of Artificial Sequence: Synthetic coding sequence
atgatcctcgagggggggggcgtgatgaatctgaaccctggaaataacctcttgcatcaaccccctgcatggactgactcttatagcacgtgcaacgtatcttccgggttctttggaggacagtggcatgaaattcatcctcagtactggactaagtatcaggtgtgggagtggcttcaacacctgcttgacactaaccagctggacgcaaattgtatcccttttcaggagttcgacataaatggcgaacacctgtgctcaatgtcactgcaggaattcacacgggcagccggtaccgctgggcagctgctctactccaatctgcagcacttgaagtggaatggccagtgtagctccgacctgttccaaagtactcacaacgtcatcgtcaaaacagagcagaccgagccgagcataatgaacacctggaaggatgaaaactatctgtacgataccaactatggcagcacggttgacctgctcgattccaaaacgttctgtcgggcccagatttccatgacaaccacttcacacttgcctgtggcggagtctcccgacatgaagaaggagcaggacccccctgctaagtgtcatacaaaaaaacacaatcccagggggacgcatctatgggagtttattagagacatcctgctgaatccagataaaaatcccggcttgattaagtgggaggacaggagcgaaggagtgttccggttcctgaaaagcgaggccgtggcacagctgtggggcaaaaagaagaacaatagcagtatgacatacgaaaaactgtcccgtgctatgcggtactattacaagcgcgagatcctggaacgcgtggacggtcgacgactggtgtacaaatttggcaaaaatgcccggggttggagagaaaacgaaaattag

SEQ ID NO: 116123 - DNA, 969 bp, Artificial Sequence
  Description of Artificial Sequence: Synthetic coding sequence
atgggtttgcccgagcgtcggggtctcgttctcttgttgtccctggcagagatactgttcaagattatgatcctggaaggaggcggcgtaatgaatctgaatccaggcaataatctgttgcaccagccaccagcctggaccgactcctattcaacatgcaatgtgagctcgggattttttggtgggcagtggcacgaaatccatccccagtactggacgaagtatcaagtctgggagtggctgcagcacctattagacaccaaccagctggatgctaattgcatcccatttcaggagtttgacattaacggggagcacctgtgtagcatgtcgctgcaggaattcacccgggccgcgggaaccgcgggacaactcttgtactccaacctgcagcatctgaagtggaatggacagtgttccagcgatctattccagtctactcacaacgtgatcgtgaaaacagagcaaacggagccaagcattatgaatacttggaaggacgagaattatctttacgacaccaactacgggtccactgtggatcttctcgatagcaaaacattctgtagggcacagattagcatgactacgactagtcacttgccagtggctgagagccctgatatgaaaaaagagcaggatcctccagctaagtgccacaccaagaagcataatccccgggggacccacctctgggagttcatcagggatattctgcttaacccagacaagaatcctggactgattaagtgggaagatcggagcgaaggagtgttccgttttctgaagtcagaggcggtggctcagctgtggggtaagaagaagaataattcaagcatgacttacgagaagttatcgagagccatgagatattactacaaacgggagatccttgaacgggtcgatggacgtcgcctcgtgtataagttcggcaagaatgccaggggatggagagagaacgagaattag

SEQ ID NO: 116124 - DNA, 903 bp, Artificial Sequence
  Description of Artificial Sequence: Synthetic coding sequence
atgatcctggagggcggtggcgttatgaatctgaatccagggaacaatctcttgcatcaacctcctgcctggaccgattcttactccacctgtaacgtttcgtccggattctttggcggacagtggcatgaaatccatccgcagtactggaccaaataccaggtgtgggaatggctgcagcaccttctggatacgaatcagttggacgccaactgtatccctttccaggaatttgacatcaacggcgagcacctgtgtagcatgtcattgcaggaatttacgcgtgcggctggtaccgccggacaacttctatactctaatttgcaacaccttaaatggaacggtcagtgctcctccgatttgttccaaagcacacacaacgtaatagtgaagacagaacaaaccgaaccttctatcatgaacacatggaaggacgagaactatctgtacgataccaactatggtagtaccgttgacttgttggattctaagacattctgtagggcacagattagcatgacaacaacgagtcacctgcccgtagctgagagtcccgacatgaagaaggagcaagatccccccgccaaatgtcataccaaaaagcataatcctcgtggaacgcacctgtgggagttcattagggatattctgctgaatcctgataagaatccaggcttaatcaagtgggaagatcgttccgagggggtctttcggttcctgaagtcagaagccgtcgctcaactgtggggaaaaaagaaaaacaatagtagtatgacctacgaaaagctgagccgggcaatgcgatattattacaaaagagagatcctggaacgcgtcgatgggaggcggctggtgtacaagtttgggaaaaacgcccgtggatggcgcgaaaatgagaactag

SEQ ID NO: 116125 - DNA, 834 bp, Artificial Sequence
  Description of Artificial Sequence: Synthetic coding sequence
atgatccttgaggggggcggcgttatgaatctgaacccaggaaataatctgcttcatcaacctcctgcttggacagactcctacagcacctgtaatgtgagttctggtttctttggtggacaatggcacgaaattcacccccagtactggacaaagtatcaggtgtgggaatggctccaacacttgcttgatacaaaccagttagatgcaaattgtatcccattccaggagtttgacatcaatggagaacacctgtgctccatgtccctccaagagttcaccagggctgctggcacagcaggccagctgctttattcaaacctgcagcatctaaaatggaacggacagtgctctagtgatctctttcagtccacacataatgtgatagtgaagactgaacagaccgaaccctcaataatgaatacatggaaagatgagaactatctgtacgacaccaattacggctccaccgtggcagagagcccggatatgaaaaaggaacaggatcccccggccaagtgccacacaaaaaaacataatcctaggggaacccatctttgggaattcatccgggatatcctattgaatcccgacaagaacccaggcttaatcaagtgggaggatagatcagaaggagtgttccgctttttaaagagcgaggccgttgcgcagttatggggtaaaaagaagaacaacagttctatgacttatgagaaactgtctcgagccatgcgctactactataagagagaaattctggaaagggtcgacggtaggcggcttgtgtacaaattcgggaaaaatgcacgcgggtggagggaaaatgaaaattag

SEQ ID NO: 116126 - DNA, 555 bp, Artificial Sequence
  Description of Artificial Sequence: Synthetic coding sequence
atggacctgtggaactgggatgaggctagcccacaggaggtgcccccgggtaacaagctagccggattggagggggcgaagttggggttttgcttcccagacttggcgctgcaaggggacacccccacagcaactgccgaaacttgctggaaagggacctcgagttccttggcatccttcccccagttggattgggggagcgccctcctacatcctgaagtgccctggggtgcagaacccgacagtcaggccctaccctggagtggagattggacggatatggcctgcacagcttgggacagctggtccggagctagtcagactttaggacccgcacccctgggaccgggtcccatacctgcggctgggtcggagggtgccgcgggacagaattgctctccgccggcccccggactctaccacttgctggagccaggcgcggcttgtgggtggcaccatctctttgaggctgtccctgagctctcttcacacaggctgctcaggacagagcctgcagttggaccgtgccagttcggcagcatgccccaaaactag

SEQ ID NO: 116127 - DNA, 468 bp, Artificial Sequence
  Description of Artificial Sequence: Synthetic coding sequence
atggatctatggaattgggacgaggcatcaccccaggaagtgccccctggtaataaattggccgggctagagggcgcgaaacttggcttttgtttccctgacctggcactacagggggatacacctactgccacagccgagacatgctggaagggcccgatacagttgtggcagtttctcctagaactgctgcacgatggggctagaagtagttgcattaggtggaccggtaattcacgggaatttcaactatgtgaccctaaggaggtggctcgtctgtggggagagcgtaaaaggaagccaggcatgaattacgaaaaattatcacgaggcctgcgatattattaccgcagagacatcgtccgtaagagcggaggcaggaagtatacttaccggtttggcggcagagtaccttccctggcatatcccgactgcgccggcggaggccgaggggctgaaacacagtag

SEQ ID NO: 116128 - DNA, 1029 bp, Artificial Sequence
  Description of Artificial Sequence: Synthetic coding sequence
atggacctgtggaattgggacgaggcatcaccacaggaggttccccccgggaacaaactcgcaggactggaaggtgcaaagctggggttttgcttcccagatctggctctgcagggcgacactcctaccgctacagccgagacttgctggaaaggaacatcttcgagcctagcatcgttccctcagttggattggggttctgcactcctgcatccagaagtaccatggggcgccgagcctgacagccaggccctaccctggagcggcgactggaccgacatggcatgcactgcctgggattcctggtctggtgcaagccagaccttgggcccagctccactaggtcctggcccgattccagcagcagggagcgagggggccgccggtcagaactgcgtgccagtcgccggggaggcgaccagctggtctagggctcaggccgccgggagtaacacttcgtgggattgtagcgtcggacccgacggtgacacctactggggtagcggactcggaggggagccacgaaccgactgtacgattagctggggtggccccgccggtcccgactgcaccacatcttggaacccgggattacatgctggcggtacgaccagtctcaaaaggtaccaatcctctgccctgacagtatgcagcgaacctagtccacagagcgacagagcttctcttgctcgatgtccaaaaaccaaccacagaggaccaatccaactctggcagttcctgctcgagctacttcacgatggcgcacggagcagctgcattcgatggactggcaatagcagagagttccagctctgcgaccccaaggaggtggcacggttgtggggggagcggaagagaaaacccggcatgaattacgagaagctgtccagaggcctacgctactactacaggcgtgatattgtgcgcaaatccgggggccgaaagtacacgtatcgcttcggggggagagtgccttcgctggcatatcccgactgcgcaggcggcggccggggggcggagacgcagtag

SEQ ID NO: 116129 - DNA, 1029 bp, Artificial Sequence
  Description of Artificial Sequence: Synthetic coding sequence
atggacctgtggaattgggatgaggcttctccacaggaggtgcctcctggaaataagctggctgggctggaaggtgcgaagcttggtttttgctttcccgaccttgccctgcagggcgatacacccaccgcaacagccgagacctgttggaaagggactagctcttctcttgccagctttccacagctggactgggggtcggccctgctgcaccctgaggtaccatggggggcagagcctgactcacaggcactaccctggtccggcgactggacagatatggcctgcacggcttgggactcctggtccggggctagtcaaaccctgggacccgccccgttggggcccggacctataccagccgccgggagcgagggtgccgccggacagaactgtgtcccggtggcaggagaggctacttcctggtctcgagcccaggccgcaggtagcaatacctcttgggattgttcagttggtccagacggcgatacctactgggggagcggactcggtggggaaccccgtactgactgcactatctcatggggcgggccggctgggccagactgtaccaccagctggaatcctggcctgcacgctgggggcacgaccagcctgaagcggtaccagtcgagtgcccttaccgtgtgcagtgagcctagcccccaatcagatagagcctctctggcccgatgtcccaagactaatcatcgcggtccaattcagttatggcagttcttgctggagctcctccacgacggggctcggagcagctgcatccgctggactgggaacagtagggagttccagttgtgcgacccaaaggaggtggcccgcttatggggcgagcggaagcggaagcctggtatgaattatgaaaagttaagtcgaggattaaggtactattatagaagagacattgtcaggaaatctggagggcgcaagtacacatacaggttcggcggacgggtgccctcgctggcatacccagattgcgccgggggcggtagaggggcagagactcagtag

SEQ ID NO: 116130 - DNA, 432 bp, Artificial Sequence
  Description of Artificial Sequence: Synthetic coding sequence
atgaaggccggctgcagtatcgtggagaagccagagggcggcggcgggtatcagtttccagactgggcttataagaccgaatccagtccaggaagccggcaaatacagctttggcattttattctggagctgctacagaaggaagaattccggcacgttatcgcttggcagcagggtgagtacggtgaattcgtgattaaggaccctgacgaggtggccaggttgtggggaaggcgcaaatgcaagccacagatgaactatgataaattgtctagagccctgcggtattactataataaacgtatactgcacaagacaaagggtaaacgctttacatataagttcaatttcaacaagctggttatgccaaactatccgtttattaatatcagaagctcaggaaagatccagactttgctggtcggtaactag

SEQ ID NO: 116131 - DNA, 1539 bp, Artificial Sequence
  Description of Artificial Sequence: Synthetic coding sequence
atgaaggcaggatgttccattgtagagaagccagaggggggcggcggctaccagttcccagattgggcctataagactgagagctccccaggcagcaggcagattcaactgtggcacttcatcctggagctcctgcagaaggaagagtttcgtcacgtgatcgcttggcaacagggggagtatggcgagttcgtcatcaaagaccccgacgaggttgcgcgcctttggggcagaaggaagtgcaagcctcagatgaattacgataaactatccagagcccttagatactattacaataaacgcattcttcacaaaacgaagggcaagaggtttacttacaagttcaatttcaacaaactggtgatgccgaactatccttttattaatattcggagctctggcgttgttcctcagagcgcacctccggtccctaccgcctcatcccggttccactttcccccactcgatactcatagtcctactaacgacgtgcaacctggtcgtttcagtgcctcgagtttgactgcttccggacaggagtcatcaaacggaactgataggaaaacggagctgagcgaacttgaggatggaagcgccgcagattggagacggggcgtggacccagtcagcagcaggaatgccatcggaggcggcggtatcgggcaccagaaaagaaagcccgatattatgctgcctctgttcgccaggccgggaatgtacccggatccacactctccatttgccgttagtcctatccccgggcgaggtggggtactcaacgtccctatttcccccgccctgtcattgacgcctaccattttctcctattcaccatcacccggtctgagtccttttacgagctcttcctgcttctcttttaacccagaggagatgaagcactacctgcacagccaggcctgctctgtgtttaattaccacctctcaccaaggacttttcctagataccccgggctgatggtcccccctctccagtgtcagatgcacccagaagagagcacgcagttctccatcaagctccaaccaccacctgtgggcaggaagaatcgcgaaagggtcgaatcttcagaagaatcggctccagtgaccacacctacgatggcctccatccctccgcgtatcaaagtggaaccagcctccgaaaaagacccagaatcgctgcgccagtcagccagagagaaggaagagcacactcaagaagagggcacggtcccatcccggacaatcgaagaggaaaaaggcactatcttcgcccgccccgcagcccccccaatatggccctccgtgccaatctccactccctccggcgagccactcgaggttaccgaggattctgaagacagacccgggaaggaaccttcagccccggagaaaaaagaggacgcacttatgcccccgaagctgcggctcaagcggagatggaacgacgatccagaggcacgtgagctttcaaagtccggaaaattcctctggaacggctcaggccctcagggtcttgccactgccgccgcagacgcatag

SEQ ID NO: 116132 - DNA, 1533 bp, Artificial Sequence
  Description of Artificial Sequence: Synthetic coding sequence
atggatggtttttacgatcaacaagttccttttatggtgccaggtaagtcgaggtctgaagaatgtcgaggtcggcctgtcattgacaggaagcggaaattcctggacacggacttggcccacgacagtgaagaactctttcaagacttatcacagttacaggaggcctggcttgcagaggcgcaggtcccggacgatgagcagttcgttccagactttcagtcagataacctcgtcctgcacgcgcctccacccactaagatcaaacgcgaattgcactcgccctcaagcgagctttcaagctgctcacacgagcaggctctgggggcaaactatggtgagaagtgcctttacaactattgtgcatacgatcggaagcctcccagcggcttcaaaccccttacccccccaactacgcccctatccccaacacatcagaacccactgtttccgccaccacaggcaacactgcccacttccggccatgccccagccgcaggtccagtgcagggagtcgggcctgccccagcccctcacagcctgcccgaaccaggcccacaacagcagactttcgccgtacctaggccccctcatcagcccctgcagatgccaaaaatgatgccagaaaaccagtacccatcagaacaacggttccagagacagctctccgaaccttgccacccgttcccacctcagccaggcgtgcctggtgacaacagaccctcatatcatcgtcagatgtccgagcccatagtccccgcagcccctccccccccccaggggttcaaacaagaataccacgaccccctgtacgagcacggagttcccgggatgccagggccacctgcacatgggttccagtctccaatgggtatcaagcaggaaccccgggattactgcgtggacagtgaggtcccaaactgtcagtcctcctacatgcgcggtggttatttttccagcagccacgagggcttcagctacgagaaagaccctcggctatattttgatgacacttgcgttgtacccgaaagactagaggggaaagtgaagcaggagcctacaatgtacagggaaggacctccttaccagcgacgcggttcgctgcagctatggcagtttctggtcacactcctcgacgaccccgccaacgcacattttatcgcctggaccgggcgtggtatggagtttaaacttatcgagcctgaggaagtcgctagaagatgggggatccagaaaaatagacctgccatgaactacgataaactctccagatcactacgttactactatgaaaagggaattatgcaaaaggtcgccggggaacgatatgtgtataagtttgtatgcgacccagatgctctcttctctatggcttttcctgacaaccagcggcccttccttaaagcggagtcagagtgccacctgtccgaagaggacaccttgcccctgacccactttgaagactcccccgcctatttgctagacatggaccgttgtagctcgctgccctatgccgagggtttcgcatactag

SEQ ID NO: 116133 - DNA, 399 bp, Artificial Sequence
  Description of Artificial Sequence: Synthetic coding sequence
atggacggcttttatgatcagcaggtccctttcatggtgcccgggaagtcccgcagtgaagagtgcagaggtcgccctgttattgatagaaaacgtaaattcctcgacaccgacttagcccacgacagtgaggagctgttccaagatctgagtcagttgcaggaggcttggttagctgaagcccaggtaccggacgacgagcaatttgtgcctgacttccagagcgacaacttggttcttcatgcaccacccccaaccaaaattaagcgggagctgcatagccccagcagcgagcttagcagttgtagccatgagcaagcactcggggcaaactacggtgaaaagtgcctgtacaactattgcgcctatgatcgaaagcctccctcaggcttcaagtag

SEQ ID NO: 116134 - DNA, 423 bp, Artificial Sequence
  Description of Artificial Sequence: Synthetic coding sequence
atggacggcttctatgaccagcaagtgccctttatggtgcctggcaaaagcaggtcagaggagtgccgcggacgccctgtgattgatcgtaagagaaaattcctcgacacagatctggcccatgatagtgaggaactgtttcaagatctatctcagctccaggaagcctggctggcggaggcgcaggtcccggatgacgagcagtttgtaccagacttccagtctgataatctggtactgcacgccccaccgcccaccaagataaaacgggagctacacagtccgagttccgaattgtcatcatgctcccacgagcaggctctcggtgccaattacggggaaaaatgtctgtataactattgcgcatacgatagaaaaccgccatctggatttaagccactgacacctcccaccacgccctag

SEQ ID NO: 116135 - DNA, 1533 bp, Artificial Sequence
  Description of Artificial Sequence: Synthetic coding sequence
atggacggattttacgaccaacaggtacccttcatggtgccgggcaagagtcgaagcgaggagtgcagggggcggcccgtgatcgacagaaaaagaaagttccttgacaccgatctggcacacgatagtgaagagctctttcaagatcttagccagctgcaggaagcctggctagccgaagcccaggtgcccgatgacgagcaattcgtgcctgattttcagtctgacaatcttgtccttcacgccccaccccctacaaagatcaagcgcgaactccattcaccatcctccgagctcagctcctgtagccatgagcaagcgctcggggctaactacggtgaaaagtgtctgtataactattgtgcttatgacagaaaacccccaagtggattcaagcctttaacaccaccaacgacccccctttcccccacacatcagaaccctctgtttcctccaccgcaggccacactcccgacatcagggcacgcacctgcagcagggcctgtgcagggcgtcggaccggcacccgccccccactcgttaccggagcctgggccacagcagcaaacgttcgccgtgcctagacctccacaccaaccgcttcaaatgccaaaaatgatgcctgaaaaccagtatcccagcgagcagagattccaacgacaattatcagaaccatgccatccttttcccccccagccaggggtcccaggcgataaccggccctcctaccaccggcagatgtcagagccaatcgtgccagcagccccccccccccctcagggtttcaagcaggaatatcacgacccactctatgagcatggagtgcccggcatgccaggcccccctgcgcacggtttccagtccccaatgggtatcaaacaggaaccgcgagattattgtgtcgacagcgaagttcctaactgccagagtagttatatgcgcggggggtatttctcaagttctcacgaggggtttagttatgagaaggaccctagactgtactttgatgacacgtgtgttgtaccagagagactggagggcaaagttaagcaggaaccgacaatgtatagagaaggtccgccctaccagaggagaggcagcctgcagttgtggcagtttctagtgactctgcttgatgatcccgccaatgcccattttattgcctggactggacgcgggatggaattcaagctcatcgagccagaagaggttgcaagacgatggggaatccagaaaaaccgacctgcgatgaactacgacaagctgagccgttccctgagatattattatgagaagggcattatgcagaaggtcgctggtgagcgatacgtctataagtttgtttgcgacccagatgctcttttcagcatggcattccccgataatcaacgcccgttcttaaaggcggagtctgagtgccatctgtccgaagaggatacgcttccactgactcactttgaagattcccccgcctatttactcgatatggaccgatgctccagcctgccttacgcggagggatttgcctattag

SEQ ID NO: 116136 - DNA, 453 bp, Artificial Sequence
  Description of Artificial Sequence: Synthetic coding sequence
atggatggattctacgatcaacaggttccgttcatggtgcccggcaagagccgctcggaggagtgcagagggaggcccgtcatcgacagaaaacgcaagttcctggacacagacctagcccacgattccgaggaacttttccaagacctgtctcagctgcaggaggcttggctggccgaagcgcaggtgcccgacgacgagcaatttgttccagactttcagagcgataacctcgtgctgcacgctcccccccccacaaagattaagcgcgagctacattccccttcatcagagttgagtagctgctctcatgagcaggccctcggcgccaattatggagagaagtgtttgtacaactattgtgcttacgatagaaaaccccccagcgggttcaaaccgctcactcccccaacaacacctctctccccaactcaccagaacccgcttttctag

SEQ ID NO: 116137 - DNA, 1659 bp, Artificial Sequence
  Description of Artificial Sequence: Synthetic coding sequence
atgagcgagcgccgctgtccacctgaacatagggagggagtcaatgatacaggggggtccctcttccctcagaagctcctgaacgctgaaacgagtcagtcaggcattcgggacgcagagagtaccatggacgggttctacgatcaacaggtgccgttcatggtgcctgggaaaagcagatcagaggaatgcagggggcggcccgtgatagatcgtaagaggaagttcctagacactgacctggcccacgatagtgaggaactgttccaagacctcagccagctgcaggaagcatggctagcagaggcccaggtccctgatgacgaacagtttgtaccggactttcaaagtgataatctcgtactccatgcacctccccccactaaaattaaacgcgagctccatagtccttcctccgagctttctagctgctctcatgaacaggcccttggggcaaattatggagaaaagtgtctctacaattactgtgcctacgaccgcaagccaccatccgggttcaaaccacttaccccaccaacaacccccttatccccgacgcatcaaaacccactgtttcctcctcctcaggcaacactgccaacatcggggcatgcacccgccgccgggccagtgcagggtgtggggccagccccagcaccgcattccctccctgagccaggcccccagcagcagacatttgccgtcccccgccccccccatcaacccctgcaaatgccaaaaatgatgccagagaaccagtatccttcagagcagcggttccagcggcagctaagcgaaccatgccacccattcccgcctcagccgggcgtgcccggagataatcgaccctcctatcatcggcaaatgtccgagccgatcgttcccgcagcccccccgcccccgcaggggttcaaacaggagtatcatgacccactctatgagcatggggtccctggcatgcctggacctcccgcccatggcttccagtcgcctatgggcatcaaacaggaaccccgagactattgtgtcgactcagaggtgcccaattgccagtcaagttacatgaggggaggatacttcagtagcagccacgagggctttagctacgagaaggaccctaggctgtactttgatgatacatgtgttgtccctgaacgcctcgagggaaaggtcaagcaggagcctacaatgtatcgggaaggccctccataccagaggcgtggaagcctgcagctgtggcaattcctggtgactctgctggacgaccctgccaatgctcacttcattgcctggacgggtagaggcatggaattcaaactgatcgaaccagaggaggtcgcccgccgttgggggattcaaaaaaacagacctgccatgaactatgataagttgtctcgctcattacgttattactacgaaaagggaattatgcagaaggtggctggggaacgctacgtgtataaatttgtgtgcgaccctgacgctctcttctcaatggcctttcctgataaccagcgacctttcctcaaagccgagagcgagtgccatctctccgaggaagacaccctgcccttgacccactttgaagactcaccggcgtacttactggacatggatcgttgttcgagccttccatatgctgagggctttgcttactag

SEQ ID NO: 116138 - DNA, 1359 bp, Artificial Sequence
  Description of Artificial Sequence: Synthetic coding sequence
atgtctgagaccccagcacagtgtagtataaagcaggagaggattagctatacgccaccagagtctcctgtaccatcctacgcctccagcacacctctccatgtgccagtacctagggcccttaggatggaggaggacagcattcgcctccctgctcacctcaggcttcaacctatttactggagccgggacgatgtcgcacagtggcttaagtgggccgagaacgagttcagtctccgcccaatagacagtaatacctttgaaatgaacggcaaagccctgctgctgctgaccaaggaggacttccggtatagaagtccacactcgggcgacgtgctctacgagctcctgcagcacatccttaaacaacgtaagccacggatcctttttagcccatttttccacccaggaaacagtatccacacacagcctgaggtgatcctgcaccagaaccacgaggaggataattgcgtccaaaggacaccacgtcctagcgtggacaacgttcaccacaaccccccaacgattgagctgctacaccgctcacgcagcccaatcacaactaatcatagaccctccccagatcctgagcaacgaccgctgcgctccccccttgataacatgattcgacggctgtctcccgcagaaagggcacagggcccccgtcctcaccaggagaacaaccaccaggagtcttacccactgtcagtgtctcctatggagaataaccactgtcctgcatcctccgagtcacacccgaagccttcctcccccaggcaagaaagtactagggtcatccaacttatgcccagtccgatcatgcacccattgatccttaaccctcgccattctgttgactttaaacaatcccgcctgtcagaggatgggctccatagggagggtaagcccatcaacttatcccaccgggaagatctcgcgtatatgaatcacatcatggtgtcagtctccccgccggaggagcatgccatgcctatcggaaggatcgctgactgcaggcttctgtgggactatgtgtatcaactcctgtctgacagtcgatatgagaatttcatcaggtgggaagataaagagtcaaagatatttcggatcgtcgatcctaacggactagcccgactttggggcaaccacaagaatcggactaatatgacttacgaaaagatgagccgggcgctgcgccactactataaacttaatatcatccgcaaggaaccaggtcagcggttgctgtttagatttatgaaaactccagatgaaataatgtcaggtcggacggatcgcctcgaacatctggaaagccaggagttggacgaacagatctatcaggaggatgagtgttag

SEQ ID NO: 116139 - DNA, 954 bp, Artificial Sequence
  Description of Artificial Sequence: Synthetic coding sequence
atgcaggaaggcgagctagccattagcccaatcagccccgtggctgccatgccacccctcggtacacacgttcaagctcggtgcgaggcgcagattaaccttctgggcgagggaggcatctgcaagttgccagggaggctgcgcattcagcccgctttatggagcagggaggatgtactccattggctacggtgggccgagcaggaatactcgctgccttgcaccgcagagcacggcttcgagatgaacgggagggctctctgcattttaaccaaagacgacttcagacaccgagcaccttcaagcggtgacgttctctacgaacttctgcaatacatcaagacccagcgtagagcgctggtgtgtgggccattttttggcggaatctttcgcctcaaaacacctacacaacactctccagtccccccggaggaggtgaccggcccctcccagatggacacccgcagaggccatctcctccaaccccccgatcccgggctgacaagtaattttggtcacctcgacgatcccggtttggctcgctggaccccaggaaaagaggagagcctcaacctgtgtcactgcgcagaactggggtgccggacccaaggtgtatgcagttttcccgctatgccccaggctccaattgacggtcggatagcggactgtcgtctcttgtgggattacgtctaccagctgctgttagacactaggtacgagccatatattaagtgggaagataaggacgctaagatcttccgggttgtcgacccaaatggattggctcgactgtggggcaaccataagaatcgggtgaacatgacttatgagaagatgagccgagcgttaagacactattacaaactgaacatcattaaaaaagagcctggccaaaagctactctttcggaacggacttcagctgattttcatctttatttggtcctttcagtag

SEQ ID NO: 116140 - DNA, 1026 bp, Artificial Sequence
  Description of Artificial Sequence: Synthetic coding sequence
atgcaagagggcgagctggccatctcccccatcagtccagtcgcagcgatgcctccgttgggaacccacgtgcaggcaagatgtgaagcgcagatcaatttactgggggagggcgggatttgtaagttgcctgggagactgcgaatacagcccgccctgtggtctcgggaagacgtgctgcattggctgcggtgggctgaacaggagtatagtctgccatgcacagccgagcacggcttcgagatgaatggccgggccctctgcattctgaccaaggatgacttcagacacagggccccctcctcaggtgacgtgttgtatgagctgttgcagtatatcaagacccagagacgggccctggtttgtggccctttcttcggtggcattttccgtctcaaaacccccactcaacattctcccgtaccccctgaagaggttactggacctagccagatggacacccgtagagggcatctcctgcaaccacctgatccaggtctgaccagcaatttcgggcatcttgacgacccaggtttagcccgctggacccctggaaaagaggagtcattaaacctgtgtcattgcgctgagctaggctgcagaactcaaggagtgtgttccttccctgcaatgccccaggcaccaattgacggcagaatcgctgactgtagactgctgtgggactacgtgtaccagttactgctcgatacgagatacgagccctacatcaaatgggaagacaaagatgctaagatcttcagggtggttgatccgaatggattagcacggctttggggcaatcataagaaccgggtgaacatgacatatgagaagatgtccagagctctccgccactactacaagctcaacattattaaaaaggaaccagggcagaaactcttgtttcgttttctaaaaactccaggaaagatggtgcaggacaagcacagccatttggagccgctcgagagccaggagcaggatagaatcgaattcaaggacaagcgtcccgagatttctccttag

SEQ ID NO: 116141 - DNA, 795 bp, Artificial Sequence
  Description of Artificial Sequence: Synthetic coding sequence
atgcaggagggcgagctggcaatttctccaatctcaccagtggcagctatgccaccactaggaacccacgtgcaagccaggtgtgaagcccagattaacttactgggagaagggggcatctgtaagctgcccggtaggttaaggatccagcccgcgctttggagtagggaagacgtgttgcactggcttcgttgggccgagcaggagtacagtttaccatgtacagcagaacacggctttgagatgaacgggcgggccctctgcatattgaccaaggacgacttccgccacagggctcctagctccggcgatgtgctgtatgagctgcttcagtacatcaaaacacagcgcagagctctcgtctgtgggccattcttcggaggaatcttccgcctcaagactcctacccagcacagcccagtgccacccgaagattgtcggctgctttgggattatgtctaccagctgttactagatacgcgctatgaaccatatattaagtgggaggataaagacgctaagatcttccgtgttgtcgacccaaacggattagccagactgtgggggaatcacaaaaacagagtgaacatgacttacgagaagatgagtcgagccctccgacattactataagcttaatatcatcaagaaggaacctgggcagaaacttctgttcagatttctaaaaacacctggtaaaatggtccaggacaagcactcccatctggagcctctggaatcccaggaacaggaccggattgagtttaaagataagagacctgaaatttcgccttag

SEQ ID NO: 116142 - DNA, 861 bp, Artificial Sequence
  Description of Artificial Sequence: Synthetic coding sequence
atgcaggagggtgagttagccatatcacctattagtccagtggctgctatgccccccctcggtactcatgtgcaggccaggtgcgaagcccaaataaatctgctgggggagggtggcatttgcaagttgcctggaaggctcagagatgtcctgtatgaattattgcagtacataaaaacccagaggagagccctggtttgcgggcccttcttcggggggatcttccgacttaagaccccaacccaacacagtcctgtgcctccagaggaagtgaccggcccatcccaaatggatacaagaagaggacatctcctgcagccaccggatcccggattaaccagtaattttggccacttagatgatccaggactcgcccggtggacccccggtaaggaagaatccttgaatctgtgccattgtgcagagctgggctgcaggacgcagggggtgtgttctttcccagcgatgccccaggccccgattgacggtcgtattgcggattgtcggctgttatgggattacgtgtaccagctgctgctcgatactcgctatgagccctacatcaagtgggaggacaaggacgccaagatcttcagggtagttgatcccaacgggcttgcccgactttggggtaaccacaagaaccgcgtgaacatgacttatgaaaagatgagccgggcactgaggcactattacaaactgaatattataaaaaaggaacctggacaaaagcttcttttccgttttttaaagacccctggaaagatggtccaggacaaacattctcatctcgagcctctcgaatctcaggagcaagatcggatcgagtttaaggataaacgccctgaaatctcaccttag

SEQ ID NO: 116143 - DNA, 573 bp, Artificial Sequence
  Description of Artificial Sequence: Synthetic coding sequence
atggacaccaggagaggccatctgctacagcctccagatcctggtctgacttccaacttcgggcacctcgacgacccggggttagccagatggaccccaggcaaggaagagagtctgaatctttgccactgcgccgaactgggatgccgaacacagggggtgtgttccttccccgccatgccgcaggcgcctatagatggaagaattgccgattgcagattgctatgggattatgtatatcagttgttgctcgacactcgctatgaaccatacatcaagtgggaggacaaagatgccaagatcttccgcgttgtcgaccctaacggactcgcaaggctatggggcaatcataagaacagagttaacatgacttacgaaaaaatgagtcgtgccttacgtcactactacaagctgaatatcatcaaaaaggagccaggccagaaactccttttccgtttcctgaaaacacctggcaaaatggtgcaggataagcacagccatctggaaccgctggagtctcaggagcaggataggatagaatttaaggacaaaaggcctgagatctcaccgtag

SEQ ID NO: 116144 - DNA, 1242 bp, Artificial Sequence
  Description of Artificial Sequence: Synthetic coding sequence
atggccagctgtgcagaaccttctgaaccatcggcccccctgcctgcaggggttcctcctctcgaagactttgaagtgttagacggtgtcgaagatgccgagggggaagaggaggaagaggaagaggaggaggaggaggacgatctgtctgagctccctccattggaggacatgggtcagccgccagcggaagaagccgagcagcccggcgcactcgcccgagaatttcttgcggccatggagccagagccagcacccgcacccgcacccgaagaatggctggatattctcggcaacgggctgcttaggaaaaagacccttgtacccggaccaccggggagctccagacccgtcaaagggcaagttgtgactgtccacctgcagacgtcactcgaaaacggaacacgggtgcaggaagagcccgaactggtgtttaccctgggtgattgcgatgtgattcaggcgctcgatttatccgtcccgctcatggatgtgggtgaaactgctatggtgactgctgattccaagtactgttacggcccacaaggctctcgtagcccctacattcccccgcacgcagcgctgtgtctcgaggtcaccctcaagacggcagtcgatggcccggatctagaaatgctgaccggtcaggaaagagtggcgctggcaaacagaaaaagagagtgtgggaacgcccactaccagcgcgctgattttgtgttggctgccaacagttatgatttggccataaaagctatcacctcatcagcaaaggttgacatgaccttcgaggaagaagcgcagctgctgcagctgaaggtgaagtgtctgaataacctggcggcctcccaattaaagctggaccattaccgcgccgctctaagatcgtgctcgttggtgctcgagcaccagccagacaatatcaaggccctgttccgaaaaggcaaggtgcttgcgcagcagggcgaatactctgaagctattcccatcctcagagccgctctgaaactggaaccatcaaacaagaccatccatgctgaactatccaaactcgtcaagaagcacgccgcacagcgctccaccgagacagcactgtatcgcaagatgcttggaaatccaagtcgattacctgccaagtgtcctggcaagggggcatggagtataccctggaagtggctattcggagcgactgctgtggcgttgggaggcgtggcactctctgttgttatcgctgcacggaactag

SEQ ID NO: 116145 - DNA, 1422 bp, Artificial Sequence
  Description of Artificial Sequence: Synthetic coding sequence
atgaattatgataagctgagccgcgccctcagatattactacaataagagaatcctgcacaagactaaggggaagagatttacctacaagtttaattttaataagcttgtgctcgtcaactatcccttcattgacgtggggcttgcggggggagccgtgccccagtcagctccccccgtcccttccgggggttctcatttccggttccctccttccaccccaagcgaggtgctgtctccaactgaggacccacgcagccctccagcatgttcctcttctagctccagcttgttctctgccgtggttgcacgtaggttgggacgaggctcagtcagcgactgttcggacggaacaagcgagttggaagagccacttggagaggatcctagagctaggccgcctggtccccccgacctcggggctttccgcgggccgccactcgccagacttcctcatgacccgggcgtgttccgcgtttatcctaggccacggggtggccccgaaccccttagtcccttccccgtcagccccctggcagggcctgggtccttgttgccaccacagctatctccggctttgccaatgaccccaacacaccttgcctatacaccaagtccaacactgtcccccatgtacccatccggcggcggcggcccctcagggtctggcgggggctcccatttttccttttctcctgaggacatgaaaagatacctgcaggcccacacacagagtgtatataactaccacctgtcccctagggccttccttcattacccagggttggtcgtgccacaaccacagcggccagacaagtgcccgttaccccctatggctcccgagacacctcctgtcccatcctcagcaagctcatccagcagttcatccagtagcccctttaagttcaagttgcagccaccccccctgggtcgtcgacagagagccgctggggagaaggccgtggcgggcgccgacaagagtggagggagtgccggaggcttggccgagggtgcaggcgcactcgctccaccaccgccaccacctcagattaaggtcgagcccattagcgaaggtgagagcgaagaagtcgaggtcaccgacatttccgacgaggatgaagaggacggtgaagtctttaaaactccaagggctccacctgctcctcctaaacctgaacctggggaggcaccaggcgcctctcaatgcatgcccctaaagctgcgattcaaaagaaggtggtccgaagactgtagactggagggcggggggggcccggcaggggggttcgaagacgagggcgaagacaagaaagtgcgaggcgaagggcccggcgaggccggggggcccttaactccgaggagggtctcgagcgatttgcagcatgccaccgcacagttatcgctggagcaccgggactcgtag

SEQ ID NO: 116146 - DNA, 2478 bp, Artificial Sequence
  Description of Artificial Sequence: Synthetic coding sequence
atggcggccgatgagggaagcgctgagaagcaggccggcgaggctcacatggcagcggatggtgagaccaacggtagctgcgaaaattctgatgcctcttcccatgctaatgcggctaagcatacacaggactccgctcgggtcaacccccaagatggtaccaacaccctcactagaatcgccgaaaacggggtctcagagcgcgattccgaagccgcaaagcagaaccacgttacggccgacgattttgttcaaacatctgtcataggttcaaatggttatatcctcaacaagcctgcccttcaagcccagcctctcagaaccaccagcaccctcgccagttccttgccggggcacgccgctaagaccttgcccggcggcgcgggaaaggggaggaccccctcggcctttccgcagactcctgccgcccccccagcaacactgggcgaaggaagcgccgataccgaggaccgcaagcttccagcacctggggcggatgtcaaggtacatcgcgcgaggaaaaccatgcccaaaagcgtggtgggactccatgctgcttcaaaggatcctagggaggtgagagaggctcgcgatcataaagaaccgaaggaagagatcaacaagaacattagtgacttcgggaggcagcagctcctgcccccctttccgagtctacatcagtcactcccccagaaccagtgctatatggccactaccaagtcccagacagcttgtttgccttttgtgctggctgcagcggtgagcaggaagaagaagagacggatggggacttacagtctagttccaaagaaaaaaaccaaagtgctgaagcagcggaccgtgattgaaatgtttaaaagcataacccacagcaccgtgggctccaagggggagaaggacctgggggcctctagtctgcatgtaaatggcgagagcttagagatggattccgatgaagacgacagcgaggaactcgaggaggacgatggtcacggggctgagcaagctgcagcctttccaacagaagattctaggacaagcaaggaatctatgagcgaggcagacagggcacaaaagatggatggggagagtgaagaggagcaagagtctgtggatacaggcgaggaagaagaaggaggtgacgaatccgatctgtctagtgaatccagcatcaagaagaagttcctgaagaggaagggaaaaacggacagcccatggattaaaccggcaagaaagcggcgccggcgctcaaggaaaaagccatcgggggctctagggtctgaatcctataaatcatccgcagggtccgcggagcagaccgctccgggcgatagtaccggctatatggaagtatctctagattccctggaccttcgagtcaaggggatcctttcctcccaggcagaaggacttgctaacgggccggacgtactggagacagacgggctgcaggaggtaccattgtgtagctgccgaatggagacccctaagtctagagagatcaccactctcgctaataatcagtgtatggctacagaatcggtggaccacgaattgggacgttgcacaaatagcgtggtcaaatacgagctgatgcggccttctaataaagcccccctgctcgtactctgcgaggaccaccgtggcaggatggtcaaacatcaatgctgccctgggtgtggctacttttgcactgccggcaattttatggaatgccagcccgagtccagcatctcacacagatttcataaggactgcgcttcgagggtgaacaacgccagttactgccctcattgcggagaggagagttccaaggctaaggaggtgacaatcgccaaggctgatacaacgagcacagtcactcctgtgcccggccaggagaaaggctctgcactggagggccgtgctgacactaccaccgggtccgccgccggaccccccttatcggaagatgacaagctgcaaggcgccgctagccacgtgccggagggtttcgatcctaccgggcccgccggactcggacgccccactcctggcttgtcacaggggcctggcaaggagaccctcgaaagcgcgttgattgcgctggactccgaaaagcccaagaagttgcgatttcatccaaagcagctttattttagtgcacgccagggagagctgcagaaggtgttgctcatgttagttgacggcattgatccaaatttcaagatggaacatcagaacaagcggagcccgctgcacgctgccgccgaggccgggcacgtagacatctgccatatgctggtccaggcaggcgctaacatagatacatgttccgaggaccagagaacgcccctgatggaagctgctgaaaacaatcacttggaagcagtgaaatatctcatcaaagccggggccttagtcgatccaaagattcaaaaaacaagcaaagtatacacggaatcacaggagacccagagatctcagacgattctctag

SEQ ID NO: 116147 - DNA, 3462 bp, Artificial Sequence
  Description of Artificial Sequence: Synthetic coding sequence
atggcggcggatgagggttcggcagagaagcaggccggagaagcacatatggccgctgatggagagactaacggcagttgtgaaaacagtgatgcctcctcccatgctaatgcggcgaaacatacccaggactctgctcgcgtcaacccacaagatggaaccaatactctcacccgaattgccgagaatggcgtgtcagaacgtgatagtgaggcagcgaaacagaaccatgtgactgccgatgatttcgtgcagacctccgtcattggaagtaatgggtacattttaaacaagccggccctacaggctcaacccctgagaacgactagtacactagcctcttccttacccggacatgccgccaaaactttgccagggggcgccgggaagggtaggacccctagtgctttcccgcaaacaccagctgctccgccagctacactaggagaagggagtgctgacaccgaagacaggaagctgccagccccaggcgcggacgtgaaagtccacagagctcgcaagaccatgcctaagtctgtggtgggcctacatgctgcatcaaaagaccctagagaagtaagagaagcaagggatcacaaagagccaaaggaggaaattaacaagaacatcagcgacttcggtcggcagcagcttctgccgccgtttccaagtctccaccagtccctgccacagaaccagtgctatatggctaccactaaatctcagacagcttgtctgcccttcgttctagccgccgctgtgagccggaagaagaaacggcggatgggtacatacagtctggtcccaaaaaaaaagaccaaagtcctaaagcagcgcacggttatcgagatgttcaagagcatcacccatagcactgtgggtagcaagggtgagaaggacctgggtgcgagctcactccacgtgaacggagaaagtctggagatggactccgatgaggacgacagtgaagagctagaggaagacgatggccacggggcggagcaggcagcagcctttccaacggaggattctcggaccagcaaagagtccatgagcgaagctgatcgggctcagaaaatggacggcgaatcggaagaagaacaggagtcagtggacactggtgaagaagaggagggcggcgacgagtctgacttatctagcgagtcaagcataaagaaaaaatttttaaaacgtaaagggaagacagactccccttggataaaacccgcaaggaaacgtagacgcagaagtcgtaaaaaaccaagcggtgccctgggttctgaatcttacaagagttcagcgggctccgctgagcagacagccccaggggattccacgggatatatggaggtgtcactggacagcctggacttgagagtgaaaggcattctctcatcccaagccgagggactcgcgaacgggcctgacgtactggagaccgacggcctccaggaggtcccattatgtagttgccgaatggaaacaccgaagtccagagaaatcacaactctagctaacaatcagtgtatggctaccgaatctgtcgaccatgaactggggcgctgtacaaattccgtggtgaaatacgagctgatgcgccctagtaacaaggccccactgctagtgctttgcgaggaccatcggggcaggatggtaaagcaccaatgctgtccaggctgtggttacttttgtaccgccggtaattttatggagtgccagcctgagtccagcatcagccaccgattccataaagattgcgcatctagggtcaataatgcctcctattgccctcactgcggggaggaatctagtaaagctaaagaggtgacgattgccaaagccgacactactagcaccgtcacacctgttccggggcaagaaaagggcagtgccttggagggaagggcagacactaccacaggatccgctgcaggcccaccattgtcggaggacgataaactgcagggggcagcctcacacgtaccggaaggctttgatcccactgggccagctggcttggggcgcccaacccccgggctgagtcaaggccctggaaaggaaactcttgagtcagccctcatcgctctggacagtgagaaaccaaagaagcttcgatttcaccccaaacagctgtattttagtgctcgccagggtgaactacagaaagtcttacttatgctagtggatggcatagaccctaattttaagatggagcaccagaataagcgatcgcctcttcatgcagcggcggaagcaggacatgtggatatctgtcacatgctggtgcaggctggcgcaaacatagatacctgttccgaggaccaaaggacgccactgatggaggccgctgaaaataaccatttagaggccgtcaagtaccttataaaggctggggcgctagtggaccctaaagatgctgaggggagtacatgtctccatttagctgcgaagaagggccactatgaggtcgtccagtatctcctaagtaatgggcagatggacgtcaattgtcaggatgatggaggctggacacctatgatatgggctaccgaatataagcacgtggacctggtgaagctactcctctccaagggatccgacatcaatattcgggacaatgaagaaaacatctgcctgcactgggcagccttttctggctgcgtggatatcgctgagatcttactggcagctaagtgtgatctgcacgccgttaatatccatggggattctcctttacatattgccgcccgcgagaaccgttacgactgcgtcgtcctgttcctgtctcgagattcagatgtaactctgaagaacaaagagggggagacccctctgcaatgcgccagcctgaattcccaggtctggagtgcactacaaatgtcaaaggctctccaagactccgcccccgatcgaccatctcccgtcgagcgcatcgtttcacgagacattgcccgcggctatgagcgcatcccaatcccatgtgtgaatgccgtcgactccgagccatgtcccagcaattacaagtacgtgtcccagaattgcgtcacgtcacccatgaatattgatcggaacatcactcatctccagtactgcgtctgtatcgacgactgttcttcttctaactgcatgtgcggccagctgagcatgcgttgttggtacgacaaagatggccgactcctccccgaatttaatatggccgagccaccactgatcttcgaatgcaatcacgcatgttcctgctggcggaattgccgcaacagggtcgtccagaatgggttgcgggcgcgtttacagctgtatcggacaagggacatgggctggggagtacgaagcttgcaggatattccaccaggcacctttgtctgcgagtacgtgggcgagttgattagtgattccgaggcagacgtgagagaggaggattcatatctgttcgatctggataataaggttattagcgcatag

SEQ ID NO: 116148 - DNA, 3897 bp, Artificial Sequence
  Description of Artificial Sequence: Synthetic coding sequence
atggctgcagcagacgcagaagctgtgcccgcaaggggggaacctcagcaggattgttgtgtgaaaactgagcttctaggagaagaaactcccatggctgctgacgaagggtccgctgagaagcaggccggagaagctcacatggcagctgatggagagaccaacggctcttgtgaaaactcagatgcctctagtcacgctaatgctgctaaacatacccaggacagcgccagagtgaatccgcaggatggtaccaatactctgacccgcattgctgaaaacggggtgtctgaaagggactcggaagcagcgaagcagaatcacgtcactgcagatgactttgtccaaacatccgtgatcggatccaatggctacattctaaataagccggcactgcaagcacagcctttacggaccacatctacactggcgtcaagcctcccagggcatgccgcaaagaccctgcctggaggggctgggaaggggcggactccatccgcctttccacagacaccggcggctccccccgctacactgggtgagggctccgctgacaccgaggatcgcaagttacccgcacccggcgctgatgtgaaagttcatagggctcgcaagactatgccaaagtctgtcgtcggactgcacgccgccagcaaggatcctagagaagttagagaggccagggaccataaggaacccaaggaagagatcaacaagaatatctctgattttggccggcagcagctgctgcctcctttcccttcgctgcaccagtcgcttccacagaaccagtgctacatggctacaacaaagtcccagaccgcttgtctgcccttcgtgctggctgcagcagtgagccggaaaaaaaagcgacgtatgggcacgtatagcttggtgccaaagaagaagaccaaggtgctcaaacagaggacagttattgagatgtttaaatccattacacatagcactgttggttctaagggagaaaaggatctcggagcctcatcactgcatgttaacggggaaagcctagaaatggattcagatgaggatgactccgaggagttagaggaggacgacggacacggcgccgaacaggctgcagccttcccaaccgaagacagtaggactagcaaggaatcaatgtccgaagccgatagggcccagaagatggacggtgagtcagaagaggagcaggagagtgtggatactggcgaagaggaagaagggggcgatgagtccgacttgagctccgagagttctattaaaaaaaagttcctgaaaaggaagggtaaaacagactctccatggatcaaaccggctaggaagcgcagacggaggtcccgcaagaagccctcgggggcgttaggtagcgagtcctacaaaagctcagccgggtcagcagaacagacagctcccggagattctacaggctacatggaagttagcctcgacagtctggatctacgagtgaaaggcatcctttctagccaggccgaggggctagcgaacgggccagatgttctcgagactgatggactacaggaggtgcctttgtgttcgtgccggatggaaacgccaaagtccagggagattactactctcgccaataatcagtgcatggctacggagtcagtggatcacgagcttggtcggtgcactaatagtgttgtgaagtatgagctgatgcgccctagcaataaagcacctcttctggttttatgtgaggaccaccggggcagaatggtgaagcaccagtgctgtcctgggtgtggctatttctgtacagccggcaactttatggagtgtcagcccgagtcatcaatttcccatcgttttcacaaagactgtgcaagtagggttaacaatgcatcttactgtccccactgcggggaggagagctctaaggctaaagaagttaccattgctaaggccgatacaactagtaccgtgactcctgtgccaggacaggagaagggctctgccctcgagggaagggctgacaccacaaccgggtctgctgctgggccccctctcagcgaagacgacaaattacaaggagccgcatcccatgttcctgaggggttcgaccccacaggacccgctggtctggggagaccgactcctgggttgtctcaaggccccggcaaggagaccctggaatccgcgttaattgcactcgactcagagaagccaaagaaactgcgcttccacccaaagcagctttactttagcgccaggcaaggcgagctgcagaaagtgctgctgatgctcgtggatggaattgatcctaattttaagatggaacatcagaataagcggagccctctccatgccgccgcagaggccggccacgtggacatatgtcacatgctagtgcaggccggtgctaacatcgatacttgctcagaggaccaaaggacgcctctgatggaggctgccgagaacaatcatctggaagcagtgaaatacctcataaaagccggcgctctggtcgaccccaaggacgccgagggaagtacttgcctccatctagccgcaaaaaagggtcactatgaagtcgtgcagtatttgttgtccaatggccagatggatgtcaactgtcaagacgacggaggctggacaccaatgatatgggctacagagtataaacacgtcgatctggtgaagcttctactctcaaaaggctcggatatcaatatcagagacaacgaggagaatatttgtctccattgggcggcgttcagcgggtgcgtggacatcgcagaaatacttctggccgcaaagtgcgacctgcatgcggtgaatattcacggagatagcccccttcacatagccgcccgtgaaaacagatatgattgcgtggtcctgtttctgtcccgggatagcgatgtgacgctcaagaataaagaaggagagactcccctccagtgtgccagcttgaatagtcaggtctggtctgccctgcagatgtccaaagcgctccaagactcggctccggataggccatcccccgtggagcgtattgtgagccgagacattgcacgcggatacgagcggattcctatcccctgcgtgaatgcagtggacagcgagccatgccccagcaattataagtatgtgagccagaactgcgtgacatcacccatgaatattgataggaatatcacccacttgcagtactgcgtgtgcatcgatgactgcagctcctccaactgcatgtgtgggcagctgtcaatgaggtgctggtacgataaagatggccgtttactgccggaatttaacatggctgagcctcccttgatattcgaatgcaaccacgcatgctcctgctggagaaactgccgtaatagagtggttcagaacgggctacgtgcccgcttgcagctctatcggacgagagatatgggatggggagtgaggtctctgcaggacattccccctggcacattcgtgtgtgaatacgtgggggagctgatctcagactcagaagccgacgtcagagaggaggacagttacctgtttgacctggataacaaggacggggaggtttactgcatcgacgctcgtttctacgggaatgttagcaggtttataaatcatcactgtgaaccgaacctggttccagtcagggtattcatggcccaccaggacctaagatttccacggattgctttctttagcacccggctcatcgaggccggggaacaactgggctttgactacggtgagaggttctgggacatcaagggcaaactgttcagctgtcgctgtgggtctccaaagtgtcggcattcgtctgccgcccttgcccagcggcaggcttctgctgcccaggaagcgcaagaggacggactgccggacactagctctgcagccgccgcagatcccctctag

SEQ ID NO: 116149 - DNA, 2427 bp, Artificial Sequence
  Description of Artificial Sequence: Synthetic coding sequence
atggctgctgccgatgctgaggccgttcccgccaggggggagccccagcaggactgttgtgtcaaaactgagctgctgggcgaggagaccccaatggccgccgacgagggcagcgcagagaaacaagccggggaggcccacatggccgccgatggagagacaaacggctcttgtgaaaattctgatgcctcttcgcatgccaatgctgccaaacatacacaggattcagcccgtgtgaacccccaagatggcaccaatacccttacgaggatcgccgaaaacggggttagcgagcgcgattcggaggccgcgaaacagaatcatgtgactgccgatgatttcgtgcagaccagtgtgattggctccaatggctacatcctgaataaacccgctctacaggcccagcctttgaggacgacttccacacttgcgtctagtctcccaggccacgccgccaaaactctaccagggggagctggcaaagggagaacccctagcgcttttccacagactcccgctgcaccgcctgccacgctaggagaggggagcgctgacacggaagacagaaagctccccgctcccggggccgatgtcaaagtgcaccgcgcaagaaaaacgatgcccaagtcggtcgtgggccttcatgccgcctcaaaagatccacgagaagtgagagaagcaagagatcataaggagcccaaggaagagatcaataaaaatatctcagacttcggtcggcaacaattactcccaccattcccatcgctccaccagtcactccctcagaaccaatgttacatggccactacgaaatcccagacagcctgcctacctttcgtgctggctgccgcggtgtcacgaaagaaaaaaagaaggatgggcacctactcccttgtgcctaagaaaaagaccaaagtgctgaaacaacgaacagtgatcgagatgttcaaatccatcactcacagtacagtgggcagcaagggggaaaaagatctaggggcatccagcctgcatgtgaatggtgaatcactggagatggacagcgatgaagacgattccgaggagctggaagaagatgatggacacggcgctgagcaggctgccgcctttccgactgaggacagccgtacttctaaagaatccatgagtgaggctgaccgcgcacaaaagatggacggagagtctgaggaggaacaagagtctgtcgatacaggagaggaggaagagggaggcgacgaatccgacctatcttccgagtccagcattaaaaagaagtttctgaagaggaagggtaaaacagattccccgtggattaagccagcaagaaagcggcggcgtcgcagtcgaaaaaaacccagcggagcattgggctctgaaagctacaagagttccgccgggtctgctgagcaaacagcacccggcgacagcactggatatatggaggtcagcttggattctctggacttgcgcgtcaaggggatcctcagcagccaggctgaagggttggccaatggtcctgatgtgctcgagacagacggcctgcaagaggtgcctctgtgcagctgccgcatggagacgcccaaaagtcgcgagatcacgacactggctaacaaccagtgtatggccacagagtcagtggatcatgaactcggcagatgcactaacagcgtggtgaaatacgaactcatgagaccatctaataaagcccccttgttagtgttgtgtgaggatcaccggggcaggatggtgaaacaccagtgctgcccaggatgcggatacttttgtacggccgggaattttatggagtgtcaaccagagtccagtatcagccatcgatttcataaggattgcgcatctagagttaacaacgctagctattgtccccactgcggcgaagagtcttctaaggccaaggaggttactatagccaaggccgatactacaagcacggttacccccgtccccggccaagaaaagggatctgctctggagggtagggctgacactaccacaggctccgctgcggggccgccgctttccgaagatgacaagcttcagggggcagcttctcatgtgccggagggatttgatccaactggcccggccgggctcggacggccgacccctgggctgtcccagggtccggggaaagagaccctcgagtccgccctgattgccctagattcagagaagcctaagaagttaaggttccacccaaagcaactttacttttccgcccgtcagggggagttacagaaagtgctgttgatgctcgtggacggtatcgatccaaacttcaagatggaacaccagaacaagagatctcccctccatgcagctgccgaggccggccatgtcgacatctgtcacatgctagtgcagttttgcagacttggatctcctaggtctagagggtgtctttggtag

SEQ ID NO: 116150 - DNA, 3702 bp, Artificial Sequence
  Description of Artificial Sequence: Synthetic coding sequence
atgcgcgggcttcctcgaggacgcggtctcatgcgggcccgggggaggggacgagctgcgccacccggttcaagagggcgtggtagaggaggacctcaccgggggcgagggcgcccccgatctctgctgtcattgcctcgcgcccaggcctcttggacaccccaattgtctacaggcctcactagcccccctgtgccttgtctgccttcacagggagaggcacccgccgaaatgggagcactgctgctggaaaaggaaaccaggggggctaccgagagggttcatggaagcctaggagacacacctcggagcgaggaaactctgcctaaggcaactcccgattcgctcgaaccagccggcccttcaagtccggctagtgtgactgttacagttggtgacgaaggagccgacacccccgtcggagccacccctctcattggcgacgaaagtgaaaatctcgagggagatggtgaccttagaggaggccgcattctgctcgggcatgcaacaaagagtttcccatcgtccccatcaaaaggcgggtcttgtccttcccgagccaagatgagcatgacaggcgccggcaaatctccccccagcgtgcagtccctggcaatgaggttgctctctatgcctggagctcagggagctgctgccgccggttccgaaccacctccggcaacaacttcacccgagggacaacccaaagtccatagagcaaggaaaacaatgtcaaaaccggggaatggccagccgcctgtacctgagaagagaccacctgaaatccagcattttagaatgtccgacgacgtgcacagcctcggtaaagtgacaagtgacctcgccaagcggcggaagctaaattctggcggcggtctgtcagaagagctaggatcggctcgtagatcaggagaagtcacacttaccaaaggagatcctggatccctggaggagtgggagacagtcgtcggagatgatttctccctatattatgacagctactccgttgatgagcgcgttgactcagactctaagagcgaagtggaagcgcttactgagcaactgtccgaggaagaggaggaagaggaggaggaagaggaagaagaggaagaagaggaggaggaggaggaagaggaggaagacgaggaatcggggaaccagtccgatagatccgggagctcaggacgtcggaaggccaagaagaaatggaggaaagattccccctgggtaaaaccgagccggaagcgaagaaaacgggaaccaccaagagccaaagagccccggggagttagcaacgacacatcctcccttgaaactgagcgcgggtttgaggaactgcccctgtgtagttgcagaatggaggcccctaaaattgatcggatttctgagcgagccggccataaatgtatggccacggagtcagtggacggggagttgagcgggtgtaatgctgcaattctcaaacgtgagactatgaggccgtccagtcgagtggccctcatggttctctgcgagacacatcgcgctcggatggttaaacatcactgctgtcccggctgcggttatttttgtaccgcaggcacttttctcgagtgtcatcctgatttccgagtggcgcaccgtttccacaaagcatgtgtatctcagctgaatggtatggtattctgcccgcattgcggagaggatgcctctgaggctcaggaggtgacaattcctagaggagacggtgtcactccgccagcaggaaccgccgcacccgctcccccgccgctgtcccaggatgtgccgggaagggccgacacatcccagcccagcgctaggatgaggggccacggcgaaccccgacggcctccttgtgaccccctagccgatacgatcgactctagtggtccgtctcttacgctgccaaatggcggttgcctgtccgccgttgggttgccactaggccccggcagagaggcactcgaaaaagccctggttatacaggaatccgagcgcaggaagaagctaagattccatccccggcaactctacctctctgttaagcagggagaactccaaaaggtgattctaatgcttctggacaacctagaccccaacttccaatctgatcagcagagcaagagaacacccctgcatgccgccgcacaaaagggttctgttgaaatttgtcacgttttgctacaggccggagccaacattaacgctgtcgacaaacaacagcgcaccccccttatggaggctgtggtcaataaccacctggaagttgcgaggtacatggtgcaacgaggaggatgtgtgtattccaaagaagaagacggctcgacgtgtctgcatcacgcagccaagatcggcaatctggaaatggtatccctgctactgtcaacaggccaggtagatgtcaacgctcaggattctggaggatggaccccaattatttgggcagccgaacacaagcatatcgaagtaattcggatgctgctaacacgcggagccgatgtcacactgactgataatgaggaaaacatctgtcttcattgggctagctttacgggttctgcagccatcgccgaggtgctgctcaatgctcggtgcgacctccacgctgtcaattatcacggcgatacaccgctccacatagccgcaagagagtcataccacgactgtgttcttctgttcctgagccgcggggccaacccagaactgagaaataaggagggcgacacagcatgggatctgacaccagaacggtcggatgtgtggttcgccctgcaactgaaccgcaaactaaggttaggtgtaggcaaccgcgccatccggaccgagaaaattatctgtcgcgatgtggcccgggggtatgagaatgtaccaatcccgtgtgtgaatggcgtggatggggaaccatgtcccgaggactataagtacatttccgaaaactgtgagactagcactatgaacattgacaggaatataacccatttgcaacactgcacttgtgtggacgattgctcctcctctaattgtctgtgtggacagcttagtatcagatgctggtacgacaaggacggtcggcttttacaggaatttaacaaaatcgagcctccattgattttcgagtgcaatcaggcttgctcttgctggcggaattgcaagaacagggtggttcagagtggcatcaaagtgcggctgcagttgtatcgcacggccaaaatgggatggggcgttcgcgcattgcaaacaatcccacaggggactttcatttgcgagtatgtgggagagctgatctccgacgccgaggccgatgttagagaggatgattcttacctcttcgatctggacaataaagatggggaggtgtattgcattgatgcccgatattatggcaacatttcccgattcattaatcacctgtgcgatccaaatattatcccggtgcgggtgttcatgctgcatcaagacctcagatttccaagaattgccttctttagttctcgggacattaggactggagaagagcttggttttgactatggcgacaggttctgggacataaagagcaaatacttcacgtgccagtgcggatccgaaaagtgtaaacactctgcagaggccattgccctggaacaatcgaggttagcacggctggatcctcacccagaactattaccagaattaggcagtctgccacccgtcaacacatag

SEQ ID NO: 116151 - DNA, 3531 bp, Artificial Sequence
  Description of Artificial Sequence: Synthetic coding sequence
atggcagccgctgcaggtgcagcagcagctgcggctgcggagggagaggcacccgcggaaatgggcgctctattgctggaaaaagagacacgtggcgctaccgagcgcgtacacggatctctaggcgacactcctagatctgaggagacccttcccaaggctaccccagacagccttgagcctgccggcccttcttccccagcctctgttaccgtgaccgtgggcgacgagggcgctgacacccctgttggcgcaactccactgatcggagacgaaagcgagaatctggaaggagacggggatctaagaggcggtaggattctactgggccatgccacaaagtctttccccagctctccatctaagggggggtcttgccccagtagagctaaaatgagtatgactggagctggaaaatcgccccccagcgtacaaagcctggcaatgaggcttctatcaatgccgggcgctcagggcgcggccgccgccggatccgaacccccgccggcaaccacctcgcctgagggccaaccgaaggtgcaccgtgcccgcaagaccatgagtaagccaggcaacggacagccacccgtgcccgaaaaacgtccgcccgagatacagcattttagaatgtcggacgacgtccatagtttagggaaagtcacgtcagacctagcaaagcgaaggaaactcaactcaggcggaggcctctcagaggaattggggagcgccagaagatccggagaagtgaccctgacaaaaggagaccccggatctctggaagagtgggaaacagtcgtgggcgacgatttttccctgtactacgattcttattccgtggatgagcgcgtggattccgactccaagtccgaggtggaagccctaacagaacagttatctgaggaagaagaagaggaagaagaagaagaagaagaggaagaggaagaagaagaagaagaggaagaagaggaagatgaggagagcggcaaccagagtgatcggtccggatccagcggtcggaggaaagccaaaaaaaaatggcgaaaagactccccatgggtgaagccctcaagaaagagaagaaagcgggagcctcccagagcaaaagagcctcgaggagtgtccaatgatacgtcctctctagagacagaaagaggcttcgaggagctaccgctgtgcagctgtcgcatggaagcacccaagattgaccgaatctccgaaagagcgggccataagtgcatggccacggaatctgtggacggggaattaagcggctgcaatgcagctattcttaaacgggagactatgagaccaagttcgcgggtggctctgatggttctgtgcgaaactcacagagcacgtatggtgaaacaccattgctgcccagggtgtgggtatttctgtacagctggcacgtttctcgagtgtcacccggatttccgcgtagcacaccggtttcataaagcctgtgtaagccaattgaacggaatggtgttttgcccccactgcggtgaggacgcgtctgaggcccaggaggtaaccatccctcgtggagacggcgtgactccaccggcgggaacagccgcccctgcgcccccaccactctctcaggacgtccccggccgtgccgatacctcccaaccatccgcacgcatgcgaggacatggggagcctcgccggcctccatgcgatccattggccgataccatcgacagctcaggcccgagtctgactttaccaaacggtggctgcctgtctgcagttggtcttccactaggtcctggccgagaggctctggagaaggctcttgtcatccaggagtcagagcggagaaaaaagcttcgattccacccacgtcaactgtacctgagcgtgaaacaaggagaactgcagaaggtcattctgatgctgctggataatctcgatcctaacttccagagcgatcagcagtccaaacgaaccccattgcatgccgccgcccagaaggggagcgtggaaatctgccatgttctgctgcaagccggcgctaatatcaatgccgtggacaagcagcagcgaacccctctgatggaggcagttgtcaataatcacctcgaagttgcccgatatatggtgcagagaggcggctgtgtgtattcaaaggaggaggatggctccacgtgtctgcaccacgctgccaagatcggaaacctggagatggtatcgcttttgctgtcaacgggccaagtagacgtcaatgctcaagattcaggtgggtggactccaattatatgggcagctgagcataagcacattgaggtgattagaatgcttctgacccgtggtgcagacgtcactctgacagataatgaggagaatatatgcctccactgggcctcattcaccggcagcgctgctattgccgaagtcctcctgaacgctcgctgtgaccttcatgccgtaaattatcacggggacactcccctgcatatagccgcaagagagagttatcatgattgtgtgctgctgtttcttagccgcggcgccaaccctgagcttcgcaataaggaaggggacacggcttgggatctgactcctgaacgctctgacgtctggttcgcgctgcaactgaatcgcaagctgcgcctgggcgtgggcaaccgggctatccgaactgagaaaatcatctgtagggacgttgcccggggctacgagaacgtgcctattccttgcgtgaatggagtggatggtgagccttgccccgaggattacaagtatatatctgagaattgcgaaacatccacaatgaatatcgatcgcaatatcacacacctgcaacactgtacatgtgttgacgactgtagctccagcaattgcctgtgtggacagttatccatccgttgctggtacgataaggacggccgcctcctgcaggagttcaataaaattgagccacccttaatttttgagtgtaaccaggcttgtagctgctggaggaactgtaagaaccgggtcgtgcagtcaggtattaaggtccgactgcagctctaccgtaccgccaaaatgggctggggcgtgagggcgctccagacgataccgcaggggacgttcatctgcgagtatgtaggagagctaatcagcgacgctgaagctgacgtacgggaggacgattcttacctgtttgacctggataataaagatggtgaagtatactgcattgatgcgcgctattatggcaatattagcagattcatcaaccatctgtgtgacccaaacataattccagttcgagtgttcatgctgcaccaagatctgcgcttcccgcggattgccttcttttcatcacgcgacatccgaactggggaagaactaggcttcgattatggcgatcgattctgggacatcaagtccaaatatttcacttgtcagtgcggaagtgagaagtgtaagcactccgccgaggcaattgcgcttgagcagtccagactcgcccgtctggatccgcaccccgagttgcttccagagttgggctcattaccacctgtgaacacgtag

SEQ ID NO: 116152 - DNA, 3633 bp, Artificial Sequence
  Description of Artificial Sequence: Synthetic coding sequence
atggccgcggccgccggcgccgcagcagctgctgcggctgagggagaagcccctgcagaaatgggggcactcctgctcgaaaaagagactcgcggcgcaacggagagggtgcacggtagtcttggagacacaccccggagtgaggagactctacccaaagctacccctgatagcctggaacctgctggaccgagcagccctgcgagcgtgaccgttaccgtgggcgatgagggggctgataccccggtgggagcaacccccctgatcggagatgaatctgagaacctggagggcgatggggacctgcgaggcggccgcattttgctgggccatgctactaaatctttcccaagcagccctagtaagggggggagttgcccctctagagctaagatgtccatgacaggtgcaggcaagtcacccccctcagtgcagtcgcttgccatgagactgttgagtatgcccggagctcagggagccgctgctgccggctcggaacctccgcctgcaactacctctcctgaaggccagccgaaagtccatagagcaaggaaaactatgagcaagcccggaaatggccagcccccagtgcctgagaagcgaccaccagagattcagcatttcagaatgagcgatgacgtgcacagtcttgggaaagtgacgagtgatctggccaaacggaggaaactgaactcgggaggcggactcagtgaggaactagggtccgcccggcgttcaggtgaggtgactctgaccaagggtgaccctggtagcctggaggagtgggaaactgtagtgggggacgacttttccctgtattatgatagttattccgtggacgaaagagtggactctgattctaaaagcgaagtggaagcactgaccgaacaactgagcgaggaggaagaagaggaagaagaagaggaggaagaggaagaggaggaggaagaagaagaggaagaggaagaggatgaggaatccggaaatcagagcgataggagtggtagttctgggagacggaaagctaagaaaaaatggcgcaaggactccccatgggttaaacctagccgaaaaaggcggaaaagggagccaccccgagcaaaggaacctaggggagttaacggtgttggctcatccggaccctccgagtacatggaggtgcccctgggctccctggaactgccttcggagggtacattgtctccaaaccacgccggcgtctcaaacgacacctcctctctggaaaccgaacgggggtttgaagaattgcctctgtgcagttgtcgcatggaagcgcccaagattgacaggatttcggagcgcgcggggcacaaatgcatggccacagagtctgtggacggcgaattgtctggctgtaatgccgcaatccttaagagagaaacgatgagaccctcatccagggtggctctgatggtgctgtgcgagactcatagggcaaggatggttaagcatcattgttgtcccggctgcggctatttttgcacagctggtacattcctcgaatgtcatcctgatttccgggtggcccaccgatttcataaggcctgtgtctcgcagctgaatgggatggtgttctgcccccattgcggtgaagatgcttctgaggcccaagaggtgaccatccctagaggagacggggtcacgccacccgccggaacagccgcccccgccccccccccactgtcacaagacgttcccggccgcgcggatacatcacagcctagtgcccgtatgagaggccacggagaaccacgccgccccccctgtgacccattggccgacacgattgattccagtggaccctctcttactctgcccaatggcggctgccttagcgcggtagggttacctctgggaccgggaagggaggcgttggagaaggccttagtaattcaagaaagtgagagacgaaagaagctccgtttccatcccaggcagctctatctctccgtgaaacaaggggagctccagaaggttatcctaatgctcctagacaatctcgatcccaattttcagtctgatcagcagtccaaacgcacccctctgcatgccgctgcgcagaagggctcggtcgaaatatgtcatgttctcttgcaagcaggcgcgaacataaacgcggtggataagcagcagcggacacccctgatggaggcagttgtcaacaatcacctcgaggtggctagatatatggtgcagcgcggaggatgcgtgtacagtaaggaggaagatgggtccacctgcctacatcatgcagccaagataggaaatctcgaaatggtctcattgctgttgtcaaccgggcaggtcgacgttaatgcccaggacagtggcggatggaccccaataatttgggcggcagagcacaaacacattgaagtgatccgcatgctgctcacgcgaggtgcagatgtgaccctgacggacaatgaggagaacatctgcctacactgggccagcttcactgggtcagctgccatcgcagaagtccttctgaatgcccgatgtgatctccatgctgttaactatcacggcgatactccccttcacatagctgcacgtgaatcctaccatgattgcgtgctcctattcctctcccgtggcgcaaatcccgaactcagaaataaggagggggataccgcatgggacttgactccagagcggagtgacgtgtggttcgcccttcagttgaaccgcaaactgaggctgggcgtgggaaatagagccattaggactgaaaagatcatatgccgagatgtggcacgcgggtacgagaacgtccccattccttgtgtcaacggcgttgacggcgagccatgtcccgaggactacaagtacatcagcgagaattgcgagacttccacaatgaacatcgaccgtaatatcacccatctgcaacactgcacctgtgtggacgactgcagctcgtccaattgcctgtgcggacagctgtcaattagatgttggtacgacaaggatggcagactgttgcaggagttcaataaaattgaacctcccctcatctttgaatgcaaccaggcctgctcatgttggcggaactgtaagaaccgagtagtgcagagcgggataaaagtgcgcctccagctctatagaacggctaagatggggtggggcgtgcgcgctctgcagactataccacagggcaccttcatttgtgagtacgtcggggaactgattagcgacgctgaagccgacgtgagagaggatgactcttatcttttcgacctggataataaagatggcgaagtatactgcattgatgcacgctactatggcaacatctcccgttttatcaatcatctgtgcgatccgaatattattccggtgcgggtgtttatgctgcatcaggacctacggtttccacgcatcgcgttcttcagcagccgtgatatccggactggggaggagcttggcttcgattacggagatcggttttgggatattaaaagcaaatatttcacgtgccagtgcggatcggaaaaatgcaaacactccgctgaagccatagctctggaacagtcgagactggccaggctggacccccaccctgagctccttcccgagctgggctcgctccccccagtgaatacgtag

SEQ ID NO: 116153 - DNA, 3531 bp, Artificial Sequence
  Description of Artificial Sequence: Synthetic coding sequence
atggcagctgccgcaggcgctgccgccgctgctgcagcagaaggggaagcccctgcagagatgggagcccttcttcttgaaaaggagactcggggggctacagaacgggtccacgggagcctgggagatacccccagaagcgaagagaccctgccgaaggccacacccgactcccttgaacccgccggacctagtagccctgctagcgtgaccgtcactgtgggcgatgaaggcgccgatacccctgtgggagcaactcccctgataggggacgagagcgagaacttggagggtgacggggatcttaggggcggacgcatacttttgggacacgccaccaaaagttttcctagttcacctagcaaaggaggaagctgtccatcacgtgcaaagatgtcaatgactggggctgggaagagccccccatccgtccagtcgctggccatgagactcctcagtatgcccggggctcagggcgcggctgcggccgggagtgagccaccacctgccaccacaagccccgagggccaacccaaagtacatagggcgcggaaaactatgtccaaaccgggcaatgggcagcccccagtgccggagaagcgccccccagagattcagcacttcaggatgtctgacgacgttcactccctcggaaaagtgacgtcagacctggccaagcgtcggaagctcaattcgggggggggcctgagcgaggagctggggagtgccagacgttccggagaagtaactctcactaagggcgaccccgggtcactggaggaatgggaaacagtggttggtgacgacttctcgttgtactacgatagctactccgtggatgagcgggtggactcagatagtaaaagcgaggttgaggcattaactgagcagctgagtgaagaggaggaagaggaagaggaggaggaggaggaagaggaggaggaggaagaagaggaggaggaagaagaggacgaggagtccggcaatcagagtgatagatcggggagctcaggcagacgcaaggccaagaaaaaatggcgaaaggactcaccttgggtgaagccaagccgcaagcgaaggaagagggagccccctagggctaaagaaccgcgtggtgtgtccaatgatactagctcactcgagacggagcgcggcttcgaagaactgcccctctgttcatgccgcatggaggcgcctaagatcgataggatcagcgaaagggctggtcacaagtgtatggctactgaatccgtggatggcgagctgagcggctgcaacgcagcaatcctcaaaagggaaaccatgagaccttcttcacgcgtcgcacttatggtcctgtgcgagactcaccgcgccagaatggtgaaacaccattgttgccctgggtgcgggtacttttgtactgccggtacttttctggaatgccatccagacttccgggtggctcaccggtttcataaagcctgcgtgtcacagttgaatggtatggtgttctgcccgcactgcggagaagatgctagcgaggcccaggaggtcaccatcccaaggggtgatggcgtgacaccaccagcaggcaccgccgccccagcccctcctcctctgagtcaagatgtacccggacgagctgacacctctcagccttccgcccgtatgcgcggccatggagaacctagaaggcccccctgcgaccccctcgctgacactatcgactctagcggacctagtcttacgttgcctaacggtgggtgcttgagtgctgtgggtttgccgcttggacccggacgtgaggcactcgaaaaagcattagtcatccaggaatctgagcgacggaagaagttgaggtttcacccacgccagctgtatttgagtgtgaagcaaggcgaactccaaaaagttattctgatgttactcgataatctggaccccaactttcagtctgatcagcagagcaagagaaccccactccatgcagcagcacagaaaggcagcgtcgagatttgtcacgtgctgctccaggccggtgctaacatcaatgcagtggacaaacagcaaagaactcccctcatggaggctgtggtcaacaatcacctcgaagtggcccgatacatggtccaacgtgggggctgtgtctatagcaaagaagaggatggttcgacctgccttcatcacgctgccaagatcggcaatctggagatggtgtcccttctcctgagcacagggcaggtggatgtgaatgcgcaggatagcggcgggtggacgcccattatctgggccgctgaacacaagcacatagaggtgatccgcatgcttctgacaaggggcgcggacgtgacactgactgataatgaagagaacatctgccttcactgggccagtttcaccggttcagcagcaattgcagaggtgctcctaaatgcccgatgcgatttacatgccgtgaactaccacggggacactccactgcatatcgccgcccgtgagtcttaccatgattgcgtccttctgttcttgtcccggggggccaatcctgagctgaggaacaaagaaggggatacagcttgggacctaactcctgagagaagcgacgtatggtttgcactgcagctgaaccggaagttgcgcctcggagttgggaaccgggcaatccggaccgaaaaaataatatgcagggacgtagcccgtggctatgagaacgtgccaatcccgtgtgtaaacggcgtggatggcgagccctgtcccgaggattacaaatacatttctgaaaactgcgagacgagtaccatgaatattgatcgtaacataacccacctgcagcactgtacttgtgtggatgattgtagttcatccaactgtctatgcggtcaattgtccatacgatgttggtatgacaaggatggccgcctcttgcaagaattcaacaagatcgagccccccctcatatttgaatgcaatcaagcctgtagctgttggcgtaattgcaagaatcgggtggtgcagtccggaatcaaggtgcgcctgcagttatatcggacagcaaagatgggctggggggtgagggcactgcagacgatcccccagggcaccttcatctgcgaatatgtgggggaacttatatccgatgccgaggcagacgtgcgcgaggatgatagctacctcttcgacctggacaacaaagacggagaggtatactgcatcgacgctagatactacggaaatatctcccggtttattaatcatttgtgcgaccctaacattattcctgtcagggtgttcatgctgcatcaagatttacgtttccccaggatcgcctttttctcgagtagggatatcaggactggtgaggagctcggctttgactacggcgatcgcttctgggatattaaaagcaagtattttacatgtcagtgtgggtctgaaaagtgcaagcactcagcggaggccatcgccttggagcagtctcgactcgcacggctagacccacaccctgaactactgcccgagctgggctccctgcctccagtcaatacatag

SEQ ID NO: 116154 - DNA, 3633 bp, Artificial Sequence
  Description of Artificial Sequence: Synthetic coding sequence
atggccgcagccgctggcgcggccgccgccgccgccgctgagggagaagctcctgctgaaatgggcgccctccttttagaaaaggaaaccaggggagcgacagagcgggtacacggttcacttggtgacacccccaggtccgaggagacgctgccgaaggctacccctgacagtctcgagcctgcagggccctcctctcctgctagcgtcactgtcacagtgggagatgaaggtgcggacacccccgtaggggcgactcccctgattggcgacgaaagcgaaaacctcgaaggcgacggcgacctgcggggcggcagaatcctattaggacacgccaccaagtcttttccttcctcaccatccaaagggggttcatgcccttccagagctaagatgtccatgacgggcgcaggcaagtcaccccccagcgtgcagtctctggccatgaggctgctctccatgccgggcgcccagggcgccgccgctgcgggcagtgagcccccccccgcaactaccagtcctgagggacagcccaaagtccaccgcgctcggaagactatgagcaaacctggaaatggacagcccccagtgccggagaagcgacctccagagatccaacatttcaggatgagcgatgacgttcatagtctgggcaaagtgaccagcgatttggcaaagagacgaaagctaaatagcggcggcggcctgtctgaagagcttggctccgctagaagaagcggggaggtaacgttaaccaaaggagatccagggtctctggaggagtgggaaacagtagtaggcgatgatttcagcctgtactatgactcgtattccgtggatgagagagttgattctgactccaaatccgaagtcgaggcgctgacggagcagttgtccgaggaagaggaggaagaagaagaggaagaggaggaggaagaggaagaagaggaagaagaggaggaagaagaggatgaagaaagcgggaaccagtcagatcgctctggatcctctggtaggcggaaggccaagaaaaaatggcgaaaggactccccttgggtcaagccctcccggaaacgccgaaagcgcgagccacctagagcaaaagagccgcgtggagtgaacggagtgggaagcagcggaccctccgaatacatggaggtcccactgggcagtctagaactgccttctgaaggtactttatctccaaatcacgcaggcgtgagtaatgatacatcttccctggagacagaacggggattcgaagaactaccattgtgttcctgcaggatggaggcccctaaaatcgaccgcatctcggaacgggcaggacacaaatgcatggcgacagaaagcgtagacggggaactgagcggttgcaacgcggctattctgaagagggagactatgcggccaagcagccgagtggcactgatggtgttgtgcgagacccaccgcgccaggatggtgaagcaccactgttgtccaggatgtggttacttctgtactgctggtacattcctggaatgccaccccgatttccgggtcgcccaccgatttcataaagcttgtgtttcacagctgaatgggatggtgttctgcccacactgcggagaggacgcttctgaggctcaggaagtgacgataccacgtggggatggcgttacgcccccagcaggtacagctgcgcctgccccaccccctttgagccaggacgtgcccgggagagcagacacatcacagccgtccgcccgaatgcgcggccacggggaacctaggaggccaccatgtgacccactggcagatacaatcgacagcagcggcccctctctcactctccctaatggaggatgtctgagtgcagtgggccttcctctcggcccaggtagagaggctctcgaaaaagctcttgtcattcaggaatccgagcgtcgtaagaagttgcgatttcatccacggcaactttatctatctgtgaagcaaggagagctgcaaaaggttattctgatgcttcttgacaatctggacccgaactttcagagcgaccaacagtcaaagagaacaccactgcatgcagctgctcagaaaggctcagtggaaatatgtcacgtactgcttcaggccggtgcaaatatcaatgcagtggataagcagcagcgtacaccgctgatggaggccgtcgtgaataaccacttagaagtggctcgatatatggttcagcggggagggtgcgtatattctaaggaagaggacggatccacctgcctgcaccacgccgccaaaattggtaatctggagatggtttcattgctgttatctactgggcaggtggatgtcaacgcccaggacagcgggggatggactccaatcatctgggctgctgagcataaacacatcgaagtcattaggatgcttctcacacggggcgctgacgttacattgaccgacaacgaagagaatatctgccttcactgggcatcctttacaggctctgctgcaattgccgaagtcctgttaaatgctcgttgcgatctccatgccgttaactaccatggcgatacccccttacacatagcggcacgcgagagctaccatgattgtgtcctgctgtttttgagtagaggagccaatcccgaactcagaaacaaagaaggtgacacagcgtgggatctcacacctgagagatccgacgtttggttcgcgcttcaactcaatcggaagctgaggcttggggtcgggaatcgggccatccggacagaaaagataatctgtcgcgacgtagcgcgtggctacgagaacgtccctattccctgtgtaaacggggttgatggggagccgtgccctgaggactacaaatatatctctgagaactgcgagacttccacgatgaacatcgataggaatattacccacttacagcactgcacatgtgtggacgattgttcctccagcaactgcctctgtgggcagctctccattcgttgttggtatgataaagacggaaggttattacaggagttcaacaagatcgaacctcctcttattttcgaatgcaatcaagcttgcagttgctggcgaaattgcaagaaccgtgttgtacagtctggaattaaggtgcgactacagctttatcgaactgcgaaaatggggtggggcgttcgagcgttgcagaccattcctcagggcacattcatatgcgagtatgttggggaactcataagcgacgccgaagctgatgtgagagaggacgacagttatctgttcgatctcgacaataaggatggcgaggtgtactgtatagacgctcgctactatgggaatatctcaaggttcatcaaccacttatgtgatcccaacatcattcccgttagggtttttatgcttcaccaggatttgcgatttccccggatagccttcttcagctcccgcgatattcggaccggggaggagttaggcttcgactatggagatcggttttgggatatcaagagtaaatactttacctgccagtgtggaagcgaaaagtgtaagcattcggccgaggccattgccttagaacaatctcgcctcgctcgcttagaccctcatcccgagctgcttccagagctcggatccctcccgcctgttaatacctag

SEQ ID NO: 116155 - DNA, 3804 bp, Artificial Sequence
  Description of Artificial Sequence: Synthetic coding sequence
atgcggggccttccacgcgggagaggactgatgcgcgcgcggggcagaggacgagccgctcctcccgggtctcgggggaggggacggggcgggccacacagggggaggggaagaccacgcagcctgctgagtctgccaagagcccaagcctcttggacgcctcagctatctaccgggcttacatccccacctgttccctgcttgcctagtcagggggaggcgcctgccgagatgggggcgctcctgctcgaaaaagaaactcgcggtgctaccgaacgggttcacggttccctgggcgatacgccccggtccgaggagaccttgcctaaggctacccctgacagcctggagccagctggcccgagctctcccgccagcgtgacagtcaccgtgggagatgaaggggccgacacaccagttggggcaacaccccttatcggggacgagtccgagaatttggagggagatggagatctgagaggtggcagaatattgctgggccatgccaccaaatctttccctagtagcccatctaagggtggctcatgccctagcagagcgaaaatgagtatgacaggggcggggaagagtccacccagcgtccagtcactggctatgaggcttctgagtatgccgggagcccagggtgccgccgctgctgggtccgagcctccaccagctaccacaagtcccgagggacagccgaaggtccatcgagcgcgcaagacgatgtcgaaacctgggaacggacagccccctgtccccgagaagcggccccccgaaatccagcactttcggatgagtgatgacgttcattctctgggcaaagtgacctccgatctcgctaaacgtcggaagctcaacagcggcggagggctgtcagaagaactaggcagcgcaaggaggtccggagaggtgaccctgacaaaaggtgacccaggctccttggaagagtgggagaccgtggtcggtgatgatttcagcctgtattacgattcttactctgtggatgagcgagtggatagcgatagcaaatcggaggttgaggcgcttacagagcagctgagcgaggaggaggaagaagaggaagaagaggaagaagaagaggaggaggaggaagaggaagaagaggaggaggaagacgaggagtcaggaaatcagtcagaccgatcagggtcatctgggagacggaaggctaagaaaaagtggaggaaggactccccctgggtcaagcctagccgaaagcggcggaagcgtgaaccaccccgggccaaagagccaaggggcgtgaatggcgtcggctcatctggcccatcagagtatatggaggtcccattaggaagcctagagctgccatccgaggggaccctgtcccctaaccacgcaggcgtaagtaacgatacgagcagtctagaaactgaaagggggttcgaggagctgccattatgctcctgccggatggaagcaccaaagatcgacagaattagcgagagagccgggcataagtgcatggcaacagagtcagttgatggagagttatccggctgcaatgcagccattttgaaacgcgagactatgcggccttcaagtcgagtggcattgatggtcttatgcgagacacacagagcccgaatggtgaaacaccattgttgcccagggtgtggctatttctgcaccgccggtacctttttggagtgtcatccagactttcgtgtagctcacaggttccacaaggcttgcgtgagccagcttaacggcatggtcttttgcccacattgcggcgaggatgccagcgaagcgcaggaagtgaccatacctcgcggagacggcgtgactcccccagccggcacagccgcccccgctccccctcctctgagccaggatgtgcccggccgagctgatacaagccagccctccgctcgaatgagggggcatggcgaaccgagacgcccaccctgcgatccactggctgacactattgacagctcaggacctagtctcacactgcctaatggtggctgtttatcggccgtgggcctccctttaggccctggaagagaggctctggaaaaggccctggtcattcaggaatcggaacgacggaagaagctgagattccacccccggcaattgtatctgtcggtgaagcagggcgagctacaaaaggttatccttatgctcctggacaatctggatccaaactttcaatctgatcaacagtccaagcgtacacccctgcacgctgccgcccagaaaggatccgtggagatctgtcacgtcttactgcaggctggggctaatatcaatgctgtggacaaacagcagcgcactccattgatggaggccgtggttaacaatcacctggaagtggccagatacatggtccagaggggcggctgtgtatactcgaaagaggaggatggctctacttgcttacaccatgctgctaaaataggaaatcttgagatggtttctctgttgttgtctactggacaagtggacgtgaacgcacaggattcgggtggctggaccccaattatctgggccgccgagcacaagcatattgaggtgatcagaatgcttcttacccggggcgcagatgtaacccttactgacaatgaggaaaatatatgtttgcattgggcttctttcacggggtcggcagccattgcagaggtgctactgaacgctaggtgtgatcttcacgctgtgaactatcacggggatactcctctccacatcgcagctcgagagtcttatcacgactgcgtgttattattcctgtcccgtggagccaaccccgaactgaggaataaggagggagacactgcctgggaccttaccccagagaggtctgacgtttggttcgcactccagctgaatcgtaagcttaggctcggagtagggaacagagctatacggaccgaaaagatcatttgcagggacgtggcacgggggtacgaaaacgttcccatcccctgcgttaatggtgtggatggggaaccctgcccagaggactacaaatatattagtgagaactgtgaaacatccacaatgaatatcgatcgaaacatcacccacctccagcactgtacttgtgtggacgattgcagttcttctaactgcctctgcggccaactgtccattcgttgctggtacgacaaagatggccggttgctgcaggagtttaacaaaatagagcctcctctcatcttcgaatgtaatcaggcatgttcttgttggagaaattgtaagaaccgagtggttcagagcggcattaaggtgcggctccaactctatcgcacagctaagatgggatggggtgtcagggctctccagacgatcccacaagggacattcatatgcgaatacgtaggtgaacttatctcagacgcggaagctgacgtgcgcgaggacgacagttatttgtttgacctcgataataaagacggtgaagtttactgtattgatgcaagatattacggcaacatctcgcggttcattaatcacctctgcgatcccaacatcatccctgtgagggtattcatgcttcaccaggacttgcgatttcctcggatcgccttctttagttctagagatatccgaactggcgaggaactgggatttgactacggggatcgcttctgggacatcaaatccaaatactttacttgtcagtgcggttctgagaagtgtaaacatagtgccgaggccatcgcactggaacagagccgcctcgcccgtctggacccccatcccgagctgttgcctgagctaggctcactgcccccagttaacacttag

SEQ ID NO: 116156 - DNA, 3804 bp, Artificial Sequence
  Description of Artificial Sequence: Synthetic coding sequence
atgagggggttgccccgagggcgtgggctcatgagggctaggggacgtggacgggcagccccacccggttcacgcggacgaggccggggcggaccacacagaggtagaggcaggcccaggtccctcctaagcctccctagagcccaggccagttggaccccacaactctccacagggcttacctcccccccggtaccatgcttaccttcacagggtgaggcccccgccgagatgggagccctgttgcttgagaaagaaacgagaggagcaacggaacgcgtgcacggctcgttgggcgacacgccccgaagcgaggagactctgccaaaggcaacccccgacagcctagagcctgcaggaccatcaagccctgcctcagttaccgtgacagtgggtgacgagggggccgacacgcccgtgggcgcaactccgttgattggggatgagagcgagaatctcgagggagacggcgatttgcgtggagggagaatactcctgggccatgccaccaaatcattcccgtcctccccatcaaaaggcggatcatgtccaagtcgagccaagatgtcaatgacaggtgcaggcaagtctcctccttccgtgcaatcacttgctatgcggttactaagtatgccgggggctcaaggggccgctgcggctggctcggaaccacccccagccacgacttctcccgaggggcagccaaaggtacacagagctcgtaaaactatgtccaaacccggaaatggccagccaccagtacccgagaagcgcccccctgagattcagcactttcgtatgtcggacgacgtccactcactgggaaaggttacctccgacctggccaagagacggaaactgaattccgggggcggattgagtgaggagttggggtccgcaagacgctccggcgaggttaccctcaccaagggagatccaggcagccttgaggaatgggagacggttgtcggggatgactttagcctttactatgacagttactccgttgatgaaagggtagattcagatagcaagagcgaggtagaggcactgaccgagcagctatctgaagaggaggaagaggaagaagaagaggaagaagaggaggaggaggaagaggaggaggaagaggaagaagaggacgaggagtcaggaaatcagtctgaccgaagcggtagctctggtcgacgcaaagcaaaaaaaaaatggagaaaggactctccatgggtcaagccctcacgaaaaagacgcaagagggaacctccacgggccaaagagccccgtggcgtgaacggagtaggttcatcaggacctagcgagtacatggaagtcccattagggagcctcgagctacccagcgaaggaacgctgagtccaaatcacgctggggtttctaacgatacttcttcactggagacagaaaggggctttgaggagctgccactgtgctcttgcaggatggaagccccaaagattgacaggatatcggagcgggccggccacaagtgtatggctactgaaagcgttgatggggaactgtcgggctgcaacgccgctattcttaagcgcgagaccatgcgtccctcatcccgggtggccttgatggtgctttgtgaaactcacagggcacggatggtaaaacaccattgctgcccgggatgcggctacttttgcacggcagggacctttctcgaatgccatcctgattttcgcgtggcacataggttccacaaggcttgcgtgtcccagctgaacgggatggtgttttgcccgcattgcggcgaggacgcgtccgaggctcaggaagtgaccatcccgagaggagacggagtgacaccccctgctggaaccgccgcaccagcacccccaccgctgtcacaagatgttcccggacgtgccgatacctcccagcctagcgcccgcatgcggggacatggcgaacccaggcgtcccccatgtgaccccttggccgacactatcgactcctccggcccgagcctgaccctgcctaacggcggctgcctctctgctgtgggcctgccccttggccctggtcgcgaagcgctagaaaaggcactggtgattcaggagagcgagaggaggaagaagctgcggttccacccacggcaactttacctgagtgtcaaacagggagagcttcagaaagtaatactgatgctcctagacaatcttgatcctaactttcagagtgaccaacagtctaagcgaacgccactccatgccgcagcccagaaaggaagtgtggagatttgccacgtcctgttgcaggcaggggcaaacattaatgctgtggacaagcagcaacggactccactgatggaagcagtagttaacaaccacctggaagtcgcccgctacatggtgcaacgcgggggatgtgtgtattcaaaggaggaggacgggagtacatgtcttcaccacgcagctaaaatcggaaatcttgaaatggtgtctctgctgcttagcacagggcaggtggacgtgaatgctcaggacagtgggggctggacacctatcatttgggctgccgagcacaagcacatcgaagtcatcagaatgttactcacccgcggagctgacgtgaccctaaccgacaacgaggagaacatctgcctgcactgggcctccttcactggatcagccgctatcgcggaagttcttctgaatgctaggtgcgatttgcacgcagtcaattatcacggcgacacccctctccacatcgctgctagagagagttatcatgactgcgtcctcctttttttgtccaggggcgccaaccctgaactgaggaacaaagagggagacacggcctgggacctgaccccggagcgcagcgacgtctggttcgccttacaactcaacaggaaactgcgcctcggcgttggcaatagagccataagaacagaaaagataatctgtcgcgacgtggcacgcgggtacgagaacgtgcccatcccctgtgtgaatggcgttgacggggaaccgtgtccagaggactataaatacattagcgagaactgtgaaactagtactatgaatatagatcggaatatcacccatttgcagcattgcacatgtgtggatgactgctcctcaagcaattgtctctgcggtcagctcagtatacggtgctggtacgacaaagacggtagactgctccaggagtttaacaagattgaaccaccgttgatatttgagtgcaatcaggcgtgcagctgttggcgcaattgtaaaaaccgggtggtccaatccggtatcaaggtgcgcctgcagctgtatcggacagctaagatggggtggggagtgcgcgcccttcagactattccccagggcacctttatctgtgagtacgttggggaactgatatcagatgccgaggccgatgtcagggaggatgactcttatctgtttgatctggataataaggacggggaagtctattgtatcgatgccaggtactacggcaacatctcccgctttatcaaccacctctgtgaccccaatattattccagtgcgcgtgttcatgctgcaccaggacctgagatttccccgcattgcattcttctcttcaagggacatcagaacaggagaagagctcggatttgattacggggacaggttttgggatataaaatcaaaatacttcacctgccagtgtggctccgagaagtgtaagcacagtgctgaggccattgctttggagcagtcgcggctcgcccgactcgacccacaccccgaattactgccggaactcggatccctcccccccgttaacacttag

SEQ ID NO: 116157 - DNA, 3702 bp, Artificial Sequence
  Description of Artificial Sequence: Synthetic coding sequence
atgcggggactaccgcgtggacggggattaatgagggctcgtggcagagggcgcgcagcgccaccagggtctcgaggtcgaggccgcggcggaccgcacagaggccgtggccgcccacggagcctgttaagccttccgcgtgcccaggcctcgtggactccacagctgagcacaggcctcacatcgcctccagtcccctgtctgcccagccagggggaagccccggctgaaatgggcgcattgttgctggaaaaggagacacgaggcgcaacagagcgtgtgcacgggtcccttggggatacacctcggtccgaggagaccctgccgaaggcaaccccggacagcttggagcctgccggtcccagctcacctgcatctgtgacggtgactgtgggcgatgaaggggcggatacaccagtcggtgcaacaccattgatcggtgacgaatccgaaaacctagagggcgacggagaccttcgcggaggcagaattttactcggccacgcgacaaaatccttcccatcatcaccttctaagggcggatcatgtccttcacgggctaagatgagcatgaccggcgccggtaagtccccaccctcagtgcaaagtctcgctatgcgcctcctcagcatgcccggagcacaaggtgccgcggcagcaggctccgaaccacccccagctacaacatccccagaaggccagccaaaggtacatcgagcccgcaagactatgtcgaaaccgggcaacggccagcctcccgtgcctgagaaacgaccacctgaaattcaacacttcaggatgtccgatgacgtccattcactggggaaggtgacatcagacctggcaaaaagaagaaaactgaattctggaggcggcctgagtgaagaactgggctccgcccggagaagcggggaagtcactctgaccaagggggaccctggatccttggaggagtgggagactgtggtaggggatgatttttccttgtactatgactcgtattccgtggatgagcgtgttgattcagacagtaagagcgaggtcgaagccctcacggaacagctgagcgaggaggaagaagaggaggaggaggaggaagaagaagaagaagaagaagaggaggaggaggaggaggaggaagacgaggaaagcggcaatcaatctgacagaagtgggtccagcgggcgtagaaaggccaagaagaagtggcgcaaagacagtccctgggtgaagccgtccaggaagcggcgtaaaagagagcctcctcgcgcgaaagagcctagaggggtgtccaatgatacatctagtttggaaaccgaacgcggcttcgaagagctgccgctgtgtagctgccgcatggaagctccaaaaattgacagaatatcagaacgagctggacacaagtgcatggcaacggagtccgtggacggtgaattgagcgggtgcaacgctgctattctgaagagggaaaccatgagaccttcctctcgcgttgcactaatggtgttgtgcgagacccacagggcccgcatggtgaagcaccactgctgccctggttgcggttacttctgcaccgctggcactttcctggagtgtcaccctgactttagagtcgctcacagatttcacaaagcctgcgtcagccagttgaacggcatggtgttttgcccgcactgtggggaagatgcctctgaggcacaagaagtcactatccctcggggggatggtgttacccctcccgccggaacagcagcgcccgcgccccccccactgagtcaggacgtgcccggcagggctgataccagtcaacctagcgccaggatgcgggggcacggagaaccacggcggcccccctgtgatcccctggctgatactatagactccagcggtcctagcctcactctgccaaatgggggctgcctgtctgccgttggacttccactggggccaggaagagaggctttggaaaaggcgctggtgatccaggaatcagagcgccggaagaagttacggttccatcctaggcaactgtatctgtcagttaaacaaggcgaactgcagaaagtgatcctgatgctcttggataatttggacccaaacttccaaagcgatcagcaaagcaagaggacaccactgcacgctgccgctcaaaaaggtagcgtagaaatctgccatgtgctgctgcaggcaggggcaaacataaatgccgttgacaaacaacagcggacccctcttatggaagctgtggtgaataatcatctggaggtggcgcgctatatggtgcagaggggcggctgtgtctactcaaaagaggaagacggcagcacatgcctccatcacgccgccaagatcgggaatctcgagatggtctcgttgctcctttctaccgggcaggtggacgtcaatgctcaggatagcgggggatggacacctatcatctgggctgccgaacataaacacattgaggttattagaatgctgctcactcgtggtgctgatgtcacacttacagataacgaagagaacatttgtctgcactgggcgtctttcacaggatccgcagccatagccgaggtgttgctgaatgcgcgctgcgatctccacgcagtaaactatcacggcgacacccctctccatatagcagcaagagaaagttatcacgattgcgtgttgctcttcctaagcagaggtgccaacccagagctgcggaataaggaaggggacaccgcatgggacctgactcccgagcgctcagatgtgtggttcgcactgcaactcaatcggaagctgcggctcggagtcggcaaccgagccattaggaccgaaaaaataatctgcagagatgtagcacgggggtacgaaaatgtccctatcccatgcgtaaacggtgtcgacggtgaaccttgcccggaggattacaaatatatttctgagaactgtgagactagcactatgaacatagatcggaacattactcatctgcagcattgtacctgcgtcgatgactgtagcagctccaactgtctgtgcggccaactgtctattcggtgctggtacgacaaggacggaaggcttctgcaggagttcaataagatcgaacctcctctcatctttgaatgtaatcaggcctgcagctgctggcgcaattgcaagaacagggtagtgcagtcaggcattaaggtccgtctccagctgtacaggacagcaaaaatgggatggggcgtgcgggcgctgcaaacgattccccaaggcacttttatctgcgagtacgttggggaactgatcagcgatgccgaggcggacgtccgcgaggatgatagttatttgtttgatctggataacaaagatggggaggtctattgcattgatgccagatattatggcaatatctcgagattcatcaaccacctgtgcgaccccaacataatcccagttcgggtgttcatgttgcaccaagatcttaggtttccacggatagcttttttctcgagtcgggacatccgtacgggagaagaattaggattcgactatggagatcgcttctgggacattaagtctaaatacttcacttgccagtgcggctccgaaaagtgcaagcattcagcggaggccattgccctcgaacagtcccggctggccaggcttgatcctcatccagagctactgcctgagttagggagcctgccacccgtcaacacctag

SEQ ID NO: 116158 - DNA, 3804 bp, Artificial Sequence
  Description of Artificial Sequence: Synthetic coding sequence
atgcgagggctcccgcggggcaggggcttgatgcgagcccgaggaagaggtcgcgcggccccgcccggcagcagagggagaggtcgaggtgggccccaccggggcaggggtcggcctcgctcattactgtctcttccccgggctcaagcgtcctggactcctcaactaagtacaggccttactagtccaccggtgccttgcctcccatcacagggggaggccccagcagagatgggagcattgctgctcgagaaagaaactcgcggcgccaccgagcgagtgcatgggtctctgggcgacacccctcggtcagaggaaacactcccaaaagccaacccggacagtctggagccagctgggccctctagccccgctagcgtcaccgtcacggtgggcgacgagggggctgatacaccagtgggcgcgacccctctcataggcgatgaaagtgagaacctggaaggagatggcgatctacgtggaggccgcattctcctgggccacgccaccaagagcttcccatcctcacccagcaaaggcgggtcttgtccatcacgggccaagatgtcgatgacaggagcaggtaagtctcctccatccgtccaatccctggccatgcggctcctgagtatgcccggggctcaaggagccgcagctgctggctccgagccgcctcccgccacaacttcccccgaaggccagcctaaagtgcaccgcgctaggaaaaccatgtcaaagccaggcaacggccagcctccagtgcccgaaaagagaccgccggagatccagcacttcaggatgagtgacgacgtacacagcttaggaaaggtgacaagcgatctggcaaagcgcagaaaattaaattccggaggaggcttgtccgaagaactgggatctgcccggcgcagtggggaagttacactgaccaagggagatccaggctcactggaagagtgggagacagtagtaggtgatgatttctctctgtattacgactcatattctgtcgatgagcgggtcgactcagacagcaagtccgaagtggaggccctcacggagcagctttcggaggaggaggaggaggaagaggaagaagaggaagaggaagaggaagaggaagaagaagaggaagaagaagaggatgaggaaagcggcaatcagagcgacagaagtggatccagtgggagacggaaagccaaaaagaagtggcggaaagattccccttgggtcaaacccagtagaaaaaggagaaaacgcgagccacctagagccaaggaaccaaggggtgtgaacggcgttggttccagcggccctagcgagtacatggaagtgccattaggtagtcttgagcttccctccgagggtactctctccccgaaccacgcaggcgtgagcaatgatacaagcagcctagagactgaaagagggtttgaggagttgcctctgtgctcgtgcagaatggaagcacccaaaattgaccggattagcgaacgcgctggacacaagtgtatggccaccgagagtgtagatggggagctcagtggctgcaacgccgccatcttgaaacgcgaaaccatgaggccaagttccagggtagccctaatggtcctgtgtgagacccaccgggcacgaatggtcaaacatcactgctgtcccgggtgcggctatttttgtaccgccgggacctttttagaatgtcaccccgactttcgcgtggcccaccggtttcacaaggcttgcgtttctcagctcaatggcatggtgttttgcccacattgtggcgaggatgcatcagaggcccaggaagtaaccatcccaagaggcgatggagtgacgccacctgccggaaccgcagctcctgctccccctcccctatctcaggacgtgccagggcgggccgatacaagtcagccgagcgcccggatgcggggccacggcgagcccaggcggcccccctgtgatcccctggccgacacaatcgattcctctggccccagtttgactctcccaaacggcgggtgtctgagtgctgttggcctcccactagggccaggccgcgaggcactggagaaggctctagtgattcaggagtccgaacggcgaaagaagctccgctttcacccaagacagctgtacctgtctgtgaagcagggcgaattgcagaaggtcatcctcatgctgctggacaatctggacccgaatttccaatccgaccagcagagcaagcggactcctctgcatgccgctgcacagaaggggtccgtcgaaatctgccatgtgctgctgcaagccggggcaaatatcaatgcagtggacaaacagcaacgcacacctctcatggaggctgtggtgaataaccatcttgaggtggctcgatacatggtccagcgaggcggctgtgtctactccaaagaagaagacggcagtacttgcctgcaccacgctgcaaagataggcaatctggaaatggtgtcacttttgctttccacagggcaggtcgacgtcaacgcccaggatagcgggggctggacacctatcatttgggcagccgagcacaagcatatagaagttatcagaatgcttctcacacgtggggccgacgttactctgacagacaacgaggagaatatttgcctgcattgggcatccttcaccggaagcgctgctatcgccgaggtcctgctcaacgcacggtgtgatttgcacgccgttaattaccacggagatacaccactacacatagctgcacgggagtcataccatgactgtgtgctcctgttcctcagccgaggcgcaaatcctgagctaaggaataaggaaggggacaccgcttgggacttgacaccggaacgctctgatgtttggtttgccctgcagttgaaccggaaattgcgattaggagttgggaatcgtgctatccgtacagagaaaataatctgcagggatgttgccagaggctatgagaacgtcccaattccctgcgtgaatggtgtagacggagaaccctgtcccgaggactacaagtatattagcgagaattgcgaaacctcaacgatgaacattgaccggaacatcacccatctgcagcactgcacatgtgtggatgactgctcgagcagcaattgcttatgtggtcaactgtctattcgttgttggtacgacaaggatggtagactactgcaagaattcaacaagatcgagcctccacttatattcgagtgtaatcaggcctgttcttgttggagaaactgtaaaaatagggtcgttcaatctggaattaaagtacggctccagctctataggactgccaagatgggctggggtgtgcgggccttgcagacaattcctcagggaacatttatttgcgagtacgttggcgagcttatctcagacgccgaagcagatgtgcgcgaggacgatagctacctttttgatctagacaacaaggacggggaggtatactgcattgatgcgagatactatgggaacatcagccgtttcataaaccatctgtgtgatcctaacatcatcccagtacgggtgttcatgctacaccaggatttgcgattcccccgcatcgcattcttctctagccgggatataaggaccggagaggagctgggattcgattatggggaccggttttgggatattaaatccaagtatttcacgtgccaatgcggatcggagaaatgtaaacacagcgccgaggccattgcactggaacagagccggctcgctagactggatcctcacccagaactgttacctgaactgggctcactgcctcccgtaaacacttag

SEQ ID NO: 116159 - DNA, 897 bp, Artificial Sequence
  Description of Artificial Sequence: Synthetic coding sequence
tgaagtaagagaacacctctgcatgcagcagcgcagaaggggtcagtagagatctgtcatgtcctgctgcaggccggcgctaatattaatgcagttgataagcagcaacgaaccccccttatggaggccgttgttaataaccacctggaagtggcccggtacatggtccaacggggtggctgcgtgtactctaaagaagaagacggtagcacctgcttacaccatgcagccaaaatcggaaatttagaaatggtctcactgttattgtcaactggccaggtggatgtaaacgcacagggccagctcccccccccctccctgccatctcatccacaggatagcggtggctggaccccgattatatgggccgctgagcataaacatattgaagtgatcagaatgctgctcacacgtggcgcagacgtcactctaacagataacgaggagaatatttgtctgcattgggcatcctttaccgggtccgccgccattgccgaagttctattgaacgcccgatgcgatctccacgctgtcaactaccatggggatactccacttcacatagcagcccgtgagtcataccacgattgcgtccttttatttctcagcagaggagcaaaccccgaattaaggaacaaagagggcgataccgcctgggacctcactcccgagcgtagtgatgtctggtttgcactccagttaaaccgcaagctgcgtctcggggtgggcaacagagcaatacgtaccgaaaagattatttgtagggacgtggccaggggttatgaaaacgttcctatcccctgtgtgaacggcgtggatggggaaccttgccctgaggactataagtacatctccgagaactgtgaaacaagcacaatgaacatcgaccgcaattag

SEQ ID NO: 116160 - DNA, 3633 bp, Artificial Sequence
  Description of Artificial Sequence: Synthetic coding sequence
atggcagctgccgccggtgctgctgccgcagccgcagccgagggggaagcccctgccgagatgggggctctgctgctcgaaaaagagactaggggagccactgaaagagttcacggctccttaggggacaccccacgctcagaagagacactgccgaaggcaaaccctgattcccttgaacccgccgggccttcaagcccagcctcagtgactgtcaccgtaggagatgagggcgcagacactcccgtgggggccaccccattgatcggagatgagtccgagaatctcgagggtgatggtgacttgcgtggcggccggatcctgttgggacacgctactaaaagtttcccatcctctccaagtaaggggggcagttgccccagcagggctaaaatgtcaatgaccggggcaggcaaatcccccccgagtgtccagtctttggccatgagactgttaagtatgcccggcgcccagggagcggctgcagcaggaagcgaacctcctcccgccactaccagcccagagggccagcctaaggtgcacagggcaagaaagaccatgtccaaacccggcaacgggcagccccctgtgccggagaagaggccgcccgaaattcagcacttccgcatgtccgatgatgtccactccttgggtaaggtaaccagcgacctagctaagcgccgaaaattaaacagcggtggcggactttctgaagaactcggaagcgctagacgctcgggagaggtgactttgaccaagggggaccccgggtctctcgaggaatgggagacagtagtaggtgatgattttagtctgtactacgactcatacagcgttgacgaaagggttgattcagactccaagagcgaagtggaggccctgacagagcagctctccgaagaggaggaggaggaagaagaggaagaggaagaagaagaggaggaggaggaggaggaggaagaggaagaggacgaggagagtggaaatcaatctgatagaagtgggtcgagcggccggcgcaaggccaaaaagaagtggaggaaggacagcccgtgggttaaacccagcagaaagcgccgtaaacgggaaccgccaagagcaaaggagccgaggggagtgaacggggtcggctctagtggacccagcgagtatatggaggtgccactcggcagtttagaactcccaagtgaggggacgcttagccctaatcacgctggggtttccaacgacacaagctccctggaaacagagcggggctttgaagaactgcccctttgctcgtgccgcatggaggcacccaaaatagatcgtatcagcgaaagggccggccacaagtgcatggcaacggaatcggttgatggcgagctgtctggctgcaatgccgcaattctgaagcgcgagacaatgaggccaagctcccgggtggcactcatggtgctgtgcgagacacatagggcccgtatggttaagcatcactgctgtccagggtgtggttacttctgtactgctggcacgtttctggagtgccaccccgacttcagggttgcccatcgttttcacaaagcctgtgtatcccagctcaacggtatggtattttgcccacactgtggtgaggacgccagcgaggcacaggaggtaacaatacctcgcggagacggggtgacacctcctgctggcactgccgcccccgcaccacctcccctgagccaggatgtgccaggccgagcagatacgtcacagccatccgcaaggatgagggggcacggtgaaccacggaggcccccttgcgatcccttggccgatacaatcgatagctccggtcctagcctgaccttgccgaacggcggatgtctctcagccgttgggctgcccctgggccccggacgcgaagctctcgaaaaagctcttgtgatccaggagagcgaacggcgaaagaaactccgttttcaccccaggcagctttacctctctgtcaaacaaggtgaacttcagaaggtgattcttatgttgctggataatttggatcccaatttccaaagtgaccagcaatccaaacggacaccccttcatgctgctgcacagaaaggtagtgtcgaaatctgtcacgttctgctgcaggccggggcaaatatcaatgctgtggataaacagcagcgaacccccctgatggaagcggtcgtgaataatcatctagaagtcgcccgttacatggttcagcggggaggatgtgtgtattccaaagaagaggacggctcaacatgtctgcaccacgctgcgaagataggaaatctagaaatggtgagtctcctgctgtcgaccgggcaggtcgacgtgaatgcccaggactccggcggctggaccccaatcatctgggccgcagaacacaagcacattgaggtcatacgtatgcttctgaccagaggagctgatgttaccctgaccgacaatgaagaaaatatttgtctgcactgggctagcttcaccggcagcgccgccattgccgaggttctgctcaacgctagatgcgacttacatgcagtgaactatcacggtgatacacctttgcatatcgctgccagagagtcttaccatgactgcgtcttgctgtttctcagccggggagcgaaccccgaactgagaaacaaagagggagacaccgcctgggacctcacccccgagagatcagatgtgtggttcgcgctgcagttgaaccgcaagctgaggctaggtgtcgggaaccgcgcaatccgaaccgaaaagataatctgccgcgatgtcgctaggggttatgaaaatgttcctatcccgtgcgtgaacggcgttgacggagagccctgtccagaggattacaaatatatctcggagaattgcgagaccagtactatgaacatcgaccggaatatcactcacctgcagcactgcacatgtgttgacgactgttcttcctccaattgtctgtgcggccagctcagtattaggtgctggtatgacaaggacgggagattgttacaggagttcaataaaattgaaccacctttgatatttgagtgcaaccaggcttgcagctgttggaggaattgtaaaaacagagtggtgcagtctggaattaaggtccgcttgcagctttatcgaactgccaaaatgggatggggcgtgcgtgccctacagaccattccacagggcacctttatctgtgaatacgttggcgaactgatttcagacgcggaggccgacgtgcgtgaggacgattcctacttattcgatttggacaacaaggacggcgaggtatattgtattgatgccaggtattatggaaacatcagtaggtttattaaccatttgtgcgacccaaatatcatccccgtacgagtgttcatgttgcaccaggacctacgctttcctcggatagcattcttctcttctcgtgacattcgaaccggcgaggagctgggctttgactacggtgataggttttgggatataaaatctaaatacttcacctgtcagtgtggttctgagaagtgtaaacatagtgcggaggccattgccctggaacagagccggctggcccggttggaccctcaccccgagctccttcctgagcttggcagcctccctcctgtgaacacctag

SEQ ID NO: 116161 - DNA, 897 bp, Artificial Sequence
  Description of Artificial Sequence: Synthetic coding sequence
tagagcaagaggacacccttgcacgccgcagcccaaaaaggatccgtggaaatttgtcatgttctcctacaggctggggcaaatatcaacgcagtggataagcagcagagaaccccgctgatggaggccgtcgtgaataatcacttggaagttgcaaggtatatggtgcaaaggggaggctgcgtctactccaaagaggaggacgggtctacatgtctgcaccacgcggcaaagataggtaacctcgaaatggtctcattgctgttgtcaaccggtcaggtggacgtgaacgcccaaggtcagttgccccctccgtctctcccatcacatccccaagactctggtggttggactcctatcatttgggccgctgaacacaagcacattgaagtaatcagaatgctgcttacccggggcgccgacgtgacacttaccgacaatgaggagaacatctgcttacactgggcctcattcacaggctcggccgctattgctgaagtactgctgaacgcccggtgtgatttgcatgccgtaaactaccatggagacacacctctgcatatcgccgcccgcgagagctaccacgattgtgtgctactgttcctgagtagaggcgccaaccccgagctccgtaacaaagagggcgacactgcgtgggacctgacaccagagcggtcggacgtgtggttcgcccttcagctcaacaggaagctgagactaggcgtagggaatagagccattcgcaccgagaagatcatctgcagggacgtcgcgcgaggctatgagaatgtaccaataccttgtgtcaacggtgtggatggagagccgtgccctgaggattacaaatacatttccgagaactgcgagacctcaacaatgaacatcgacagaaactag

SEQ ID NO: 116162 - DNA, 3531 bp, Artificial Sequence
  Description of Artificial Sequence: Synthetic coding sequence
atggccgctgctgcaggagcagccgctgcagccgcagccgagggagaggcgccagccgagatgggggccttgctgcttgaaaaagaaacacggggggcaaccgaaagggtgcacggaagcctgggcgacaccccaagatctgaagaaactttaccaaaagccacacctgacagtctggaaccagccggcccctccagtcccgcttccgtgacagtaactgttggcgacgaaggagccgatacacctgtgggggccacccctctgataggagatgagtccgagaacctcgagggggacggcgacctgagaggcgggaggatcctgcttggccacgccacaaagtcattcccttcctcccccagtaaggggggcagttgtccaagcagagccaaaatgagtatgacaggggccggcaaaagccctccaagtgtgcagtcactggctatgaggctcctatccatgcctggtgcccaaggcgccgcggctgctgggagtgagcctcctcctgctaccacttcacccgaggggcagccaaaagtccaccgtgccaggaaaaccatgtccaaaccaggtaacggacagccgccagtacctgagaagcgaccacccgagatccaacactttcgaatgagcgacgacgttcacagtctgggaaaggtcactagcgacttggcaaaaaggcggaagttaaactccggggggggattgtctgaggagctagggtctgcacgcagaagcggcgaggttacactaactaagggggatcctggcagtctggaggagtgggagaccgtggtgggtgacgacttctctctgtattatgatagctacagtgtggatgaaagagtcgatagtgactcaaaatccgaagtggaagctctaaccgaacaactgagtgaggaggaagaagaggaggaagaggaagaagaagaagaggaggaagaagaggaggaagaagaagaagaggaggacgaggaaagcggcaaccagtcagacaggtctggatcttctggccgcaggaaggcgaagaagaagtggcggaaagattctccatgggtaaagccaagtcgcaagaggagaaagcgcgaaccgccacgcgcaaaagaacctagaggtgtttctaacgacactagctcactagagacagaacgagggttcgaagagttgccactgtgcagttgccggatggaggcccccaagatcgatcgaatctctgagagggccggacataaatgcatggccaccgagtccgtagacggggaattatccggatgcaacgcagcaatactgaagcgtgagactatgagaccatcctctagagtcgctctgatggtgttgtgtgaaacacatcgcgccagaatggtgaaacatcactgttgtcctggctgtggctacttctgcaccgcagggacgtttctggaatgccatccagatttcagggtggctcacaggttccataaggcttgcgtttctcagctcaacggcatggtgttttgcccccactgcggagaggacgcttccgaggcgcaggaagtcactattccaagaggagatggagtcacccccccagctggcacagccgctcctgcccctcctcccctgtcccaggatgtgccaggccgggcagatacctctcagccaagcgctcggatgaggggccatggggagcctaggcggcccccttgtgacccgcttgcggacaccatagacagttctgggccttcgctgactctcccaaatgggggttgcctgtctgcggtgggtttaccgctggggcccggcagggaggccctcgagaaagctctggttatccaggagtcagaacgtagaaaaaaactgagatttcacccaaggcaattatacctgagcgtcaaacagggcgagctgcaaaaggtcattttgatgctgttggacaacctcgatcccaatttccagtcagatcagcagtctaaaagaaccccactgcacgccgccgctcagaaggggagtgtagaaatctgtcatgtgctccttcaagctggggcaaatattaacgccgtggacaagcagcaaaggacccccttgatggaggctgtggtgaataatcatctggaggtggccaggtacatggtgcaacgcgggggctgtgtctactctaaagaagaggatggtagtacatgcttgcaccatgccgccaagattggtaacctggaaatggtgagcttactgttatctacaggacaggtggatgttaacgcccaggattccggaggttggactcccattatctgggctgccgaacataagcatatcgaggtcatccgcatgctgctgacgcgcggggccgatgtcacactgactgataatgaggagaacatttgcctgcattgggctagctttacaggatctgcagcaattgcagaggtattattgaacgccaggtgtgacctgcatgcagtcaactaccacggcgacacgccactgcatatagccgccagagagtcctatcacgactgtgtcctactgtttcttagcaggggggccaacccagaactgcgcaataaagagggagacactgcatgggatttaactcccgaaaggtctgatgtgtggttcgctctgcaacttaaccgaaagctgcgcctgggggttggaaatcgggcgatccggacagagaagatcatctgccgggatgtggcccgtggctacgagaatgtcccaattccatgtgtcaacggcgttgacggggagccttgccctgaggattacaagtacatatcggagaactgtgagactagtaccatgaacattgatcggaacatcacccaccttcagcattgtacttgcgtcgacgattgctcctcctctaattgtctctgcggacaactatcaattagatgctggtacgacaaggatggccgacttctgcaggagtttaataaaatcgagccaccattaattttcgaatgtaatcaggcttgctcctgttggcggaactgcaagaaccgggtggtccagagtggaatcaaggtgcgactgcagttataccgaaccgctaagatgggatggggggtgcgggccctgcagacgattcctcaagggacgtttatctgcgaatatgtgggcgaactgatcagtgatgctgaagcggacgtgcgggaggatgactcttatttgttcgacctggacaataaagacggggaggtgtattgcattgacgcccgttactacggcaacattagtaggtttattaaccacctgtgtgatcctaacatcatccccgtaagagttttcatgctgcatcaagatctcagatttccaaggatcgcctttttcagcagcagggacatccgaaccggtgaagaactgggcttcgattacggagatcgcttttgggatattaagagcaagtattttacgtgtcagtgcgggtccgaaaaatgcaagcactcagctgaggctatcgcccttgaacaaagcaggcttgctcgactggacccacacccagaactgctgcctgaactggggagcctcccacccgtgaatacctag

SEQ ID NO: 116163 - DNA, 3804 bp, Artificial Sequence
  Description of Artificial Sequence: Synthetic coding sequence
atgcggggtctgccacgggggcgaggcctcatgcgcgcccggggcagaggaagggccgcccctccggggtctaggggccgtggccggggcggaccccaccggggtaggggcaggcccagaagtctcctgagtctgccccgcgcccaggcttcatggacaccacagcttagcaccggtctcaccagtcctcccgtaccttgtctcccatctcagggagaggctcccgcagagatgggggccttgctgctggaaaaggagactaggggggcgaccgagcgtgtacatgggtccctgggcgataccccacggtcagaagagactttacctaaggctacccctgactccttggagcccgctggcccatcctctccggcaagtgtcaccgtgaccgtgggcgacgagggcgcggacacccccgtgggcgctaccccactgataggcgatgagtccgaaaacctggaaggtgatggcgatttaaggggcggccgcattctcctgggccatgcaacaaagtcatttccctctagcccctcgaaaggcggaagctgtccgagtcgcgctaagatgtctatgacaggagctgggaaaagccctccttcggttcagtctcttgctatgagacttctgagcatgcccggcgcacagggtgcagcagctgctggaagtgagcccccacccgctactacgtccccagaggggcagccaaaagtccacagggcacggaagactatgagcaagccaggcaacgggcaaccacctgtgcctgaaaaacgccctcccgagatccaacactttcgcatgtctgacgacgtgcacagtctcgggaaggtgacatctgatttagccaagcgtagaaaactgaattctggtggtggcctgtctgaagagttggggagtgcacgacgaagcggtgaggtgaccctgacgaagggcgacccagggagcctggaggaatgggagaccgttgtgggcgatgacttttctctttattatgattcgtattctgtggacgagcgggtggacagcgactcaaaatctgaggtcgaggccctgacagaacagttgtctgaggaggaagaagaggaagaggaagaagaggaagaggaggaggaggaggaggaggaggaggaagaagaggaggacgaagaaagtgggaaccagtccgatagaagtggctcgtccggccgtcgcaaagccaaaaaaaaatggcgtaaggatagcccttgggtgaagccctcccgaaagcgtcgaaagagggagcccccccgcgctaaagagcctcgaggcgtcaacggggtggggtcaagtggcccgtccgaatatatggaagtgccgctggggagcttggagctgccatctgaaggcactctgtcccccaaccacgccggggtgagtaacgatactagtagtctggagacggagaggggctttgaagaacttcccctgtgctcgtgccgcatggaggcacctaagatcgatcgaatcagcgaacgagcaggacataagtgtatggcaacagagtcagttgacggggaactaagcggttgcaacgccgctatactgaagcgcgagaccatgcgcccttcgagccgtgttgcactaatggtattgtgtgaaacacacagggctcggatggttaagcatcattgttgccctggctgtggttacttttgtaccgccggcacatttctggagtgccaccctgattttagagtcgcacacagatttcacaaggcctgtgtcagccaacttaacggaatggttttctgcccccactgtggagaggatgcttctgaggcccaagaggttacaattccaaggggagatggcgtcacccccccagcggggactgctgcaccagctccacctcctctgagccaggatgtcccaggaagggctgataccagccaaccgagcgctaggatgagggggcacggggagccccggcgaccgccatgcgatccgctggcagatacaattgactccagtggcccttccctcacactgcctaacggcggttgcctgagtgccgtgggcctgccgttgggtcccggacgggaggcccttgaaaaggctctcgtgatccaggagtccgaaagaaggaaaaagcttcgatttcaccctcgtcagctttatctgagcgttaagcagggagaactgcagaaagtgattcttatgctcttggataaccttgatcccaacttccaatcagaccagcagtcaaagcgaacccccctgcatgccgccgcccagaagggttctgtagagatttgccacgtgctgctccaggctggtgcgaacatcaatgccgtcgataagcagcagcgtaccccacttatggaggccgtggtgaacaaccacctcgaggtagcacgctacatggtacaacgtggtgggtgtgtctattctaaagaggaggatggttcaacctgtctccatcatgctgcgaaaatcggcaatctcgaaatggtctctctgctgctgtccacaggccaagtagacgtgaatgcacaggacagtggagggtggactccaattatatgggctgccgagcataagcatatcgaggtgatacgaatgctgttgacaagaggggccgatgtgactctgacagataacgaagagaacatatgtcttcattgggcctccttcacgggatccgctgcgattgcggaggtgctcctcaacgctagatgtgatttgcatgccgtaaactaccacggcgacacccctctacatatcgccgccagagagtcttatcacgattgcgtgttgttgtttctgtcccgaggcgcaaacccggaactcaggaataaagagggggacacagcctgggatctgacccccgagcgcagtgatgtctggtttgctctacaactcaacaggaagcttcgccttggggtcggaaaccgtgctatccggaccgaaaagatcatctgccgagatgtggcccggggttacgagaatgtcccaataccctgcgtgaatggagttgacggcgaaccttgccccgaagattacaaatacatctctgaaaattgtgagacctctactatgaacattgaccgaaatataacacacctccagcattgcacatgcgtggacgattgctccagtagtaattgcttgtgtgggcaactaagtattcgttgctggtacgataaagacggcaggctgctgcaggaatttaacaagatcgagccgcccctgatttttgagtgcaaccaggcttgtagctgctggcgcaattgtaagaaccgggttgtgcagagtgggatcaaagtacgtctccaactgtaccgcacagctaaaatggggtggggcgtgcgagccctgcaaacaattcctcagggaactttcatttgcgagtatgttggagaattaatttctgacgcagaggccgatgtgcgcgaagatgatagttacctcttcgatctagataataaggatggtgaagtctactgtattgacgcgagatattatggaaatatatcacgcttcataaatcacctctgcgatcccaacattattcctgttagagtcttcatgcttcaccaggacctgaggttcccgcgcatagcgttcttttcttcccgggacattcgtactggcgaggagctcgggtttgattatggagacaggttttgggacatcaaatccaagtactttacatgtcaatgtggctctgagaaatgcaagcacagtgctgaggcgattgccttggaacagtccaggctggcaaggcttgatcctcatcccgagttgctgcccgaacttggcagcctaccacccgtgaatacctag

SEQ ID NO: 116164 - DNA, 3633 bp, Artificial Sequence
  Description of Artificial Sequence: Synthetic coding sequence
atggccgctgctgctggcgctgccgccgccgcggcagcagagggagaagcaccagctgagatgggagctctgctgctagaaaaggagacgcgaggagctacggagcgagtccatggttcattgggtgacactccccggagcgaggaaacactgccaaaggctaatcccgactccttggagcctgccggcccatcttcccccgctagtgtgactgtgaccgtgggggacgagggagccgatacacctgttggagccacccctctgatcggagatgagagcgagaatctggaaggagacggtgacctgcgcgggggccgcatactcttgggtcacgctacaaagtcattcccttccagtcctagcaaaggtggcagctgtccaagcagggctaaaatgtccatgaccggtgcaggaaagtctccgccctctgttcagagcttagctatgcgtctactgtccatgcccggagctcagggagcagccgctgccggttcagaacctccacccgccaccaccagccctgagggccagcctaaggtccatcgagcccggaagaccatgtctaaacctggcaacggccagccacctgttccagaaaaaagaccgcccgaaatccagcactttaggatgtcagatgatgtgcactctctcgggaaagtgacctctgatctggctaagaggcgtaagctcaactcgggtgggggcctgtcagaagaactggggagtgcacgaaggagcggggaggtaactctgaccaaaggagatcccggctccctggaggagtgggagacagtagtgggcgatgacttctctctttattacgattcgtacagtgtggatgagagagtagactcagattctaaatccgaggtagaggcgctgacggagcagctcagtgaggaggaggaggaggaggaagaggaggaagaggaggaagaagaggaggaagaggaagaggaggaagaggaagatgaagagtcaggaaaccaaagcgaccgctctggtagctccgggcgacggaaggccaagaaaaaatggcgcaaagacagcccatgggtgaagccaagcaggaagcggaggaagcgagagccacctagggcgaaggagccaagaggggtgaatggggtcggctccagtgggcccagcgaatatatggaggtacccctcggctcacttgaactgcctagtgaaggaaccctctcccctaaccatgcaggagtgtctaatgacacaagtagtctggagactgagcggggcttcgaggagttgccactctgctcatgcagaatggaagcccccaagatcgatcgcatctcggaacgcgcaggccataagtgcatggccacagaaagtgtcgacggcgagctgtcaggctgtaatgctgctatccttaaacgtgagacaatgagaccttcaagcagagtcgcactgatggtgctctgcgagacccacagggctcgaatggtcaagcatcactgctgtccaggctgcggatacttttgcacagccgggacgttcctggaatgtcatccagactttagagtggctcatcggtttcacaaggcctgcgtttctcaacttaatggaatggtattttgcccacattgcggagaagacgcctccgaagcgcaggaggtgacaatccctagaggagatggtgtaacgcctcctgccgggacggccgccccagccccacctcctctgtctcaggacgtacccggtagggcagacacctctcagcctagcgcccgcatgagaggacacggcgaaccacggagaccgccgtgcgaccctctagctgataccatcgacagtagtggcccatctttgacactgcctaatggcggatgcctgagcgccgtgggtctaccgctgggtccgggccgagaagcgttggaaaaggcactcgtcatccaggagtccgaacgaagaaagaaacttcgattccacccaagacagctgtatctgtctgtgaaacagggggaattgcaaaaagtgatacttatgctcttggataatctggaccccaactttcagagtgaccaacaatcgaagaggacccctcttcacgccgcagcccagaaaggcagcgtcgagatctgtcacgtgttactgcaggcaggcgccaatataaatgccgtggataagcagcagaggacccctctcatggaagctgtcgtgaataatcacctcgaggtggctagatacatggtccaacggggcggatgtgtctattccaaagaggaagatggctccacatgtctccaccatgctgcgaagatcggcaacctagagatggtctctctgctgttgtcaacaggacaggtagatgtgaacgctcaggattctggtgggtggacgcccattatttgggcagccgagcacaaacacattgaggtgattcggatgttgctcacacggggggctgatgtgacactgaccgacaacgaggaaaacatctgtcttcactgggcatcatttaccggctccgctgccatcgcggaggtcctgctgaacgcgaggtgcgaccttcatgcagtgaattaccatggcgatacacccctgcatattgctgcaagggagagctatcacgactgtgtgctgctgtttctgtcacgcggtgcaaatcccgagcttaggaataaggagggcgacaccgcctgggacctaacaccggagagatcagatgtttggtttgcgttacaactcaatcgaaagctgcgtctgggggttgggaatagagccatccgcacagaaaagatcatatgcagggatgtcgcccgcgggtatgagaacgtacccataccatgtgtcaatggtgttgatggcgagccatgtcccgaggactataagtacatcagcgaaaactgtgaaacttcaacaatgaacatagaccggaacatcacccacctccaacactgtacctgtgtagatgactgttcctcatccaactgcctatgcggacagttgtctattcggtgctggtatgacaaagatggacgcttgttacaggagttcaacaaaattgaaccaccacttatatttgaatgcaatcaggcatgctcctgctggaggaactgtaagaaccgcgtggtccagagcggcattaaagtgcggttacagttatacaggactgctaaaatgggctggggcgttcgcgctctgcaaactattccgcagggaacctttatatgtgagtacgtgggagaactgatcagtgacgcagaagcggacgtcagggaggacgattcgtacctgtttgatctggacaataaagatggcgaagtgtactgtatcgacgcccgctactatggcaacatctctagattcattaaccatctgtgtgaccccaatatcattcctgtgcgcgttttcatgcttcatcaggacctgcgttttcctcgaattgccttcttctcatcacgcgacatccgcactggagaagagctcgggttcgattatggtgataggttctgggacattaaatctaaatacttcacctgtcaatgcggatcagaaaaatgtaaacattcagccgaagctatcgcactcgaacagagccgcctggccaggcttgacccgcaccccgaattgctgccagaactgggttcactgcctcctgttaatacatag

SEQ ID NO: 116165 - DNA, 897 bp, Artificial Sequence
  Description of Artificial Sequence: Synthetic coding sequence
taatctaaaagaacgccactgcacgcagcagcacagaaaggctccgtggagatctgccatgtcctgctccaggcaggcgctaatattaacgccgtggacaaacaacagcgcactccgctgatggaagcagtcgtgaataaccacctagaagtggcccgttatatggttcaacgaggcggctgtgtctattctaaggaggaggacgggtcgacttgcctgcatcacgcagcgaaaatcgggaatctcgaaatggtgagcttgctcctgagcaccggacaggtagacgtgaacgcgcagggacagcttccaccacccagtctcccttcgcacccccaggatagtggtggctggaccccaattatatgggccgcggagcataagcacatcgaggtgattaggatgttgctgactaggggggctgacgtgacactcaccgataatgaagagaatatctgcttacattgggcctcttttaccgggagcgcggccatagccgaggtgcttctgaatgcccggtgtgatctgcacgccgtgaattaccacggcgatacgccattgcacattgccgccagagagagttaccacgactgcgtgctgctgttcctgtcgcggggggccaatcctgagctgcgcaacaaggagggggacactgcctgggaccttacccccgagcgctctgacgtttggttcgccctgcaactgaaccggaagctgcgcctaggcgtgggaaacagagcgataagaaccgagaaaattatttgccgcgatgtggcccgcggctatgagaatgtcccaatcccttgtgttaacggcgttgacggggaaccttgccctgaagactataagtacattagcgaaaactgtgagacctctaccatgaatatagatcgcaactag

SEQ ID NO: 116166 - DNA, 2769 bp, Artificial Sequence
  Description of Artificial Sequence: Synthetic coding sequence
tcagaggtcgaggccctgaccgaacagctgagcgaggaggaagaggaagaagaggaggaggaggaagaggaagaggaagaggaggaggaagaggaggaagaggaagatgaagaatctggaaaccagagtgaccgctccggatccagcgggcggcggaaggcaaaaaaaaagtggcgaaaggactcaccctgggtgaagcctagtaggaagcgcagaaaaagggaacctccgagagcgaaggaaccaagaggcgtgaatggagtcggatcatccgggccgtctgaatacatggaggtcccgctggggtcgctggagctcccgagcgaagggaccctatctccgaatcacgctggcgtgagtaatgacactagctcccttgaaacagaacggggttttgaggagctccctctctgttcgtgtcgtatggaggcccctaagatcgatcgaattagcgaacgtgctggccataaatgcatggccactgagtcggtcgatggagagctgagtgggtgcaacgccgccatcctgaagagggaaacgatgagaccctcctctcgggtggccctcatggtgttgtgtgaaactcatcgtgccaggatggtcaaacatcattgttgcccaggatgcggttatttttgtaccgctggcacttttttagaatgccatcctgattttcgagtggcccatcgtttccataaggcttgcgtcagtcagctgaatgggatggtcttttgtcctcactgtggcgaagatgcaagtgaagcccaggaggtgacaataccacgtggcgacggggtaacaccaccagctggtacagcagcacctgccccccctccactgtcacaagatgtccccggccgcgctgacacttcgcagcctagcgctcggatgcgtggacatggcgaaccaaggcggccgccctgtgaccccctcgccgataccatcgattcctccgggccgtcactgactctgccaaatggtggctgcctttcagctgtcgggcttcctctcgggccgggaagagaagctcttgagaaagccctggtgatccaggaatcagagcgacgcaaaaaactcaggttccaccccaggcaactgtatctgtcggtaaaacagggagaactgcagaaagtgatcctgatgcttcttgataacctagaccctaatttccagtctgatcagcagtctaagaggacacctcttcacgccgctgcccagaaggggtccgttgagatctgtcacgtgctacttcaggcgggagcaaacattaatgcagtagataagcagcagcgtactcctctgatggaggccgtagtgaacaaccatctggaagtcgctcggtatatggtgcagcggggtggctgcgtttacagcaaggaggaggatggtagcacctgcctgcatcacgctgctaagattggcaatctagagatggtgtccctgctcttatccaccggccaggtagatgtgaacgcacaggacagtgggggatggactccaataatctgggcagccgaacacaaacacatagaagtaattcgcatgttgctgaccaggggagcagacgtgactctgacagataatgaagagaacatttgcctgcactgggccagcttcacggggagtgctgccatcgcggaggtcctcctaaacgctagatgcgatctgcacgcagtgaattatcacggcgacactccactccatatcgcagctagggaaagttaccatgactgcgtcttgctcttcctttctaggggtgccaaccctgaactcaggaataaagagggtgacaccgcctgggatctgacacccgagcggagtgacgtgtggttcgctctgcaacttaatcggaagcttcgtctaggggtcggtaaccgcgcaatccgaacagagaagatcatatgccgcgacgtcgcaaggggctacgaaaacgtcccgatcccctgtgtgaatggggttgacggagaaccttgcccagaagactataagtatatctccgagaattgtgaaacttccaccatgaacattgatcgcaatatcactcatttacagcactgcacatgcgtcgatgattgttcatcaagcaattgcttatgtgggcagctctcaatccgatgctggtacgacaaagatggccggctgctgcaggaatttaacaagattgaaccacccctcatttttgaatgtaaccaggcttgtagctgttggagaaattgcaagaatcgggtcgtgcaaagtggtatcaaggtgcggctgcagctatatcgcaccgcgaaaatggggtggggagtgcgggccctccagactatcccacagggaacatttatctgtgaatatgtcggagaactgattagcgatgctgaagcagatgtgagggaggatgattcatacctttttgatctggacaataaagacggagaagtatactgcattgacgctcgttattatggtaacatctcccggtttattaaccatttgtgtgaccctaacatcatccccgtcagagtctttatgttacatcaggatctgaggtttcctcgtatcgctttcttcagcagcagggacatacgcactggagaggaactcggctttgattatggcgaccgcttctgggatatcaaatcaaagtacttcacctgtcaatgcggatccgagaaatgtaagcacagcgccgaggcaatcgccctggaacagtcacgtctggctcgccttgacccgcaccccgaactcctccccgagctggggtccctgccaccggttaatacatag

SEQ ID NO: 116167 - DNA, 3702 bp, Artificial Sequence
  Description of Artificial Sequence: Synthetic coding sequence
atgcgggggctgcctcgtgggaggggtcttatgagagcaagaggcagaggccgtgccgctccaccaggaagccgcggcagagggcggggaggaccccatagagggcgtggtcgcccgcggtctttgctcagccttcctagggcccaagcaagctggaccccccagctctctacgggcttaacctctccacccgtgccctgcttacccagccaaggagaagcccccgccgaaatgggggcactcctgcttgagaaagagactaggggggctacagaacgagtacatgggtctcttggggacacccccaggtccgaagagactttgcctaaggcaaatcccgacagcctggaaccagctggccccagtagcccagcctccgtgaccgttactgttggagacgagggtgccgatactcctgtgggggctacacccctgattggtgatgaatcagaaaacctggaaggagacggggaccttaggggaggacggatcctactgggccatgctacaaagtcgttcccatcaagtcctagtaaaggcggctcatgcccctcccgcgcgaagatgagcatgacaggcgccggaaaaagccctcctagtgttcaatctctggccatgcgtctgcttagcatgccaggcgcccaaggcgccgctgcggcaggctccgagccaccccctgcgacaaccagcccagagggccaacctaaggtccacagggccaggaagactatgagtaagcccggtaacgggcagcctcccgtgccagagaaaagacccccagaaattcaacatttcaggatgagcgacgatgtccattccttaggcaaggtgactagtgacctcgctaaaagacgcaagctcaactccggcggaggcctgtcagaggagcttggcagtgcacgcagaagtggggaggtgactttgactaaaggtgacccaggctctctcgaagagtgggagaccgtggttggcgacgatttttcactttactatgactcctatagcgtggatgagcgcgtcgactccgactcaaaaagcgaggtggaggccttaaccgagcaactatctgaagaggaggaggaagaagaagaagaggaagaggaagaggaagaggaggaagaagaagaagaagaagaggaagatgaggaatcaggcaatcaatcagaccgatctggttccagtgggcgtaggaaagcaaagaagaaatggcgcaaggattcaccatgggttaagccttcccgaaaaaggcgcaagcgcgagcctccacgggcgaaggagccacggggagtgagcaatgataccagcagtctggagacagagcggggcttcgaagagctcccattatgttcttgtcgtatggaggctcccaaaattgatagaataagcgagcgcgccggtcacaaatgcatggctaccgaaagcgtggatggggagctttccggatgtaacgccgctatcctcaagcgcgaaacgatgcgcccctcctccagagttgcattaatggtcctgtgtgagactcatagggccagaatggttaagcatcattgctgtccaggctgcggatatttttgtactgctgggacctttctcgaatgtcacccagattttcgggtggctcataggtttcataaagcctgtgtgagtcagctcaacggcatggtcttctgtcctcattgtggcgaggacgcatcagaagcccaggaggtcaccattcctaggggggatggcgtgacaccacctgctggcactgccgcacctgcccccccaccactgtctcaggacgtgcccggaagggctgatacttcccagccatcagccaggatgagaggacatggagaacctaggagaccaccctgcgaccccctagcagataccatcgattcgtctggaccttccctgaccctccccaatggaggatgcctatccgccgtgggactgccactaggccctgggcgggaggcactcgagaaagccctagtaatacaggaatctgagaggaggaaaaaactgaggtttcatccaaggcagctgtatctgagcgtcaaacagggcgaactccagaaagtcatcctgatgctcctcgataatctggatcctaactttcaaagcgatcagcaatctaaacgcactcctttgcacgctgctgcgcaaaagggatccgtggagatctgtcatgtcctgctgcaggcgggagcgaatatcaacgccgtggataagcagcaaaggacccctctgatggaagctgtcgttaacaaccatctggaggtggcaagatacatggtgcagagaggaggctgtgtgtatagtaaagaagaagatggctccacttgcttacaccacgccgctaagatcggaaaccttgagatggtgagtttgctcctatcaaccggtcaagtagacgtgaacgcgcaagacagtggcggttggacacctattatctgggcagccgaacacaaacatatcgaagtcatccggatgctgctcacccgaggagctgacgttactctgaccgacaatgaggagaatatctgtcttcattgggctagctttactggaagtgctgccatcgcggaggtgttgctgaacgcaagatgcgacctgcacgccgtaaactatcacggcgacactcccctccacatagccgcacgggaatcctaccacgactgcgtccttctattcctttctagaggcgccaatcctgaactgcgaaacaaagagggtgacactgcctgggacctaacaccagagcgatctgatgtttggtttgccctccagctgaacagaaaactgcggttaggcgtgggcaaccgggccattcggactgaaaaaatcatttgtagggatgtggcacgtggctatgaaaatgtgcccattccatgcgtgaatggggttgatggggagccctgcccagaggactataagtacatctcagagaattgcgaaacttcgaccatgaacattgatagaaatattactcaccttcagcactgcacttgcgtcgatgactgcagcagctcaaactgtttatgtggacagctaagtatccgctgttggtatgataaagatgggcgcctgctacaagaatttaataaaatcgagccccctctgatcttcgaatgcaaccaggcgtgtagctgctggcgcaactgtaaaaacagagtggtccagagtggcatcaaagtccgattacagttgtacagaaccgcaaaaatgggttggggagtgagggcactacagactattccccaggggacctttatctgcgagtacgtcggcgaacttatttcagatgccgaggccgacgtgcgagaggatgacagctatctgtttgatcttgataacaaagacggggaagtgtattgtatcgatgctcgctactacggcaatatatcacgatttataaatcacctgtgcgacccaaacattatcccagtcagggtctttatgctccaccaagatctgcgatttcctcgtatagcttttttcagttccagggacatacgtactggagaagagttgggtttcgattatggggatcgtttctgggatattaagagtaagtacttcacttgtcagtgcggttctgagaagtgtaaacatagcgccgaggccatcgccttggagcagtcacgtctggccagactggatccccatccggaactgctgccagaactgggttctctgccacccgtgaatacttag

SEQ ID NO: 116168 - DNA, 3702 bp, Artificial Sequence
  Description of Artificial Sequence: Synthetic coding sequence
atgcggggcttgccacgaggcaggggcctcatgcgggcccgaggacgaggcagggccgctcctcccggatccagaggcagaggacggggggggcctcaccgcgggcgcggccgccccagatccctactgagtttgccccgggcacaggcgtcatggacaccgcagctctcgaccgggctgaccagtccgcctgtaccgtgtttaccgtcccagggagaagctcccgccgagatgggtgccttattattagagaaggaaacacgtggtgctacggagagagtacacggatccctgggagacacacccagaagcgaggagaccctaccaaaggccaccccggactcactggaacctgctgggccttccagtcccgcaagcgttacagtcactgttggtgatgaaggggctgacactcccgttggggctacaccacttattggcgacgagtctgaaaacctggaaggggacggggacctgagaggcgggagaatcctgctgggacatgccaccaagagctttccctctagcccgtctaaaggcggatcttgtcctagtagggccaaaatgtcaatgacaggtgcagggaagtctccaccctcagttcaatctttggctatgcggctcctgagtatgccgggtgcacagggcgcggcagcggcaggatctgagcccccgcctgccactacttccccagaaggacagcctaaagtgcacagagcaaggaaaaccatgtctaaaccaggcaacggccagcctcccgtcccagaaaaacgtccccccgagatacaacatttcaggatgagcgacgatgttcattcccttggaaaggtgacctcagacctcgccaaacggagaaagctaaacagcgggggcggcctgtcagaggagctgggaagcgcgcgacggtcaggtgaggttacgctgactaagggcgacccgggcagtctggaggagtgggaaacagttgtgggcgatgacttttcattgtattatgactcctactcagtcgatgagagagttgacagcgattcaaaatcagaggtcgaagcactaacagagcagctctctgaagaagaagaagaggaggaggaagaggaggaagaagaagaggaagaagaagaggaagaggaagaagaggaggacgaggaaagtggcaatcagtctgatcggtccgggagctctggtcgtcgcaaggccaagaaaaagtggcgaaaggatagcccctgggttaaaccttcccgcaagcgtagaaagagggagccgccaagagcaaaagaacctagaggagttagtaacgatacgtctagtctggaaaccgaaaggggattcgaagaactgccgctctgttcatgtcggatggaggctccaaaaatcgaccgtatctcggaaagggcaggacacaagtgcatggccacggagtcagtagatggcgaactgagcggatgtaacgccgccatcctgaagagagagaccatgcggcccagctcccgggtggccctcatggtcctgtgtgagacacacagagcaagaatggtgaagcaccactgctgtcccggatgtggatatttctgtactgccggtaccttcctggagtgtcaccccgattttagagtagcacatcggtttcacaaggcttgcgtctcacagctgaacgggatggtgttctgtcctcattgtggcgaagacgcttctgaggctcaggaagtcacaattcctcggggagatggcgttaccccaccagcgggaacggcggctccggcacctccccccctctctcaggacgtgcctggccgtgctgacacgtcgcagccttccgccagaatgagagggcatggagagccccgcaggcctccctgtgaccccctggcagacactatcgatagctcagggccttccctgaccctgcccaacggcgggtgtctctccgccgtgggtctgcctcttggcccaggccgggaggcactcgaaaaagccctggttattcaggagagcgaacgtaggaaaaaactaaggttccatccccggcaactttatctgagcgttaaacaaggcgagctgcagaaagttatcttaatgctgctcgataatctggacccaaatttccaatctgatcagcagtcaaaaagaacccccttacacgccgctgctcagaaagggagtgtcgagatctgccacgtcttgctccaggctggggccaatattaacgcggtggataaacagcagcgaacacctctaatggaggcggtggtgaataaccatctagaggtggcacgctacatggtgcagaggggtgggtgtgtctattcaaaagaggaagacggtagcacttgccttcaccacgcggctaagatcggcaacttggaaatggtctcgctgctgttgtcgactggtcaggtcgacgtcaatgcacaggacagtggagggtggacgcctattatctgggctgctgaacataagcatatcgaagtgatacgtatgttgctgactcggggcgccgatgtgacactcactgataatgaagagaacatttgccttcactgggcaagtttcacgggttctgctgccatcgcagaagtgctcctgaatgcaagatgcgatctccatgctgtcaactaccatggcgacacacctcttcacatagcggctcgcgaatcgtaccacgattgcgtactgctgttcctcagcaggggcgctaatcccgaacttcgcaacaaggagggcgataccgcgtgggatctgaccccagagcgatctgatgtgtggttcgccctccaactcaaccggaaactgcggcttggcgtcggaaaccgggccatcagaactgaaaagatcatctgcagagacgtggctcgcggctacgagaacgttccaattccgtgtgtgaatggggtcgatggggaaccttgcccagaggactataagtacatctcagagaattgcgagactagcactatgaacatcgaccggaacatcactcacctgcaacattgcacgtgcgttgacgactgtagcagcagcaattgtctatgtggccagctttcaattcggtgttggtacgataaggacgggcgactactccaggagttcaacaagatcgaacctccactaattttcgaatgcaatcaggcctgtagctgttggaggaactgcaaaaaccgtgtggtgcaatcgggcatcaaggttaggctacaattgtaccgcactgctaaaatgggatggggagtgcgcgctcttcagactatccctcaagggaccttcatctgcgaatatgtcggagaattgatctcagacgccgaggcagacgtaagggaagatgattcatatctttttgacttagataataaggacggtgaggtatactgtattgatgcccggtactatggtaacatatcgcggtttattaatcatctgtgtgatccaaatatcattcctgtccgcgtgtttatgttgcaccaagaccttcggttcccaagaatcgctttcttttccagcagggatatacggacaggagaggagctgggtttcgattatggggaccgcttctgggatatcaagtctaagtacttcacttgccagtgtggttctgaaaagtgtaagcacagcgctgaagcaattgctcttgagcaaagtagactggcccggctcgacccacatcccgaattgctgccagagctcggcagccttccacctgtgaacacctag

SEQ ID NO: 116169 - DNA, 3633 bp, Artificial Sequence
  Description of Artificial Sequence: Synthetic coding sequence
atggctgccgccgcgggcgcagccgctgccgcagcagccgagggcgaagcgcctgctgagatgggagccctgctcctggaaaaggaaacgcgcggggcaaccgagcgcgtgcacggctccttgggcgacactccccgtagcgaggaaaccttgcccaaggccacacctgattctttggaacccgccgggcccagctcaccagcaagtgtgacggttacagtgggagatgagggtgccgatacaccagttggggccaccccactcatcggggacgagagcgaaaatctcgagggtgacggagatttaagagggggccgcatcttactgggacatgccaccaaatccttcccctcgtccccgtcaaaggggggaagctgccctagtcgagcaaagatgtctatgaccggcgcggggaagtcccctccatcagtgcagagccttgccatgcgcctgttgagcatgcccggagcacaaggcgctgcggccgctggaagcgaacccccaccagccactacttcccctgagggccagcctaaggtacacagagcccggaagaccatgtctaaacccggtaacgggcagccaccggtgcctgagaaacgaccaccggagatccagcactttcggatgtccgacgatgtgcatagcctgggtaaagtaacttccgacctagccaaacggcgcaaattgaactctggcggtggtctgagtgaagagctgggtagcgcccgtcgatcaggcgaagtgacactgaccaagggcgatccgggcagtcttgaagagtgggaaaccgtcgtcggcgatgacttttcattgtactatgatagttattctgtggacgagagggtcgactccgacagtaaatccgaggtcgaagccctgacagaacagctgtccgaagaagaagaggaagaggaagaggaggaagaagaggaagaggaagaggaggaggaggaggaagaggaagaagatgaagagtccggcaatcaaagcgatcggtctgggtcctccggccggcgtaaagccaaaaaaaaatggcgcaaagactccccttgggtgaagcccagtaggaaacggagaaaacgcgagccccctcgggccaaagaaccgagaggcgtgaacggggtaggttcttccggtccttcagagtatatggaggttcctctgggctcccttgagttgccaagcgaaggtactctttctcccaaccacgccggggtgagcaacgatacttccagcctggagacagaacgcggttttgaggagttacccctttgctcttgtcggatggaagcaccaaaaattgaccggatatctgagcgggcgggtcacaagtgcatggccactgagtccgtagacggcgaactgtccggatgcaatgcagcaattctgaagcgcgaaactatgcggcctagctcacgggtggccctgatggtcctgtgtgaaacacacagagcaagaatggtgaaacatcactgctgccccggttgcggctacttttgcacagcgggcaccttcctcgagtgccaccccgattttcgggtcgcacatcggtttcataaggcgtgcgtatctcagcttaacggcatggtgttctgcccacactgtggcgaagacgccagtgaggcgcaggaggttacaattccacggggtgacggagtaaccccccctgcaggcacagctgcacctgctcccccaccactcagtcaggacgttccaggtcgggcagacacctctcagccgtcagcccggatgcggggacacggagagcccagaagacctccttgcgatcctttggccgacacaatcgatagtagtggcccaagcctcactctgcccaacggtggctgtctctcagctgtgggactgcccctagggccaggccgtgaggcactagaaaaggccttggttattcaggagagtgaacgcagaaaaaagctgaggtttcatcctcgtcagctctacctgtccgtcaagcagggtgagcttcagaaggttatcctcatgctcctggacaaccttgatccgaattttcagtccgaccagcagtcgaaaaggactcctttacatgccgccgcacaaaaaggaagcgtcgagatatgccacgtcttgcttcaggcgggggctaacataaatgcagtggataagcaacagcggaccccgcttatggaggccgtggtgaacaaccatctggaggttgcccgctacatggtgcagagaggaggctgtgtatacagcaaggaggaagacggaagcacctgcctgcatcacgccgctaagatcggaaaccttgagatggtttcacttctattgtctacaggtcaggtggacgtgaatgcacaagactctggtggatggacaccgatcatctgggcggcggagcacaaacacatcgaggtgatccggatgttgttaacgcgcggtgccgatgtgacgctgacagacaatgaggaaaacatctgtttacactgggcctcattcacgggcagcgctgccattgccgaagttttgctaaatgcccgctgcgacctgcacgctgtgaactaccacggcgacaccccgctgcacatagccgcccgtgaatcctaccacgactgtgttctcttattcttgtcaaggggggcaaacccagaactgcggaataaggagggagataccgcctgggacctgaccccagaacgctccgacgtgtggtttgcactgcaattaaatcggaaactgcgcctcggcgtggggaaccgcgcaatccgtacagagaaaattatctgcagggacgtagcgaggggctacgagaacgtccccattccttgcgtgaacggcgtcgacggcgaaccttgccccgaggattacaaatacatttccgaaaactgcgaaacttcaacaatgaacatcgatcgtaacataacccacctacagcactgcacctgcgtggacgactgtagcagttccaattgcttatgtgggcagttgagcattaggtgttggtatgataaagacggtcggttactacaggagttcaataagatcgaaccacccctgatctttgagtgcaatcaggcatgttcttgctggagaaattgtaagaaccgcgttgtgcagtctggaataaaagtccgacttcagctttatcggacagccaaaatggggtggggtgtaagagcattgcagaccatccctcaaggaacgttcatttgtgaatatgtcggcgagctgatcagcgacgcggaagcagacgtgagggaggacgatagctacctgtttgatctcgataacaaggacggggaggtctattgcatagacgcacggtattatgggaacattagccgatttatcaatcacctgtgcgaccctaatatcattcctgttcgggtttttatgctccaccaagatctgcgattcccacgcattgccttcttctcttctagagatattaggacaggggaggaactggggtttgactatggggaccgcttctgggacattaagtcaaaatattttacctgtcagtgcgggtccgagaaatgtaaacactcagccgaggccatcgccctggaacagagtagactggcacgactagatccccaccctgagttactgcctgaattgggctccctaccacccgtcaacacatag

SEQ ID NO: 116170 - DNA, 897 bp, Artificial Sequence
  Description of Artificial Sequence: Synthetic coding sequence
taaagcaagagaacgcctctccatgcggcggcgcagaagggatccgtagaaatttgccacgtgcttctgcaggctggggctaacatcaatgcagttgacaagcagcagcgaacgccacttatggaagctgtcgtgaataatcatttagaagtagcgaggtacatggtgcagcgggggggctgtgtgtattcaaaagaagaagacggttccacctgcctccaccacgccgctaagatcggaaatttagagatggtgtctttgctattatctacgggacaggttgatgtgaacgcccagggccagctgcctccccccagtctgcccagccacccacaggactcaggggggtggactccgatcatatgggccgcagaacacaaacacatcgaagtgattcgcatgctgcttactcggggcgctgacgtgaccctaactgataatgaagaaaatatatgtctgcattgggcaagtttcacagggtcagcggctatagctgaggtgttactgaatgccaggtgcgacctgcacgccgtgaattaccatggagatacacctctgcatattgccgccagagaatcctatcatgattgcgtgctgctgtttctctcacggggagccaatcccgaactcagaaacaaggaaggtgacactgcctgggatctcacacccgagcgctcagatgtgtggttcgctttacagttaaaccggaaactgcggttgggggtcggcaaccgggccattaggacagagaaaatcatttgccgcgacgtggctcggggctatgagaatgtacccatcccttgcgtgaacggcgtggatggcgagccgtgccctgaggattacaagtacatctcagagaattgcgagacaagcacaatgaatatcgatcgcaattag

SEQ ID NO: 116171 - DNA, 3804 bp, Artificial Sequence
  Description of Artificial Sequence: Synthetic coding sequence
atgcggggcctacctcgaggacggggactcatgagggcccgcggaagaggcagagccgctccacctgggagtaggggcagaggacggggtggccctcacagaggtaggggcagaccccgcagtctgctctccctgccccgtgcacaagcttcttggaccccgcagttatcaactggtttgacctcccctccggttccgtgtctgccaagtcaaggagaggctccagcagaaatgggggcacttctgctcgaaaaggagacgcgtggagcaacagagagggtccacggctctctgggagatacccccaggtctgaagaaaccttacccaaagctaccccagacagcttggagcccgctggtccaagcagccccgcctcagtgacggtgacagtcggggatgagggtgccgacactccggttggagccactcctctgataggcgacgaaagcgagaatctggagggggatggcgacctgcgtgggggcaggatcctgcttggccatgcaaccaaatccttcccgtctagcccttctaagggcggctcttgtcccagtcgtgccaagatgagcatgacgggagctggtaaatcacccccaagcgttcaatcgctggccatgagactgctctcgatgccaggcgcccagggagcggccgctgctggctccgagccaccacctgcgaccacctctcctgaggggcaaccaaaggtgcatagagcaaggaagactatgtccaagccgggaaatggacagccgcccgtaccagagaagagacctcctgagattcagcactttcgaatgagcgatgatgtgcatagcctcggcaaggtgacatcagacctggccaaaaggcggaaactgaactcagggggggggttaagcgaggaactggggtccgccagacgaagcggcgaagtaaccctgactaagggagatcccggctcacttgaggagtgggagaccgtcgtcggggatgacttttcactgtactacgacagctattccgtggacgagcgggtcgattcagactccaaaagcgaggtggaagcgctgacagaacagttgtccgaggaggaggaggaagaagaagaggaggaagaagaggaggaggaagaggaggaggaagaggaggaagaggaggatgaagagtccggcaatcaaagcgatcgcagcggaagcagtggccgacgcaaagccaaaaaaaagtggaggaaggactcaccttgggtcaagccatctcggaaaaggcggaaaagggaaccaccgagggccaaggaacctaggggcgtcaatggggtgggaagtagcgggccaagcgagtacatggaagtgccactggggtccctggaactcccatctgagggaacacttagcccgaaccatgccggggtctcgaacgacaccagcagccttgagaccgagcgcggtttcgaagagctgcccctctgcagttgccgcatggaggctccgaaaattgacagaattagcgaaagggcaggacataaatgcatggcaactgaatccgtggacggcgaacttagtggctgcaatgctgctatcttgaaaagggaaaccatgagacccagttcacgggtcgctcttatggtgctatgtgagacacatcgcgcccgcatggtgaagcatcactgctgtcccggctgtgggtacttctgtaccgctggcacatttttagagtgtcatcctgacttcagggtggctcacaggttccacaaagcttgtgtctcacaacttaacggtatggtgttctgtccccactgcggcgaggacgcgtccgaggcccaggaagtcaccataccacgcggcgacggggttacacctcccgctggcaccgccgcgcccgccccacctccactaagccaggatgttcccggtagggctgacaccagccagccctccgctcgcatgcggggccatggcgagcctagacgtcctccctgcgaccccctggccgacaccatcgatagctcaggcccttctctaacactgcctaacgggggatgcctaagcgcagtaggactccctctcgggccagggagggaagcgctggaaaaggctctggtcatccaggaatccgagcgccgcaaaaaattaaggtttcatcccaggcagctatatttgtccgttaagcagggggagctgcagaaggttatacttatgctgttagataacctggatcccaactttcagagcgaccagcagagcaagcggaccccactgcacgcggccgcacagaaggggtctgtagagatttgccatgtcctccttcaggccggcgccaacataaatgctgttgacaagcagcagcgcaccccactgatggaggccgtggttaacaatcatcttgaagttgctaggtacatggtacagcggggaggatgcgtgtactcaaaggaagaagacggctccacttgtctccatcacgccgctaagatcggcaacctggagatggtcagtttactcctgagcaccgggcaggtagatgtcaatgcacaggactctggggggtggactcctataatatgggcagctgaacacaaacacatcgaggtgattcgtatgctgctaacgcgcggcgctgacgtcacccttacagataatgaagagaacatctgtctccattgggcgagcttcacggggagcgccgccatcgcagaggttttattgaacgctcgctgcgacctccacgccgtcaactatcatggagatactcctctccacatcgccgcccgagagtcctaccatgattgcgtgctgttgtttctgtctagaggggctaaccctgaactccggaataaagaaggcgacactgcttgggacctgacgccagagcggtctgacgtctggttcgcgctccaacttaacaggaaactgcgactcggcgtgggaaaccgagccattaggactgagaagataatctgtcgtgatgtggccagagggtacgaaaatgttcctattccttgcgtcaacggtgtggacggcgaaccatgcccagaggactataagtatatcagcgagaattgcgagacttctacgatgaacatagatcgcaatattactcacttgcaacattgcacttgcgtcgacgactgtagctcctctaattgcctttgcggccagctctcaatacgttgctggtatgataaggacggtcggttgctgcaggaattcaataaaattgaacctcccttaatattcgaatgtaatcaagcatgcagctgttggagaaattgcaagaatagagtagtccagtctggcattaaggtgagactccagctgtatcgcacagctaagatggggtggggtgtcagagcattacaaactatcccacaagggacgttcatctgtgagtatgtgggcgagctgatatcagatgccgaagctgacgtgagagaggatgattcctatctgtttgatctcgacaataaagatggggaagtatattgtatcgatgcccggtattacggtaatatctctaggttcattaaccatctgtgcgatcctaatattatacctgtccgggtgtttatgctgcaccaagaccttagattcccacggattgcattcttttcgtctcgcgatattcgcaccggagaagagctgggtttcgattatggcgacagattctgggatataaagtccaagtacttcacatgccaatgcgggtccgaaaaatgtaagcactccgccgaggcaattgcactggagcagtctagactcgcgcggctggacccgcacccagagctactgccagaattggggagcctgcctcctgttaatacctag

SEQ ID NO: 116172 - DNA, 2667 bp, Artificial Sequence
  Description of Artificial Sequence: Synthetic coding sequence
tcagaggtggaggcactaacagaacagttgagcgaggaggaggaggaggaggaggaggaagaagaagaagaggaagaggaagaggaggaggaagaagaggaggaagatgaagagtcgggtaatcagtctgacagatctggatcttcgggtagaagaaaagccaagaaaaaatggagaaaagactctccttgggttaagcctagccgaaaacgcaggaagagagagcctcccagggccaaggaacctaggggggtgtcaaatgacacatcgagtctcgagactgagagggggttcgaagagctgcccctctgttcttgtcggatggaagcacctaaaatcgataggatctcagagagagcagggcacaaatgcatggcgaccgaaagcgtggacggggaattatccggatgtaacgcagcaatcttgaagcgtgaaaccatgagaccctcttccagagtcgctctgatggtcctgtgcgagacccaccgagctcgaatggtgaagcatcattgttgtccaggctgcggatacttctgcactgctggcacattcctcgagtgtcaccctgattttagagtagctcatcgcttccataaggcttgcgtgtcccagcttaacggaatggtgttctgtcctcattgcggtgaggatgcatctgaggcccaggaagttactatccctcgcggggatggcgtgactcctcctgcgggaactgccgctcccgcccccccgccccttagtcaggacgtgcctggccgagcagataccagtcaacccagcgctcgtatgaggggacatggggaacctaggcgccctccctgtgaccctctcgccgacacaatcgatagctccggcccgtcacttaccctgcccaacggaggctgtctaagcgccgtgggcctgcccctggggccaggtcgggaggccctggaaaaagcattagtgatacaggaatccgaaagacggaagaagcttagatttcaccccagacagctctatcttagcgtgaaacagggagagctgcagaaggtgattttaatgctactagacaacctggaccccaacttccaatcagaccagcaatccaagcgcacaccactgcacgcagccgcccagaaggggtccgtggagatatgccacgtgctgctgcaagctggcgccaatattaacgctgtcgacaaacagcaacggaccccgctcatggaggcagtcgttaataatcacctagaggtagcccgttacatggtccaaaggggggggtgcgtgtattctaaagaagaagacgggtctacgtgtcttcatcatgcggcaaagattggtaatctggaaatggtgagcctgctcttgtccactgggcaggtcgacgtgaacgcccaggacagtggtggttggacccccatcatttgggccgccgagcataagcacatcgaggtaatccgcatgcttctaacaagaggcgcagatgtgactttaaccgacaacgaggaaaatatctgcttacactgggccagtttcactggctccgctgccattgcagaagtattattaaatgcgagatgcgatctgcatgccgtgaactatcacggcgatacacccctgcatatcgcagctagggagtcttaccacgactgtgtcctcttgtttctgtctaggggcgctaaccccgagttgcgcaacaaagagggagataccgcttgggacttgacacctgaacgctcagacgtttggttcgctctgcagttaaatcggaagcttcgtctcggtgttgggaatagggcaattcgtacagaaaaaattatctgccgggacgttgccagggggtacgagaatgttcctattccctgtgtcaatggtgtggacggcgagccctgtccagaggactacaaatatatatcagagaactgcgaaacgtctacgatgaatatcgacaggaacattacacacctacagcattgtacttgtgtcgacgactgttcaagtagcaactgtctgtgtggccagctgtccatccggtgctggtatgataaagacggtaggcttcttcaggagtttaataaaatcgagccacctctaatcttcgagtgcaaccaagcctgcagctgctggagaaactgtaagaatagagtcgtgcagagtggcatcaaagtccgcctccagctgtaccgcacagccaaaatgggctggggcgtgcgggctctgcaaacaattccccaggggacattcatctgcgaatatgtgggagaactgatctcagacgccgaggctgacgtgcgggaggatgactcttacttgtttgatctcgataacaaagatggcgaggtctactgcattgacgcccgatattatggaaacatctcaagattcattaaccacttatgtgatcccaacatcatccctgtccgagtttttatgctccatcaggacctgaggtttcctcgcatcgctttctttagctccagagacatacggaccggagaagagctggggtttgactacggagatcgcttctgggacatcaaatctaaatattttacctgccaatgtggcagcgaaaaatgtaaacacagtgctgaagccatagccctggagcagtccagattagcccgactcgatcctcaccccgagctcctgccggaactagggtcattgcctcccgtgaatacctag

SEQ ID NO: 116173 - DNA, 3531 bp, Artificial Sequence
  Description of Artificial Sequence: Synthetic coding sequence
atggcagccgccgcgggagcagccgcggcagctgctgccgaaggtgaggccccggcggagatgggggctctgttactggaaaaagaaactcggggtgccacagagcgggtgcatggctccttgggcgacactccacgcagtgaggagacactaccgaaagctaacccagacagcctggaaccggccggtccctcaagcccagccagcgtgacagtgactgtgggtgacgagggcgcagacactccagtgggggccactccactcatcggggacgagagcgagaacctggagggcgacggagatctaagaggaggccgcattctcctgggacatgcaacaaagagcttcccttccagcccatccaagggaggctcctgcccttccagggctaaaatgagcatgactggggctggtaaatcccccccttccgtccagagcctcgcgatgaggctgctgtccatgcccggcgcacaaggggcagcagccgctggcagcgagcctccaccagccactacctcccctgagggccagcctaaagtgcaccgagcgaggaaaaccatgtctaaaccgggcaacggccaaccccccgtgcccgaaaagcgccctcctgagatccaacactttcggatgtccgatgatgtgcattccttgggcaaggtgacatctgacctggcgaagcgccgtaagttaaactctggaggtggcttaagtgaagagctcggctcagcgagacgaagcggggaggtgacactcaccaagggagaccccggatcactggaggagtgggagacagtggtgggggatgacttcagcctgtattatgacagttacagcgtagatgagagagttgactcagatagtaaaagtgaagtggaagctctcacagagcagctgagtgaagaggaagaagaagaagaggaggaagaagaagaggaggaagaggaggaggaggaagaggaagaggaagaggatgaggagtcggggaaccagagcgaccgctcgggctcttctgggcgccggaaagccaaaaagaagtggagaaaggattcaccctgggtgaaaccctctcggaagaggcgaaagcgagaacctcccagagcaaaggagccaaggggcgtgtcaaacgacaccagttctctcgagaccgagcgcggctttgaggagctccccctgtgcagctgccgaatggaagctccaaagatagatagaatatctgagagagccggccataagtgtatggcaaccgaatctgttgacggggaactgtctggttgcaatgcagccattctcaagcgtgaaacaatgcgtccatcttctcgcgtagccctcatggtcctctgtgagacgcacagagccagaatggtgaagcaccactgttgccccggatgcgggtacttctgtacagccggaacattcttggagtgtcatcccgatttcagggtggctcacaggtttcataaagcttgtgttagccagctgaacggtatggtgttctgcccccattgtggcgaggatgcgtccgaggcacaggaggtgacaatccccagaggcgacggcgtgaccccgcccgctggcaccgcagctccagcgccgccccctctctctcaggacgttccaggaagagcagacaccagtcagccatcagctcgcatgaggggacatggcgaacccaggcgtccaccctgcgatcccctcgcagatacgatcgactcttccggccctagcctgactctccctaacggtggctgcctgtctgctgttgggttgcccttaggacccgggcgagaagcgctcgaaaaagcactagtgattcaggaatccgagcgaaggaagaaattgagatttcacccccgccagctgtatcttagcgtcaaacagggcgaactccaaaaagtcatcctgatgctgctggacaatctcgacccaaactttcagagcgatcagcagagcaaaagaacacctttacatgcagcggcccaaaaaggctcagtggagatatgccacgtgctgctccaggctggcgctaatattaatgccgtcgacaaacagcagcgaactccactcatggaagcagttgtgaacaaccatctggaagtggcacgatatatggtgcaaagaggcggctgtgtatatagcaaggaagaggacgggagtacgtgtctgcaccatgcagccaagattggaaacctcgagatggtgagcttgcttctgtccactggccaggtggatgtgaacgcccaggacagtggcggctggacacccatcatctgggccgcggagcacaagcatatcgaggtcatccgtatgctgctcactcggggagcagacgtgactctgacagataacgaggaaaatatatgcctgcactgggctagcttcaccggaagtgcagctatcgccgaggttctgttaaatgcgaggtgtgatctacacgcggtaaactaccatggagacacccccctgcacatcgcagcccgcgagtcttaccatgattgcgtgctgcttttcctgagtcgaggtgccaatcccgaactgcgtaacaaggaaggtgacaccgcttgggatctcacacccgagaggagtgatgtctggtttgcactgcagctgaatagaaagttgcgactgggggtgggaaatcgcgcgattagaactgagaaaattatttgtcgtgatgtagcacgcggctatgagaatgtgcccattccctgcgtaaatggggtggatggggaaccgtgccctgaagactataaatacatttcagagaattgtgagacttcaaccatgaatatcgatcgcaatattactcacctgcagcactgcacttgtgtggacgactgttccagttccaactgcctttgcggtcaactgtccattcggtgttggtacgacaaagatggacgattgctgcaggaatttaataagattgaacctccgctgatttttgaatgcaatcaggcctgctcttgttggaggaattgcaaaaatcgggttgtgcagtccggcataaaggtgcgactccagctttacaggactgccaagatgggatggggtgttagagccctacagacgatcccacaggggacgtttatttgcgaatacgttggtgaattgatctctgacgccgaggccgatgtccgagaagatgattcctatctgttcgatctggacaataaggatggtgaggtttattgcattgatgctcgatactatggaaacatctcccgcttcattaaccatctgtgtgaccctaacattatccccgtgcgggtgtttatgttgcaccaggatctgaggttcccacgaatagctttctttagttcccgggacatccgaactggggaggaactgggctttgattacggagacaggttttgggacattaagagcaagtacttcacctgtcagtgtgggagtgagaagtgcaaacacagtgccgaggccatcgcactggaacaaagccgtctggcccgactggacccccacccagagcttctaccggaactggggtcactgccgcctgtgaatacctag

SEQ ID NO: 116174 - DNA, 3096 bp, Artificial Sequence
  Description of Artificial Sequence: Synthetic coding sequence
tcctgtcattgtactccaagttggccgcctgtgcctgaaaaaaggccccctgagatacaacatttcagaatgagcgacgatgtacatagcctgggaaaagtgactagcgatcttgccaagcggcgaaaactcaacagcggtggggggctgagcgaggaactgggttcagcgcgtcggtctggggaggtgactctgacaaagggtgatcccgggtccctggaagaatgggaaaccgtcgtgggggacgactttagtctttattacgacagctattccgtggacgagagagtggactctgatagtaaatccgaggtagaggctctgactgaacagctcagtgaggaggaagaggaagaggaagaggaagaagaggaagaggaggaagaagaagaggaagaggaggaagaagaggatgaagagagtggtaatcaatcagaccggagcggctcaagcggcagacgcaaggcaaagaagaagtggcggaaggattctccctgggtaaagccctcacgcaaacgaagaaagcgggagcctccccgggctaaagagcctcgtggagtcaacggtgtagggtcgtccggaccatctgaatatatggaggtcccactgggctccctggagctgcctagtgagggaactctgagtccaaatcacgctggggtttcaaacgacacctcaagcctggagactgaacgcggattcgaagagcttcctctttgttcctgtcgaatggaggccccgaaaatcgataggattagcgagcgcgccggtcacaagtgcatggcgactgaaagcgtggatggcgagctcagcgggtgcaacgcggctatactcaagcgcgagaccatgcgtccatcatccagggtcgcactgatggtcctctgtgagacccaccgcgcacgcatggtcaaacaccactgctgtcccggctgtggttatttctgcaccgcaggaacctttctcgagtgtcaccctgacttccgcgtagcccatcgcttccataaagcatgcgtgtcacagttgaatgggatggtgttttgcccccattgcggagaagacgcttcagaggctcaggaagtgaccatacctagaggcgacggtgtgaccccaccagctggtaccgccgcccctgcacccccccccctttctcaagatgtgcccgggagggctgacactagtcagccttccgccaggatgcgcggccacggcgagccaaggcggcccccttgcgaccctctcgccgacacaattgactcttcaggcccttctctgaccttgccaaatgggggctgcctcagcgccgtcggattaccactgggccctgggagggaggcgctcgaaaaggcccttgtgatacaagaatcagaacgccgtaaaaagctgcgctttcacccaagacagctgtacctgtcagttaagcaaggagagctacagaaggtgattcttatgctcttagacaacctggatccaaactttcagtctgatcagcagtcaaaaaggacacctctgcatgctgcagcccagaaggggtccgtagagatatgccacgtgcttcttcaggcaggcgccaatataaacgctgtggataagcagcaacgcacccccctcatggaagctgtcgttaacaaccacttggaagtcgcgagatatatggttcagagaggagggtgcgtgtattctaaggaagaagatggctccacgtgcttgcaccacgccgctaaaattggcaaccttgaaatggtctccctcctgttgagtacaggacaggtagacgtgaatgcgcaggatagcggaggctggacgccaattatatgggcggcagagcacaagcacatcgaagtcatccggatgcttttgaccaggggcgcagacgtcaccttaacagacaacgtgagcgagaggctcgtggaagaggaaaacatatgcctgcactgggccagttttacaggtagtgcagcaattgctgaagtgctcctgaatgctcggtgtgatctccacgctgtgaactatcatggcgatacacctcttcacatcgctgcccgggagtcttaccacgactgtgttctcttgtttctgagccgaggtgccaatccagagctgaggaataaagagggagataccgcgtgggacttgacgccagagcgctccgatgtgtggttcgcgctacaacttaatcgaaagctgagattaggcgtcggaaatagagccattcgcactgaaaaaattatctgcagagacgtagccagaggatatgaaaatgtgcccatcccttgtgtgaacggcgtcgatggtgagccttgtcccgaagactataagtatatctctgaaaattgcgagactagtacaatgaacatagacaggaatataacacacttgcagcattgcacttgcgtggatgattgctcctcttcaaattgcctctgcggccaactgagcataaggtgttggtatgacaaggacggccgcctcctccaagagttcaacaagatcgaaccacctctgatcttcgagtgcaatcaggcatgctcatgctggaggaattgtaagaatcgggtggtgcagtctggcatcaaggttcgcctgcaactgtacaggaccgctaagatgggttggggagttcgcgcgcttcagacgattccgcaggggacgttcatttgcgagtacgtcggcgaactgatcagcgacgccgaagcagatgtgcgagaagatgactcttatctgtttgatctggataataaggacggagaggtgtattgcattgacgcacgttactacggtaacataagtcggtttattaatcacctctgcgacccaaatatcataccggtgagggtgtttatgctacaccaagacttacggtttccccgtatagccttcttttccagtagggatatcagaacaggagaagagttaggcttcgactacggggataggttttgggacatcaagtcaaaatacttcacttgtcagtgcgggagcgagaaatgtaagcacagcgctgaagccatcgccttggaacagagtcgactggccaggctggacccccaccccgagctgctacctgagctcggctcgctcccacctgtgaacacctag

SEQ ID NO: 116175 - DNA, 3702 bp, Artificial Sequence
  Description of Artificial Sequence: Synthetic coding sequence
atgcgaggactgccacgcggccggggattaatgcgcgcacggggtcgcggcagggccgcccctcccggatctagaggcagaggccgtggaggacctcaccggggcaggggtaggcccagatccttgctgtctctgcccagggcgcaggccagctggacccctcaattgagcaccggactcaccagcccccctgtcccttgtctgcccagccaaggggaggctcctgcagagatgggtgcactcctcttggaaaaagaaactaggggcgcgacagagcgagtgcatggcagtctaggtgacactcccagaagcgaggaaacactcccaaaagccacccctgactctttggagcccgccggacctagctcaccggcgtctgtcaccgtaactgtgggcgacgagggagctgacactcccgtcggcgccacccccctgattggagatgaaagcgagaaccttgaaggcgacggcgacctgagaggcggtcggatcttgttaggacatgcaacgaagagttttcctagctctccctcaaaggggggcagctgcccttctcgcgcgaagatgtctatgactggcgccgggaaatccccaccaagcgtgcagagcctggctatgcgcttgctgagtatgccgggggcccagggggcagcagccgccggaagcgaacctcccccggccaccaccagcccagagggtcaaccaaaggtccacagggcaagaaagacaatgtccaagccaggaaatggccagccaccggtgccagagaagcggcctcctgaaatccagcatttccgcatgagcgatgatgtccacagtctggggaaagtaacatcagacttagctaaacggcgcaagctgaattcgggcggtggcctcagtgaggagctgggttcggcaagaaggtctggagaggtcacactgacaaagggcgaccctgggtctcttgaagagtgggagacagtggtgggcgatgacttttctctgtactatgattcgtacagcgtggatgagcgtgtagacagtgacagcaaatcagaagttgaggcactcacagagcagcttagcgaagaggaagaggaggaggaagaagaagaggaagaagaggaagaggaggaagaggaggaagaagaagaggaagacgaagagagtggcaatcagagcgacaggagtggctccagtggacgcaggaaggcaaaaaaaaagtggcgcaaagattcaccgtgggtgaaaccatcccgcaaacgtagaaaaagggagcctccgcgggccaaggaaccccggggcgtgagtaacgacacctccagtctggagacggaaagggggttcgaggaactcccattatgttcctgcagaatggaggctccaaaaatcgacaggatttccgagagggcagggcacaagtgtatggctaccgagagcgtcgatggcgaactgagcgggtgcaatgccgccatcttgaagagagagactatgcgcccttcctctagagtggcgctcatggtcctgtgtgaaacccatagggcccgtatggtgaaacatcactgctgtcccggatgtgggtatttttgcaccgcaggcacatttctcgagtgtcatcccgattttcgagtagcgcacagatttcataaagcctgcgtctctcagctgaacggaatggtgttctgtcctcattgtggcgaggacgcttccgaggctcaggaggtcaccataccacgaggggacggcgtgactccacctgccggcacggctgctccggctcccccgccattgtcacaggatgtgccgggacgagcggatacctcccaaccatcagccagaatgcgcgggcacggcgaacctagaaggcccccatgcgaccctctcgccgacacaatcgacagtagcggtccaagtctgacattaccgaatggaggttgtctgtcagccgtgggcctccccctcggccccggtagagaagcccttgagaaggccctggtgatacaggagtccgagcggcggaagaaactcagattccaccccaggcagctctatctgtccgtcaaacagggggagctgcaaaaagtgattttgatgctgctggacaacctggaccccaattttcaatctgatcagcagagcaaaaggacaccactgcacgcagcagcccaaaaggggtccgtggagatttgtcacgtgttactgcaggccggcgctaatattaatgcagttgacaaacagcagagaactccattgatggaggcagtcgtcaacaatcatctagaggtggctaggtatatggtgcaacgagggggctgtgtctacagcaaggaggaggatgggtctacttgtctccaccatgccgctaaaatcggcaatctggaaatggtcagcctgttgctgtccacaggtcaggtggacgtcaacgcccaggactcaggtgggtggactccgattatttgggccgctgaacataagcacatcgaggtcatccgtatgcttctaactcgtggcgctgatgtaacgctcacggataatgaggagaatatttgcctacattgggcgagctttaccggatctgctgctattgcagaggttctactgaacgcccggtgcgatctccacgcggtcaactatcacggggacacaccgctccatatcgccgccagggagtcctatcacgactgtgtgctgctgttcctgagcaggggagctaatcctgagttacgcaataaggaaggcgacacggcctgggaccttacaccagaaagaagcgacgtgtggttcgccctgcagctgaaccggaaattacgccttggcgttgggaacagggccataaggacggagaagatcatctgccgggatgtggctcgtgggtatgaaaatgtcccgatcccttgcgtaaatggcgttgacggagagccctgccctgaggattataagtatatttccgagaactgcgaaacctccactatgaatattgaccgcaatataactcatcttcagcattgcacctgtgtggatgactgctcctcatcgaactgtctctgtggacagctgagtatccgctgctggtatgacaaggatggtcgcctgctgcaagagttcaacaagattgagccacccctgatattcgaatgcaatcaggcttgttcatgttggcggaattgcaagaacagggtggtgcagtccggaataaaagtcagactgcagctctatcgcacagcaaagatgggatggggcgtccgggctctgcagacaattcctcagggaacattcatctgcgagtatgttggtgagctaatctctgacgccgaggctgacgtgcgcgaggacgattcttacttattcgatcttgataataaagacggcgaggtatactgtatcgatgcacggtattatggcaatatatcgcggttcattaaccacctttgcgatcccaatatcataccagtacgcgtgtttatgctgcaccaggatctccggtttccgagaatcgcgtttttcagctccagagatatccggaccggggaggagcttggattcgattatggcgataggttctgggatatcaagtcaaagtacttcacgtgccagtgcgggtcagagaaatgcaagcattctgccgaggccatcgccctggaacagagtaggctggcccgcctggacccccaccctgaactgcttccagaacttggatccctcccgccagtaaacacatag

SEQ ID NO: 116176 - DNA, 3804 bp, Artificial Sequence
  Description of Artificial Sequence: Synthetic coding sequence
atgcgcggtctgcctagaggaagagggcttatgcgtgccagggggaggggacgcgcagccccacctggctctagggggcgtggaagggggggaccccataggggccgagggaggccccgcagccttctctccctccccagggctcaagcttcctggactccccagttgtcaactgggctgacgagcccacccgttccttgtcttccaagtcagggtgaagcaccagcagagatgggcgccttgctgcttgagaaggagaccagaggagcgactgaaagggtccacgggtccttgggtgatacgccacgctcggaggaaacattaccaaaagccaacccagactcgctggagcctgcaggtcctagtagcccagcgtccgttacagtcaccgtgggtgatgagggcgccgatacccccgtcggtgcaacacccctcatcggggatgaaagcgagaaccttgaaggagatggggatttgcgaggtggacgaatactactcggtcacgccaccaagagttttccatcctcgcccagtaagggtggatcatgccctagccgggctaagatgagtatgactggagccggaaagagccctccttcagtccagtctctggcgatgcgactcctctcgatgcctggcgcccagggggccgctgcggccggctccgagccccccccagcaaccaccagccccgagggtcaaccaaaagtacatcgagcacggaaaaccatgtctaaacccggcaatggacagccgcctgttcctgagaaacggccacccgagatccagcacttcaggatgtcagatgacgtccacagcctcggaaaggttacgagtgacttagccaagagaaggaagctgaactcaggtggtggactaagcgaagagctggggtcggcgcgcagatctggtgaggtaacacttacaaagggggatcccgggtccttagaggagtgggagacagtggtcggagatgatttctcactgtattacgactcttactccgtagacgagcgcgtggatagcgacagtaaatctgaagtggaggctctgacagagcagctttctgaagaggaggaggaggaagaagaagaggaagaggaagaggaagaggaagaggaagaagaggaggaagaagaggacgaagaaagtggcaaccagagcgataggagcggaagtagcggaaggaggaaagctaaaaaaaaatggcgcaaggatagtccctgggttaaaccttctcgaaaacgccgcaagagggagcctcctagggctaaggagcctcgcggagtgaacggcgttggctccagtggacctagcgagtatatggaagtcccactgggatcactggagctgccctccgagggaaccctgtccccaaatcatgccggtgtgtcaaatgacaccagttctctggaaaccgagcggggttttgaggagctccctctctgctcgtgcagaatggaggcgcccaaaatcgatcgcatctctgagagggcgggccataagtgcatggctaccgagtctgtggatggcgagctctcaggctgtaatgcggctattctgaagagggagacaatgagaccaagctccagagtcgcattgatggttctctgtgagactcacagggcccgcatggtgaagcaccactgttgccccggatgcgggtatttttgcactgctggaaccttcttggaatgtcatcctgacttcagagttgcacaccggttccataaagcttgcgtgagccagttaaacgggatggtgttctgtcctcattgtggggaggacgcatcagaggcacaagaggtgacaataccccggggcgacggtgttaccccgcctgccggaacggcggctccagcccctcctccactctcccaggacgttcccgggagagccgatacatcccagccttctgcaagaatgaggggccacggggaaccccgacgcccgccatgtgacccactcgctgataccatcgacagctccggccccagtttgacactccctaacggtggatgtttatctgcagttgggctccccctcgggccaggccgtgaggctttagaaaaggctctggtgattcaggagtctgagcgccgaaagaaactgcggttccatccgcgccagctctacttatctgtgaaacagggggagcttcagaaagttattttaatgttgcttgacaacctggacccaaactttcagtccgatcagcaaagcaaaaggaccccactgcacgctgcagctcagaagggctccgttgagatctgtcacgtgctcctccaggcaggagcgaacataaacgcagtcgataaacaacagaggactccgctcatggaagcagtggtcaacaaccatctggaagtggcgagatacatggttcagcgaggaggttgtgtgtacagtaaggaggaggatggttctacttgcctgcaccatgccgctaaaattggcaatctggagatggtgtcactgctcctgagcaccggacaggtcgacgtaaacgcccaggatagtggcgggtggaccccaatcatttgggcggcagagcacaagcatattgaagttattaggatgctgctcacacggggcgctgacgttacccttacagataacgaggagaacatctgtttacactgggcttcctttactggcagcgccgcgatcgctgaggtcctgctgaacgcgaggtgtgatctgcatgccgtcaattaccacggtgacacccccctacacatcgccgctcgcgagtcgtaccatgattgtgtcctgctcttcctgtctcgaggcgctaatcctgagctgcgaaataaggaaggggatactgcttgggacctgacccccgagcggtctgacgtgtggttcgctctccagcttaaccggaagctgcgcctgggcgtcggcaacagggctatcagaactgagaaaattatttgtcgtgatgtggcaagaggttatgagaatgtacccataccttgtgtgaacggagtggatggtgagccctgtccggaagactacaagtacatctccgaaaattgcgaaacttccaccatgaatattgatcgtaacattacccacctgcaacattgtacatgtgtggatgattgtagctcatctaattgcctgtgtggtcagctcagcattagatgttggtatgacaaagacggtcggctcctccaagagttcaataagattgaaccaccactcatctttgagtgtaaccaagcgtgtagttgttggcgcaactgcaagaatcgcgtggttcaatctggcattaaggtacgattacagctgtataggactgccaagatgggatggggtgtgcgagcacttcaaacaattccacaggggacatttatctgtgagtacgtgggtgagctaatttccgatgccgaagctgatgtgcgcgaagacgattcgtatctgttcgatctggataacaaggacggtgaggtgtattgcattgacgctagatactacggtaatatctcacgcttcatcaaccatctttgtgaccccaatatcattcctgtccgggtttttatgctgcaccaggatttacgctttccgcgtatcgccttctttagttctagagatatcagaaccggggaagagctgggatttgattatggggaccgtttttgggacatcaaaagcaaatacttcacgtgtcagtgcggctctgagaagtgtaaacactcagcggaagctattgctctggagcagtccagactggcccggctggacccccatcctgagctacttccggagcttgggagcctcccaccagtgaacacttag

SEQ ID NO: 116177 - DNA, 897 bp, Artificial Sequence
  Description of Artificial Sequence: Synthetic coding sequence
tgaagcaagaggacccccctccacgctgccgcccagaaaggctcagtcgagatttgccacgtgctgttacaggcaggagccaatattaatgcagttgataagcagcagaggaccccgctcatggaagcagtagtaaataaccacctggaggtcgcccgctatatggtccagagaggagggtgtgtgtacagcaaggaagaggacgggtctacatgtctgcatcatgccgcgaaaattgggaatttagagatggtctccctgcttctgagtacaggccaggttgatgtgaacgcgcagggccagctacccccgccctccctcccttcacaccctcaggattccggcggatggacaccaataatctgggctgccgaacacaagcatattgaagttatcaggatgttactgacgcgcggagcggacgtgacactcactgacaatgaggaaaacatttgccttcattgggcaagcttcaccggatcggcggcaattgccgaggtactactcaatgccaggtgtgacttgcatgccgtgaattaccatggggataccccactgcacattgccgctagggagtcgtaccacgactgcgtgctgctgttcctgtccaggggtgccaatcccgaattgcgcaataaagaaggcgataccgcctgggatctgaccccagagcgcagcgacgtgtggtttgctctgcaactcaaccgcaaactgagactaggagtgggcaacagagctatcagaacagaaaagattatctgtagagatgttgcacgcggatacgaaaacgtgccaatcccttgcgtgaacggagtggatggggagccatgcccagaggattacaagtacatttccgaaaactgcgagacttccaccatgaacattgatcggaactag

SEQ ID NO: 116178 - DNA, 897 bp, Artificial Sequence
  Description of Artificial Sequence: Synthetic coding sequence
tagtctaaacgcacccctcttcatgctgccgcacagaagggcagcgtcgagatctgtcacgtcttgctccaggctggggccaacatcaacgccgtggacaaacaacagaggactccactgatggaggccgttgtgaacaaccacctcgaggtggcccgctatatggtccagagaggcggctgcgtctactctaaggaggaggacgggtccacctgcctgcaccatgccgcaaagattggtaacctggaaatggtttccctgctgctcagcactggccaggtggatgtcaatgcacaggggcagttgccccccccatcactgcccagtcatccacaggactctggcggctggacacctatcatctgggccgcagagcataaacacatcgaggtgatacgcatgctcctgactaggggcgctgacgtcacactgacggataacgaagagaacatatgtctgcactgggcttcatttaccggtagtgcagcgatcgctgaagtgttactgaatgcacggtgcgacctccacgctgttaattaccatggtgatactcccctgcacatcgccgctagggaatcgtatcacgattgtgttttactgtttctgtctagaggggcaaatcctgagctgcgcaataaggagggcgataccgcctgggacctaacaccggaacgcagcgatgtgtggtttgctcttcagctcaatagaaaactccgcctgggagtggggaatagagccataagaactgagaagatcatttgtcgggatgtcgcccgcggctacgaaaacgtgccaattccctgcgtaaacggcgtcgacggggagccttgccctgaggattacaagtacattagtgagaactgtgaaacgagtacaatgaacattgatcgtaactag

SEQ ID NO: 116179 - DNA, 3633 bp, Artificial Sequence
  Description of Artificial Sequence: Synthetic coding sequence
atggccgccgccgccggcgccgcagcagctgctgctgccgagggcgaagcaccagccgagatgggtgctctcctgctcgagaaggagacacggggcgctacggaaagggtgcatgggtccttgggagacacaccccggtcagaagaaacactgccaaaagccacacccgacagtctggagcctgcggggccatctagtcccgcctctgtgaccgttactgtcggcgatgaaggcgctgacaccccagttggggccacacccctgattggtgatgagagcgaaaaccttgaaggcgacggcgaccttagagggggcaggatcctcctgggccatgcgactaaaagcttccccagctctcctagcaaaggggggtcgtgtccctcgagagcaaagatgtctatgacgggggcaggcaaaagccccccttcagttcagtccctggcgatgaggttgttatcgatgccgggggcccagggagccgccgcagccggctccgaaccgccaccggccacaactagcccagaaggccagccgaaggttcaccgtgcgcggaagaccatgtccaagcctggtaatggccagccaccagttcccgagaaacggcctccagagatacaacattttcgtatgtccgatgacgtgcattccttggggaaggtgacttcagacctcgctaagcgcagaaaactaaacagcggaggggggctctctgaggagctgggcagcgcaagaagaagcggagaggtcaccctcaccaaaggtgacccgggatcgctcgaagaatgggagactgtggtgggcgatgactttagtctttattatgatagctactctgtggatgagcgtgtggattccgatagtaagtcagaagtggaggccttgacagagcagctctcagaggaggaagaagaagaagaggaggaggaagaagaggaagaagaggaagaggaagaagaggaagaggaagaggacgaggaaagtggcaaccaatctgacaggtcaggctccagtggccggcggaaggctaagaagaaatggaggaaagacagcccctgggtcaaaccctccaggaagcgacggaaaagggagccacctcgcgctaaagaaccccgtggggtgaatggtgttggctcttcgggtccaagtgaatacatggaagttcccctgggttccctggagctcccctcggagggaactttgtcccccaatcacgccggcgtcagcaatgacacaagcagcctggaaaccgagcgtgggtttgaggaactaccgttatgctcctgcagaatggaggcccccaaaatagatcgtatcagcgagagagcaggccacaagtgcatggcaacagaatcagtagacggagagctctcagggtgtaatgctgcaattctcaagcgagagactatgagaccatccagcagagtggcgctgatggttctgtgcgagacccaccgtgcccgcatggtgaagcaccactgctgtccaggctgtggatacttctgcactgctggtacttttttggagtgccatcccgacttccgcgtcgctcacagattccataaggcatgcgtctctcagcttaacggtatggtgttctgccctcattgcggagaggatgctagcgaggcccaggaggtgaccatcccacgaggtgacggagtcacccctcctgcaggcacagccgcccctgcccccccccctctaagtcaggacgtccctggcagggccgacacctcacagccgagcgctagaatgcggggacatggagagcctcggcgccccccatgcgatcctctggccgatacaatagactcctctggcccgagtctcacgctgcctaatggtggatgtctgtccgcggtcggattgccattagggcctggtcgagaggcactggaaaaggctttggtcattcaagaaagcgaaaggcgcaagaagcttcggtttcacccgcggcagctctacctatccgtgaagcagggagaattgcagaaagtgatcttgatgctcttggacaatctggatcccaacttccagagcgaccagcagtcaaaacggaccccactgcacgctgcagcacaaaagggctcagtcgaaatttgccatgtgcttttgcaagccggtgcaaatatcaatgccgtggacaagcaacagagaaccccgctcatggaggctgtcgtcaataatcacctggaggtggctaggtatatggttcaacgcggaggctgtgtctattctaaagaggaagacggtagtacctgcttgcaccatgcggccaaaataggtaacttagaaatggtgagcctgctgctcagtaccggccaggtggacgtgaacgctcaggatagcgggggttggacaccaattatttgggcagctgagcacaaacatatcgaggttataaggatgctattgaccaggggggccgacgtgaccctgacggataacgaagaaaacatctgcttgcactgggccagcttcaccgggtcggccgctattgctgaggtgttgctcaatgctcggtgtgacctgcacgccgttaactatcatggagacactccccttcatatcgctgcccgtgagagctatcacgattgcgttctgttgtttctttcccgaggggccaaccctgaacttaggaataaggagggagacaccgcctgggatcttacacccgagagaagtgacgtgtggtttgccctgcaactcaatagaaagttaaggctaggcgttggcaaccgcgctatacgtacagagaagattatctgcagggatgtcgctcgcggctacgagaacgtccccataccatgtgtaaacggggtcgatggggaaccctgtccagaagattacaagtatatcagcgaaaattgtgaaacctcgactatgaatattgatagaaatatcacgcatctgcagcattgcacgtgcgtcgacgattgctcttcatccaactgcctgtgtggccaactgtctattaggtgctggtacgacaaggatggccgccttctgcaggagttcaacaaaattgagccacccttgattttcgaatgtaaccaggcttgctcttgctggcgtaattgtaaaaacagagtcgtgcagagtggcatcaaggtcagactgcagctttacaggacagccaagatgggatggggagtgagggctctgcagactatccctcaggggacatttatctgcgagtacgttggagagttgatcagtgacgcggaggcagacgtaagagaagacgattcctacctgtttgacctcgacaataaggatggcgaagtctactgcatcgacgcgcgctattatggcaatattagtagattcataaatcacctgtgcgacccaaacattatcccagttcgagtgttcatgctgcaccaggacctgagatttcctcgcatcgcctttttctctagccgggacataagaaccggcgaggaactcggtttcgactatggagacagattttgggacatcaaatcaaaatacttcacctgccaatgtggttcagaaaaatgtaaacactccgcggaggccatcgcgctggaacagagcaggctcgccaggctagatccccatccggaactgcttcctgagcttggctctctgcctccagtgaatacatag

SEQ ID NO: 116180 - DNA, 3531 bp, Artificial Sequence
  Description of Artificial Sequence: Synthetic coding sequence
atggccgccgccgctggcgcagcagccgccgccgctgccgaaggcgaggcccctgctgaaatgggggctctcctcctcgaaaaagaaacacggggggctaccgaacgggtgcatggtagtttaggggataccccacgctctgaggagactttaccgaaggccacacctgattctctggaaccagccggtccaagttcaccagcgtcagtcactgtcactgtgggggatgagggagccgacacccccgtcggagctactcccctgattggcgatgaatctgagaaccttgagggcgatggtgacttacgggggggcagaatcctgctgggacacgcaaccaaaagctttccatcttccccgtcgaaaggaggctcttgtccgagtagggccaagatgtcaatgacgggagccggcaaaagccccccttccgtacagtccctggcaatgcgactgctatccatgcccggagcccagggggctgccgcagcaggtagtgagcctccacctgccaccacatcccctgaagggcaacccaaggtccatagagcgagaaaaacgatgagcaaacccggtaacggccagccccccgtgccggagaagcgccctcctgagattcagcatttcagaatgtccgacgatgtccactctctgggtaaggtgacctccgacctggccaaaagaagaaaactaaatagcggcggaggcctctcagaggaacttggctccgccagacgctccggggaggtgaccctgacaaagggcgatcctgggagcctcgaggagtgggaaactgtggtcggagatgattttagtctatactacgacagctactcggtagacgaaagggtggacagcgatagtaagagcgaagtcgaggcattaaccgagcagctgtccgaagaggaggaggaggaggaggaagaggaggaagaagaggaggaagaggaggaggaagaagaagaagaggaagacgaggagtccggcaatcagagtgatagatcaggaagctctggcaggcggaaggcgaagaaaaagtggaggaaagattccccatgggttaaaccttctagaaaaagacgcaagcgcgagccccccagagctaaggagccaaggggagtatccaatgacaccagcagcctggaaactgagagaggctttgaagaattgcccctgtgcagttgtcgcatggaagctcctaagatcgatagaatctccgagcgcgctggccacaagtgcatggcaacagaaagtgtggatggggagttaagtggttgtaacgccgccatcctcaaacgcgaaactatgcgccccagttctcgtgtggctcttatggttttgtgcgagacacaccgggcaagaatggttaaacaccactgttgtccaggttgcggatacttttgcacagcagggacatttcttgaatgtcacccagatttcagagtggctcataggttccataaagcatgcgtgagccagctaaatggtatggtgttttgtccacactgcggcgaggatgcaagcgaggctcaagaggtgaccattccccgcggggacggagtgactccccctgctggtacagccgctcccgcaccccctcccctgagccaggatgtgcctgggagagccgacacctctcagccctccgcaaggatgcgggggcacggagagcctcgaaggcctccctgcgatcctctcgctgacaccatagattccagtggtccgtccctgaccttgccgaatggtggttgcctctccgcagtgggactgccgctgggacctgggcgggaggctttagagaaagcgctggttatccaagaatcagagcgaaggaaaaagctcagattccaccctcggcaactttacctaagcgtgaaacaaggcgaattgcagaaggtgatactaatgctcctggataacctggatcctaattttcaaagtgaccaacagtccaaaagaacaccgctccatgcagctgcacagaaaggatcagtggaaatctgtcacgttctattgcaagctggggccaacatcaatgcagtggataagcaacagcgtactccgctgatggaggcagtcgtgaacaatcatcttgaggtcgcacgatacatggtgcagcgcggaggctgcgtttactccaaagaagaagatgggtccacatgcttacatcacgccgctaaaatcggcaacttggaaatggtgtcactcctcttatctaccgggcaggtcgatgtgaatgctcaggactctggaggatggacacctattatttgggctgccgagcacaagcacattgaagtgattcgcatgttgctgaccaggggcgccgatgttacgctgactgataacgaggagaacatttgtttgcactgggccagctttactggctctgccgccatagctgaagtgctactgaacgcccggtgtgaccttcacgctgtgaattatcatggcgatacccccctgcatatagccgctcgcgagtcctaccatgattgcgtactcctcttcctctctagaggagccaacccggagctgcgaaacaaagagggcgatacagcctgggatctcacccccgagcgcagtgacgtttggttcgctctgcagttaaaccgcaaattgcggctcggtgtgggaaatcgggccattcggactgagaagataatttgccgggatgtggccagaggttacgagaacgtcccaatcccatgtgtgaatggagtggatggcgaaccatgtccagaagattacaaatatatcagcgaaaactgtgaaacatcaacgatgaacatcgatcgtaacattacacatttgcagcactgcacctgtgtcgatgattgcagtagttcaaattgcctatgcggacagctctcaataagatgctggtacgacaaggacgggcgtctgctccaggagtttaataaaatagaaccacctctgattttcgaatgtaaccaagcgtgctcgtgctggaggaactgtaagaacagagtggtccaaagcggcattaaggtgagacttcagctataccgaaccgccaagatggggtggggcgtccgtgccctccaaaccattccccagggcactttcatttgtgagtacgtgggggagcttatttcggacgcggaggccgacgtgagagaggatgactcctaccttttcgatcttgacaacaaggatggcgaggtgtactgtatcgatgccagatactatggtaatatttccaggtttattaatcacctgtgcgatccaaatataatacccgttagagtgttcatgctgcatcaggaccttagattccctcgcatcgcctttttttcgtcccgggatatccgaactggagaagagctgggtttcgactacggcgatcggttttgggacatcaagtctaagtatttcacttgccagtgtggatcggagaagtgtaaacacagtgcagaagcaattgctctggaacagagcagactggcgcgattggacccgcacccggagttgttgcccgagctcgggagcctgccccccgtgaatacatag

SEQ ID NO: 116181 - DNA, 3702 bp, Artificial Sequence
  Description of Artificial Sequence: Synthetic coding sequence
atgcggggtctgcctcgcggccgcggcttgatgagagcaagggggcgagggcgcgcagcaccacctggcagtcgcggcaggggcaggggcggtcctcaccggggcagaggtaggccacggagtctcctgtctttgccacgtgcccaggcctcctggacacctcagttatctacagggttgactagtcccccagtgccctgccttccttcccagggtgaggcacctgcagagatgggagctctcctgctagagaaggagacccgtggtgccactgagcgagtccatgggtccttaggcgataccccaaggagtgaagaaacgctcccaaaggctaatcctgactcactggaacccgctgggccaagctctcccgccagcgtgactgttaccgtaggagatgagggggctgacacacccgtgggagcaacccctcttatcggtgacgagtctgagaatctggagggcgatggcgacctgagagggggcagaattctgctgggccacgcgacgaaatcattcccaagttctcctagcaagggcggaagttgcccatctagggcaaaaatgtctatgacgggggctggaaagagtccacccagcgtccagagcttggcgatgcggttgctttcaatgcctggcgctcagggtgccgcagcggccggatccgagcctcctcccgccacaacatcccccgaagggcagcccaaggtgcatagagcccggaagacaatgtctaagcccgggaatggacaaccgcccgtgcctgaaaaacggcctcctgaaattcaacactttaggatgtctgatgacgtgcacagcctcggcaaggtcacaagtgacctcgctaagagaagaaagctcaatagtggcggaggcctgagcgaagagctgggctccgcacgccggtcaggcgaggttaccctcaccaagggagaccccggcagtctcgaggaatgggagacggttgtgggggatgacttctcactttactacgacagttattccgttgacgagcgcgtggacagcgactctaagagtgaagtggaggctctaaccgagcaattgagtgaggaggaggaagaagaagaagaggaggaggaggaagaggaggaggaagaggaggaagaggaagaggaggaagatgaggagagcggcaaccagtccgaccggtccggatcttccgggcgccgaaaggctaagaagaagtggaggaaggactccccctgggtcaagccatctcgcaagcgccgcaagagagagccacctcgggcgaaagaaccaaggggggtttcaaatgacacgagtagcctcgaaacagaacgagggtttgaggagctgccactttgttcgtgccgcatggaggctcctaagatcgaccgaatctccgaacgggcagggcacaagtgcatggccacagagtctgtggacggggaactgtccgggtgcaacgcagccatcttaaagcgcgagactatgcgtccttcttccagggtcgctctgatggtgctatgtgagacacatcgagcacgcatggtcaagcatcactgctgcccgggatgcgggtatttttgcacagcaggcacttttctggagtgccatcctgattttagagttgcccaccgtttccataaggcgtgtgtctctcagcttaacggcatggtcttctgtccacattgcggtgaggacgcgagcgaggcccaagaagtgaccattccaaggggagacggcgtgacacctcctgctggcacagctgctccagcacctccacccttgtcgcaggatgtgcccgggagagccgacacctcgcaaccctcagcccgcatgcgaggccacggtgagcccaggcggcccccctgcgatccgctggcagacacgatagatagcagcggcccctcgctcaccctgccaaacggaggttgcctctccgccgtcgggctgcccctaggtcctggtagggaagcactagagaaggcgctggttatacaggaatcagagaggcgcaagaaactgcgctttcatccgcgccagctgtacttgtccgttaagcagggagagttgcagaaggtcattctcatgctcctagataacctggatcctaatttccagtcagaccagcagtctaaaaggacccccctgcacgctgctgcacagaaaggctcagtggaaatctgccacgttttgctgcaggctggagccaacatcaatgccgtcgataagcaacagcggacaccgcttatggaagcagtcgtgaacaaccaccttgaagtagcacggtacatggtgcaacgagggggctgtgtgtactctaaggaggaggacggaagtacctgcctgcatcacgcggcgaagatcggcaacctggagatggtgagcctcctcctgtcaaccggacaggtggatgtgaatgcacaggattcaggaggctggactcctatcatatgggcggccgaacacaaacatatagaagtgataagaatgctgctgaccaggggcgctgacgtgaccctgaccgacaatgaagagaacatttgtctccactgggcttcttttaccggttcagccgctatagctgaagtcttgctaaatgcccggtgtgatctgcacgccgtaaattatcacggagatacgcccctgcacattgccgcccgagagagctaccacgattgtgtgttactttttctgtccagaggcgccaacccggagctgaggaacaaggagggtgacacagcatgggatctcacccctgagcgatcagacgtgtggtttgctctccaactgaatcgaaaacttagattgggtgtaggtaaccgtgcaatacgaacggaaaagatcatatgtcgggacgttgcccggggctacgagaatgtgcccattccatgcgtgaatggcgttgatggagagccatgtccagaggattataaatatatcagcgagaattgcgaaaccagcaccatgaacattgatcgtaacattactcacctccagcattgcacgtgtgtcgatgactgcagctctagcaattgtctttgcggacagctaagtattagatgctggtatgataaggacggcaggttgctgcaggaatttaacaagattgagccgcccttaatctttgagtgcaaccaggcctgcagctgctggcgtaactgcaaaaatcgagtggtgcagagcggaatcaaggtgaggctgcagctctaccggactgcaaagatgggatggggtgtccgagccctccagactattccccagggaaccttcatttgcgagtacgtaggggagttaatctcggatgctgaggccgacgtgagagaggacgacagttacctgtttgacctggacaacaaggacggggaggtgtactgcattgatgctcgatactacggcaatatcagccggttcattaatcatctttgtgatcctaatattattcccgtgagagttttcatgctacatcaggacttgcgttttcctcgcatcgcgtttttctcctccagggacattcggaccggggaagaactggggttcgactacggcgataggttctgggatattaagtccaaatactttacctgccagtgtggatccgagaagtgcaagcattccgcggaggcaatcgccctggagcagtctagacttgcaaggctggacccacatccggagctcttacctgaactgggctctttgccaccagttaatacctag

SEQ ID NO: 116182 - DNA, 897 bp, Artificial Sequence
  Description of Artificial Sequence: Synthetic coding sequence
tgatcaaagaggacacccctgcatgcagctgcccagaaaggctcagtcgagatctgccacgtgttactgcaggctggagcaaacattaacgcggtggacaagcagcaaaggacccctctgatggaggctgtagtcaataatcacttagaagtcgccaggtacatggttcagcgggggggatgcgtttatagcaaggaagaggatgggagcacatgcctacaccatgcggccaagattggtaacttagagatggtctcactcctgctgagcaccggtcaggttgacgtgaatgctcaaggacagctccctccgccttcactgccatctcatcctcaggacagtggcggctggacccccattatttgggcagccgaacacaagcatatcgaggtgattcggatgctgctcaccaggggggctgacgtgacattaacagacaatgaagaaaacatttgcctccattgggcctccttcacaggctcagccgccatcgccgaggtcctcctgaacgcccggtgcgacctgcatgcagttaactatcacggcgacacccctctgcacatcgcagcgagggagagttaccacgactgtgtactgctcttcctgtccagaggagctaatccagagttgagaaacaaagagggcgacactgcctgggaccttacaccggaacgcagcgacgtatggttcgccctgcagctgaaccgcaagttgagactaggggtcggaaaccgcgccattcgcactgaaaagataatttgccgcgatgtggccagaggctacgagaacgtgcctattccctgtgtgaacggtgttgatggcgagccatgccctgaagactacaagtacatcagcgaaaactgcgaaacaagtacaatgaatatcgaccgcaactag

SEQ ID NO: 116183 - DNA, 3531 bp, Artificial Sequence
  Description of Artificial Sequence: Synthetic coding sequence
atggctgctgccgccggagcggccgccgcggcggcagctgaaggcgaagctcccgctgaaatgggagctctgctactggagaaggagactcgcggggcaactgaaagggtgcacggctcccttggcgatacacccaggagtgaagagactttaccaaaagccaaccccgacagtttggagccagcgggcccttccagtcctgcctctgtgaccgtgactgtgggcgatgagggagcagacacgcccgttggagctaccccactaatcggagatgaaagtgaaaatctggagggtgacggggatcttagaggcggcagaatcctcctgggtcacgcaaccaaatcctttccctcgtccccgtctaaaggtggttcctgccctagccgagcgaagatgagcatgaccggggccggcaaaagccctccttccgtccagagcctcgctatgagattattgtcaatgccaggtgcccaaggcgcggcagccgctgggagcgaacctccccctgctaccacctcacctgagggccaaccaaaggtgcatagggctcgcaagactatgtcgaaaccgggcaacggccagccacctgtgcccgagaagagacccccagagatccaacacttccggatgagtgatgatgttcacagtctcggcaaggtaacgtcagacctggccaaaaggagaaagcttaattcaggtggcggactctcggaggagctcggcagtgctaggagatcaggagaagtaaccctgaccaaaggcgatcctggcagcctggaggagtgggagacggtcgtgggggacgatttcagtctctactacgatagctatagtgttgatgagcgcgttgatagcgattccaaaagcgaagtcgaggccctgactgagcagctgtcggaggaggaagaggaagaagaagaagaagaggaagaggaagaagaagaagaagaggaagaagaggaagaggaagatgaggagtctggcaatcagagtgacaggtcgggctccagcggaaggcgaaaagccaaaaaaaagtggagaaaggacagcccctgggtcaagcctagccgaaagaggcggaaacgggaaccccctcgagccaaagaaccccgaggcgtgtctaacgacactagtagccttgagacagagcggggtttcgaagagctcccgctgtgcagttgccgcatggaggcaccgaagattgaccgtataagtgagagagccgggcataagtgcatggcaactgaaagcgtggacggggagctgagcgggtgtaacgctgcgattctgaagcgggagaccatgaggccatctagcagagtggcactgatggtgttatgcgaaactcaccgggctcgtatggttaaacatcattgctgtccgggctgtggatatttttgtaccgccgggacttttctggagtgtcatcctgacttcagagtcgcacaccgtttccataaagcttgcgtgtctcagctgaatggaatggtcttctgtcctcactgtggcgaagacgctagcgaagcacaggaagtcactatccctcgcggcgacggcgtaactccccccgccggcacagcggctcctgccccaccgcccctgagccaggacgttcccgggcgcgcagacacaagccagccttctgcccggatgcgggggcatggggagccccgtcgcccgccttgcgaccccctggctgacacaatcgacagttccggcccgtctctcactctacccaatggtgggtgcctgagcgcagtgggactgcccctggggcctggtagagaggccctggaaaaagcattagttatccaggaatctgagcgtcgtaagaagctgcggtttcatccccgacagctgtatctgtctgtcaaacagggagaactgcagaaagttattctgatgctgcttgataatctggaccctaactttcagagtgatcaacagagtaagagaacccctctgcatgcagccgcccagaaaggttccgtcgaaatatgccacgtgctgctacaggctggagctaacataaatgctgtggacaagcagcagagaacacctctgatggaggcagttgtgaataaccatctagaagttgccagatatatggtgcagcggggaggctgcgtttactccaaagaggaggacggcagcacatgtcttcatcatgccgctaagatcggcaatttagagatggtctctctgctactatccaccggccaggtggatgttaacgcccaggatagcgggggctggacgcctataatttgggctgcggaacataaacacattgaggtgattcgtatgctgcttactcgtggggccgacgtgacgttgactgataacgaggagaacatctgcctgcactgggcatcgttcactggtagtgctgccatcgccgaggtgctcttaaacgctcgctgtgacctgcatgccgtcaactaccacggcgacacccccctccatatagctgcccgagagagttaccatgactgtgttctgctgttcctcagccgcggcgccaacccagaactgcgcaacaaagaaggggatactgcatgggacttaacccccgaacggagtgacgtatggtttgcacttcagttgaacagaaaactgcggctcggtgttggcaaccgggcgatacggaccgaaaagatcatatgccgtgatgtggcgagggggtacgagaacgttcctatcccttgcgtgaacggtgtggacggagagccctgccctgaagactataagtacatctctgagaactgcgaaacgtctacaatgaatatcgacaggaatattacccatttgcagcattgcacttgtgtggacgactgtagcagttccaactgcctgtgtggccaactgagtatccgctgctggtacgataaagatggacgattactgcaggaattcaataagatagaaccacccctgattttcgagtgtaaccaggcttgttcatgctggcgcaactgcaagaaccgggtcgtacaatctgggatcaaagtccgtctgcaactctatcgaactgcaaaaatggggtggggagtgagagccttgcagactattcctcagggaacgtttatttgcgaatacgttggggaactaattagtgatgctgaagctgatgttcgtgaagacgattcttacctctttgatctggacaataaggatggagaggtgtattgcatcgatgcaagatactacggtaacatttctcggttcattaatcacctgtgtgaccccaatatcattccggttcgggtgtttatgctccaccaggaccttagatttccgagaattgcattcttcagctcccgggatatcagaacaggggaggaattgggtttcgactatggcgatcgattctgggatattaagagtaaatattttacatgtcagtgtggtagcgagaagtgcaagcacagcgctgaggcgatcgccctcgagcagagtcgtctcgcccggctggaccctcatccagagctgcttccagaactaggctccctcccacctgtcaacacgtag

SEQ ID NO: 116184 - DNA, 2667 bp, Artificial Sequence
  Description of Artificial Sequence: Synthetic coding sequence
tctgaggtggaagcccttaccgaacagctaagcgaggaggaagaggaggaggaggaggaagaggaggaagaagaggaggaggaagaggaggaagaggaagaggaggacgaggaatctggcaatcagagcgataggagtggatcttcaggccgccgaaaagctaagaagaaatggagaaaggactcaccttgggttaagcctagtcgcaaaaggaggaaacgcgagccacccagagctaaagaaccacgcggtgtcagtaacgatacttcctccctcgaaaccgagcggggattcgaggagctgcctctctgtagctgtagaatggaagccccgaaaattgaccgcatttcagaaagagcaggacataagtgcatggctaccgaatcagtggatggcgaactcagcgggtgcaatgctgcaattttgaagcgtgagactatgaggccctctagtcgggtggctctgatggtgctatgtgagacacacagagctaggatggttaaacatcattgctgtcctgggtgtggatatttctgcaccgcagggacattccttgagtgtcaccccgacttccgggtggctcaccggttccacaaagcatgcgtctcacagctaaacggcatggtgttctgccctcactgcggtgaagatgctagcgaggcccaggaagtcacaattccacgtggggatggcgtgaccccacctgccgggaccgcagcacccgctccaccaccactgtcgcaagacgtgcctggcagagctgatacatctcagccctcagctcggatgcggggccacggggagccgaggcgacccccgtgcgaccctctggcagacacaattgatagttctgggccgtcactaacattgcccaatggtggctgcctgtctgccgttggccttccgctcggccccggtagagaggctctggagaaggctctggtaatccaggaaagcgaaaggcggaaaaagttgcgctttcaccccaggcagctttacctttccgtcaagcaaggcgagctgcaaaaagtgatcctgatgctgctggataatctagacccaaatttccagagcgaccaacagagcaagcgtacaccactgcacgctgctgcccagaaaggttctgtggaaatttgtcacgtcctgttgcaggctggcgccaacataaacgctgtggacaaacaacaacgcacgccactaatggaggcggtggtcaacaaccacttggaagtggctaggtacatggtgcagagaggggggtgcgtttatagtaaagaggaggatggttctacttgtctgcatcacgctgccaaaatcggcaaccttgaaatggtcagccttctgctatcaaccggccaggttgacgttaacgcacaggactccggaggatggactccaataatctgggctgccgaacacaagcacattgaagtgatccggatgttgctgacccgcggcgctgatgtcactcttacagacaatgaggaaaatatctgcctgcactgggccagcttcacgggatccgctgcaatcgcagaggtcctcctgaacgcacggtgtgatctgcacgccgtaaactatcacggagataccccgctgcacatcgcagcgagggagtcttaccacgattgcgtgctgctcttcctttcacggggggccaacccggaactcaggaataaggagggggatactgcctgggacctgacccccgagcggagcgatgtttggtttgcattgcagctcaacaggaagttaagactaggggtggggaaccgcgccatccgcacggagaagattatctgccgggacgttgcgagaggatatgagaatgtcccaatcccctgcgttaacggcgtcgacggtgaaccctgcccagaagattataaatacatctccgaaaattgtgagacctcgaccatgaatatcgaccgaaatattacacacctgcagcattgtacatgcgtcgacgattgtagcagttctaattgcctctgtggccagttgtccatcaggtgctggtatgacaaggacggcagactgttgcaggagtttaataaaatcgaaccgccactcatctttgaatgcaaccaggcctgttcttgctggaggaactgcaagaatagagtagtccagtcaggcattaaagtgcggctgcaactctaccgcaccgccaagatgggatggggggtccgcgctctgcagacaatacctcagggaacgttcatttgcgagtatgttggcgagctcatcagtgacgccgaagctgatgtgagagaggacgattcctacctgtttgacttggataacaaggatggcgaggtgtattgtattgatgctcggtattacggtaatattagccggttcatcaatcacctgtgcgacccaaacatcatcccagtacgtgtgtttatgctgcatcaggacttaagattcccgcgaatcgcatttttttccagccgggacattcgaaccggcgaggaactcggcttcgactacggggataggttttgggatatcaaatcaaagtactttacatgccagtgcggcagcgagaaatgtaagcacagcgctgaggccattgccctggaacagtccagactggcccgcctggacccccacccggaactcctgcctgagctaggcagcctgcctccggtcaatacctag

SEQ ID NO: 116185 - DNA, 2769 bp, Artificial Sequence
  Description of Artificial Sequence: Synthetic coding sequence
tccgaggtcgaggcactgaccgaacagttgagcgaggaagaagaagaagaagaagaggaggaggaagaggaggaagaagaagaggaggaagaggaggaggaggaagacgaggaatcaggcaaccaaagcgaccggagtggcagctcgggccgcagaaaggcgaagaagaagtggcgaaaagacagtccctgggtgaagccatccaggaaaaggaggaaaagggagcctcctagagcaaaggaaccacgaggcgtgaacggcgtgggctcttccggcccctctgaatatatggaggttcccttgggcagtctcgaactacctagtgaaggaacgctgagccctaaccacgccggcgtgtccaacgacacgagttccttagagaccgagagagggtttgaggaactaccgttgtgttcatgcaggatggaagccccaaagattgatcggatatccgaacgcgcaggccataagtgtatggccacagaatccgtggacggggagctcagtgggtgtaatgccgccattctcaagcgagaaaccatgcgaccctcctctagagtggcactgatggtgttgtgcgagacccacagggctcgaatggtgaagcatcattgttgtcccggctgtggatatttttgtacggctggaacgttcctggaatgtcacccagattttagagtcgctcacaggtttcataaggcttgtgtgtctcagctcaatggaatggttttttgcccacattgcggggaggacgcatccgaagcccaggaggtaaccatcccccgcggcgatggagtgaccccacctgcaggaactgcagcacctgcccctccaccgttaagccaggacgttcccggcagggcggacacaagccagccttccgcgcgaatgcgtggccacggtgaaccacggcggcccccatgtgaccccctggctgacacgatcgattcttccggaccatcactgactctacccaatggtggctgtttaagtgccgtgggcctcccactgggtcctggtcgtgaggcattagagaaggctttggtgatacaagagagcgagaggcgtaagaagctgcggttccacccccgccagctctatctgagtgtcaaacagggtgagttacaaaaggtgatacttatgctcctggataacctcgatccaaactttcaatctgaccagcagtccaagagaacaccactccatgccgctgctcagaaaggttcggttgagatctgccacgtgctgttgcaggcaggcgccaacatcaatgctgtggacaaacagcaacgcacaccactcatggaagctgtggtgaacaaccatctggaggtggctcggtacatggttcagcgaggtggatgtgtttattctaaggaagaggatggatccacttgccttcatcatgcagctaaaatcggcaacttagagatggtgtctctgctactgtctactggtcaggttgatgtcaatgctcaggattcaggaggatggacgccaatcatttgggccgctgagcacaaacatatcgaggttatccgaatgctgctgacacggggagccgatgtgactctgaccgataacgaggagaacatttgcctgcattgggccagcttcactggctcagcggccattgcagaagtgttgctcaacgccaggtgcgatctacatgctgtaaactaccatggcgatacaccgttacatatcgctgcccgagagtcttaccatgactgcgtgctactgttcttatcccgtggcgccaatcccgaactgcgcaacaaagagggcgataccgcatgggatctgacccccgagcgtagcgatgtgtggtttgcccttcagctgaataggaagcttaggttaggagtgggtaacagagctatccgcaccgagaagatcatctgcagggacgtcgctagaggctatgagaatgttcccatcccatgcgttaacggggtggatggcgagccgtgtcccgaggactacaaatatattagcgagaactgcgagacctccaccatgaacattgaccggaacatcacccacttacaacattgtacatgtgtcgacgactgttcttcgagcaactgtctatgtgggcagctgagcatccgctgttggtacgataaggacggccggctgttacaggagttcaataagattgagccaccccttatttttgaatgcaatcaagcttgctcctgttggcgaaattgtaagaatcgtgtcgtgcagagcggaatcaaagtgagactccagttgtatcgaacagcaaaaatgggctggggggttcgggctttacagactatccctcagggcacgttcatctgtgagtatgtgggtgagctcatctctgatgcagaggctgatgttagggaagatgatagctacctatttgatcttgataataaggatggagaggtatattgtatcgatgcccgttattatggtaacattagccgttttattaatcacctgtgtgatcctaacattatccccgtccgggtgtttatgcttcaccaagacctgcgattcccccgcattgccttcttctcctcaagagacataaggacgggtgaagagctgggtttcgactacggtgacagattttgggatattaaatcaaagtatttcacatgccagtgtggcagtgaaaagtgcaagcatagtgccgaggccatagcgctcgagcagtcccgcctggccagactggatccccatcctgagctcttgccggagttagggtcactaccaccggtcaacacttag

SEQ ID NO: 116186 - DNA, 3096 bp, Artificial Sequence
  Description of Artificial Sequence: Synthetic coding sequence
tcatgtcactgcactccctccaggccccctgtccctgagaaacggccacccgaaatccagcatttccgcatgtctgacgatgtacattccctggggaaggtgacttcggatcttgccaaacggcggaagctgaactccggaggcgggctcagtgaagagttgggctccgctcggcgaagcggcgaggtcacccttaccaaaggcgatcccggatcacttgaagagtgggagactgtcgtaggtgatgatttctctctgtactacgattcttacagcgtagacgaacgcgtggatagtgattcaaaatctgaggtagaggctctgacggagcagttgagcgaggaagaggaggaggaggaggaggaggaggaggaggaagaagaagaggaggaagaagaagaagaagaagaagacgaagagtccgggaatcagagcgacagatcgggaagtagcgggcgccggaaagcaaaaaagaagtggaggaaggacagcccttgggtgaaaccaagtcgtaaaaggcggaaacgtgagcccccccgcgcgaaagagccgaggggcgtgaacggagtggggtcctccggcccatcagagtatatggaagtacctcttggcagcctggaactcccaagcgaggggacactatcccccaatcacgccggggtaagtaatgatacaagcagtttggagactgagaggggttttgaagaactgccactgtgttcatgtagaatggaagctcctaagatagacagaatctcggagagagccgggcacaagtgcatggctactgagtctgtggacggtgaactctccggctgcaatgctgcaatactaaaaagggagactatgagaccaagctctcgcgtcgcattaatggtactatgtgaaacacacagggccagaatggtaaagcatcattgctgcccaggctgcgggtacttctgcacagctgggacattccttgaatgccatccggatttccgggtagcccatagatttcataaggcctgcgtgtcccagttgaacgggatggtcttctgcccacattgcggcgaggacgcgagcgaggcacaggaggtaacaattcctcgaggagatggcgttacacctcccgctgggaccgcggcccctgcccctcccccacttagccaggacgtacccggtcgggccgacacctctcagcctagtgcaagaatgcgggggcatggggagccaaggaggccgccgtgcgatcccctggccgacactattgactcatcaggcccatccctgacactgcctaacgggggatgcctgtctgctgtgggactccccctgggacccggacgagaggctctggagaaagcgctcgtcatccaggagtcagaaagaagaaagaaattgcgctttcatcctagacagttgtacctctctgttaagcagggcgaactgcagaaggtgattttgatgctgttggataatttggaccctaattttcagtcagaccagcagagtaaacggaccccgctccacgctgccgcacagaagggatccgttgagatttgccatgtgctgctgcaggcaggtgcgaacatcaacgccgtcgataagcagcagcggaccccccttatggaagctgtggttaacaatcatctagaggtcgcaagatacatggtgcagagggggggttgtgtttattccaaagaagaggacgggtccacgtgtcttcaccatgcagctaaaatcggcaatctggagatggtgtccctgctgctgtcaacggggcaggtagacgtgaacgctcaggacagcggtgggtggacaccaataatctgggcggcagagcacaagcacatcgaggttattcggatgcttctgaccaggggggcagatgtgactctgactgataacgtgagtgaacgtctggttgaagaagaaaacatttgcctgcattgggcctcattcaccggaagcgctgccatcgcggaagttctgttgaatgcacggtgcgacttgcacgctgtcaactatcatggcgatactcccctccacattgccgccagagaaagttaccatgactgcgtgcttctattcctcagcaggggggctaaccctgaactccgaaacaaggagggggacaccgcatgggatttgactccggagaggtctgatgtgtggttcgcacttcagttaaaccgaaaacttcgcttaggcgtgggcaaccgggccatcaggactgaaaaaattatctgcagggacgtggcgcgcggatatgaaaacgtacctatcccctgtgtgaacggagtagatggtgaaccatgcccagaggattataagtacatcagtgagaactgtgaaacttctaccatgaacatagatcgaaacataactcatctgcagcattgcacctgtgttgatgactgctccagttctaactgcctctgtggacagctctccattaggtgctggtacgacaaggatgggcggctcctccaggagtttaacaaaatcgaacctcctctcatcttcgagtgcaaccaggcctgtagctgctggcgtaattgtaagaatcgcgtcgtgcagtctggtattaaagtgagattgcagctctatagaaccgccaagatgggttggggcgtgcgagcgctgcaaacaataccccagggtacctttatctgtgaatatgttggagaactgatctctgatgccgaagctgacgtgagggaagacgactcctacttatttgatttagataacaaggacggcgaggtgtactgcattgacgccaggtactacggtaatatcagtcgcttcatcaaccacctgtgcgatccaaacattattccagtgcgcgttttcatgctgcaccaagacttgaggttcccgcggatcgctttcttcagcagccgcgacatcaggactggggaggaactcggatttgactacggcgacagattttgggatattaagagcaagtatttcacttgtcaatgcggcagcgaaaaatgcaagcatagcgccgaggcaatcgccttggaacagtctagactcgccagactagatcctcaccctgagttgctgccggaactcggcagtctcccaccagttaatacttag

SEQ ID NO: 116187 - DNA, 3096 bp, Artificial Sequence
  Description of Artificial Sequence: Synthetic coding sequence
tcatgtcactgcactccttcatggccaccagtgcccgaaaagagaccacctgaaatacaacattttcgaatgtccgacgacgtgcactctctgggaaaggtaaccagcgacctggccaagaggcggaagctgaacagtggagggggactttctgaagagctgggttctgcgcgcaggagcggtgaggtgactttgacgaaaggtgatcccgggtccctcgaggaatgggagacagtggtgggcgacgacttcagtttgtattacgactcctacagcgttgacgagcgcgtggactcagactcaaagagtgaggtggaggcgcttaccgagcaactctccgaggaggaggaggaggaagaagaagaggaagaggaagaggaggaggaggaggaggaagaagaagaggaggaagacgaggagtctggaaatcagagcgacagatccgggagctccggtcggcgcaaagctaagaaaaaatggagaaaggattctccttgggtgaagcccagccggaagaggaggaaacgcgagccccctagagccaaagagcctaggggagttaacggcgtaggttcttccgggcctagtgaatacatggaggtgcccttgggaagtttagaactgcctagcgagggcactctgtcccccaatcacgctggtgtatctaatgacaccagttccctggagaccgagcggggctttgaggagctgcctctgtgttcttgccgcatggaggcacctaagatcgatagaatttccgaacgagccggccataagtgcatggcaacggaatcagtcgacggcgagctgagcggctgcaatgctgcgatcctcaagagagagactatgcggccgtcatcacgcgtggccctaatggtgctctgcgaaacccatagggcccggatggtgaagcatcactgttgtcccggctgtggctatttctgtacagctggcacgtttctcgagtgtcatccagacttcagggtggcccaccggttccacaaagcctgtgtgagccagctcaacggaatggttttttgcccccactgtggcgaagatgccagcgaggcgcaagaagttaccataccacgaggtgacggggtgacacctcctgccgggacagccgccccagcccccccacccctttcacaggacgtccctgggcgagccgacacctcgcagccatcagctcgcatgcggggccatggtgagcccaggcggccaccatgcgatccactggctgacaccatagactctagcggcccgtcactcacccttcccaacggtggatgtttatccgccgtgggattacctctaggtcctgggagagaagccttagagaaagctcttgtgatccaggagtcagaacgacggaagaagttgagattccatccgcggcagctgtatctgtcagtgaagcagggagagctccagaaggtgattttgatgctcctcgataatcttgatcctaatttccagagtgatcagcagagcaaacgcactccactgcacgctgctgctcagaagggatccgtcgaaatctgtcacgtgctcctacaggctggggctaacattaacgcagtggacaagcagcagcggacacctctgatggaggccgtggttaataaccacctggaggttgcacggtatatggtgcaacgcggaggctgcgtgtactcgaaggaagaggacggtagtacatgcttgcatcatgctgccaaaattgggaatctggaaatggtgagcctgctcctctcaaccggtcaggttgacgtcaatgcgcaggattctgggggctggactcctataatctgggcggccgagcacaaacacatcgaagtaatcaggatgttgcttacgcgaggcgctgatgtgaccctcactgacaatgttagcgaaaggctggtcgaggaagaaaacatctgcctacactgggcgagcttcaccgggagtgcggccattgctgaagtgctcctcaacgcccgttgtgaccttcatgccgtcaactatcacggggatacgcctctgcatatcgccgctcgggaaagttaccacgactgcgtactcctattcctttctcgcggagctaatcccgagttgcggaacaaggagggagacacggcatgggacctcacacccgaacgatccgatgtttggttcgcgctgcagctcaatcgcaaactgcggctgggggtgggaaatagggcaatcagaaccgaaaagatcatctgtagagacgtggccagaggatatgagaatgtcccaatcccatgtgtgaacggggtggacggcgaaccctgccctgaggactataagtacatctcagagaattgcgagaccagcaccatgaacattgaccggaatataacgcatttgcagcactgtacctgcgtggatgattgttccagctcgaattgcctgtgtggacagctaagcatacggtgttggtatgacaaggatgggcggcttcttcaggagtttaataagatcgagccgcctctaatatttgagtgcaatcaggcttgctcctgctggcggaattgtaaaaacagagtggtccaatcaggcattaaagtgcggctccagctatatcgtacagccaagatgggatggggagtcagagccctccagaccattccccagggtacctttatctgcgaatatgtcggcgaactcataagcgatgctgaggccgacgtccgggaggatgactcttatctctttgacctggataataaggacggagaggtatactgtatcgacgctaggtactacggaaatatcagccgatttatcaaccacttatgtgatccaaacatcatccccgtgagggtgtttatgctgcaccaggacctccggtttcctcgcattgcatttttctctagccgcgacattcgaacgggcgaggaacttgggttcgactatggcgatagattttgggacatcaaaagcaagtacttcacctgtcagtgtggctcagaaaagtgtaagcactcagcagaggcaatcgccctggagcagagcaggctggcccggctggatcctcatcccgaactgttgcctgaactggggagcctgccccccgtgaacacctag

SEQ ID NO: 116188 - DNA, 3096 bp, Artificial Sequence
  Description of Artificial Sequence: Synthetic coding sequence
agttgccactgcaccccaagctggcctcccgtaccagaaaaacgtccacctgagatacagcatttccgaatgtcggatgatgtacatagccttgggaaggtcacctcagatttggccaagcgtcggaagctgaattccggcggcggactctccgaggagctgggcagcgcaaggcggtccggcgaggtgaccctgaccaagggtgatcccggatctctcgaggagtgggagaccgtggtgggcgacgacttttccctgtactacgatagctactcagttgacgagagagtggattccgacagtaagtcagaggtggaggcactgactgaacagctgagtgaggaagaggaggaagaggaagaagaggaagaggaggaagaggaggaggaggaagaggaggaggaggaggaggacgaagagtccggtaatcagagtgacaggtccggtagcagcggacggcgaaaagccaagaagaagtggcggaaagattcgccatgggtgaaaccatcacggaagcgtcgcaagcgtgagccgcctagagcgaaggagccaaggggggttaatggtgtcggaagctccggcccttccgagtatatggaagtccctctgggcagtctggaactgccctctgaaggtacactgagtccaaaccatgctggagtgtcgaacgatacctcctcattggagactgagagagggttcgaagaactcccactttgctcgtgccgtatggaggctccaaaaattgaccggatttctgaacgagccggccataagtgcatggcaactgaatctgtggacggcgagttgtcaggctgcaatgctgccatcctcaagcgagagacaatgcggccatcgtcccgggtagcgctgatggtactttgcgagacgcacagggccaggatggtcaaacaccactgctgtccaggctgcggctacttttgcacagctggtactttcctcgagtgccatcccgacttcagagtggcccatcgttttcataaggcctgtgtgtcccagctgaacgggatggtgttctgtcctcactgcggagaggatgctagtgaggcccaggaagtgactatccccagaggggacggagtcacaccaccagctggaacagcggctcccgctcccccaccactttcccaggatgtgcccggacgggcggatacaagccagccttcagccaggatgagaggccacggagagccccggagaccgccatgcgacccgctggccgacacaatcgatagcagcggacccagtctgactctcccgaatggaggatgccttagcgcagtgggattgcctttggggccaggtcgagaagctctagagaaagctctcgttattcaagagagcgagcgaagaaaaaagctccgcttccacccgcgtcagctctatcttagcgtcaagcagggagaattgcagaaagtcatactgatgctcctggataacctggaccccaactttcagtcagaccagcagtctaagaggacccctctgcacgcagccgcacagaagggatccgtggaaatctgccacgtgctgctgcaagcgggagccaatataaacgctgtggacaagcaacaacgaaccccactgatggaggccgtcgttaataaccacctcgaagttgcaaggtatatggttcaaagaggtgggtgcgtctactccaaggaagaggacgggagcacgtgcttacatcatgccgccaagatcggaaaccttgagatggtgtctctgcttttaagcacaggccaggtggacgtaaacgcacaggattctggcggttggacccccatcatatgggcagccgagcacaaacacattgaggtgattcggatgcttctcacgagaggggccgacgtgaccctgacagataacgtgtccgaacggctcgtggaggaggaaaacatctgtttgcactgggcctcgtttactgggtccgccgcgatcgccgaagttcttcttaacgcacggtgcgacctgcatgcagtcaactaccatggcgatactcccctccatattgccgccagggaatcctatcacgattgtgttctgttgttcctgtccaggggcgcaaatccagaacttaggaataaggaaggggacacagcatgggaccttacacctgaacgctccgacgtgtggttcgcactccagctgaataggaagctgcgtctgggcgtcgggaacagggcaattcggactgagaagatcatttgcagggacgtcgccagaggatatgaaaacgtccccattccttgcgtgaatggggttgacggagagccttgtccagaggattacaagtatatttctgaaaactgcgaaacctccactatgaacattgaccgcaatataactcacctgcagcattgcacttgcgttgacgactgctcctcttccaattgtctgtgcggacagctctcaattcgttgctggtatgacaaagatggtcggctgttacaggagtttaacaagattgagcctccactaatcttcgaatgcaatcaggcttgtagctgttggcggaattgtaaaaatagagtcgttcaatcaggtatcaaagtcaggcttcagctttaccgcaccgctaaaatggggtggggagtgagggctctccaaacgattccgcaaggcacatttatctgtgagtatgtcggggagttgatctcagacgcggaggccgacgtccgcgaggatgacagctatttgtttgatttggataataaggatggcgaggtgtattgcattgatgctaggtactacggaaacatctcaagattcatcaaccacctgtgcgatcctaacattatccccgtccgggtgttcatgcttcaccaagatctgaggtttcccaggattgccttcttttcctctcgagacatccggactggagaagaactgggctttgattacggagaccggttctgggacataaagagtaagtacttcacctgccagtgtggctctgagaagtgcaagcatagtgccgaggccatcgcacttgaacaaagccggctggcccgtctcgaccctcaccccgagctgctgcccgaactgggctccctcccacctgtcaatacttag

SEQ ID NO: 116189 - DNA, 3096 bp, Artificial Sequence
  Description of Artificial Sequence: Synthetic coding sequence
tcttgccattgcacccccagcagaccaccagttccagagaagagacctccagaaattcaacacttcaggatgtctgatgacgttcatagcctcggcaaggtgacgagtgatctggccaaacgcagaaagctgaactccggtggaggactttctgaagagcttggtagcgcacggcgcagcggagaagtcactttgaccaaaggggacccaggctcactggaagagtgggagactgtagtgggtgacgatttcagtctatactatgacagttattctgtggatgaacgcgtagatagcgattcaaaaagcgaggtggaggcacttaccgagcagctgagcgaggaggaagaggaagaggaagaagaggaggaagaagaggaagaggaagaggaggaggaagaggaggaagaagatgaggagtcaggaaaccaaagtgaccgctccggctcctctggacggagaaaagctaagaagaaatggcggaaagatagcccatgggttaaaccaagtcgcaaacgcaggaagcgcgaaccaccacgagccaaggagcctcgaggggtaaatggcgttgggtcaagtgggccgtccgaatatatggaggtcccccttggctcactagaacttcctagtgagggaactctctcgcccaatcatgccggcgtctccaacgacacatcatcgttggagactgagagaggcttcgaagaactcccactgtgtagttgccggatggaggctcccaagattgatcgaatctccgaacgggctggccacaaatgtatggctaccgagagcgtggacggagaactgtccggttgcaatgctgcaattctcaaaagggaaaccatgcgaccatctagccgggtggcccttatggtgctgtgcgaaacacaccgggcacgaatggtcaaacatcattgctgtcccggatgcggctatttctgtactgcaggaacttttctcgagtgtcacccagattttagggtcgcacatagattccacaaagcctgtgtgtcacaactgaatggcatggtgttttgccctcactgtggagaggacgcttctgaggcccaggaggtgactattcctagaggcgacggggtgactccccccgcaggcacagccgctcctgctccacctccactgtctcaggatgtcccgggaagggccgacacctcacagcccagcgcgagaatgagagggcatggggaaccaaggcggcccccttgtgaccctttggcggatacgatagattccagcggaccatcactgacgttgcccaacggcggctgcctttcagccgtgggactgcctctgggacccggcagggaagcactcgaaaaagcgctggtgattcaagaatccgaaagacggaagaaactgcgcttccacccccgccagctgtatctgagtgtcaaacagggcgagttacagaaggtgatcctgatgttgctggacaacctcgatcctaactttcaatctgatcagcagtcaaaacgcacccccctccatgccgccgcccagaaggggtcggtggaaatttgccacgttctccttcaagcaggcgccaacattaatgccgtggacaagcagcaacgcacccctctgatggaggctgtcgttaataaccacctcgaagtggctcgttacatggtccagcggggtggatgcgtctatagcaaggaagaagatgggtctacatgcctccaccatgctgcaaagattggaaatctggagatggtgtctcttctgctctccacaggacaggtggacgtaaatgcgcaggattccggggggtggacaccaatcatctgggcagcggaacacaagcacatcgaagtgattagaatgttgctgacgagaggggccgacgtgacactgacagacaatgtgtcagaacgcttggtcgaggaggagaacatttgcctgcactgggccagtttcacggggagcgccgccattgctgaagttctcctgaatgcccggtgcgatcttcacgccgttaattaccacggggacacgccgctgcatattgccgcaagagaaagttaccatgattgcgtgctcctcttcttaagtagaggggccaacccagaattgcggaacaaagaaggggatacagcctgggacctgactcctgagcggtccgacgtgtggttcgctctgcagctaaatcggaagttacgtttgggggtgggaaatagagcgatcagaaccgaaaaaattatttgccgggatgtcgctcgagggtatgagaatgtccctattccatgtgttaacggtgtagatggcgagccatgccccgaggattacaagtacatctctgagaattgtgagaccagtaccatgaatattgacagaaacataacccatttgcagcactgcacttgtgttgacgattgtagttcttcaaattgcctgtgcggtcagctgtccatccgatgctggtacgacaaagatggcagacttcttcaggagtttaataaaatcgagcctccactcatcttcgagtgcaatcaggcatgcagttgctggcgtaattgcaaaaaccgggtagttcaatcaggtattaaggtacggttgcagctttaccgcaccgcgaaaatgggttggggggtgcgagccctgcaaactatcccacaggggacttttatctgtgagtatgttggcgaacttatatcagatgcggaggctgacgttcgggaggatgacagttacttgttcgacttggacaataaggacggagaggtgtattgtatagacgcacggtattacggcaatattagccggttcatcaaccatctgtgtgaccccaacattatcccagtgagagtgttcatgcttcatcaagatctgaggttccccagaatagcattctttagctccagggatattcggacaggagaggaactgggcttcgactatggggataggttttgggacataaaaagtaagtacttcacctgtcaatgcggctcagagaagtgcaagcattcggcagaagctatcgcactagaacagagtaggctagctcgattggatccgcacccagagctgttacccgaattaggttcgctccctccagtgaatacttag

SEQ ID NO: 116190 - DNA, 3096 bp, Artificial Sequence
  Description of Artificial Sequence: Synthetic coding sequence
tcctgtcattgcacgcctagttggcctcctgtcccagagaagcgaccacctgagattcaacactttcgtatgagtgacgatgtgcattcactgggcaaggtgacatccgacctggcaaagcgaagaaagttaaactcgggcggtggtctttccgaagagctagggtctgctaggcggagtggggaagtgaccctgacaaaaggggacccaggtagcttggaggagtgggagaccgtcgtgggcgacgatttcagcctttattatgattcctactcagtcgatgagagggtggattctgacagcaagtctgaagttgaggctttgacagagcagctcagcgaggaggaggaggaggaagaggaggaagaggaggaggaagaagaggaggaggaagaagaggaagaggaggaggacgaggagagcggcaaccagtcagataggagcggcagctctgggaggcggaaagcaaagaaaaaatggcgaaaggacagcccctgggtgaagccctcccgaaagaggcggaaaagggagcctccacgggcaaaggaaccaagaggcgtaaacggcgtaggttcgtctggtccttctgaatacatggaagttcccctaggttcactggaactgccctccgagggcaccctctctcccaatcacgcaggcgtatccaacgacacaagctcgctggagacagaacgcggtttcgaagaactaccgttgtgctcgtgtcggatggaggccccgaagattgatcgaatcagcgaacgggcaggtcataaatgcatggcgactgagtcggtggacggggaactgagtgggtgcaatgctgccatcctcaaacgagaaactatgcgaccaagcagccgcgtggcactgatggtcctttgcgaaacacaccgggctagaatggtgaaacatcattgctgccctggatgtgggtatttctgtactgccggaacgtttttggagtgtcacccagactttcgcgttgcacacagatttcataaagcctgcgtctctcagctaaacggcatggtattttgtcctcattgtggggaggatgcaagtgaagcgcaagaggtgactattcctagaggcgacggcgtgacgccacccgccggtacagccgcacccgcaccacctcctctctctcaggatgtgccaggccgggctgacacaagtcagcctagtgctcgcatgagaggtcacggtgagcctcgacggcccccctgcgaccccctggctgataccatcgattccagtgggcctagcttgacgctgccaaacggaggctgtctctcagccgtggggcttcctctaggtcctggcagagaagccttagagaaagcactagttattcaggagagcgagcgcagaaagaaactgaggttccatccacggcagctgtatctgtcagttaagcagggcgagctccagaaagtcatcttaatgctgctcgacaatctcgatccgaactttcagagcgaccaacagtctaaaagaactcctctgcacgctgccgcccagaagggctccgtggagatatgtcacgtgctgctgcaagccggtgccaatatcaatgccgtggacaaacagcaacgcacccccttgatggaagccgtggtcaataatcacctggaagtcgcgcgatatatggttcagaggggcggctgcgtgtattccaaggaggaggacggttctacatgcctccaccacgcagccaagataggcaacctcgaaatggttagccttctgcttagtacgggtcaggtagacgtcaacgcgcaggacagtggcggctggacaccgattatttgggccgctgaacataagcatatagaggtcattcgcatgctcttgactagaggcgctgacgtaactcttacagacaatgtttccgagcgcttggtcgaagaagaaaatatctgcttgcactgggccagcttcacaggttccgctgccattgccgaagtcctcctgaacgctagatgcgacttgcatgcagtgaactaccacggggacacaccattgcatattgccgcccgcgagtcatatcatgattgtgtcctactctttttaagcagaggggctaatcctgaattaagaaataaagagggggatacggcctgggacctgacgcctgaaagaagcgacgtgtggttcgccctacagttgaaccggaagctccgtctgggggtcggcaatcgggcgattaggacggaaaaaattatttgcagagatgtggctcgaggctatgaaaatgtacccattccttgcgtgaatggagtggatggggaaccatgcccagaggattacaaatatattagtgaaaactgcgagactagtaccatgaacattgatcggaatattacgcatctccagcactgtacatgcgtggatgattgttcttcatcaaactgcctgtgtggtcaactgtctataaggtgctggtacgacaaggatggtaggcttctgcaggaattcaataaaatcgagcccccactaatctttgagtgcaatcaggcatgctcatgctggcgtaactgtaagaatcgcgttgtgcagagtggaatcaaggtccgactgcagctatataggactgcaaagatgggctggggagtcagagctcttcaaaccataccgcaaggaacctttatttgcgagtacgttggagagctgataagcgacgccgaagccgatgtgagggaagacgactcatacctgtttgatctggacaacaaggacggtgaggtgtactgcatagatgcgaggtactacggtaatatcagcagatttatcaaccacctttgtgaccccaatatcatcccggttagagtctttatgttgcatcaggatctccggtttccacggatcgcttttttctccagccgagacatcagaaccggcgaagagctcggctttgactacggcgatcgcttttgggatattaagtcaaagtactttacctgtcagtgcgggtctgaaaagtgcaaacattctgccgaagcaatcgcccttgagcagtctaggctggcgcgcctcgatccacaccccgagctgctgccagagctggggagcctcccacccgtgaatacttag

SEQ ID NO: 116191 - DNA, 2178 bp, Artificial Sequence
  Description of Artificial Sequence: Synthetic coding sequence
atggcggatgaagatcttatttttagactcgaaggggtcgacggagggcagagcccccgcgccgggcacgacggcgatagtgatggcgactccgacgacgaggagggctatttcatctgtcccataacagacgacccctcatctaaccagaacgttaattccaaggtaaacaagtattatagcaatctgacaaagtcagagagatacagttccagtggttctcccgccaatagctttcatttcaaagaggcctggaaacacgcaatacaaaaggcgaagcacatgcccgatccctgggctgagttccatctggaggacatcgcaacggagagagctacgagacacagatataacgcagtgacaggcgaatggttagatgacgaggttttgataaaaatggcaagccagcccttcggcaggggtgccatgagggagtgtttcagaacaaagaagctgtccaactttctgcatgctcagcaatggaagggagcaagtaattacgtcgccaaacggtatattgaacccgtggacagggatgtgtacttcgaggacgtccggctgcaaatggaagctaaactgtggggcgaggaatataaccggcataaacctccaaagcaggtagacataatgcagatgtgtatcattgagctaaaggataggccaggcaagcctctcttccatctggagcactacatcgaagggaaatacataaagtacaattcaaatagtggctttgttagagacgacaatattcgactcaccccgcaggcatttagccacttcacgttcgaaagaagtggccatcaattgattgtggtcgatatacagggggtcggtgacctctacaccgatcctcagatacataccgagacgggtacagatttcggtgatgggaacttgggcgttagaggcatggccctcttcttctactcacatgcttgtaacaggatttgcgagtctatgggtctcgccccatttgacctcagccctcgggagcgggacgctgttaaccaaaatactaagctcttgcagtccgctaagaccattttgcgcggaacagaagaaaaatgcggttctcctcaggtcaggacccttagtggtagtagaccacccctgttgcgtccactgtccgaaaacagcggggatgagaacatgagcgacgtcaccttcgacagtctcccctccagcccctccagcgcgaccccacatagccagaagcttgaccatctacactggcccgtattcagcgacctagacaacatggcttctcgcgaccacgatcacctcgataatcacagagagagcgaaaactcaggcgattccggatatcctagcgaaaagcggggcgaacttgatgatcccgagcccagggagcatggacacagctactctaaccgtaagtacgaatccgacgaagatagcctcggctcgagcgggagagtgtgcgttgaaaaatggaatctcctaaatagttcccgacttcatctccctagggcctctgccgtggctctggaagtccagcggttaaacgccctggacctcgagaaaaagattgggaaaagcattctggggaaggtgcacctcgccatggtgcgctatcatgaaggcggacgcttctgtgaaaaaggcgaggagtgggaccaggaatcagctgttttccacctagagcacgccgcaaacttgggcgagctagaagccattgtgggactcggccttatgtatagccagctgccacatcacatactcgccgatgtgtccttgaaagaaacggaagaaaataaaactaaagggtttgattatctacttaaggcggcggaggcaggggatcgtcagtcaatgatcctcgtggccagggctttcgacagcgggcagaacctaagtcctgatagatgtcaggactggctggaggcccttcactggtataatactgctctggagatgacagactgcgacgagggaggcgaatatgacggtatgcaggatgaaccccggtacatgatgctcgcgcgggaggccgagatgctgtttactgggggctacggcctggaaaaggatccccaaagaagtggggacttgtatacccaggccgccgaggctgccatggaggcaatgaaaggccggcttgcgaaccagtattatcaaaaagccgaagaagcctgggcccagatggaggagtag

SEQ ID NO: 116192 - DNA, 1389 bp, Artificial Sequence
  Description of Artificial Sequence: Synthetic coding sequence
atggggaaggaaaaaactcatataaatatagtagtcattgggcacgtggattcaggaaaaagcaccactacgggtcatttaatatataagtgcggcgggattgacaagagaaccatcgaaaagttcgagaaggaggcggcagaaatggggaaaggctcttttaaatacgcttgggtgcttgataagctgaaagctgagcgagagcggggaatcacaattgacatctctttgtggaaattcgagacctccaagtactatgtaactatcatcgatgctcctgggcatcgcgatttcattaagaacatgataacagggacatctcaggccgattgcgccgtactcatcgtggccgccggtgtgggagaatttgaggccggcatatcaaagaatggtcagacacgggaacacgccctgctggcctatactttaggcgtaaagcagctgattgtgggagtaaataagatggactctacggaacccccatatagccagaagcgctacgaggagatcgtgaaagaagtgtccacatacataaaaaagatcggctacaaccctgatacggtggcgttcgtgccaatcagtggatggaatggagacaacatgctggaaccctcggccaacatgccttggtttaaggggtggaaggtaactaggaaagacggcaatgcaagtggaactacactgctggaagcccttgattgtattctgcctccaacccggcctacggataagcccctgagacttccgctccaggatgtgtacaaaattggcggaattgggactgtgcccgtaggtcgtgtcgagacaggtgtcctcaagcctggtatggttgtcactttcgcccctgtcaatgtaactaccgaagttaaatccgtggaaatgcatcatgaagccttatctgaggccttgccgggcgataacgtcgggttcaacgtgaagaacgtgagtgtgaaagatgttagaaggggaaacgtggctggagactccaaaaacgatccacctatggaagcagcaggcttcactgctcaggtcatcatcctaaatcaccccggacagatttccgccggttacgcccctgttctggattgccatacagcacacatcgcttgcaaatttgcagagctgaaggagaagatagatagacgctccgggaaaaaactagaggatgggccgaagttcttaaaatccggagatgcagcgattgtcgacatggtcccggggaagccgatgtgcgtggagtcctttagtgactacccccccctggggcgctttgctgtacgggacatgagacaaacagtggcggtgggagtcattaaggctgtggacaaaaaagctgccggcgccggtaaagtgaccaaaagtgcccagaaagcccagaaggcaaaatag

SEQ ID NO: 116193 - DNA, 1389 bp, Artificial Sequence
  Description of Artificial Sequence: Synthetic coding sequence
atggggaaagagaagacgcacatcaatattgttgtgatcggacacgtggacagcggcaaatccacgaccacagggcacctgatttataaatgcggcgggattgataaaagaactattgaaaagttcgaaaaagaggccgccgaaatgggcaaaggcagtttcaagtacgcctgggttcttgataagttaaaggccgaaagagagcggggaatcaccatcgacatttccctgtggaagttcgagaccagcaaatactatgttacaatcattgacgcccccggtcaccgcgattttattaagaacatgatcactggaactagtcaggctgactgcgctgtcctgattgtcgccgctggtgttggagaattcgaagctggcatttccaagaatggccagactagagagcacgccctgcttgcctacaccctgggggtgaaacagctcatagtgggggtaaataagatggactctacagaaccaccctactcccagaaaaggtacgaggaaatcgtgaaagaagtttctacatatattaagaaaattgggtataaccctgatactgtcgctttcgtgccaatctccggctggaacggcgacaacatgctcgaaccctccgccaatatgccctggtttaaagggtggaaggtgacccgcaaagatgggaatgcctccggcactactctgctcgaggctctggattgcatactgcccccaacgcggcccacagataaaccattaagacttcctctgcaggacgtctataagattggagggattggcacagtgccagtgggaagagtggagacaggagttcttaagcccgggatggtcgtcacgttcgctcccgtgaatgtgactactgaagtgaagtctgtggagatgcaccacgaggctttgtcggaggccttacctggggacaacgtgggatttaatgtaaagaacgtgtcagtgaaagatgtcaggaggggaaacgttgctggtgacagcaagaatgacccacctatggaggcggcaggctttacagcacaggtcataattctgaaccatcctgggcagatctcagctggctatgctcccgtgctggactgccacactgctcacattgcctgtaaatttgccgagctcaaagagaagattgacaggaggtcagggaaaaagctggaggacggtcctaagtttcttaaatctggagatgctgctatcgtggatatggtacccggtaaacctatgtgcgtggagagtttttcagactatccacctctggggcggtttgcagtcagggacatgcggcagacagtcgctgtcggcgtgatcaaggctgttgataagaaggcagctggtgccggtaaagtgacaaagtcagctcaaaaggcccagaaggctaaatag

SEQ ID NO: 116194 - DNA, 1389 bp, Artificial Sequence
  Description of Artificial Sequence: Synthetic coding sequence
atgggtaaggagaaaacacacattaatatcgtggttatcgggcatgtggacagcggtaaatcaacaaccacaggccatctcatctataagtgcggaggaattgataagcgcacaatcgaaaagttcgaaaaggaggcagccgagatgggaaagggctccttcaagtatgcttgggttctcgacaagcttaaagctgaaagagagcgtggcatcactatagacatctccttatggaaatttgaaacctctaaatactacgtgactatcatcgatgcacctggacatcgggatttcattaaaaatatgatcactggcacaagccaggctgattgcgctgtgctgatcgttgccgctggagtgggagagttcgaggctgggatctcaaaaaacggccagacgcgggagcacgctctgttggcatacacactgggagtgaaacagctgatagtcggagttaacaaaatggactcaacggagcctccctacagtcagaaaagatacgaagaaatcgtgaaggaagtgagcacatacatcaaaaaaataggctacaatcccgacacagttgcgtttgtccccatctccgggtggaatggggataatatgctggagccaagcgcaaacatgccatggtttaaagggtggaaggttacacggaaagatggcaatgcctccggaactactctcctcgaggcactggactgcatcctcccgccaacgcggcctaccgataaacctctgagattaccactgcaggatgtgtacaagatcggcggaattggcaccgtgcctgtaggaagggtggagacaggggtactgaaacctggaatggtggtcacttttgctcccgtcaacgtgacaactgaggtaaagtctgttgagatgcatcacgaggccctgtcagaagcactcccgggtgacaatgtgggattcaatgtaaaaaatgttagcgttaaagacgtgcgcagggggaacgttgctggagactccaagaacgaccctcctatggaagctgccggttttactgcccaggtgatcattctgaatcaccctgggcagatttccgcaggctacgccccagtactagattgccacaccgcccacatcgcctgtaaattcgctgaactgaaggagaaaattgatcgtagatccggcaagaaactcgaagacgggccgaagtttctgaagtccggcgacgccgcaatagttgacatggtgccaggtaagccaatgtgcgttgagtccttcagcgactatccgccactggggagatttgccgtaagagacatgaggcaaaccgtggccgtcggcgtgatcaaggccgtggacaaaaaggcggctggtgccgggaaggtcaccaaaagtgcacagaaagcccagaaagctaagtag

SEQ ID NO: 116195 - DNA, 438 bp, Artificial Sequence
  Description of Artificial Sequence: Synthetic coding sequence
atggggaaagagaaaactcatataaacatcgtggttattggacacgtggatagcggtaaatcaacaacaactgggcacttgatctacaagtgcggcggaatcgataagcgaacgatcgaaaagtttgagaaggaggcggcagaaatgggtaagggctccttcaaatacgcctgggttctcgacaaactcaaagccgagagggagcgcggaatcaccattgatatcagcttgtggaaattcgagacctccaagtactacgttacaatcatcgatgctcccggtcatcgggatttcatcaagaatatgattacaggcaccagccaggccgactgcgctgtactcatagtagccgcaggggtcggcgagtttgaagcgggaatcagcaagaatggccagacccgagaacacgccctgcttgcctatacgctgggagtctag

SEQ ID NO: 116196 - DNA, 1281 bp, Artificial Sequence
  Description of Artificial Sequence: Synthetic coding sequence
atgggaaaagaaaagacacacattaacatcgtggtgatcgggcacgtagactctgggaagtctactacaactggtcacttgatatacaaatgcggaggcatcgataaaagaaccattgagaagtttgaaaaggaagcggccgagatgggcaaaggaagcttcaaatatgcatgggtgctcgataagttgaaggccgagcgggagagggggattacaatcgacattagtctatggaaattcgagacctctaaatactatgtgacgatcatagacgcaccagggcaccgagattttattaaaaacatgatcacagggacctcacaggcggactgcgcggtacttattgtcgccgcaggcgtgggagagtttgaagcgggcatttccaaaaacggacagacccgtgaacatgcactgttagcgtacaccctcggcgtaaagcaattaatcgttggtgtcaataagatggattctacggagccaccttacagtcagaagcggtacgaggagatagtgaaggaggtgtcaacatacatcaagaagattggttacaatcctgataccgtggcattcgtgccaatttctgggtggaacggcgataacatgctggagccctcagccaacatgccctggtttaagggatggaaagtgaccaggaaggatggcaacgctagtggtacaacactgctcgaggctctcgattgtattctccctccaaccagaccaacggacaagccgctgagactgccgcttcaggatgtttacaagattgggggcatcggtactgtgcccgttccctcgggtgactggtgctcacctggcatggtggtaacgtttgctcccgttaatgtcaccacggaggtgaaatcagttgaaatgcaccatgaggcattgagcgaagcactacccggagacaacgtgggatttaacgttaagaacgttagtgtaaaggacgtgagaaggggaaatgtggccggagactcgaagaacgatcccccgatggaggccgctggctttacagctcaggttatcattctgaatcacccaggccaaatttctgctggatatgcgccagtccttgactgtcacactgcccacatcgcctgcaagtttgccgaactgaaagaaaagattgaccggcgcagtggcaagaaactggaagacggcccaaagtttctcaagagtggtgatgctgcgatcgtggacatggttcccggtaaaccaatgtgcgtggagagctttagcgattaccctcccctgggcaaaagtctctgctgttcctag

SEQ ID NO: 116197 - DNA, 1326 bp, Artificial Sequence
  Description of Artificial Sequence: Synthetic coding sequence
atgggaaaggagaagacacacatcaatattgtggtaatcggacatgtggactcgggtaaaagtacaaccacagggcacttaatttacaagtgtggcggcattgataaacggaccatcgagaagttcgagaaggaggcagctgagatggggaaaggctcctttaagtacgcgtgggtcctcgataagctgaaagccgagcgagagaggggaatcaccattgatatatccctgtggaaattcgaaacatccaaatactacgtgaccattatcgacgcccccggtcacagagatttcatcaagaatatgattactggaacctcgcaggccgactgcgccgtgttaatagttgcagccggagtgggggagttcgaggccggaatctccaagaatgggcagaccagggaacacgccctgcttgcatattctcagaaacgatacgaggaaatcgtgaaagaggtgtccacatacatcaagaaaatcggttacaaccctgacactgttgctttcgtgcctataagcgggtggaatggtgacaacatgttggaacctagtgccaatatgccatggtttaagggatggaaggttacccgcaaggatggcaacgcctcaggaactactctgctggaggcattagactgcatcttgccacccactagaccaactgataagccactccgcctgcccttgcaagatgtttacaagatcggtgggatcggaacagtgcccgtgggccgggtggagactggtgtgctgaagcccggaatggtggtcacttttgcccccgttaacgttactacggaagtgaagtcggtagagatgcatcacgaggctctgtcagaagccttgccgggagacaacgtggggtttaacgtgaagaatgtgagtgtgaaagatgtcagacgaggaaacgtggctggcgattccaagaacgacccccccatggaagctgcaggcttcactgctcaggttatcatcttgaatcatcctgggcagatttcagccggctatgcccccgtcctggattgccatacagctcacatagcttgcaaattcgccgaactaaaggagaagatagatagaaggtcagggaaaaagctagaagatggtccgaagttcctgaaatccggggatgcagccattgtggatatggtccccggaaaacctatgtgcgtcgagtcattcagcgactacccgcctctgggccggttcgccgtgagggacatgcggcaaacagttgccgtgggtgtgataaaagcagtggataagaaggcggccggcgcagggaaagtcaccaaaagtgcacagaaagcacagaaggcaaagtag

SEQ ID NO: 116198 - DNA, 324 bp, Artificial Sequence
  Description of Artificial Sequence: Synthetic coding sequence
atggggaaggaaaagacacacattaacatagtggtgattggtcacgtagattccggtaaatctaccaccaccggccatctcatttacaagtgtggcggcattgacaagcgtacgattgaaaagtttgagaaagaagccgcagagatggggaaaggctccttcaagtacgcatgggtgttggataagctgaaagctgagagggagcgcggcattacgattgatatttccctctggaagttcgaaacgtccaagtactacgtgaccatcatagacgcccctggtcatagagactttataaaaaacatgataaccggaaccagctag

SEQ ID NO: 116199 - DNA, 336 bp, Artificial Sequence
  Description of Artificial Sequence: Synthetic coding sequence
atgggaaaggagaaaacacatattaacattgttgtgatcggacacgtcgactccggaaagtctacaaccaccggacacctcatttataaatgcgggggcattgataaacgaacgattgagaagttcgaaaaggaagctgctgagatgggcaaaggctcctttaagtacgcatgggtgctggataagcttaaggccgagcgggagcgaggcattaccatagacatttcgctgtggaagtttgaaactaccaaacagtggacgaggcgcttgttggaactggccagatctccaagcttgcccagaaagctcagaagactgaatgaatactatccttag

SEQ ID NO: 116200 - DNA, 1626 bp, Artificial Sequence
  Description of Artificial Sequence: Synthetic coding sequence
atggtcattaacctttgcctcccccagttccgaccacgcattcattgcaataaaatcagtgcagatggatatgaagttgaaaacctgatctcagaggacctcacaaagaggtcgcacgggtttcgtactgaatattttataaagcctcccgtctatgtgacggtttcattcccattcaatgtcgaaatttgccgaattaacatcgacttaactgccggggggggccagaacgtaactggacttgagatgtatacttccgctagcagttcgagggtcagttggaacacgccccagtgccgcacgctcggcccagctgagccaagtgtcccggacaaagaggcattcacactggtgggtaaggttctgcttaagaaccagtctcaagtcgtttttagtcacagaggcttcaaggcccggccaccctttggtgccatggaagctactcttccgtcacccgctgtggtagctcaggaactgtggaataaaggcgccctcagtctgtcccacgtggcgcacctccgcatatgcataacccacgtcaccggcggagggatcccatgtattaaacgtctggaagtgtggggtcagcccgctaagacctgctcccaggaggtgatcgactcgattttgctggttacctctgaaaacctgcctcaggacgtggccctccaggcccccgccctcccaatggagtccgattgcgacccaggcgatcaacctgaaagccaacaagccccttcctccctccagaagttagctgagatcatccaagatgtcccagaggagtttctagatccaatcacgttagaaattatgccatgtcctatgctgctaccaagcggaaaggtcatcgatcagtccaccctcgaaaagtgtaacaggtcagaggctacatggggacgagttccatcggatcccttcaccggagtggccttcaccccacacagccagccactgcctcatccttcgctcaaggcaaggatcgaccacttcctcctccaacactcaatacctggttgccacctgctaggccgtgcacaaaccgccctcgcggtcataccctcgagcatcgtgctgcccagccagaagagaaagattgaacaggccgagcatgtgcccgatagcaattttggggtgaacgctagctgtttcagcgccacctcgcccctcgtgttgcctaccacatccgagcacaccgctaaaaagatgaaagctaccaacgagccaagtttgacacacatggattgttctactggccccctgagccatgaacagaaactgagtcagtcacttgaaatcgcccttgcctccactttgggatctatgccgtcttttacagcgcgcttaactaggggtcagctgcagcacctggggaccaggggcagcaacacaagttggcgccctggcaccgggagcgagcagccaggtagcatcctcggcccggagtgcgcaagctgcaaacgggtgttttcaccttactttaagaaagagccagtctaccagttgccgtgtgggcatctgctctgccgtccttgcctgggagagaagcaacggtccttgccgatgacatgcacagcctgtcaaaggccggtagcatcacaggacgtcttacgggtgcacttctag

SEQ ID NO: 116201 - DNA, 1392 bp, Artificial Sequence
  Description of Artificial Sequence: Synthetic coding sequence
atgggcaaagaaaagactcatataaatattgtcgtcattggccacgtcgactccggcaagtctactaccacagggcatctgatctacaagtgtggtggtatcgataaaaggaccattgagaaattcgaaaaggaggccgccgaaatgggtaaggggagctttaaatacgcctgggtgctggataaactgaaggcagagcgggagcggggcatcactatcgatatatctctctggaaattcgaaaccacaaagtattacatcacgataatagacgccccaggccacagggactttatcaagaacatgataactggcaccagtcaggctgattgtgctgtgctgatcgtggcggcaggagtgggagaatttgaggccggaattagcaagaatggccaaaccagggagcacgctttactggcctataccctgggagtcaaacagctcattgtgggagtgaataaaatggattcgaccgaacctgcatatagtgaaaagcggtatgatgagatcgtgaaggaggtgtccgcatacatcaagaagatcggctacaaccctgctaccgtgccctttgtgcctatctccggctggcatggggacaacatgctggagccgtccccaaacatgccctggttcaaagggtggaaagtggaacgcaaggaggggaacgcaagcggtgtgtccttgctcgaggccctggacacaatcctgccaccaacacggcctactgataaaccacttaggttgcctctgcaggatgtctacaagattgggggtatagggaccgtgcctgtgggcagggtggagacaggtattttgaggcccggaatggtagtgacgttcgcaccagtaaacattaccactgaggttaaatcagtagagatgcatcatgaggctctgagcgaagcactccccggcgataacgtaggctttaatgttaagaacgttagcgtcaaggatattcggcgaggaaatgtttgtggcgacagtaagtccgatcccccgcaggaggccgcacaattcacctcacaagttatcattctgaatcaccctggacaaatttccgccggctattcccctgtcatcgactgtcataccgcccatattgcatgtaagtttgctgagttaaaggaaaaaatcgaccggagatcgggcaagaaactagaagataatccgaaatcactgaaatcaggcgacgcagcaattgtagaaatggttcctggcaaaccaatgtgtgtggaatcattctcacaatatcctcccttgggccgcttcgctgtaagggatatgcggcagacagtggcagtgggagtgataaagaatgtggagaaaaaaagcggtggtgccggaaaggtgacaaaatccgcccagaaggcacaaaaagcagggaagtag

SEQ ID NO: 116202 - DNA, 678 bp, Artificial Sequence
  Description of Artificial Sequence: Synthetic coding sequence
atgggttttggtgatctgaagagcccagcgggacttcaagtgctgaacgactatctggctgataagagctacattgaggggtacgttccaagccaggccgacgtggccgtttttgaagcagtttcttcccccccccctgccgatctgtgtcatgcattgcggtggtacaaccacatcaaatcatacgagaaggaaaaagcttcccttcccggagtgaaaaaggccctgggcaaatacggccccgcagacgtggaagatactacagggagcggagctacagacagtaaagacgatgatgatatcgacttgtttgggtccgacgatgaggaagagtctgaggaggccaagcgactccgggaggagcggttggcccagtacgagagtaagaaggcaaagaagcccgcccttgtggctaagtctagtatactcctagatgttaaaccttgggacgacgagacagatatggcaaaattggaggagtgtgtgcgaagtatccaagcagacggacttgtctggggatcaagcaagcttgtgcccgttgggtatggtatcaagaagttgcaaatacagtgtgtggttgaagatgataaagttggcactgacatgctggaagagcagattacagcgtttgaagactatgtccagagtatggacgtagcagcattcaataagatctag

SEQ ID NO: 116203 - DNA, 678 bp, Artificial Sequence
  Description of Artificial Sequence: Synthetic coding sequence
atgggcttcggtgatcttaagtccccagccggcctgcaggtgcttaacgactatctcgctgataagagttacattgaagggtatgttcctagccaagcagatgtggctgtgttcgaggccgtgtcatcccccccccctgctgacctctgccacgccctgcggtggtacaaccacatcaagtcttatgaaaaggagaaagcaagtttgcccggcgtaaaaaaggcactgggtaaatatggtccggccgatgtagaagataccactggcagcggagccactgatagtaaagatgacgatgatatcgatctctttggcagtgatgatgaagaagaaagcgaggaggccaaaagattaagggaggaacggttagctcagtacgaaagcaagaaggctaaaaagccagctcttgtggccaaatctagtatcctcctcgatgtaaagccctgggacgatgaaaccgacatggctaaactggaggagtgtgtgagaagcatccaggctgatggccttgtgtggggctcatcgaaactggtgccagtggggtacggtattaagaagcttcaaatacagtgcgtcgtcgaggacgacaaggtgggcacagatatgctcgaagagcaaattacggcctttgaggactacgtccagagtatggatgtcgcagcattcaataagatttag

SEQ ID NO: 116204 - DNA, 678 bp, Artificial Sequence
  Description of Artificial Sequence: Synthetic coding sequence
atgggcttcggtgacctaaaaagtccagccggcctccaggtgctgaacgactacttagcggacaaatcgtacatcgaggggtatgtgccctctcaggctgacgtggccgttttcgaggctgtgagttcgccgcctccagcggatctgtgtcatgccctcaggtggtataaccacattaagtcatacgagaaggagaaggcatccctcccgggggtgaaaaaggccctgggcaagtacgggcccgcggatgtggaagacacaacaggcagcggtgctacagatagtaaggacgacgacgacatcgatttgttcggcagcgacgatgaggaggaaagtgaggaagccaagaggctgcgggaggaacgattggcccagtatgagtcgaaaaaggcgaaaaaacccgcactcgttgcaaaatcctcaatccttctcgacgtgaaaccttgggacgacgagaccgacatggccaaactagaggaatgtgtgcggtccatccaagctgatggccttgtttggggaagtagcaaattggtgcctgtaggctacggcattaagaaattgcagattcagtgcgtggtggaggatgacaaggtgggaaccgacatgctggaagaacagatcaccgcatttgaagattatgttcaaagcatggacgtagcagctttcaataagatttag

SEQ ID NO: 116205 - DNA, 372 bp, Artificial Sequence
  Description of Artificial Sequence: Synthetic coding sequence
atgggcttcggggatctgaaatcccccgcaggccttcaggttctcaacgattacctagccgataagtcctatatagaagggtacgtaccttcccaggctgacgttgcagtgtttgaggccgtcagctcccctcctccagctgatttatgccatgccctgagatggtacaatcatatcaaatcctacgaaaaggagaaggccagcttacccggagtaaaaaaggctcttgggaaatacggccctgctgacgttgaagacacaaccggcagcggtgccacagactccaaggacgatgatgacatcgatctgtttgggtctgacgacgaagaggaatcagaggaagccaagcgactgagggaagagaggctgtag

SEQ ID NO: 116206 - DNA, 846 bp, Artificial Sequence
  Description of Artificial Sequence: Synthetic coding sequence
atggccaccaatttcctggcccatgagaaaatatggtttgataaattcaagtacgacgacgccgagcgtaggttttacgaacagatgaacggtccagtagccggggcctcgaggcaagagaacggtgctagcgtcatcctgcgtgatatagcccgggccagagagaacattcagaagtccctggccgggtctagtggaccaggggcctctagtggcacctctggagaccatggcgaactggtggtgcggattgctagtctcgaggttgaaaatcaaagcctgcgaggcgtcgtacaggagctgcagcaggctatcagcaagctggaagcaaggctgaacgtgcttgagaagtcctcacccggacatcgggccaccgcgccacaaacccaacatgtgtcacctatgaggcaggtcgagcctccagccaagaaaccggccactcccgctgaggatgatgaggacgatgacatcgacttgttcggaagtgataacgaggaagaagacaaagaagctgcccaacttagggaggagaggctgagacagtacgcagaaaagaaggccaaaaagcccgcattagtggctaagagctccattttacttgacgtgaagccctgggacgacgaaacagatatggctcaactcgaagcatgcgtgcgatcaatccagctcgacggtctggtctggggagccagcaaactggtccctgtggggtatggcattagaaaactgcagatccagtgtgtggtggaagatgacaaggttgggactgacctgcttgaggaggagatcaccaaatttgaggagcacgtgcagtctgtcgatatcgctgcattcaacaagatctag

SEQ ID NO: 116207 - DNA, 1896 bp, Artificial Sequence
  Description of Artificial Sequence: Synthetic coding sequence
atgaggagcggtaaagcctcatgcaccctggagaccgtgtgggaggataagcataaatacgaggaggccgaacggagattctatgagcacgaagccacccaggcagctgcaagtgcgcagcagttacctgcggaaggacctgctatgaacggccctggacaggatgatcccgaggacgccgacgaagctgaggcccccgacggtggaagcagaagggatccacgcaaatcccaagattctcggaagccgctccagaaaaagcgtaagcggagtccaaaatccggacttgggccagcagatttggccttgctcggcctctccgcggagagggtatggttggacaagtcgttatttgaccaggccgagagtagctacaggcaaaaactggccgacgtcgccgcccaggccgcttggccccctgctctagcaccatgggggctgtgtacccacggcaaccaagtggcctgccatcatgtaacctgggggatttgggttaataagtcttcattcgatcaggcagagcgagctttcgtggagtggagccaggcactgctcctcgcgcctgacggcagtcgccggcagggaacgccaaatacaggccagcaggttgctgttcccgatctagcccaccagccttctccccccgtgaatggacaaccccctctcggctccttgcaggccctcgtcagagaggtatggctggagaagccccgatacgatgcggctgagagaggattctacgaagccctctttgatggacacccacctggcaaggtgcgactgcaagagcgggccgggctggctgaaggcgcgagaagaggccgccgtgatagacgaggtcggaacatcctgggcaataagagggccggactcaggcgcgctgatggcgaagctccgtcagcgctgccatattgttactttctgcagaaggacgccgaggccccatggctgagcaaacctgcctacgattcggcggagtgccggcaccacgctgccgaggccctgcgcgtggcgtggtgtctggaagccgctagcttgagccacaggcccggaccacggtcaggtctgtctgtgtccagtctacggcccaacagaaagatggccacaaactttctagcccacgagaagatctggtttgacaagtttaagtacgatgatgctgagcgccgcttctatgaacaaatgaacggccctgttgctggggcctcccggcaagaaaacggggccagcgtgatccttcgagacatcgcgcgagcaagagaaaacatacagaagagtctagccggttcaagcggcccgggcgcttcttctggaacctcaggggatcacggcgagctggtcgtgaggatcgccagtttagaggtcgaaaaccaatctctaaggggggtcgtacaggagttacaacaggcaattagcaaactggaggcccgtttgaacgtcctggagaaatcgtctccagggcaccgggctaccgcaccacagacacagcacgtttctcctatgcgacaagtcgagccaccagccaaaaagccggccacccccgccgaagatgatgaggacgacgatattgatttatttggcagtgacaatgaggaagaagacaaggaggcagcacagctaagggaggaaagactccgccagtacgcggagaaaaaggcaaagaaacctgctctggtcgcaaagtcctcgatcctgctcgatgtgaagccatgggacgacgagactgatatggcacagctggaggcatgcgtacgttccatacagttggatggactggtttggggagccagtaaactggttcctgttggttacggaatccgaaagctgcagattcaatgcgtaggcggaagacagggaggcgacaggctggctggaggcggcgatcatcaagtttag

SEQ ID NO: 116208 - DNA, 1728 bp, Artificial Sequence
  Description of Artificial Sequence: Synthetic coding sequence
atgaacggacctggacaagacgaccccgaggatgcggatgaagctgaggcacccgatgggggctccagacgcgatccccgaaagtctcaggactctcgaaaacccctccagaagaaaagaaagcggagtccgaaaagtggactcggtcctgcagatttggcgctactgggtctgtccgctgagagggtgtggcttgataaatcgcttttcgaccaggcagaatcatcctaccgccagaagcttgcagacgttgccgcacaagcagcctggcctcccgcacttgctccgtgggggctctgcactcacggcaatcaggtggcctgtcaccatgttacatggggtatctgggtaaataaatcctcattcgaccaagcagaacgggccttcgtggaatggtcacaggccctgcttctggctccagatggctccaggagacagggaacgcccaacacaggccagcaggtggccgtccccgatctagctcatcagccctctccacctgtgaatggtcagcctcccctgggcagcctgcaggccctggtgagagaagtgtggctggaaaagcctcgctatgatgcggccgagaggggattctatgaagctttatttgatgggcatcccccggggaaagtgaggcttcaggagcgcgcaggcctggcagagggcgcgcggcgcggccgccgcgatagacgaggccggaatattctcggcaataaaagagccggcttgagaagggccgatggtgaggcaccaagtgcactgccatattgttatttcttgcaaaaagacgccgaagctccatggttatccaagccagcctatgatagcgccgaatgtcgtcaccacgctgctgaagcccttagggtggcttggtgcttggaagctgctagtcttagtcataggccgggaccaagatccgggctgtccgtaagctccctgcgtcctaaccgaaagatggccaccaacttcctggctcacgaaaagatttggtttgacaaattcaaatacgacgacgcagagcgacgattctatgagcaaatgaatggacctgtagccggagcttcacgccagagcagtggcccaggagctagctctggcacaagtggcgatcacggtgaactcgtggtgagaatagcatcactggaggtggaaaatcagtctctcagaggagttgttcaggagcttcaacaggccatttctaaattagaggctaggctaaatgtcctggaaaagtcaagccctggccaccgagctacagccccccagacccagcacgtgtctcctatgagacaggtggaaccccccgcaaaaaaaccagccacacccgccgaagatgatgaagacgacgacattgacttattcggctccgataacgaggaggaggacaaggaagcagcccaacttcgggaggagcggctccggcagtatgccgaaaagaaagcaaaaaagcccgctctggtggccaagagctctatcttgcttgacgtcaagccctgggacgacgagaccgacatggctcagctggaagcctgcgtaaggagtatccagctggatgggctcgtgtggggtgctagtaaattagtgcctgtcggttacggtatcagaaaactccagattcaatgcgtcgtcgaggatgacaaggtgggcactgatctgcttgaggaggaaatcaccaagttcgaggagcacgtgcagtccgtcgacatagcagcctttaataaaatttag

SEQ ID NO: 116209 - DNA, 846 bp, Artificial Sequence
  Description of Artificial Sequence: Synthetic coding sequence
atggctacaaacttcctcgctcatgagaagatttggtttgacaagttcaagtacgacgacgctgagagacgcttttacgagcagatgaatggacccgttgccggtgccagccgtcaggaaaacggcgcaagtgtcatcttacgagacatcgctcgggctcgagaaaatattcagaaaagcctggcagggtccagtgggcctggggcctctagcggaactagtggggaccatggagagctcgtggtgagaatcgcctcactcgaagtcgaaaaccaatcacttcgtggtgtcgtccaggagctgcaacaggcgatcagcaagctcgaggcacgactcaatgtgcttgaaaagtcttctcctgggcaccgtgcaactgcccctcagacccagcatgtgtcaccgatgcgacaagtggaacctcctgctaaaaaacctgcaactccagctgaagatgacgaggacgacgacatcgacctcttcggctccgacaatgaggaagaagataaagaggccgcccaattgagagaggagcggctccggcagtacgctgaaaagaaggccaaaaagcctgcactggttgcaaagtcttccattctgctggatgtgaagccatgggacgatgagactgacatggcacagctggaggcttgcgttaggtccattcagctcgatggactggtctggggcgcttccaaacttgtgcctgtgggttacggcatcaggaaactgcaaattcagtgcgtagttgaggacgacaaagtgggcactgacctgttggaggaggagatcactaagttcgaagaacacgtccaatctgtcgacatagccgccttcaataaaatctag

SEQ ID NO: 116210 - DNA, 846 bp, Artificial Sequence
  Description of Artificial Sequence: Synthetic coding sequence
atggccaccaattttttagcacacgagaagatttggttcgataagtttaaatatgacgacgccgagaggcgcttctatgaacagatgaatggccctgtcgctggggcctctaggcaggaaaatggggctagcgttatcctgcgcgatatcgcacgcgcaagagagaacattcaaaagagtctcgctggcagctcagggcctggagcctctagcggtacatcaggcgatcacggcgagttggtggtgcgcatagcaagcttggaagtggaaaatcagtcccttcgcggagtagtccaggaattgcagcaggcgatctctaagttggaagcaagactgaatgtgctcgaaaagtctagtcccggccacagagccactgccccacagactcaacacgtctcgcccatgaggcaggtggagccccccgcaaagaaaccagccacccctgcggaagatgatgaggacgacgacatcgacctgttcggttctgataatgaggaggaggacaaagaggccgcgcaactacgcgaagaacgtcttaggcagtacgccgagaagaaggctaagaagcctgcactggtcgctaaaagcagcattctgctcgacgttaagccctgggatgatgaaaccgacatggcgcagttggaagcctgcgtgcggagtattcagctggacggactcgtgtggggagcgtcgaagctggtgcctgtgggttatggaatacgtaagctgcagattcaatgtgtcgttgaggatgacaaagtgggcaccgatctccttgaggaagagattaccaagttcgaagagcacgtccagagcgtggacatcgccgcatttaataagatctag

SEQ ID NO: 116211 - DNA, 1944 bp, Artificial Sequence
  Description of Artificial Sequence: Synthetic coding sequence
atgcgctccggcaaggcatcttgcacactcgagactgtttgggaagataaacacaagtacgaggaggccgaaagacgcttctacgaacacgaagccactcaggctgccgccagcgcacaacagctgccggccgagggtcctgccatgaacggacctggacaggacgaccctgaagacgctgatgaggctgaggcaccagacgggggctctcggcgggaccctagaaagtcgcaagactctaggaaacctctccagaagaaacgcaagcgaagccccaaaagtggtctcgggcccgccgatttggcccttcttgggctttccgccgagagggtgtggctcgacaaaagcctatttgaccaagcagaatcaagctacagacaaaaactggcagacgtggccgctcaggcagcgtggcccccagctctggctccctggggactgtgtacccatggcaaccaggtcgcctgccaccacgttacttggggcatatgggttaataaaagttcattcgaccaggcagagcgagcttttgtggagtggtcccaggccctgctcctggcccccgatgggagccgccgtcaaggaactcccaacactggccagcaggtggcagtgccagatctggcccaccagccatccccacccgttaacggccagccacctctcggttccctgcaggccctggtccgtgaagtctggctcgaaaaacccaggtatgacgccgccgaaagggggttctatgaggctctgttcgacggtcatccccccggtaaagtgagactgcaggaacgcgcaggtctggccgagggcgctcgacgtggtaggagagacagacggggtaggaacattctgggaaataagagagccgggcttcgacgcgcggacggagaagctccttcagccctgccttattgttattttctgcaaaaggatgctgaggccccctggctgtcgaagcccgcctatgactccgctgagtgtagacaccacgcagccgaagccctgagggtcgcctggtgtcttgaggccgcctccttgtcacatcggcctggcccccggtcaggcctgtccgtttcctcattaaggccgaacagaaaaatggctacaaatttcctggcacacgagaagatctggtttgacaagtttaaatacgacgacgccgagaggcggttttacgaacagatgaatggccccgtcgctggcgcaagccgacaggagaacggcgccagcgtcattctacgtgatatcgctagggcgcgtgaaaatatacagaagtcgttggccgggtctagcgggcctggcgcttcttcggggactagtggagatcacggggaactggtggtgagaatcgcaagcctggaagtcgaaaatcagagtttgagaggcgtggtccaagagctccagcaggctatctccaaactggaggcccgtttgaatgttctggaaaaaagcagccctggccatcgtgctactgccccccagacgcagcacgtgtctccgatgcgccaggtggaacccccagccaagaagccagcaacacccgctgaggacgacgaagacgacgacatcgatttgttcgggagcgataatgaggaggaagataaagaggccgcccagttgagggaggaaagactgcggcagtacgctgagaaaaaagccaagaagccagcgcttgtagctaaaagcagtatactcctggatgtgaagccttgggatgacgagactgacatggcccaattagaggcctgcgtgcggagcatacaactggacgggctggtctggggagcctctaagctcgtgcccgttgggtatggcatacgaaaactgcaaattcagtgcgtcgtggaagatgataaagtgggtacagacctcctggaagaagaaatcacgaaatttgaagagcatgttcagtccgtggatattgccgcctttaataagatctag

SEQ ID NO: 116212 - DNA, 1944 bp, Artificial Sequence
  Description of Artificial Sequence: Synthetic coding sequence
atgcggtctggcaaagcctcctgcactttggaaactgtttgggaggataagcataagtatgaagaggctgaaaggagattctacgaacatgaagccacccaggctgccgcatctgctcagcagctgccagctgagggacccgctatgaatggccccgggcaggatgaccccgaggacgcagacgaggccgaggcacctgacggcggtagcaggagggacccgcgcaaatctcaggatagtcgaaagcctttacaaaaaaaaaggaagcgatctcccaaatcgggactaggtcctgccgatctagccctcctgggcctgagtgcagagagggtgtggttggacaaaagcctattcgaccaggctgagtctagctacagacagaaattggcagacgtcgctgcccaggccgcctggccaccagcattggctccttggggactctgcacacatggcaaccaagtggcttgtcaccatgttacctggggaatctgggtcaataagagctcattcgaccaggcggaacgtgcattcgtggagtggagccaggcactgctgctggctcctgatggcagccggcgccagggaactcccaacactgggcagcaggttgctgtgcccgatcttgctcatcaaccatcgcccccagtgaacggccagccgcccctcgggagcctgcaggccctagtgagagaggtttggcttgagaagccgaggtacgacgctgcagagcggggattctacgaagctctctttgatgggcatccccccgggaaagtgaggcttcaagaaagggctggactcgccgagggggctcgtcgaggccgccgcgatcgtcgtgggaggaatattctcgggaacaagcgcgcgggcctgcgaagagccgacggtgaagccccctccgcattgccatactgttatttcttgcagaaagacgcagaggcaccttggctgtcgaaaccggcctatgatagcgccgagtgtcgacaccacgctgccgaggcactaagagtagcgtggtgtctagaggccgccagtctgtcccatcgtcctggccctcgctccggtctctctgtgagctccctgcgaccaaatcgtaaaatggcaactaactttttggcccatgaaaaaatctggttcgacaagtttaagtatgacgacgcagagcggcgattctatgaacaaatgaacggacccgttgctggggcgtcccgacaggaaaacggggcttcagtgattttaagggacattgctagggcccgcgagaatattcagaagagcctggctggatcatccggccccggagctagtagcggtacctccggggatcatggggagctggtggtccggattgcctcgctagaagtcgagaaccaaagcctgagaggtgtcgttcaggaattacagcaggcaatttctaaattggaggcccgcctgaacgtactggagaagtcaagcccaggacaccgcgccaccgctccgcaaactcagcacgtgtcacctatgcgccaggtggagccaccagctaagaagcctgctacccctgctgaggatgacgaggacgatgacattgatttgtttggatccgacaatgaagaggaagataaggaggctgcccagctgcgcgaggagcgcttgagacagtacgccgaaaagaaggcaaagaagcccgctttagttgccaagtctagtatcttgctggacgtgaagccctgggatgacgagactgatatggcccagttagaagcctgtgtacgttctattcaactagatgggctggtgtggggagctagtaaactggtgcctgtgggatacgggatccggaaactccagattcaatgcgtagtcgaagatgacaaagtcggaacggacctgctggaggaagaaatcacaaagttcgaagaacacgttcaatccgtggatatagcagcctttaataaaatctag

SEQ ID NO: 116213 - DNA, 774 bp, Artificial Sequence
  Description of Artificial Sequence: Synthetic coding sequence
atggccacaaatttcctggcccacgagaagatctggttcgacaaatttaagtatgacgatgctgaaagacgcttttacgagcagatgaatggcccagtggccggagctagtcgtcaatctagcggtcccggggccagtagcggcactagcggcgaccacggggagctggtcgtgcgcatcgcttcattagaggtggagaatcagtcattgcgcggagtggtgcaggagctgcagcaagccatctcaaagctggaggctagactcaacgtgttggaaaagtcgagtccagggcacagggccacagctccacagacccagcatgtgagccccatgcgccaggttgaacccccagcaaaaaaacccgctaccccagctgaggatgatgaggatgatgacatcgatctcttcgggtctgataacgaggaggaggacaaagaggcggcgcagcttcgagaagaacgactgcgccagtatgccgaaaagaaggcaaagaaacctgcgctggttgccaagtccagcatcctgctggacgtcaaaccctgggatgacgaaacagacatggcccagctcgaggcctgcgtgcgaagcattcagctggatggtcttgtctggggcgcctcaaaactggtcccggttgggtacggaattcggaaacttcagatccagtgtgtggtcgaggacgataaggtgggaacagacctcttggaagaggagattacaaagtttgaggaacacgtgcaaagcgttgacattgccgcctttaacaaaatctag

SEQ ID NO: 116214 - DNA, 546 bp, Artificial Sequence
  Description of Artificial Sequence: Synthetic coding sequence
atgagaagcggtaaagctagctgcacactggaaacagtgtgggaagataagcacaaatatgaagaagcggaacgtaggttttacgagcacgaggccacccaggccgccgctagcgcccagcagctgcccgccgaaggacccgcaatgaacggcccagggcaggacgatccagaagatgccgacgaagcagaagcacctgacggaggtagcagacgggaccctcggaagtcacaggattctaggaagcccctgcaaaaaaaacggaagaggagccctaaatcaggtctcggccccgccgatctggccttgttaggcctgtcggctgagagagtgtggctcgataagagtctcttcgatcaagctgaatcctcctatagacagaaattggcagatgtggcggctcaggccgcatggcccccagctctggccccatggggtctctgtacccacggaaaccaggtagcttgccaccacgtgacatggggaatatgggtcaacaaatcaagttttgaccaggcggagagggcgttcgtcgaatggagttag

SEQ ID NO: 116215 - DNA, 192 bp, Artificial Sequence
  Description of Artificial Sequence: Synthetic coding sequence
atgcggagcggaaaagcaagctgcaccctggagaccgtctgggaagacaagcacaagtacgaagaagcagagcgtaggttttacgagcacgaggccactcaggctgccgcttccgcccagcagctgcctgcagaggggccggccatgaatgggcctgggcaggacgacccagaagatgccgacgaggcatag

SEQ ID NO: 116216 - DNA, 120 bp, Artificial Sequence
  Description of Artificial Sequence: Synthetic coding sequence
atggccactaattttcttgctcacgaaaaaatttggttcgataagttcaagtacgatgacgccgaacgccgattctacgagcagatgaatggaccggtggctggggcttctcgtcaatag

SEQ ID NO: 116217 - DNA, 246 bp, Artificial Sequence
  Description of Artificial Sequence: Synthetic coding sequence
atgcggagcggcaaagcttcctgcacacttgaaactgtgtgggaggacaaacacaagtacgaagaagcagaaagaagattctatgaacatgaagcaacacaggcagccgcctctgctcagcaattaccagccgagggccccgcgatgaatggccctggacaagatgatccagaggacgctgacgaggcagaggctcctgacggcggctctaggcgcgacccgcgtaaatcacaggacagcaggtag

SEQ ID NO: 116218 - DNA, 114 bp, Artificial Sequence
  Description of Artificial Sequence: Synthetic coding sequence
atgaggtctgggaaggctagttgtactttagaaacagtgtgggaggataaacacaagtacgaggaagctgaacgacgcttctacgagcacgaagctacccaagctgccgcttag

SEQ ID NO: 116219 - DNA, 162 bp, Artificial Sequence
  Description of Artificial Sequence: Synthetic coding sequence
atgcggtcaggcaaggcgtcatgtacccttgaaacagtttgggaggacaaacacaaatatgaggaagccgagcgaagattctacgagcatgaggccactcaggcggccgctagcgcacagcagctgcccgcagagggccccgctatgaacgggcctgggtag

SEQ ID NO: 116220 - DNA, 192 bp, Artificial Sequence
  Description of Artificial Sequence: Synthetic coding sequence
atggccacgaatttccttgcccacgaaaagatatggttcgacaagttcaaatatgatgatgctgaaagaaggttttacgagcaaatgaatggccctgtcgccggcgcttccaggcaggagaatggagctagcgtgattctgcgggacatcgcacgggcacgagagaacatccagaaatctcttgccggctag

SEQ ID NO: 116221 - DNA, 903 bp, Artificial Sequence
  Description of Artificial Sequence: Synthetic coding sequence
atgcgtagcgggaaggcatcttgtactctggagacagtttgggaagataaacataagtacgaagaggctgagcggcgtttttacgaacatgaggctacacaggctgctgcgtctgcacaacagctgcctgcagaaggcccagctatgaatggacccggacaggacgatccagaggacgccgatgaggcggaggccccagatggagggtcccggagagatcctcggaaaagccaggactcccggaagccccttcaaaagaagagaaaacgcagccctaagtctggactggggcccgccgacctggctttgttgggactgtccgctgaacgggtctggttggacaagtccttgtttgatcaggccgaatcttcctacagacagaaacttgcagatgtagccgcccaagccgcgtggcctccggcattagcgccatggggattgtgcacgcacggaaatcaggtggcctgccaccatgtgacttggggcatatgggtgaataagtccagctttgatcaggcggaaagggctttcgtggagtggagccaggccttactcttagcccccgatggcagtcgtcgacagggtactcctaataccggacaacaagtcgccgtccctgatcttgcgcatcagcccagtcctcctgtcaatgggcagccccccttgggttccctgcaggccttagtgagagaagtgtggctagagaagccacgatacgatgcagccgagcgcggcttctatgaagcactgttcgacggccaccctcctggcaaagtgaggctgcaggaacgggcaggtctggcggagggggctagaaggggacggagggataggaggggcaggaacatcctcggcaacaaacgagcaggcctgcgccgcgctgacggggaagccccaagctag

SEQ ID NO: 116222 - DNA, 66 bp, Artificial Sequence
  Description of Artificial Sequence: Synthetic coding sequence
atgcggagcgggaaagctagctgtacactcgagaccgtgtgggaagataagcataaatacgagtag

SEQ ID NO: 116223 - DNA, 474 bp, Artificial Sequence
  Description of Artificial Sequence: Synthetic coding sequence
atgcgttcagggaaagccagttgtaccctggagaccgtgtgggaggacaaacacaagtacgaagaggccgagaggagattttacgagcatgaggcaacgcaggctgctgcatcagctcagcagcttcctgccgaaggaccagctatgaacggccccgggcaagacgaccccgaggatgcagacgaagctgaggcccctgatggagggagcagacgggaccctcgaaagagtcaggactcacgtaaaccactccaaaagaagaggaaacgtagtccaaaatccggtctaggtcccgcagacctggcccttctagggttgtctgcagagagagtgtggctggataaaagcctgttcgaccaagccgagtccagctacaggcagaagctagctgatgtcgctgctcaggccgcctggccaccagcactggcaccatggggcttgtgcacacatgggaatcaggtggcttgtcattag

SEQ ID NO: 116224 - DNA, 774 bp, Artificial Sequence
  Description of Artificial Sequence: Synthetic coding sequence
atggccaccaactttctggcccacgagaagatatggtttgataagtttaagtacgatgatgctgaacggcgcttctatgaacaaatgaatggcccggtcgccggtgcgtcaagacaaagtagtgggccgggggcctcgagcggtacttccggggatcatggggagttagtggtaagaattgcctctcttgaggtcgagaatcagagcctccgcggggttgtccaggaactacaacaagcaatctccaaactggaggcaagattgaatgtgctcgagaaatcttcccctggacaccgggctactgcccctcaaacccagcatgtatcacctatgcgccaagtggagcccccagccaagaagcctgcgactccagctgaggacgacgaagacgacgatatcgatctgttcggcagcgataatgaggaggaagataaggaagctgcgcagctgagggaagaacgactgcggcagtatgcagagaaaaaagctaagaagccagcgctcgtggcaaaatccagtatcctgctcgacgtgaagccctgggatgacgaaactgatatggctcagctcgaggcatgcgttcgttcgatccagctcgatggcctggtatggggggcttccaaactagtgcccgtgggttacggtatcagaaagctgcaaattcagtgtgtggttgaagacgataaggtgggcaccgatttactagaagaagaaattaccaaattcgaagaacatgttcagagtgttgatatcgcggctttcaacaagatttag

SEQ ID NO: 116225 - DNA, 846 bp, Artificial Sequence
  Description of Artificial Sequence: Synthetic coding sequence
atggctactaattttctggcacacgaaaaaatctggttcgacaagtttaagtacgacgatgccgagaggagattttacgaacagatgaatggcccggttgccggggcctctcggcaggagaacggagcttcggtgattcttagggatattgcccgggctcgggagaatattcagaaatccctcgcaggaagcagcgggcctggagccagtagcggcactagtggtgatcatggagagttggtagtccggattgcatccctggaggtggagaatcaatccctgagaggtgttgtgcaggaattgcagcaggcaatctctaagctcgaagcaaggctcaacgtgttggagaaaagctctcctggtcatagagccaccgccccccaaacacagcacgtgagtcccatgagacaggtggagccgccagcgaagaagcctgccaccccagccgaggacgacgaggacgacgacattgacctgttcggttctgacaacgaggaagaagacaaagaggctgcccagctcagagaggagaggctgcggcagtatgcagaaaagaaggccaaaaaaccagctttggtggccaaatcttcaattttactggacgttaaaccttgggatgacgagacagacatggcccagctagaggcttgcgttagatcgatccagttggacggtctggtatggggggcatccaaactagtccctgtcggatacggaattaggaaactgcaaatccagtgcgttgtcgaggacgacaaggtgggaaccgatctgctcgaagaagagatcacaaagttcgaggaacatgtacagtccgttgacatcgctgccttcaacaagatctag

SEQ ID NO: 116226 - DNA, 441 bp, Artificial Sequence
  Description of Artificial Sequence: Synthetic coding sequence
atgaggagtggaaaagcatcctgcacccttgagacagtgtgggaagacaaacacaaatacgaggaagccgaacggaggttttatgagcacgaggctacgcaggccgccgcttctgctcagcagctgccagccgaaggtcccgctatgaacggaccaggccaggacgatccagaagatgctgatgaagccgaggctccggatggcggatccaggcgtgatcctcgcaaatctcaagattctcgtaagccactccagaagaaaagaaaacgctccccaaagtccggtctcggcccagcagaccttgctttactagggttatcggctgaaagagtgtggctggataagagtttgtttgaccaagccgagtcttcatacagacagaagctggcggatgtggccgctcaggcggcttggcctcccgcactggctccgtggggatag

SEQ ID NO: 116227 - DNA, 615 bp, Artificial Sequence
  Description of Artificial Sequence: Synthetic coding sequence
atggcaaccaatttcttggcccacgaaaaaatttggtttgacaaatttaagtatgatgacgccgaacgtcggttttacgagcagatgaatggaccggtggctggtgccagcaggcaagaaaatggggcgtctgtgatactgcgcgatatagcaagagcaagggagaatatccaaaagtccctcgccggttcctccggccccggtgcgtcctccggtacttctggggaccatggcgaactcgtcgtgaggattgccagccttgaagtggaaaatcagagtctgaggggggttgtccaggaattgcaacaggctataagtaagttggaagccagactcaatgtgttggaaaagtcctcgccggggcatagagccacggccccccagacacagcacgtctccccaatgcggcaggtggaacccccagcaaagaagcccgccactcctgcggaagacgatgaggatgacgatattgacctgttcgggtctgacaatgaggaggaggacaaggaagctgcccagcttcgcgaggagcgcctacgtcaatacgcggagaaaaaagctaaaaaaccggcattagtcgccaagagtagtatactgttggatgtcaaaccgtag

SEQ ID NO: 116228 - DNA, 390 bp, Artificial Sequence
  Description of Artificial Sequence: Synthetic coding sequence
atgcgttctggaaaagcgagctgtacactggagactgtgtgggaggataagcacaagtacgaggaagccgagaggaggttttacgagcacgaagctacacaagccgccgccagtgctcagcagttgcctgcggagggcccagccatgaatgggcccggtcaggatgatccggaagatgctgatgaggcggaggctccagacggcggctctcgcagggaccctcggaaatctcaggactctcgcaagccattacagaaaaagcgcaagagatcccccaaatccgggctgggccctgcggacctggccctgctgggcctgtccgctgagcgcgtttggctcgataagagtctgtttgaccaagctgagagtagttatcgccagaagctgtag

SEQ ID NO: 116229 - DNA, 501 bp, Artificial Sequence
  Description of Artificial Sequence: Synthetic coding sequence
atggccaccaattttcttgcccacgagaaaatttggttcgacaagtttaaatatgacgacgccgaaaggaggttttacgaacagatgaatggtccagttgccggcgcaagcagacaggagaacggggcttcggttatccttcgagatatcgcccgtgccagagaaaacattcagaaatctttagcaggcagctccggccccggtgcctccagcggcactagcggagaccatggggaactagtcgtgcgcattgcaagcttggaggtggagaaccagtctttacgcggggtcgtgcaggaattgcagcaagcgattagcaaactggaggccagactgaacgttctcgaaaagtcttccccaggccatcgcgcaactgccccacagacacagcatgtatccccaatgagacaggtggaacccccggccaaaaagcctgcaactccagccgaggatgatgaagacgacgatattgatctatttggtagcgacaatgaagagtag

SEQ ID NO: 116230 - DNA, 255 bp, Artificial Sequence
  Description of Artificial Sequence: Synthetic coding sequence
atgcgctccggtaaagccagttgcacgttggaaactgtctgggaggacaaacacaagtatgaggaggccgagcggcgcttctacgaacatgaagctacccaggcggctgctagcgcgcagcagctgccagctgagggacccgccatgaacgggcccggtcaggacgaccctgaggacgccgacgaagccgaagcccccgatggcgggtcccgtagggatccccgcaaaagccaggatagcagaaaaccgttgtag

SEQ ID NO: 116231 - DNA, 600 bp, Artificial Sequence
  Description of Artificial Sequence: Synthetic coding sequence
atggccacgaactttcttgcacacgagaaaatctggtttgacaagtttaagtacgatgacgccgagcggcgcttctacgaacagatgaacggccccgtcgccggggccagcagacaggaaaacggggcctcggtgatcctgcgggacatcgctagggccagagagaacatacagaagtctctggccgggagttcgggccctggagcaagctccggcacctctggtgaccacggcgaactggtagttcgaatcgcttcattggaggtggaaaaccagtcgctccgaggggtggtgcaggaactgcagcaggcaatctctaaacttgaggcaaggctcaacgtgcttgagaagtcttctcctgggcatcgtgcaactgcacctcagacacagcatgtttcacccatgaggcaagtggaacctcctgctaaaaagcctgcaacccctgctgaagacgacgaagacgacgacattgaccttttcggttccgataacgaggaggaggacaaagaggctgcacagctgcgagaagagcggttgcggcagtacgccgagaagaaggccaagaagccagccctcgttgccaagtccagtatcctttag

SEQ ID NO: 116232 - DNA, 774 bp, Artificial Sequence
  Description of Artificial Sequence: Synthetic coding sequence
atgaggagcggcaaggcctcttgtaccctcgaaactgtctgggaagacaaacacaaatacgaggaagcagaacgtcgcttctacgaacacgaagccacccaggccgcagcatcagcacagcagttaccggcggagggacccgccatgaacggcccgggtcaggacgaccctgaggatgcggacgaggcagaagcgcccgacggcggcagtagacgcgaccccaggaaaagccaagacagccgaaagccgctgcagaagaagcgcaagcgcagcccgaagtctggattgggcccagctgacctggccttacttggcctttcagctgagagggtctggctggacaaatctttatttgaccaagccgagagtagctataggcaaaaactcgctgacgttgccgctcaggctgcttggcctcccgctttggccccatggggtctgtgtactcacggcaaccaggtggcttgtcatcatgtcacatggggtatctgggtcaacaaaagcagttttgaccaagccgagcgggcctttgttgagtggagccaggcattgctgctagcgcctgatggctcaaggcggcagggtacgcctaacacagggcagcaggtcgccgtaccagatctcgcccatcagccctctccccctgtgaacgggcagccacctctcgggagcctgcaggctttggtccgcgaggtatggctggaaaagcctaggtatgacgctgcggagcgaggattttacgaagctctcttcgacggacacccacctggttag

SEQ ID NO: 116233 - DNA, 540 bp, Artificial Sequence
  Description of Artificial Sequence: Synthetic coding sequence
atgcggtccgggaaagcctcttgcactctggagacagtctgggaagataagcacaagtatgaggaagcggaaagacggttttatgagcacgaggccacacaggccgcagcttctgcccagcagctgccagccgagggcccggccatgaacggtccagggcaagatgacccagaggatgccgacgaagcagaagcacccgatggtggctccagaagggatccaagaaaaagccaagattcaaggaaacccttgcagaagaagagaaaaagatcccctaaatctggcctaggccccgcagacttggctttactgggcctgtctgccgagcgtgtctggctggacaaaagtctctttgaccaggctgagagcagctaccgccagaagctcgccgatgtggctgcccaagcagcttggccgcctgcgctggctccttggggcctctgcacacacggaaatcaagtcgcctgtcatcatgtaacctggggaatctgggtcaacaaatcttcatttgatcaggctgagagggctttcgtcgaatag

SEQ ID NO: 116234 - DNA, 108 bp, Artificial Sequence
  Description of Artificial Sequence: Synthetic coding sequence
atggctacaaactttctcgctcacgaaaagatctggtttgacaagttcaagtacgatgacgctgaacgccgattctatgagcagatgaacgggccagttgcagggtag

SEQ ID NO: 116235 - DNA, 150 bp, Artificial Sequence
  Description of Artificial Sequence: Synthetic coding sequence
atgcggtctggaaaagctagctgcaccctggagacagtgtgggaagacaagcataagtacgaagaggcagaaaggagattctatgaacatgaagccactcaggcagccgcatcggcacaacagctccctgccgagggccctgcgatgtag

SEQ ID NO: 116236 - DNA, 120 bp, Artificial Sequence
  Description of Artificial Sequence: Synthetic coding sequence
atggccactaactttctggcccatgagaaaatctggttcgataagtttaagtatgatgatgcagagagacgcttctacgaacaaatgaatggcccagtggcaggggcttctcgacaatag

SEQ ID NO: 116237 - DNA, 573 bp, Artificial Sequence
  Description of Artificial Sequence: Synthetic coding sequence
atgcggtcggggaaagcaagctgcacactcgaaactgtatgggaagataagcataaatacgaagaggcagagcgacgtttctacgaacacgaagctactcaggcagctgcttccgcgcagcaattgcctgccgaggggcctgccatgaatggtcccggccaagacgaccctgaggacgcagatgaagccgaagcccccgatggcgggtctagaagagacccacgcaagagtcaggactcccgcaaaccactccagaagaagagaaaacgatcccctaaaagcgggttgggtccagccgacttagccctgcttggtttgagcgcagagagggtgtggctagacaaatccctgttcgaccaggcagagtcttcctatcggcaaaaactcgccgacgtggctgcccaggcagcatggccaccagccctggcaccctggggcctctgcacacacggcaatcaggtggcgtgccaccacgtgacctggggtatctgggtgaacaaatcatcctttgaccaggccgaacgcgcatttgttgagtggtcccaggctctgctcctcgcaccggatggctag

SEQ ID NO: 116238 - DNA, 2094 bp, Artificial Sequence
  Description of Artificial Sequence: Synthetic coding sequence
atggaagcaccgctgggaagtatcctgagtccttgcccaggccgggctgcgactggacgggccggcaccggcagggtgggaactggtttgcgcccacccgctgtactgcaactttgccctttactagccttttacaggtgtgtgcgcaaaatgcgttctggcaaagccagctgtaccctcgagacggtatgggaggacaaacataaatatgaggaagcagaaaggcgtttctacgagcacgaggccacccaagccgccgcttccgcccaacagctcccggccgagggaccagccatgaacggtccaggacaagacgaccccgaggatgctgatgaggcagaggccccggatggcgggagccgtcgagatcctcgaaaatctcaagatagccgtaagcctctccaaaagaaacggaagaggagccccaagtcggggctcgggcctgccgatctggccctcctgggcttgtccgccgaacgcgtgtggctggataagagcctctttgaccaggctgaatcatcataccgccaaaagctcgctgatgtagctgctcaggcagcttggccgcctgcgctcgccccttggggattgtgtacccacggaaatcaagtagcttgtcaccatgtgacctgggggatctgggtgaataagtcgtcctttgatcaggccgaaagagccttcgtagaatggtctcaggcactcctactcgcccccgacggcagccgcagacagggcacaccaaacacagggcagcaggtggccgtgcctgacctggcccatcaaccaagtccccccgtgaacggacaaccgcccttgggtagcctgcaggcgcttgtcagggaggtgtggcttgagaaaccccggtacgacgccgccgaaagaggcttctatgaagcgctgtttgatggacaccccccaggtaaagtgcggctgcaagagcgagctggtctggcagaaggcgctaggagaggacgaagagacaggcgagggcgcaatatactgggcaacaagagggccgggctgcgccgggctgacggcgaagctccaagcgccttgccatactgctacttcttgcagaaggacgccgaggcaccatggctttctaaacctgcctacgacagcgcagaatgtcgccatcacgctgctgaggccttgagggtggcctggtgcctcgaagctgcctctctgagtcatagacctggcccccggagcgggttgtcggttagtagcctccgacctaaccgtaagatggccacgaacttcctcgctcacgagaaaatttggtttgacaagtttaaatacgatgacgccgaaagacggttctatgaacagatgaatggcccagttgccggagcaagtaggcaggagaatggtgcgtccgtgatactacgggacatagcccgtgccagggagaacatccagaagagtctggcaggctcctccggcccaggcgcaagctccggcaccagcggggaccatggagagctggttgtcagaatcgcctctttggaggttgagaaccaatctctgcgaggcgtggtacaggagctgcagcaggccattagcaagctggaggctcggctcaatgtcttggagaagagttctcctggacaccgagcaaccgctccccagacacagcatgtgagccctatgcggcaggtggaaccgcctgcaaaaaaaccggctacacctgcagaagacgacgaggatgacgatatagacctgttcggctcggataacgaggaagaggacaaggaggctgcccagttacgtgaagagagactgaggcagtacgcggagaaaaaagcgaagaaaccagccctggttgccaagtcaagcatcctacttgatgtgaaaccctgggacgatgaaacggacatggcgcagctggaagcctgcgttcggagcatccagttggatggcctcgtgtggggcgcctctaagttagtgccggttggatacggaatccgcaagcttcagatccagtgtgtggttgaagatgataaagtgggcaccgacctactggaggaggaaataaccaaatttgaagagcatgtccaaagcgtggacattgcagcattcaataaaatctag

SEQ ID NO: 116239 - DNA, 615 bp, Artificial Sequence
  Description of Artificial Sequence: Synthetic coding sequence
atggctacaaacttccttgctcatgaaaagatttggttcgacaagtttaagtatgacgacgccgagagacgattctacgagcagatgaacggccctgtggccggtgcgtcaagacaggaaaacggggcctccgtaatcctccgcgatatagctcgggcacgggagaatatccagaagagcctcgcgggcagttccggccccggggcttccagcggcactagtggtgaccacggtgaactggtggttcgcatcgccagcctggaagttgaaaaccaatcactcaggggggtcgtgcaggaactacaacaggccatttccaaactggaggctcggttgaatgtactggagaaaagtagtcctggccatcgggccaccgccccacagacccagcacgtctcccccatgcggcaggtggaacccccggccaaaaagcctgcaacacctgccgaagatgatgaagacgacgacatcgacctgtttggctcagataatgaggaggaagacaaggaggcagctcagctaagggaagagcgtctgcgccagtacgcggaaaaaaaggcaaaaaagccggcactagtggcaaagtcctccattttacttgatgttaagccttag

SEQ ID NO: 116240 - DNA, 507 bp, Artificial Sequence
  Description of Artificial Sequence: Synthetic coding sequence
atggcaaccaattttctggctcatgagaaaatttggttcgacaaatttaaatacgatgatgctgagagaagattttacgaacagatgaacggtcccgtagccggggcctccaggcaagagaacggagcctctgtgattctccgggatattgctcgcgcgagggagaatatccagaagtcactggccggcagtagcgggcccggagcctcaagcggaacgtccggagatcatggagaacttgtagtgcgaatcgccagtttggaagtcgagaatcaatctctccgcggggtcgttcaggagctccagcaggcgataagcaagctggaagctagacttaacgtactggagaaatctagtccaggacaccgggctaccgctccccagacgcaacatgtaagtccaatgcgtcaggtcgaacccccagccaagaagccagccactccggcggaggacgacgaagacgatgacatcgatctgttcgggtcggacaacgaggaagaggattag

SEQ ID NO: 116241 - DNA, 786 bp, Artificial Sequence
  Description of Artificial Sequence: Synthetic coding sequence
atggccacaaactttttggcgcacgaaaagatctggttcgataaattcaaatacgacgatgcagagaggagattctacgaacagatgaacggacctgttgctggagcgtcgaggcaagaaaatggcgctagtgtcatattacgggacattgccagggcccgggaaaatattcaaaagagcttagccggttcttccggacccggcgcaagcagtggcacatccggtgaccacggcgaactggtggttcggattgcttcccttgaggtagagaatcagtcgctgcgcggagttgttcaagagctgcaacaggccattagtaagttggaggcccggctgaacgtgcttgagaaatcttctcccggtcacagggccaccgcgccacagactcagcacgtgagccccatgaggcaggtggaaccgccggctaaaaagccagccacccctgccgaggatgatgaggacgatgacattgatctgttcgggagcgacaatgaagaagaggacaaggaggctgcccagctgcgggaggagcggctgcgtcagtacgccgagaaaaaagctaagaaaccagccctcgtagcgaaatcttcaatactgctcgacgttaaaccatgggacgatgagaccgatatggcgcaactagaggcttgtgtgcgaagtattcaacttgacgggctcgtctggggcgcatccaaattggtcccggttggctatggtatcaggaaactgcaaatccagtgcgtcgtggaagacgacaaggtcggcacagatttgctggaagagtag

SEQ ID NO: 116242 - DNA, 96 bp, Artificial Sequence
  Description of Artificial Sequence: Synthetic coding sequence
atgagaagcgggaaggcatcatgtacgctcgagactgtatgggaggacaagcacaaatacgaggaggccgaaaggagattctacgaacacgaatag

SEQ ID NO: 116243 - DNA, 207 bp, Artificial Sequence
  Description of Artificial Sequence: Synthetic coding sequence
atgcggagcggcaaggcatcgtgcacactggagactgtgtgggaagacaaacacaaatatgaagaggccgagaggaggttttacgagcacgaggccactcaggcggctgcgtcagcacagcaacttcctgctgaagggccagcgatgaacggtccggggcaggacgacccagaagatgccgacgaggctgaggcccccgatggctag

SEQ ID NO: 116244 - DNA, 789 bp, Artificial Sequence
  Description of Artificial Sequence: Synthetic coding sequence
atggctaccaattttttggcccatgaaaagatttggttcgacaaattcaagtatgatgacgctgaaaggaggttctatgaacaaatgaacggtcccgtggccggtgcatctagacaggaaaatggcgccagtgtgattctgagggacattgccagggccagagagaatattcagaaatcgctggctgggtcaagcggccccggggcatcctcaggcacctctggtgatcacgtggtgcaggaactacagcaggcaattagcaaacttgaggcaagactaaacgtccttgaaaaatcctctcccgggcacagagccacagccccacagacccagcatgtatcacctatgcggcaggtcgagcccccagccaaaaaaccggctacaccagccgaggacgacgaggatgacgacattgatctgtttgggtccgacaatgaggaggaagataaagaagctgcccagctgcgcgaggaaagactccgccagtatgcagaaaagaaagccaagaagccagctctcgtcgctaaatcttcgatcttgctagatgtgaaaccttgggatgacgagacagatatggcacagcttgaggcctgcgtgaggtctatccagcttgatgggctagtgtggggcgcctctaagctggtcccagtgggatacgggatacgaaaactccaaatccaatgcgtagtggaagacgacaaggtggggaccgacctgctggaagaagagatcacaaaatttgaggagcacgtgcagtccgttgatatagcagcatttaataaaatctag

SEQ ID NO: 116245 - DNA, 525 bp, Artificial Sequence
  Description of Artificial Sequence: Synthetic coding sequence
atggccgcagccgctgaactgtctcttctggagaaatccttgggcctgtcaaaaggcaataaatattccgctcagggagaacgccagatcccagtgctccagacgaacaacggcccttctcttactggactgacaacgattgccgcccacttggtgaagcaggccaataaagagtacctgctggggagcaccgccgaagagaaagccatcgtgcagcagtggctcgagtacagagtaacacaggtggatggacactcaagcaaaaacgacattcataccctgttgaaggatctgaattcttacctggaggataaggtgtacttaactggctacaatttcacactggctgacatactcttgtactacggactgcaccgctttatcgtggacctcaccgtgcaggagaaggaaaaatacctcaacgtctccagatggttctgccatatccagcattatcctggtatcaggcagcatctgtcctccgttgtgtttattaaaaaccgattgtatacaaattcccactag

SEQ ID NO: 116246 - DNA, 420 bp, Artificial Sequence
  Description of Artificial Sequence: Synthetic coding sequence
atggctgcagccgccgaattgtctttactcgagaaaagtctgggcctaagtaaggggaacaaatattctgcccagggagagagacagatccctgtgctacagacaaacaacggaccgagtctgactggcctcaccaccatcgcggcacatctcgtcaagcaagccaacaaggagtacctgttaggatctactgccgaagagaaggctatagtccagcagtggctggaatatcgagtaactcaggtcgacggacatagctcaaagaatgatatccataccctgctgaaggacctgaattcctacctcgaggacaaggtatacctcactggttataactttactctggcagatattctactttattacggtctgcacaggtttatcattcgcaagctgcgccacacagaggtgggtaattag

SEQ ID NO: 116247 - DNA, 1314 bp, Artificial Sequence
  Description of Artificial Sequence: Synthetic coding sequence
atggccgctggtaccctttatacataccccgaaaattggagagcgttcaaggccctgatagctgcccagtactccggagcacaggtcagagtactgagcgcgccccctcatttccacttcgggcagacgaaccggaccccggagttcctcaggaagttccctgccggaaaggtccctgccttcgagggagatgacgggttctgtgtctttgagtctaacgccatcgcttattatgtgtctaatgaggagctacgagggtcaacacctgaggcggctgcccaggtcgtgcagtgggtcagcttcgctgattccgacatagtacccccagccagcacatgggtgttccctactctcgggattatgcatcataataagcaggccacagagaacgctaaggaggaggtgagaagaattctgggcttgttggatgcttatctgaaaacaagaactttccttgtgggagagagagtgactcttgcagacattaccgtggtatgtaccctcctctggctctacaaacaggtcttggagcctagcttccgccaggcattcccaaacaccaatcgctggtttctgacctgcattaaccagccccaatttcgggctgtcctcggtgaagtgaagttgtgtgaaaagatggcccagttcgacgccaagaaattcgctgaaacgcaacctaaaaaggacactcccaggaaagagaagggaagtcgcgaagagaagcagaagccacaagctgagaggaaggaggagaagaaagctgctgccccagcccccgaggaggaaatggacgagtgtgaacaagcccttgcagcggaacctaaagcaaaagaccccttcgctcacctccccaagtctacgtttgtgctggacgagttcaagcgcaagtattccaacgaggacactctctccgtggcactgccctatttctgggaacatttcgacaaggatgggtggagcctgtggtacagcgaatacaggttcccagaagagctgactcagacatttatgagttgtaacttaataactggcatgtttcagagactggataagcttcgtaaaaacgccttcgctagcgttattctatttgggaccaacaacagctcctcaatttctggtgtgtgggtgttcagagggcaagaactagcatttccactgagtcccgattggcaggtagattacgaaagttacacctggaggaagttagaccctggtagcgaagaaacccagacactcgttcgggaatatttttcatgggagggtgctttccagcacgtcggaaaggcttttaaccagggtaagatcttcaagtag

SEQ ID NO: 116248 - DNA, 1464 bp, Artificial Sequence
  Description of Artificial Sequence: Synthetic coding sequence
atggctgagaggtgggtggcccccgccgtcctgcgaagggctaggtttgcttcaactttctttttatccccgcagatttatgcacataaagacggcgatctcaggagcgcattcttcatcttgtccttcaagcggggagagtttattcccttcctgaactggacactatatacgtaccctgagaactggcgggccttcaaggctctgattgctgcccaatacagtggcgcccaagtgagagtgctgagtgctcctccacattttcatttcggccagaccaataggactccagagttccttaggaaattcccagctggcaaagtgcccgccttcgaaggagatgatggtttttgcgtgtttgagtctaacgccattgcatattacgtgagcaatgaggagctgcggggctccacgcctgaagcggccgcccaagttgtgcaatgggtgtcattcgccgactcggacatagtgcccccagctagtacctgggtgtttcctacactaggcatcatgcaccacaacaaacaggcaaccgaaaacgctaaggaggaggtgcgccgcatactgggactgctcgatgcttatctgaagacccgaacattcttagtgggcgagcgagtaaccctggcagacatcaccgtagtctgcactctgctgtggctctacaaacaggtcctggaaccttcatttagacaagcatttccgaacactaacagatggttcttaacgtgcataaaccagccgcagtttcgagcagtgctgggtgaggttaagctgtgcgagaagatggcccagtttgatgcaaaaaagttcgccgagactcagcctaaaaaagacacgccacggaaggagaaaggctcaagagaggaaaaacaaaagccccaggccgaacgcaaggaggaaaagaaagccgctgctcccgccccggaggaggaaatggatgaatgtgagcaggcgctcgccgctgagccaaaggctaaagacccattcgcgcatctccctaagtctaccttcgtgctcgacgaatttaagcgaaaatattctaacgaggacacattgtcggtagcactcccctacttttgggagcacttcgacaaggatggatggagcctatggtatagtgaatatcgttttccagaagagctgacacagacattcatgtcatgtaatctgatcaccggcatgttccaaaggctggataaactcagaaaaaatgccttcgcctcagtgatcttattcggcaccaacaatagcagctcaatttccggcgtgtgggtgtttcgcgggcaggagcttgcctttcccctgagccctgactggcaggtggattacgaatcctatacctggaggaaactggatcccggaagcgaagagacacaaactctggtgcgcgaatacttttcctgggaaggggcatttcagcatgtcgggaaggcttttaaccagggcaagatcttcaaatag

SEQ ID NO: 116249 - DNA, 621 bp, Artificial Sequence
  Description of Artificial Sequence: Synthetic coding sequence
atgcaccacaataagcaggcaaccgaaaacgccaaggaggaggtcaggaggattctggggttattggatgcttacctgaagaccagaacctttctggtgggtgaacgggttacgttggcggcggaacctaaggccaaggacccgtttgcccacctgcctaaaagtacctttgttcttgatgaatttaagcgcaagtattccaacgaagacacactgtccgtggctctgccttacttttgggaacatttcgacaaggacggatggtcgttatggtactccgagtacaggttcccagaggaactgacccagacgtttatgagctgcaacctgataactggcatgtttcaacggctggataaattgaggaaaaacgcttttgcgagcgtgattctttttggtactaacaacagctcctccatttcgggagtatgggtgttccgtggccaagagctcgccttcccccttagtcccgattggcaggtcgactatgagtcctacacttggaggaaacttgaccccgggtctgaagagacacagacactcgttcgtgagtatttctcatgggagggggcgttccaacatgtgggtaaagctttcaaccagggaaaaatcttcaaatag

SEQ ID NO: 116250 - DNA, 2577 bp, Artificial Sequence
  Description of Artificial Sequence: Synthetic coding sequence
atggtaaatttcactgtggatcagatcagagccataatggacaagaaggccaacatacgaaacatgtccgtgattgcacacgtggaccacggcaagagcacccttaccgattctttagtttgtaaagccggcattatcgccagtgccagggcaggggagacacgcttcactgacactcggaaggacgaacaagaaagatgtataaccattaagagtactgcaatcagtctgttttatgaactgagcgagaatgacctgaatttcatcaaacagtctaaagatggcgcaggcttcttgatcaacttgatcgactctccggggcacgtggactttagtagtgaagtcaccgccgccctgcgggtcaccgatggagctttggtggtggtggactgcgtgtctggtgtatgtgtccaaacagagaccgtccttaggcaggccattgcagagaggatcaaacccgtgctaatgatgaataaaatggacagggcactgctggaactgcagttagagcctgaggagctgtatcaaacattccaaagaattgtggagaacgttaacgtcattattagcacgtatggcgagggggagagcggccctatgggcaacattatgatcgatcccgtgttgggcaccgtcggcttcggctctggcctgcacggctgggcttttaccttgaagcaattcgctgaaatgtatgtggcaaagtttgctgctaagggagaaggccagttggggcccgccgaaagagcaaaaaaagtggaggacatgatgaagaagctgtggggcgataggtactttgaccccgccaatggaaaatttagtaagtccgccacatctcctgagggcaagaagctgccgcgtaccttctgtcaattgatactcgaccccattttcaaggtgtttgacgctatcatgaactttaagaaggaggagacagccaaactgatagagaagcttgacatcaagctggattcagaagacaaagataaggaaggcaaaccactgctgaaggcagtcatgcgccggtggctaccggctggcgacgccctgctgcagatgatcacaattcatctcccaagccctgtgaccgcccaaaagtatcgctgtgaactgctttacgaaggtccgccggacgacgaagccgccatgggcatcaaaagctgtgatccaaaggggcccctaatgatgtatatatctaagatggtgcctacctctgacaaaggaagattctatgcctttggacgggtgttctccggtctagtcagtaccgggcttaaagtccggattatgggacctaattacacacccgggaagaaggaggacctgtacctcaagcctatacagaggacaattctgatgatgggccgatatgtcgagcccatcgaggatgtgccttgcggcaacattgtggggctggtgggtgttgatcagtttctggtgaagacgggcaccataaccacgtttgagcacgcccataacatgagggtcatgaagttctcagtgtctcccgttgtcagagtggccgtagaagccaaaaaccctgccgacctgccaaaactggtggagggccttaagaggctggctaagtcagatccgatggtccaatgcattatcgaggaatctggcgagcacataatcgccggcgctggggagctccacctcgagatatgcctcaaagatctggaagaggatcacgcttgcattccgatcaagaaaagtgaccctgtcgtgagctacagggagactgtttctgaagagagcaacgtcctatgcctgtccaaaagccccaacaagcataaccgcctatacatgaaagcacgaccctttccggatggactggccgaggacatcgacaagggagaggttagtgccagacaggagctcaagcagcgagcccgttatctcgccgaaaaatacgagtgggacgtcgccgaagcccggaaaatatggtgctttggccctgatgggaccgggcccaatatcctgactgacattactaaaggggtgcagtatctaaatgagataaaggattctgtggtcgccggctttcaatgggccaccaaagaaggggctctttgtgaagagaacatgagaggcgttcgcttcgacgtacacgacgtaacgctgcacgccgacgctattcatagagggggcgggcagatcatacctacagctcggcgctgtctgtatgcctctgtgttgacagcacagcccagactgatggaacctatctatctggttgaaatccaatgtccagaacaagtggtgggcggcatttacggggtgttgaatcggaagagaggtcacgtttttgaagaatctcaagtagccgggacacccatgttcgtggtgaaagcctacctccctgtgaatgaatcttttggatttaccgcagatctgcgctccaatacaggcggccaggcatttcctcaatgtgtgtttgatcattggcaaatcctgcccggcgacccctttgataactcatctcgtccaagccaggtcgtcgcagagacgcgaaagcgcaaaggactgaaagaagggattcctgccttagataactttcttgacaagctgtag

SEQ ID NO: 116251 - DNA, 1752 bp, Artificial Sequence
  Description of Artificial Sequence: Synthetic coding sequence
atggttaactttactgttgatcagatacgtgccattatggacaaaaaggctaatatccgtaatatgagcgtgattgcccatgtcgatcacggcaaaagtacactgactgatagcctggtgtgtaaggcaggaattattgcatctgccagagcaggcgaaacccggtttaccgacaccaggaaagatgagcaggagaggtgtattacaatcaagagtaccgccatctcgcttttctacgaactcagcgaaaatgaccttaactttatcaaacagtccaaggatggagctgggtttttgatcaacctcattgactcccccggtcacgttgacttctcaagtgaggtgaccgccgcactccgcgtgactgatggtgctctcgtggtagtggattgtgtgtcgggagtatgtgtccaaacagagactgtgttgaggcaggctatagccgagcgcataaagcctgtgcttatgatgaacaagatggatcgagctctgttggagcttcaactggagccagaggagctttaccagacatttcagcgtatagtagagaatgttaacgtgataatcagcacctatggggagggtgagtcaggtccgatgggaaacatcatgatcgaccctgtgctgggcacagtgggctttggtagcggcctacatggttgggctttcacgcttaaacaattcgctgagatgtacgtggcaaagtttgcagccaagggcgagggccagctgggacccgcagagcgggccaaaaaagtggaggacatgatgaaaaagttatggggtgaccggtattttgatccagcaaatggtaagttttcaaaatctgccactagccctgaggggaagaagctgccgcgcacattctgccagttgatcctggatcctatctttaaagtgttcgacgccattatgaatttcaaaaaggaggagaccgcaaagttgatcgagaagctggacatcaaactcgattctgaggataaagacaaggaggggaaacccttgcttaaagccgtgatgaggaggtggcttccagctggagacgccctgcttcagatgataacgatccatcttccttcacccgtgactgcccagaaataccgctgcgaattgctttatgagggtcctccggatgacgaggctgcaatgggaataaagagctgtgatcccaaggggccgctcatgatgtacatctccaagatggtgccgacgtccgataagggaagattctacgcatttggtcgcgtgttctcaggcctggtgagcacggggctcaaggttcggatcatgggacctaattacactcccgggaagaaagaggatttgtacttaaagcctattcaacgaacaatactaatgatggggaggtatgtggaaccaatcgaggatgtaccgtgtggcaatattgtaggcctggtgggagtagaccagtttctggtcaaaactggaacgatcactacttttgagcatgctcacaacatgagagtgatgaagttcagtgtctccccagtggtaagagtcgctgtggaggctaagaacccagccgacctccccaagctcgttgagggtctaaaacggctggcgaagtcggatcctatggtgcaatgtatcattgaggagagtggagagcacatcattgccggggcaggcgagcttcacctggaaatttgcctgaaggatcttgaagaggaccatgcgtgtattccaattaagaaggagaccgtgtctaagaaaaagaaaaagaaaaagtag

SEQ ID NO: 116252 - DNA, 351 bp, Artificial Sequence
  Description of Artificial Sequence: Synthetic coding sequence
atgcccaaaaacaaagagtacgcgcaggttatcaaaatgctgggcaacggacgactggaggctatgtgctttgacggcgtgaaacggctatgccacatacgaggcaaactacgcaaaaaggtgtggatcaacacttcagacatcatcctggttggtttgcgagactatcaggataacaaagctgatgtgattctgaagtacaacgctgacgaagccaggagtctgaaggcctatggtgaattgccagagcatgccaagattaacgaaaccgacaccttcggccccggggacgatgacgaaatccaatttgatgatattggtgatgatgatgaggatatcgatgatatttag

SEQ ID NO: 116253 - DNA, 435 bp, Artificial Sequence
  Description of Artificial Sequence: Synthetic coding sequence
atgcctaagaacaaaggaaaagggggaaaaaaccgccggcgtggaaaaaatgaaaacgagagtgagaaaagagaattggtcttcaaagaagatgggcaagagtacgcccaagtgattaagatgcttgggaacggtaggctggaagcgatgtgtttcgatggggtcaaacggctttgtcacattcgcggcaaattacggaagaaggtgtggattaatacatctgatatcattcttgtaggactgagggattaccaggacaacaaggccgacgtgatcctgaagtacaatgctgacgaagcgcgttctcttaaagcatatggcgagctgccagagcacgccaaaatcaatgagaccgacacctttggccctggagacgacgacgaaatccagttcgacgacatcggcgatgacgacgaagatatcgatgatatctag

SEQ ID NO: 116254 - DNA, 435 bp, Artificial Sequence
  Description of Artificial Sequence: Synthetic coding sequence
atgcccaagaataagggtaaaggcggcaaaaacagacgaaggggcaagaatgaaaatgagtcagaaaaaagagagcttgtgtttaaagaggatggccaagaatacgcacaggtcatcaagatgctgggtaatgggagattagaggccctctgtttcgacggggtaaagcgcctgtgtcatatccgaggcaaactgaggaagaaggtgtggatcaacacttccgacataattttggtgggactacgagattatcaggacaataaggctgatgttatactgaagtacaacgccgacgaggccagaagcctcaaggcttatggtgagttaccagaacacgccaagattaatgaaaccgacacttttggccctggggacgatgatgaaatccagttcgacgacatcggtgacgatgacgaggacatcgatgatatctag

SEQ ID NO: 116255 - DNA, 384 bp, Artificial Sequence
  Description of Artificial Sequence: Synthetic coding sequence
atgcctaagaacaaggggaagggtggcaagaacaggcgtaggggaaagaacgagaacgaaagcgagaagagggaattagtcttcaaagaggatggacaggaatatgcacaagttataaagatgcttggtaatgggagattagaagccttatgctttgatggcgtgaagagactgtgccatatccgcggtaagctacgaaagaaagataataaagctgacgtgattttgaaatataatgcggatgaggcaagaagcctcaaagcgtatggcgagctgcccgagcacgccaagatcaacgagactgatacattcggccctggcgacgatgacgagattcagtttgatgacatcggcgacgatgatgaggatatagacgacatctag

SEQ ID NO: 116256 - DNA, 1419 bp, Artificial Sequence
  Description of Artificial Sequence: Synthetic coding sequence
atggccggtggtgaagccggcgtaaccctgggccaaccgcacttgtcaagacaggacttgactacattggacgtgactaaactaacgcctctgagccacgaagtgatatcaaggcaagcgactatcaacatcgggacaatcggccatgtcgcccacggaaagtctacagtggtgaaggccattagtggcgtacacacggtgaggttcaagaatgagctagagcgaaacattaccataaagttaggatatgccaacgccaaaatctataaactggatgatccaagttgccccaggcctgaatgctacaggtcatgtggaagtagtactcctgatgaattccccactgacatcccaggaacgaagggtaatttcaagttggtgagacatgtctccttcgtggactgccctgggcacgacatactgatggccaccatgttaaacggtgcagcagtgatggacgctgccctgctactgatcgcggggaacgaaagctgcccacagccacaaactagtgagcatctggccgccattgagataatgaaactgaagcacatactgattcttcagaacaaaatcgacctggtcaaggagtcccaggccaaagagcagtatgaacaaatccttgcctttgttcagggaacggttgccgagggcgctcctattattcccatttccgcccagctgaagtataatatagaggtcgtctgcgagtatatagtgaaaaagattcctgtaccgccacgagattttacctccgagccacggttgatagtcatacgatcctttgacgtcaataagcccggctgcgaagttgatgatctgaagggaggtgttgcaggcgggtccatcctgaagggagtattgaaggtgggacaggaaatcgaagtacggccgggcattgtgagcaaagattctgaaggcaaactcatgtgcaagccaatctttagcaagatcgtatccctgtttgctgagcacaacgacctccagtatgctgcccctggcggtttaatcggggtgggtaccaagattgaccccactctttgccgggctgacagaatggttggccaagtattaggtgccgtgggcgctttgcccgagatttttacagaactcgaaatctcgtacttcctactaagacgcctgctgggggtgcgtacagagggtgacaagaaagccgcaaaggttcagaaactgagtaaaaatgaagtccttatggtgaatattggcagcctgtccacgggcggccgggtgtccgccgtgaaagccgacctgggcaagatcgtcttgacgaatccggtttgcactgaggtgggggagaagattgcgttgtcccgccgggtagaaaagcattggaggctgattgggtggggtcagatcaggcgcggtgtgaccatcaagccaactgttgatgacgactag

SEQ ID NO: 116257 - DNA, 552 bp, Artificial Sequence
  Description of Artificial Sequence: Synthetic coding sequence
taagcaggtggggaggcaggagtcaccctcgggcaacctcatctgagcaggcaggatttaaccaccttggacgttaccaaattaacaccgctttctcacgaggttatttcaagacaggcgacgattaatataggcacaatagggcatgtcgcccacggaaagagtactgtggttaaggcgattagtggcgtccataccgtgcgctttaaaaatgagcttgagcgaaacataactattaagctggggtacgccaatgccaagatctacaagctagatgacccaagctgtccccggcccgagtgctacagaagctgtgggagttcaacaccagatgaatttccaaccgatatcccgggtactaaagggaattttaagctggttagacatgtgtcttttgtggactgcccaggccacgatattctaatggcaactatgcttaacggagctgctgttatggacgctgcactgctgctaataggcaaatacttgactattggcctcgacaagtcgatgtggaacaagtccaagatgaagtacctgaagggcaactag

SEQ ID NO: 116258 - DNA, 1116 bp, Artificial Sequence
  Description of Artificial Sequence: Synthetic coding sequence
atgtttcaggaggtaaaggcagataaggtcaccatgctgtggaataagaaggccacagccgtgctggtgattgcaagcacggacgtggacaagaccggagcctcctactatggggagcagaccctgcattacattgccaccaacggtgaatccgccgtggtgcagctgccaaagaatgggccgatttacgatgtggtatggaatagttcgtctacagagttttgtgctgtctatggcttcatgccagccaaggcaaccatttttaacctgaagtgcgatcccgtgtttgactttggcaccggacctagaaacgctgcctattatagtcctcacggccacatcctcgtcctagcagggtttggcaatctgcggggtcagatggaagtctgggacgttaaaaactataagctgattagtaagccagtggcctccgacagtacttacttcgcctggtgccctgatggagaacatatcctgacagccacttgcgcaccccgtctgcgcgtgaacaacggctacaaaatttggcactatacgggttccatcctacacaaatatgatgtacctagcaacgcggaattgtggcaagtatcttggcaaccttttctggacggcatcttccccgccaaaacaataacatatcaggccgtaccatctgaagtgccaaacgaggaaccaaaagtggccaccgcttaccgaccccctgccttgagaaataagccaataacgaatagcaagctgcacgaagaggagcctccccaaaatatgaaaccccagagcggcaacgataagcctctgtctaagacagctctcaagaatcagagaaagcatgaagctaaaaaggccgccaagcaagaagccaggagcgacaagtctcccgatcttgcgccgacaccagcaccacagagcacacctcggaacactgtcagtcagtctatcagcggagatccagaaatcgacaagaagattaagaacctgaagaaaaagttaaaagctattgaacagctgaaggagcaagctgcaacgggaaaacagctggaaaagaatcaactggagaagatacagaaggaaacagccctcctgcaagagttggaggacctggagttaggcatatag

SEQ ID NO: 116259 - DNA, 1758 bp, Artificial Sequence
  Description of Artificial Sequence: Synthetic coding sequence
atggcaccatccaccccactgcttactgtacgggggtcagaaggactatacatggtgaatggacccccacatttcacagaatcaaccgtgtttccccgtgaatctggcaagaattgcaaagtatgtatattttctaaggatggcacactcttcgcatgggggaacggagaaaaggtgaatataatctccgtgaccaataaggggttattacacagttttgatctattaaaagctgtgtgtctggaattttccccgaagaacacagttttggcgacatggcagccatatacgacaagcaaggacggtacagccggtatccctaacctccaactgtacgacgtcaagacgggaacgtgtctgaaaagttttatacagaagaagatgcaaaattggtgtccgagctggtccgaggatgaaaccctgtgcgctcgcaacgtcaacaacgaagtgcacttttttgagaataataattttaacaccatcgcaaacaaactgcacttacaaaagattaatgacttcgtgttgtccccaggtccgcagccatataaagtggccgtctacgtgcctggaagcaagggtgcgccgtcattcgtgaggctttatcagtatcccaactttgccgggccccacgccgcacttgcaaacaagtctttctttaaagctgacaaagtaacaatgttgtggaacaagaaggctaccgctgtgctcgtgattgccagcacagatgtggataagactggcgcaagctactacggggaacagactctccactatatcgccacgaatggagaaagcgctgtggtgcagttgccaaagaacggccccatttacgacgtggtgtggaattctagcagcactgaattttgcgctgtgtatggatttatgccagccaaggccacaatctttaacctgaaatgcgatcccgtgtttgacttcgggactggccccaggaatgccgcctactatagccctcacggccatatcctggtgctggctggcttcggtaatctgagaggacagatggaggtgtgggatgtgaagaactataagcttatcagcaagcctgtggccagcgattcaacatattttgcatggtgtcccgacggagaacatatcctcaccgcaacctgcgcccctcgcctgagagtaaacaatggctacaagatatggcactacacgggcagtatcctccataagtatgacgtcccaagcaacgcggagctatggcaagtgtcgtggcaaccattcctggatgggatctttcccgccaaaactatcacttaccaggccgtcccatctgaggtgcccaatgaggaaccgaaggtagccaccgcctacaggcctcctgccctgcgcaataaaccaataacgaattctaagttgcacgaggaagagcccccccagaatatgaagccacagtctgggaacgacaagcctctgtcaaagacggccctcaagaaccagcgaaaacatgaagctaagaaggctgccaaacaggaggcacgtagtgataagtcacctgacttagcccccacacctgctccacagtccacccccaggaataccgtgagtcagtccatctcaggcgatcccgagattgacaagaagattaagaacctgaagaagaaactgaaggctatcgagcagctgaaggaacaagcagcaaccggcaaacagctagaaaagaatcagctggagaaaatccagaaggaaacggcactattgcaagaacttgaggatttagaactgggtatttag

SEQ ID NO: 116260 - DNA, 1893 bp, Artificial Sequence
  Description of Artificial Sequence: Synthetic coding sequence
atgcagggcggcaacagcggggtgcgaaaaagagaagaagagggagatggcgccggcgccgtggctgctcctccagctatcgactttcctgcagaaggtcctgatccagaatacgacgaaagtgacgtacctgcggaaattcaggtgctcaaagagccgctgcaacagcctacattcccctttgcagtcgcaaaccaactgctgctggtgtccctgctggagcatctgagtcacgttcacgaacccaacccgcttaggtcacgccaggtgttcaagctgctgtgtcagacatttattaagatgggtctactgtcttcgtttacgtgttctgacgaattctcctcgcttcggctgcaccacaatcgtgctatcactcatttgatgcgaagcgccaaggagagagtgcgtcaggatccatgtgaggatatttcacggattcagaagatacggagccgagaagtggctctggaagcacaaacatccagatacctgaacgaatttgaagagctcgcgatcctggggaaaggaggatacggtagagtgtataaggtgagaaataagttggatggacagtattacgcgatcaagaaaattctcatcaaaggggccactaagaccgtgtgtatgaaggtcctcagggaagtaaaggtccttgccggcttacagcatcccaatatcgtgggctaccacactgcttggatcgagcacgtacacgtgattcagccccgcgccgatagagctgctatcgaacttccgtccctggaagtcctgagcgatcaagaagaggacagagagcagtgtggggtgaagaatgatgagtcttcatcttcctcgatcatatttgctgagcccacacccgagaaagagaagaggttcggagaatctgacaccgaaaaccagaacaacaaaagcgtgaagtacacgaccaacctcgtaatcagggaatcgggggaactggagagtacgctagaactccaggaaaatgggctcgcaggattaagtgcatcctctatcgtggagcagcaactgccgctcaggaggaattcccaccttgaggagtccttcactagtacagaggagtctagtgaggagaacgtgaactttctcgggcagacagaggctcagtaccacttaatgctccatattcagatgcagctatgcgagctctccctgtgggattggattgttgagcggaataaacgcggacgcgaatatgtcgacgaaagtgcttgtccctacgtgatggccaatgtggctactaagattttccaggaactggtggagggagtgttctatatccacaatatgggcatcgtccaccgggatctcaaacctcggaacatcttcttgcatgggcctgatcagcaggtcaaaattggggactttggcctcgcctgtaccgacatccttcagaaaaacaccgattggaccaatcggaacggaaaacggacacctacccacacctctagggtggggacgtgcctttatgcctctcccgagcaactggagggctccgaatacgatgcgaagtctgatatgtactcgctgggtgtggtgctgctggaactcttccagccgtttggtacagaaatggaacgcgccgaagttttgaccggcctgaggaccggtcagctacctgaatctctaaggaagcgctgccccgtgcaggccaagtacattcagcacttgactagacggaactcaagtcagcgaccctccgctattcagctgctgcagagcgaactttttcagaattccggaaacgtgaacttgactctgcagatgaagattattgagcaggaaaaggaaatcgccgagctcaaaaagcaactgaacctgttgtctcaagataaaggagtccgagacgatggcaaggatggcggtgtgggctag

SEQ ID NO: 116261 - DNA, 1734 bp, Artificial Sequence
  Description of Artificial Sequence: Synthetic coding sequence
atgaatcagacccacttcgtgcaagataggtgtctcagcgatccatgcgaggacatctctcgtatccagaagatccgcagccgtgaggttgcacttgaagcacagacaagcagatacctcaacgagttcgaggagctggccatcttgggtaaggggggatacggtcgagtttacaaggtacggaataagttggatgggcaatactacgccatcaagaaaatactcattaaaggagccacaaaaactgtgtgcatgaaggtgctccgggaggtgaaggtcctggctgggttacaacatcccaacatcgtcgggtaccacaccgcctggattgagcatgtccacgttatccagccaagggcagatcgggccgcaatcgaactaccaagcctcgaagtactgtccgatcaagaagaggacagggagcagtgcggggtgaagaacgacgagtccagctcttcttccatcatttttgccgagcccacaccagagaaagaaaagagattcggtgagagcgacacagagaaccagaacaacaagtctgtgaagtacacaactaatctcgtgatccgcgagtccggggagctggagagcactttggagcttcaggagaatggcttagctgggctgtctgcgtcttcaattgttgagcagcagctgcccctgcggcgcaatagtcacctggaggagagcttcacgagcacagaagagagcagtgaggaaaacgtgaatttccttggccagaccgaggcgcagtaccacctgatgcttcacattcagatgcaattgtgcgaactatcgctatgggactggatcgtggagaggaacaaacggggtagagaatatgttgacgagagtgcttgcccatatgtgatggctaatgtggccacaaagattttccaggagctggtggagggagttttctacatccataatatgggtatagtgcaccgggatctgaaacccaggaatatctttcttcacggtcctgatcagcaagtaaagattggcgactttggccttgcatgcactgatatactgcagaagaataccgactggaccaatcgaaacggtaaaagaacacctacacatacttctcgcgtgggaacttgtttgtatgctagtccagaacagctagagggttccgaatatgatgctaagagcgacatgtatagtctgggcgtcgtactgcttgagttgtttcagccattcggaacggaaatggagcgggctgaagtgctgacaggcttacgcaccgggcagcttccagaaagtctgcggaaaaggtgccctgtgcaagctaagtacattcagcatctgaccaggaggaactccagccagcgccccagcgcaattcaattgttgcagagtgagctgtttcagaacagtggaaacgtgaatctgaccctccagatgaagatcatcgagcaggaaaaggagatcgctgaactgaagaagcagcttaatctgctcagtcaggataaaggcttttccgtgatccccaagcctcatccttgtaaagccctgtacagcgctccgcagatgatatcccggcagttacgttccttgagctgtctctgtccagcactctttcctgggacctcgagctttattgtggccttatcatcaccggccaacctgtacataccacagagacagcggtcagatgaactcgtctttgaaagccagaagggctctgccatggagttagccgttattaccgtcgacggtgtatag

SEQ ID NO: 116262 - DNA, 3351 bp, Artificial Sequence
  Description of Artificial Sequence: Synthetic coding sequence
atggaacgggccataagtcctggtctgctggtgcgtgccttactgcttctcttactgttgctcggactcgcagcaagaaccgtcgccgccggtcgagctcggggcctgccagccccaaccgctgaagccgcattcggtctcggtgctgcggccgcccccacaagtgccacaagagttcctgcggcaggagccgtagctgccgccgaggtaaccgttgaggacgccgaagcccttccggcagccgccggagaacaggaacctcggggcccagaacctgacgacgaaactgagctacgtccgcgggggcgctcactggtgataattagcactctggacgggcgaatcgccgccctggatcccgaaaatcatgggaagaaacagtgggacctggatgtgggaagcggatccctggtatcatctagtctgtccaaacccgaagtgttcggtaacaagatgatcattccctcactggatggagccctgtttcaatgggaccaggatagggaatcaatggaaaccgtccccttcacagtcgagtccttgctcgaatccagttataagttcggtgatgacgtggtactggtcggtggcaagtctttaacaacatacgggttgtctgcatactccgggaaagtgagatacatttgctccgcattaggttgcaggcagtgggactctgacgagatggagcaggaagaagatatcctcctactgcagcgcacccagaagaccgttcgcgccgtgggcccccggtctggtaacgaaaagtggaactttagtgtcggtcatttcgagctgagatacattcccgatatggaaacacgcgcgggattcatcgaatccacttttaagcctaacgagaacacagaagaaagtaagattatctccgatgtagaggagcaggaagccgctatcatggacatcgtaataaaagtgtcggtggcagactggaaggtgatggcatttagtaagaagggcggccatctcgaatgggagtatcagttttgtacccccatcgcgtctgcctggcttctgaaagacgggaaggttattccaataagtctattcgacgacacaagttacacaagcaatgacgacgtcctggaagatgaagaggacatcgtagaagccgctaggggcgcgactgagaattccgtgtacctaggaatgtacagagggcagctctacctacagtccagtgtcagaatttctgagaagttcccatcctcccctaaagccctcgaatctgtgaccaacgaaaatgcaatcattccacttcccacaattaagtggaaacctctcatccactcccccagcaggactcccgtcttggtcggtagcgacgaatttgacaagtgtctctcgaacgacaagttttcccacgaggaatactcaaacggagccctatccatcttgcagtacccttacgataatggatattatctcccctattacaagagggaaagaaataaaagaagtacccagatcacggttaggttcctagataatcctcattacaataagaacatccggaagaaggacccagtgctgctgctacactggtggaaggagatagtagcaacgatcctcttctgcatcattgcaactactttcatagtgagaagattattccaccctcacccccatcgtcagcgcaaggaaagtgagacacaatgccagacggaaaataagtatgactcggtgagtggtgaagcaaatgactcttcctggaacgacatcaagaactcgggctatattagccgctatctgacagatttcgagccgatccagtgtctcggcaggggaggctttggcgtggtctttgaagctaagaacaaagtcgacgattgcaactacgctatcaaaagaattcggcttccgaacagagagctggcccgggagaaagtcatgagagaagtcaaagcactggctaagctggaacaccccgggatagttcgctactttaacgcttggttagaagccccccccgagaaatggcaggaaaagatggacgaaatctggctgaaagacgaatcgacagattggcctctgagtagcccatcacccatggatgccccctctgttaagatccgccgtatggacccgtttgcgaccaaagagcacattgaaatcattgcgccatcaccacagcgaagccgttcgttttccgtcgggatttcttgtgaccagactagctcaagtgaatcacagttcagtcctctggagtttagtgggatggaccatgaggacatctctgaatccgtagatgcagcctacaatctgcaagactcctgtttgactgactgcgacgtggaagacggaactatggatgggaatgatgagggccattctttcgaactgtgtcccagcgaggcatcgccatatgtgcgttctcgagaacgtacctccagctcaatcgtcttcgaagactcagggtgcgataacgcttcttcaaaggaagaaccgaaaacaaatagactccatatcggcaatcattgtgctaacaagttgacggcgttcaagcctactagttcaaagtcaagcagcgaagccaccctatctattagtccccccagaccaactactctgtcactcgatttgactaaaaataccacagagaagctgcagccttcttctccgaaagtttacctctacattcagatgcagctttgtcgtaaggaaaatttgaaagactggatgaatgggcgctgcactattgaagaaagagaaaggtcagtgtgcctgcacattttcctgcagattgctgaagctgtggaattcctccacagcaagggcttgatgcatagggacttgaaaccaagcaatatattcttcacaatggatgatgtagtgaaagtgggcgactttgggctggtgacggctatggaccaggacgaggaggagcagacggttctaacccccatgccagcttatgcacgccacactggacaggtgggcactaaattatacatgagtccggaacagattcacgggaactcctattcccacaaggtcgatattttttcactcggcctgatcctgtttgagcttctatatccttttagtacacaaatggaaagggtgagaactcttaccgacgttcggaatctaaagtttcctccattgttcacccagaagtacccatgcgagtatgtcatggttcaggatatgctttctccgagtcctatggaacgccctgaggctatcaatattatagaaaacgccgtgtttgaggacttagattttccaggcaagaccgtgctccggcaaagaagccgtagtctctcaagttctggaacaaagcactccagacagagcaataattctcactccccactgcctagcaattag

SEQ ID NO: 116263 - DNA, 2898 bp, Artificial Sequence
  Description of Artificial Sequence: Synthetic coding sequence
atgattatcccttcgctagatggggctctgtttcagtgggatcaggatcgcgagagcatggaaaccgtcccattcacggtggagtcactgctggaaagctcttataagtttggcgacgatgtggtcctggtcggaggcaagtcactgacaacctatggtctgtctgcctattcaggcaaagtgcgctatatctgctctgccttagggtgcagacagtgggactccgacgaaatggagcaagaagaagatattctgctcctgcagcgaacacagaaaacagtgagagccgtcggacccaggtccggcaacgagaagtggaacttctcagtgggccacttcgagctccgttatattcccgatatggagaccagggcgggtttcatcgaaagcactttcaagcctaatgaaaatactgaggaaagcaaaatcatctcagacgttgaagaacaagaagccgccatcatggatattgtaataaaggtgtccgtggctgattggaaggtgatggctttctccaaaaaggggggccacctcgagtgggagtatcagttctgcacgcctatcgcatcggcctggcttctcaaagatggtaaggtgatacctatatccctttttgacgataccagctacacatccaatgacgatgtactggaggatgaggaggacatagtcgaagccgcccggggagccaccgagaattccgtgtacctgggcatgtataggggccaattgtacctgcaatcatctgtccggatctcggaaaagttcccctcctctcccaaagccctggagtccgtgactaacgaaaatgcaatcatcccactgccaacaatcaagtggaaaccactgatacattccccatccagaactccagtcttggtaggctctgatgaatttgacaagtgcttgtccaatgataagttttcacacgaggaatactccaacggggcactgtcaattttgcagtatccatatgacaatgggtattacctcccttattacaaacgagagagaaataagagatctactcagattactgtccgttttctggataatcctcactacaacaaaaacatcagaaaaaaggatcccgtgctgctgctacattggtggaaggaaatagtagccaccattctgttttgcataatcgctaccacattcatcgtaaggcggctgtttcatccccatccccaccggcagaggaaagaatccgaaacacagtgccagaccgaaaacaaatacgatagcgtttccggcgaagctaacgattccagctggaatgacatcaaaaacagcggttacatctctaggtacttgacagatttcgaacccatccagtgcctcggtcgcggcggcttcggggtggtgtttgaggctaaaaacaaagttgatgactgtaactatgccattaaaaggattaggctcccgaacagggagctggccagggaaaaagttatgcgggaggtgaaagccctcgcgaaattagagcaccccgggatcgtcaggtatttcaacgcatggctcgaggccccgccagagaagtggcaggagaaaatggacgagatctggctaaaagatgagagcactgactggcctttgtcctcaccttccccaatggatgcaccatcagtcaagatcaggcgcatggacccctttgccaccaaggaacacattgaaattatcgctcccagccctcaaagatcacgtagctttagtgtcgggattagttgtgatcagaccagctcttcggaaagtcaattctctccccttgaattttcaggcatggatcacgaagatatctcggagtctgtagatgccgcctacaacctgcaggattcttgcctcacggactgcgatgtggaggacggaactatggatggtaatgacgagggccattctttcgaattatgcccctctgaggcttctccgtatgtgcggagccgcgagaggacctcttctagtattgttttcgaggattctgggtgtgataatgcttcatcaaaggaagagccaaagacaaatagattgcatatcggtaaccattgtgcgaataagctcacagcgttcaagcccacatcgtcaaagagctcctctgaggcaaccctgtcaattagcccgcccagacccaccaccctaagcctggatttaaccaagaacaccacagagaagcttcaaccaagttctcctaaggtctatctttatatacagatgcagctctgtcgaaaagaaaacctcaaggattggatgaatgggagatgcaccatagaggaaagggagagaagtgtgtgtcttcacatctttctacaaattgccgaggccgtggagtttctgcactctaaaggactcatgcacagggatctgaaacccagtaacattttcttcactatggatgacgtagtgaaggtaggagattttggactggtcacggccatggatcaagacgaggaggagcagacagtcttgacgcctatgcctgcttatgccaggcatacaggccaagtggggactaaactgtacatgtcccctgaacagattcacggtaattcttactcccataaggtggacattttctcactcggtctcatcctctttgaactactgtatcccttcagtacacaaatggaacgtgtcagaacccttacggacgtaaggaacttaaagttcccccccctgttcactcaaaagtacccatgcgaatatgtcatggtgcaggacatgttaagcccaagcccaatggagcggccagaggctattaacattatcgagaacgcggttttcgaagacttggacttcccgggcaagactgtccttcgccagcgtagtcgctccctcagcagcagcggaacaaagcactctcggcagtctaacaactcgcattctcctctgccctcaaactag

SEQ ID NO: 116264 - DNA, 1569 bp, Artificial Sequence
  Description of Artificial Sequence: Synthetic coding sequence
atggccgcagtggccgtcgctgtcagagaagatagcggctccggaatgaaggctgagctgcctcctggtccgggcgccgtgggtcgggaaatgaccaaggaggagaaactgcagctccgcaaggagaagaaacagcagaaaaagaaaagaaaggaggaaaagggcgcagaaccagagactgggtcggcagtctccgcagcacagtgccagggtccaacaagagagctgcccgagagcgggattcagttaggcacccctcgggagaaggtacctgccggcagatccaaggcagagctgagagctgaacggagggccaaacaggaagccgaacgcgccctgaagcaggcaagaaaaggtgaacagggcggtcctccccctaaggcgtctccatcaacagcaggggaaacgcctagcggagtgaagcgcctgcccgagtatccccaagtggatgatctccttcttcgccgcctggtgaagaagccggagcgccagcaggtgccaacacgcaaagattacgggagcaaggtgtccctgtttagccacttgcctcagtacagtagacagaactctctcacacagttcatgagcattccctcttctgtgatccatcccgccatggtgcgactggggctgcagtattcccagggcctggtgtccggctccaatgctaggtgtattgctctgctgagagcactgcagcaggtgatccaggactacacgacacctcccaacgaggagttgtcaagggacctcgtcaacaaattgaaaccatatatgtctttcttgacccagtgcagacccctcagtgccagtatgcacaacgctattaaattcttgaacaaagaaataacttcggtcggtagctccaagcgcgaagaggaggccaagtccgaactgagagctgcaattgatagatatgttcaagagaagattgttctggcggctcaggcgatctcacgtttcgcgtaccagaagatatcaaatggcgacgtgattctcgtctacggctgcagctctctggtgagtcgaatcctacaggaagcttggacagaggggaggcgcttccgcgtggtcgtcgtcgattcacgaccttggctcgaaggtcgccataccctgcgctctctggtccacgccggggtacccgcaagctacctactgatcccagccgcatcctacgtgctccccgaagtgagtaaagtcctgctgggtgcgcacgcccttttggccaatggaagcgtcatgtctcgagtaggcacggctcagctggctctcgtcgctagagcccataatgtgccagtcctcgtctgctgtgaaacttataagttctgcgaaagagtgcagaccgatgccttcgttagtaacgaactcgatgatcccgacgatctacagtgcaagcgtggcgaacatgtagcactggccaactggcagaatcacgccagccttcgactgcttaatcttgtgtatgatgtcacccctcctgagctagtggatctagtgattacggaattgggcatgatcccatgctctagtgttcctgtagttcttcgagtgaagagtagtgaccagtag

SEQ ID NO: 116265 - DNA, 1632 bp, Artificial Sequence
  Description of Artificial Sequence: Synthetic coding sequence
atgcctacccagcagcccgccgcgccaagtacccgcgctcccaaaccttccagatctctctccggatctctctgtgccctttttagcgatgccgattctggtagtggcatgaaagctgaactgccaccaggcccaggagcagtaggcagggagatgactaaagaggaaaagttgcagttgagaaaagagaagaagcagcagaagaaaaagcggaaggaggaaaagggcgctgagcccgagacgggcagcgctgttagtgccgcacagtgtcagggccccacacgggaactgccggaatcgggtatccagttaggtacacctcgggaaaaggtgcctgcaggccggagcaaagccgagttgagagccgaacgccgtgctaagcaggaagccgagagggccctcaagcaggcaagaaaaggagagcaagggggtcctccccctaaagcatcacctagtaccgcaggcgagaccccatcaggggtaaagaggctgcccgaataccctcaggtggatgacttattgttacgcagacttgtaaaaaaaccagaaaggcagcaggtaccaaccaggaaggattacggttccaaggttagtctgttctcccacctaccacagtacagtcgacagaattccctgacgcagttcatgtccatcccaagctccgtaatacatccggccatggtgcgacttggcctacagtattcccaaggccttgtgagtgggtcgaacgcccggtgcattgccctcctgagggcccttcaacaggttatacaggattatacaactccacctaatgaagaattgtcccgagacctggtcaacaaattgaaaccatatatgtcgttcttgacccagtgtagaccactatctgcttcaatgcataacgccattaagttcttgaataaagagatcacatcagtaggcagctcaaagagggaggaggaagcaaagtctgagctgcgagccgcaatcgatagatacgtgcaagagaagatcgtgcttgcggcccaggctatctcacggttcgcgtaccagaagatcagcaacggggacgtcatactggtgtacggctgctctagcctcgtatcccgcatacttcaggaggcctggactgaaggcaggcggttccgggtcgtggtcgtggactctcggccctggctggagggacgtcatacgctgagatcattggtgcacgccggagttcctgcatcatacctccttattcctgccgcctcatacgtgctacctgaggtttcgaaagtgctgctgggggcacacgccctgcttgcgaatgggtctgtcatgtcccgcgtaggcacagcacagttggctctggtggccagggcccacaacgtgcccgtgctagtgtgttgtgaaacatacaagttctgtgagcgggttcagacggatgcatttgtgtccaacgagcttgacgacccagacgatctgcagtgcaaaagaggcgagcacgtcgcccttgctaattggcagaatcacgcgagccttcgcctgctcaaccttgtttatgatgtcacaccacctgaactcgtagaccttgtcattactgaactgggcatgatcccttgtagctcggtacctgttgtattacgggtcaaatcctccgaccagtag

SEQ ID NO: 116266 - DNA, 918 bp, Artificial Sequence
  Description of Artificial Sequence: Synthetic coding sequence
atggacgataaggaattaattgagtattttaaatcccagatgaaagaggatcccgatatggccagtgctgtggccgccattcggacccttctggagttccttaaacgagacaaaggagaaactatccagggcctgcgtgctaacctgacttctgcaattgaaaccctttgcggcgtggattcttcagttgccgtctctagcgggggagaactttttctccgtttcatcagcttggcttcactggagtatagcgattattctaaatgcaagaagatcatgatagagcggggcgaactatttttgagaaggataagcttatccaggaataagatcgctgacctttgccatacgtttattaaggacggagccactattctgacccacgcatactcaagagtggtattgagggtccttgaggccgccgttgccgctaaaaaacgcttttccgtgtatgtcactgaatcacaacccgacctgagtggtaagaaaatggcaaaagccctgtgtcacttgaacgtgcccgttactgtggtcctagatgctgctgtgggttatatcatggagaaggccgatctcgttatcgtgggggctgagggagtggtggagaatggtggcataattaacaagatcggcaccaatcagatggcagtgtgcgctaaagcacagaacaagccattctatgtggtggctgagtcctttaagtttgtgagactatttcccctgaaccagcaggatgtccccgacaaatttaagtacaaagctgacactttgaaagtcgctcagaccggacaagatctgaaagaggagcatccatgggtagactacaccgctccttccctcataacgctgctatttaccgatttgggagtgcttacgccaagcgcagttagcgatgagctgattaagctgtatttatag

SEQ ID NO: 116267 - DNA, 1056 bp, Artificial Sequence
  Description of Artificial Sequence: Synthetic coding sequence
atgcctgggtccgccgctaaaggctccgagttaagcgagaggatcgagagcttcgtggagaccctaaaaagagggggcgggccgcgaagctcagaggagatggccagagagaccctcggactgctacggcaaattattacggaccacaggtggtctaatgctggagagttaatggagctgatccgcagggagggtagacgcatgacagctgcacaaccatctgagaccaccgtgggcaatatggtcagacgagtcttgaagatcatccgtgaggagtacggtcggttacatggccggtcggacgagtctgatcagcaagagtcccttcacaagctgctcacctcaggtgggcttaatgaagacttctcctttcactatgcgcagctacagtctaacatcattgaagccattaatgagctgctcgtcgaactcgaagggaccatggaaaatattgctgcccaggcccttgaacacatccactctaatgaagtgatcatgactatcgggttttctaggacagttgaggcattcctgaaggaggcagcacgcaaaaggaagttccacgtgatcgtcgccgaatgcgctcccttctgccagggccacgagatggcagttaacctctcaaaggccggcatcgagacaactgtgatgaccgacgcagcgatctttgcagtcatgtcccgcgtgaacaaggttatcattggaaccaaaacaatattagcgaacggagcgctgcgggccgtgaccgggacgcatactctcgcattagccgcgaagcaccattctacccccctaatagtgtgcgcaccaatgttcaagctgtcccctcaatttccaaacgaggaggatagtttccataagtttgttgctccggaagaagtgcttccgttcacagagggggatatcctagaaaaggtgagcgttcactgcccggtattcgactatgtcccgccagaactgatcactctcttcattagtaatattgggggcaatgccccaagttatatatacaggctcatgtccgaactctatcatccagacgaccatgttctgtag

SEQ ID NO: 116268 - DNA, 1359 bp, Artificial Sequence
  Description of Artificial Sequence: Synthetic coding sequence
atggagttccaggcagtcgtaatggcggtgggaggcgggtctagaatgaccgatctcacctcatcaatcccaaaacctctgttgcctgtaggcaacaaacctcttatctggtatccactcaacctgctggagcgcgtgggctttgaggaggtgatcgtggtgaccaccagagacgtgcagaaagcactttgcgccgagtttaaaatgaagatgaagcctgacattgtctgtattcccgacgatgccgatatgggaactgctgactctctcagatacatctatccgaagctgaagaccgacgttcttgtccttagctgcgacctaatcacagatgtagcactgcacgaggttgtcgacctttttagagcctacgatgccagtctcgcgatgttaatgcgcaagggccaggacagcatcgagcccgtcccaggccaaaaagggaaaaagaaagcagttgagcagagggacttcattggggtggactccaccggaaaacgcctccttttcatggcaaacgaggccgacctcgacgaagagcttgttatcaaaggctctatcctccagaagcaccccaggatcaggttccacaccggcttggttgacgctcacctttactgtctgaagaaatacattgttgacttcttaatggaaaacgggtcaattacaagcattcgatctgagctgattccctatctggtcagaaagcaattctctagcgcgagctcacagcagggtcaagaggagaaggaggaggatttgaaaaagaaagagctgaagagcctcgatatctactcatttatcaaagaagctaataccctgaatttggcaccttatgatgcctgttggaatgcgtgtcgcggggatagatgggaagacctgtcccgcagtcaggtgcgatgctatgtgcacattatgaaggaaggactgtgtagtagagtgtccaccttgggattatacatggaagcgaataggcaggtgcccaaactactgtctgccctgtgtcccgaagaaccacccgtccattccagtgcacagatagtatctaaacaccttgtgggagtggactctctgatcggccctgagactcaaattggcgaaaagtcgtcaattaaacggtctgtgatcggaagctcttgtttgataaaggaccgagtgactatcaccaactgtctgttgatgaattccgtcaccgttgaagaaggctcaaacatccagggctcagtcatctgcaataacgccgtaatcgagaagggcgccgacatcaaggactgtttaatcggctccggccaacgcatagaagccaaagcaaagagagttaacgaagtcatcgttggcaacgaccagttgatggagatctag

SEQ ID NO: 116269 - DNA, 594 bp, Artificial Sequence
  Description of Artificial Sequence: Synthetic coding sequence
atggagtttcaggcggttgtcatggccgtgggcggaggatcacggatgactgatctgacaagtagcatccctaaacctctactgcctgtgggtaataagccactgatttggtatccgctgaatcttttggagagagtcggatttgaagaagtgatcgtggtcacaactagggatgtccagaaagctctctgcgcagaatttaaaatgaagatgaaacctgatatcgtatgcattccggacgacgcggatatgggcaccgcagacagcttacgttacatctatccaaaactgaagacggacgtcctggtcttgtcctgcgacctcatcacagacgttgccttacacgaagtcgtcgatctgtttcgagcctacgacgcctcgctcgctatgctcatgagaaaagggcaggattccattgagcccgtccccggacagaaaggaaagaagaaagcagatggagattctctttgctgccaggccggggtgcaatggcaccacctgggatccttacagagcccacctccaggatttaagcacttcacatgtctgtctcttccctcctcttgggattacatgcatatgcccccgcactag

SEQ ID NO: 116270 - DNA, 1239 bp, Artificial Sequence
  Description of Artificial Sequence: Synthetic coding sequence
atggagttccaggctgtagttatggccgtcggcggggggagtcgaatgacagatctgacttccagcatccccaaaccacttctgccagtcggcaataaacccctcatctggtatccactgaatctcctggagcgagtcggttttgaggaggtgattgtcgtgacaacgcgcgacgtgcagaaggctctgtgtgcagaattcaagatgaagatgaaaccagacatcgtttgcattcccgacgacgccgacatgggcaccgctgactcactgcgttacatctacccaaaactgaagacagacgtcctggtgctgtcgtgcgaccttataacagatgtggccctccacgaggtagtggatctgttccgggcctacgacgcctccctcgctatgctgatgaggaagggccaggattcgatcgaaccagtgccggggcaaaaaggaaagaagaaggcagtggagcagagagattttataggagtcgactcaactggaaaacgtctgctgttcatggcaaacgaggccgatcttgacgaggagttagtgatcaaagggtctattttgcaaaagcacccgagaattaggttccatactgggctcgtagatgcccacctgtactgcttgaaaaagtatatcgtcgactttttgatggaaaacggctctataacgagcattcgctcggagctgatcccttatctcgtgcgtaaacagttctcatccgctagctctcagcaagggcaggaggagaaggaggaggatctgaagaagaaggaactgaagagtctggacatttattcctttattaaggaagctaacacgcttaacctggctccttatgacgcatgttggaacgcctgccgaggagacaggtgggaggatttgagcaggagccaggtcaggtgctacgtccacataatgaaggaaggactctgttccagagtgagcacattggggctctatatggaggccaatcggcaggtgccaaaacttcttagtgcattgtgccccgaagaacctcctgtccatagctccgcccaaattgtgagcaagcatctcgtgggcgtggacagtctgatagggcctgagacccaaatcggcgaaaaaagttcaatcaaaagaagcgtaatcgggtctagctgtctgatcaaagaccgagtcaccattaccaactgtctccttatgaattccgtgactgtagaagaaggctacgtgtctccctgtacccatctaaggcagagatag

SEQ ID NO: 116271 - DNA, 669 bp, Artificial Sequence
  Description of Artificial Sequence: Synthetic coding sequence
tgagtgatcaaaggttcaatcctccaaaagcacccaagaattcggttccacaccgggctggttgatgcccacctgtactgcctcaagaagtatatcgtggatttcctgatggagaatgggagcatcacaagcatccggtctgagctaatcccttacctggtccggaaacagttctcttcagcttcgtcccagcaggggcaggaggaaaaggaggaagaccttaagaagaaggagctgaaatctctcgacatatactcattcatcaaggaggcaaatacacttaacctggcaccctacgatgcttgctggaacgcctgtagaggtgatcgctgggaggacctctccagatctcaagttaggtgctatgtgcatatcatgaaagaggggctttgcagtcgtgtctctactctggggctgtacatggaggcaaacaggcaggtccccaaactgctgtccgcactgtgtccagaggaaccacctgtccatagttcggcccaaattgtctccaagcatcttgtgggagtggactccttgatcgggcctgagacccagatcggcgaaaaatcctccattaaaagatctgttattgggtccagctgccttatcaaggacagagtgactatcaccaactgcctcttaatgaattcggtgaccgtggaggaagggtag

SEQ ID NO: 116272 - DNA, 1572 bp, Artificial Sequence
  Description of Artificial Sequence: Synthetic coding sequence
atggcagccgtggcagtggccgtacgggaagatagtggatccggcatgaaagccgaactcccccctgggcccggggcagtggggagggaaatgacaaaagaggagaagttacaactcagaaaagaaaaaaaacaacaaaagaagaaacgtaaagaggagaagggcgccgaacctgagaccgggagtgctgtgagtgccgctcagtgtcaggtggggcccactagggaactgcctgagtccggcattcagttaggtactccgcgagagaaagtgccggccggcagatccaaggctgagctgcgggccgagagaagagccaaacaagaggccgagcgggcactcaagcaggctagaaagggggagcaagggggtccccctcccaaagcaagccccagtaccgcaggcgagacaccatccggcgtgaagcggttacccgaatatccgcaggtcgacgaccttctactgcgcagactggtcaaaaaaccagagcgacagcaagttcctacacgtaaagactatggcagtaaggtcagcctgttctcgcatcttcctcagtattctagacaaaatagcctgacacaattcatgtctatccccagttccgtgatacatcccgccatggtgagactggggttgcagtacagtcaagggttagtgtccggaagcaacgcacgatgcattgctttactccgtgcattgcagcaggtgatacaggattacactaccccacctaacgaggagttgtccagggatctcgtcaataagctgaaaccctacatgtctttcctgacccaatgccgccccttgtctgcaagcatgcacaatgccattaagtttctgaataaggagattacgagtgtcggtagcagtaaacgcgaagaggaagccaagtccgaactgagagcagcaatcgaccgctacgtacaggaaaaaatcgttctggccgcacaggccatttctcgatttgcttaccagaagattagtaacggagatgtcatcttggtttacggatgctcttccttggtgagcagaattctgcaggaggcatggaccgagggcagaaggtttagagtggttgtggtggattcaagaccatggttagaggggcggcatacactcagatctctggtgcacgccggcgtgccagccagctatttattgattcctgccgcgtcatacgttctccccgaggtcagtaaagtcttgctcggcgcccacgcccttttggccaatggaagtgttatgagtcgcgtgggcactgctcagttggccttggtggcaagggctcataacgtccccgtgctcgtctgttgcgagacatacaaattttgcgagcgagtgcagacagatgctttcgtcagtaatgaactggatgatcctgacgacctgcagtgcaaaaggggagaacatgttgctttggccaattggcaaaaccacgcatcattgcggcttctcaacttggtgtacgatgtaacccctcctgaactggtggacttggtaatcaccgagctcggcatgatcccctgtagttccgtacccgtggtattgcgcgtgaaatctagcgaccagtag

SEQ ID NO: 116273 - DNA, 1563 bp, Artificial Sequence
  Description of Artificial Sequence: Synthetic coding sequence
atggctgctgtcgctgtggccgtccgagaggattctgggagtgggatgaaagccgaaagcccttgggcatgggtgggccgagagatgactaaggaagagaaacttcagctccgaaaggagaagaagcagcagaagaaaaagcggaaggaagagaaaggtgctgaacctgaaacgggatccgccgtgtccgcagcacagtgccagggtcctacccgagaattgccagagtctggtatccagctggggacacctagggagaaagtgcctgctgggcggtccaaggccgaactcagagctgaacgccgtgcgaagcaagaagccgagcgggccttgaaacaagcaaggaagggggagcagggggggccacctcctaaagcttccccttcaacagccggggagacccctagcggcgttaagcgtctcccagaatatccccaggtggatgatctccttcttcgcagattagtgaagaaacctgaacgacagcaggtgcccacgcgcaaggattacggatccaaggtctctctgttttctcacctgccacaatactcacgccagaattccctgacacagttcatgtccataccctcttctgtcatacaccccgcaatggttcgcctcggactgcagtactctcagggactagtgtctggctcaaatgctcgttgtattgccttgctcagggctctgcagcaagtaatccaggattatacaactccacccaacgaggagcttagcagggatctggttaacaaattgaagccatatatgtccttcctgacacaatgccgtcccctgagcgcttcaatgcataatgcgattaagttcctcaataaagaaatcaccagcgtggggtcgagcaaacgggaggaggaggctaagagcgagctgagagccgctatagaccggtatgtgcaggagaagattgtgttggcggcccaggcaatctcacgctttgcttaccaaaaaatatcgaacggcgacgtcatcctggtatatggatgctctagtttagtgagtaggatcttacaggaggcatggaccgagggtagaagatttcgcgttgtcgtcgtggactccaggccttggctcgagggcagacataccttaagatcactggtccacgccggagtacctgcatcataccttcttatccctgccgcatcctatgtcctgccagaggtgagtaaggtgctcttaggcgctcatgcgcttctcgccaatggctctgtgatgtcccgcgtggggaccgctcagctggccctggtggcccgagcgcacaatgtgcccgttctggtgtgctgtgaaacatacaaattctgcgaaagggtccagactgacgcctttgtgtctaatgagctcgacgatccagacgacttacagtgtaaacgcggcgaacacgtggccttagccaattggcagaatcacgcctctctccggctgcttaacctggtgtatgacgtgactccacccgagctcgtagatctggtcatcacggaactgggcatgattccatgttctagcgtaccagtggtgctcagagttaagtcatccgaccagtag

SEQ ID NO: 116274 - DNA, 2166 bp, Artificial Sequence
  Description of Artificial Sequence: Synthetic coding sequence
atggctgctccggtggtagcgccgcctggagtcgtagtgagccgggccaataaaaggagcggagccggccccggcggaagtggcggtgggggggctcggggggctgaggaagagcctcctccccccctgcaagctgttttggtggctgactcattcgatcgtcgattttttcccatctctaaggatcagccgcgcgtccttctaccgcttgccaacgtcgccctgattgattacacgctcgaatttctgaccgccacaggagttcaggagacgtttgtcttctgctgttggaaggccgcgcagatcaaggagcacctgctgaagagtaagtggtgtagacctacaagccttaatgtcgtgcgaataatcacctctgaactttaccggagtctgggagacgtgctgagagatgtggatgccaaggcactggtgcggtcagactttttattagtttatggggacgtgatctcgaatattaatataacccgtgcattagaggaacaccggttgcggcgaaagctagagaagaatgtttccgtaatgacgatgatcttcaaggagagctcccctagccacccgacaagatgccacgaggacaatgtcgttgtcgccgtggactccaccacaaacagagtgttgcacttccagaagacacagggactgcggagattcgccttccctctgagcctgttccaaggatcctcggatggcgtcgaggtaagatacgatctccttgattgtcatatctctatctgctccccccaggtggcccaactttttactgataactttgactatcagactagggacgatttcgtcagaggactgttagtcaacgaagaaatcctgggcaaccagatccatatgcacgtgacagccaaagaatatggggcacgagtgtccaaccttcatatgtacagcgcagtgtgtgcggacgtgatacggagatgggtatatccactcactcccgaggcaaactttactgacagcacaacacagtcttgcacccattctcggcataacatttatcgaggtcccgaagtcagcctggggcacggtagcatcttggaggaaaacgtgttgctcgggtccggcaccgtcatcggctcaaactgcttcatcacaaattctgtgatcggccccggatgccacatcggcgacaatgtggtccttgatcagacatatctgtggcaaggagtccgggtggccgcaggcgctcagattcaccagtcactgctttgtgataacgccgaagtgaaggagagagttacactcaaaccacggagcgttctcacctctcaggtggttgtcggtcctaacattaccctacccgaaggctctgtcatttcgctccaccccccggacgccgaggaagatgaggatgatggggagtttagtgatgatagcggcgccgaccaagagaaagataaggtaaaaatgaaagggtacaatcctgccgaagtaggagcagcaggaaaagggtacctttggaaggccgcaggcatgaacatggaggaagaggaagagttacagcagaacctctgggggcttaagataaacatggaagaggaaagtgagtcggaatccgagcaatccatggactccgaggaacctgacagtcgcgggggctccccacagatggatgacataaaagtgttccagaacgaggtgctgggaaccctgcaacgcgggaaagaagagaatatcagctgcgacaatctggtactggagatcaactcactgaaatacgcatataatatttccttaaaagaggtgatgcaggtcctttctcatgtggtactggagtttcccctacaacagatggactcgcccctggacagctctcggtactgcgccctgctgttgcccctgctcaaagcctggtcgccggtctttcggaactatatcaaacgcgctgccgaccacctcgaggccttagcagctatcgaggactttttccttgagcatgaggccctcggaatttcaatggcgaaggtcctgatggcgttttaccaactggagatcctggccgaggaaaccatcctctcgtggttttctcaaagggataccacagataaggggcagcagcttcgcaagaatcagcaactccagcgcttcatccagtggctgaaagaggccgaggaggagtcatcagaggacgattag

SEQ ID NO: 116275 - DNA, 1014 bp, Artificial Sequence
  Description of Artificial Sequence: Synthetic coding sequence
cccccccagccttcgaaaatgctggggctgcaggttgcacagctttttacagataactttgactaccagacacgagacgacttcgtcagagggcttctggtgaacgaggaaatcctcgggaatcagatccatatgcacgtgaccgccaaggagtacggtgctcgcgtgagtaacttacatatgtactccgccgtatgtgccgacgtgattaggcgttgggtttaccccctgaccccggaggctaacttcaccgacagcacaactcagtcgtgcacccacagcagacataacatctatcgcggtccagaggtgtccctcggacatgggagtattttggaggagaacgttctgttggggtcggggacagtcatcgggtcaaactgctttatcacaaatagcgtgatcggaccaggatgtcatataggcgacaacgtggtcctcgaccaaacatacctctggcagggggtccgtgtggcagcgggtgcgcagattcaccaatctctgctatgcgacaatgccgaagttaaggagagagtcactctaaaacctcgttccgtcttgacatctcaagtggtggtgggccctaatataaccttgcctgagggatccgtcattagtctgcatccccccgacgcggaagaggacgaggacgacggcgagttcagcgatgactccggcgcagaccaggagaaggacaaggtgaaaatgaagggttacaaccctgccgaagtaggcgctgcgggaaagggatatctctggaaggcggcagggatgaatatggaagaggaggaagagctccagcagaatctttgggggttaaagattaacatggaggaagaatcggaatctgaatcagagcaatccatggactcagaagagcctgacagccgaggcggtagcccacagatggacgacatcaaggtgtttcagaacgaagtgctgggaaccctgcaaaggggcaaagaagaaaatatttcctgtgacaacctcgtgctggagataaactcgttgtag

SEQ ID NO: 116276 - DNA, 2574 bp, Artificial Sequence
  Description of Artificial Sequence: Synthetic coding sequence
atggaagctggcccatctggagctgctgcaggggcatacctcccgcccctccagcaggtgttccaggcaccccgcaggcccgggattggcacagtggggaagcctatcaaactcctggccaactattttgaggtggatattccaaaaatagatgtataccattacgaggtggatattaaacccgacaaatgccctaggcgggtcaatagagaggtggtggagtacatggtgcaacatttcaagccccaaatcttcggggacaggaaaccagtgtatgacggcaagaaaaacatctacaccgtgacggcactcccaattggaaacgagcgcgtggactttgaggtgacgatccccggcgagggaaaggatagaattttcaaggtaagtatcaagtggttagctatagtttcttggcgcatgctgcatgaagcactggtcagcggtcagattcctgtcccactcgagtctgtccaggcccttgacgtggccatgaggcatctcgcttccatgagatatacacccgtgggaagatcctttttctctcctcccgagggctattatcacccgctaggcggagggagagaagtttggttcgggttccaccagtccgttcgccctgccatgtggaaaatgatgctcaatatagacgtgtccgctacggctttctataaggcccagcctgtgatcgagtttatgtgcgaggtgctggacatcagaaatattgacgaacagcctaaaccccttacggattctcagagagttagatttaccaaagagatcaagggcctcaaagttgaggtaacccattgcggccagatgaagcggaagtaccgcgtctgcaatgtaaccaggagacctgcttctcaccagacatttccactccaattggagtctgggcaaacagtcgagtgtaccgtggcccagtattttaaacaaaagtacaatctgcaactcaagtatcctcacctgccctgcctgcaggtcggacaagaacagaaacatacctacctccctttagaggtgtgcaatatcgtcgctgggcagcggtgcattaagaagctgaccgataaccagacttcgactatgatcaaggcgactgctaggtctgccccagaccgccaggaggaaatcagtagattgatgaaaaatgcttcctacaatcttgatccttacattcaggagttcggtatcaaagtaaaggacgacatgaccgaagttaccggacgagtgctgcccgcccctattcttcagtacggtggccgaaacagagcaattgcgacacccaaccaaggcgtgtgggacatgagagggaagcagttttataacggtattgagatcaaggtatgggccattgcctgctttgcaccccagaaacagtgccgggaggaggtcttgaaaaacttcaccgatcagttgcgcaaaatcagtaaggatgcaggaatgccaatccaaggccagccctgtttctgcaaatatgcgcaaggagctgacagtgtggagccaatgtttcggcatttgaagaacacctacagcggacttcagctgataatcgttatcctgccaggaaaaactccagtgtacgccgaggttaaaagggtgggggacaccctgctggggatggcgacccagtgtgtgcaggtgaagaacgtagtcaaaacatccccgcagaccctgtctaatctctgtctgaagatcaatgtcaagcttggtggcataaataacattcttgtgccccaccagcggtccgctgtgttccagcagccagttattttcctgggagccgacgtcactcatccgccagcaggggatggcaaaaagccttcaataacagccgtagtggggagcatggacgcacatccgagcagatactgcgccactgtccgcgtccaacggccaaggcaggaaattatcgaagacctgagctacatggtgcgagagctcttgatccagttctacaagagtacccggtttaagcccacaaggatcatcttctatagagatggggtgccagagggccagctccctcagatcctgcattatgagctcctcgcaatccgagacgcctgtatcaagctggagaaagactatcagcccggcatcacatacattgtcgtgcaaaagaggcaccatacgcggctgttctgcgccgataagaatgagcgaattggtaagagcggaaacatccctgcagggaccaccgtcgacactaatatcacccaccctttcgagtttgacttttacctgtgttcccacgccggcatccagggtacatctagaccttcccactactacgtgctgtgggatgacaacaggttcacagctgacgaactgcaaatcctcacgtaccagttgtgccacacttacgtccgctgcacaaggtccgtgtcaatccccgcgcctgcgtactacgcgcgactcgtcgctttccgggcccgttatcacttggtggataaggaacatgacagcggggagggaagtcacatttctgggcagtctaacggccgtgacccacaggctttggcaaaggctgtccaggtgcatcaggataccctgcgtacaatgtactttgcttag

SEQ ID NO: 116277 - DNA, 2349 bp, Artificial Sequence
  Description of Artificial Sequence: Synthetic coding sequence
atggtacagcactttaaaccacagatattcggcgatcgcaagccagtctacgacggaaagaagaacatctatactgtcaccgcactgcccataggtaacgagcgtgtggacttcgaggttacaatccccggagagggaaaagacaggatcttcaaggtgagcattaagtggttagctattgtgagctggcggatgttacatgaagccctggttagtggacaaatacccgttcctctggagagcgttcaggccctggacgtcgcaatgcgccacctagcctcaatgcgttacacccctgtcggtaggagcttcttctctccccctgagggttactaccaccctctggggggtggaagggaggtatggtttggttttcatcaatctgtccgcccagccatgtggaaaatgatgcttaatatcgatgtctcggccactgcattctataaggctcagccagtgattgaattcatgtgtgaggtgctggatattaggaatattgacgaacagcccaaacccctgacagactcacagagggtcaggttcaccaaagagataaaggggctaaaagttgaggtgacacattgcggccagatgaagagaaaatatcgcgtgtgcaatgtcacccgtcggcctgccagccatcaaaccttcccgcttcaactcgaaagtggccaaacggtcgaatgcactgttgctcagtactttaagcagaagtacaatctgcagctgaagtacccccacttgccctgtttgcaggtcggtcaggaacagaaacacacctacctgcccctagaggtgtgtaacattgtggctggtcaacggtgcatcaagaaactgaccgacaaccagacgtcaaccatgattaaagccacagctaggtctgccccagacaggcaggaagagatttctcgattgatgaagaatgcatcctacaaccttgacccttacatccaagaattcggtatcaaggtgaaggatgacatgacagaggtgaccgggagggtcttacctgcgcctatccttcaatatggtggccgcaaccgagccattgccaccccaaatcagggtgtatgggatatgcgcggtaagcagttttacaacgggattgagataaaagtttgggcaatagcctgcttcgctccccagaagcagtgccgagaggaggtactaaagaatttcactgaccagctgaggaagatctccaaggatgcaggaatgcctatccaaggtcaaccctgcttctgcaaatacgctcagggagcagatagcgtggaacctatgtttcgccatctcaagaatacgtattccgggctgcagttgattattgttatactcccaggtaagactccggtctacgctgaagtgaagagagtcggagacactctgttgggcatggccacccagtgtgtgcaggtgaaaaatgtggtcaagacttccccccaaaccctgtctaacctgtgtctcaagattaacgtgaagctgggtggcatcaataatatcctggtgcctcaccagaggtccgcagtgttccagcagcccgtgatatttctgggggcagacgtgacacacccccccgccggggacgggaaaaagccaagcattacagccgtggtgggatctatggacgcccatcctagcagatattgcgcaaccgtacgtgtccaaaggcccagacaggagattatcgaggacctgtcatatatggtgcgggaacttctgatccagttttacaaaagcactagattcaagccaacacgcatcatcttctatagggacggtgtgcccgaaggccaattaccacaaattttacattacgagctcctagcaatccgcgacgcgtgtatcaagttagaaaaggactaccagccaggaatcacctacattgtggtacagaaacggcatcatacccgcctcttttgcgcggataaaaatgagagaattgggaagtccggcaatatccccgcaggtacgaccgttgacaccaatatcacccaccccttcgaattcgatttttatctgtgcagccatgcgggaatccaaggcacttccagaccgagccactactatgtcttgtgggacgataaccggtttaccgccgatgagctgcagatcctcacatatcaactgtgtcacacatacgtgcggtgcacccgtagcgtttcaatccccgcaccggcttattatgcaaggttggtggcattcagggctcgctaccatttagttgataaagaacacgacagcggagaaggtagccatatcagtggtcaatctaacgggagagaccctcaggctctggctaaggctgtgcaagttcaccaagacactctgaggaccatgtactttgcatag

SEQ ID NO: 116278 - DNA, 1254 bp, Artificial Sequence
  Description of Artificial Sequence: Synthetic coding sequence
atggaatttgtaaaatgccttgggcatccagaagagttctacaaccttgtgcgctttcgtataggggggaagcgtaaggtgatgccaaagatggaccaggactccctgtcttcatccttgaagacatgctacaagtacttgaaccagacctctcgctccttcgccgctgtaatacaggctcttgacggggaaatgcgcaacgccgtgtgcattttttacttagtgctgcgcgcgctggataccctagaggatgatatgactataagcgtggaaaaaaaagtacctctgctgcacaacttccactcctttctgtatcaacccgactggagatttatggagagtaaagagaaagatcggcaggtacttgaggacttccctaccatctccttagagttcaggaacctggccgagaagtatcaaacagtcatcgcagacatttgtcgcagaatggggataggcatggcggagtttctggacaagcacgtaacatcagaacaagagtgggataaatattgtcactatgtggcaggactagttggtatcggtttgtccagactgttctctgcatcagagttcgaagatccactggttggtgaagacacggaacgggcaaactccatgggactgtttctgcagaagacaaatataatccgggactatctcgaggatcagcagggcggacgagagttttggccccaggaggtgtggagccgttacgtgaaaaagctaggcgattttgctaagcctgaaaacattgatctggccgtccaatgcctgaatgagctcatcacaaacgccctacaccatatccccgacgttatcacatacctttccaggttgcgaaaccagtcagttttcaatttttgcgccatccctcaagtgatggctattgccaccctggctgcctgttacaataatcagcaggtgttcaaaggcgcagtgaaaatccgaaaggggcaggccgtgacgctgatgatggacgccaccaatatgcccgctgttaaagccattatctaccagtacatggaagagatctatcatcgcatacccgactcggatcctagcagctctaagactcggcagataataagcacaatcagaacacagaatctccccaattgccagttgatatcccggtctcactactctcctatctacctgagtttcgtgatgttactggctgccttaagttggcagtacctgacgaccttaagtcaggtgaccgaggactacgtgcagacaggcgagcactag

SEQ ID NO: 116279 - DNA, 2478 bp, Artificial Sequence
  Description of Artificial Sequence: Synthetic coding sequence
atgtacagcggcgccgggcctgctttagcaccaccggcccctccgccaccaatccagggctatgctttcaaacctcctccccggcccgatttcggcacgtctggaagaaccatcaaactgcaggcaaacttttttgagatggacatacccaaaatcgatatctaccattacgagttagatataaagcctgagaaatgccccagacgcgttaatcgcgaaattgttgagcatatggtgcagcatttcaagacccaaatatttggagatcggaagcctgttttcgacggacgaaagaatctctacactgctatgcctctgccaatcgggagagacaaagtggagctggaggtcacactccccggagagggaaaggaccggattttcaaggtgtccataaagtgggtttcctgcgtgtcactccaggccctgcacgacgccttatctgggaggttgccttctgtaccattcgagaccatacaggccttggacgtagtgatgagacatctacccagcatgagatatacaccagttggccgtagcttcttcaccgctagtgaaggctgtagtaaccctcttggcggaggcagggaagtatggttcggcttccaccagagcgtccgccccagcctctggaagatgatgttgaacatagatgtgtctgccactgctttctacaaggcccagccagtcatagagttcgtttgcgaagtgctcgacttcaaaagtatcgaagagcagcagaaacctctaacagattctcagcgggtgaaattcactaaagagataaaggggcttaaggtggaaatcacacattgcggccagatgaagagaaagtaccgggtgtgcaatgtcaccagacggccagcatcccaccagacgtttccgctgcaacaagagagcggccagacggtcgagtgcactgtggctcaatactttaaagaccgccacaagctggtgttgagatatccacatctaccttgcctacaagtgggccaggagcagaagcacacctatctgccgctggaagtgtgcaatattgtggcgggccagcggtgtattaagaagttgacggacaaccaaacgtcgactatgatccgggcaaccgctcggtctgctccggatagacaggaggagatttctaaactgatgcggtctgcatcttttaacaccgacccctatgtgagagagttcggaatcatggttaaggatgagatgaccgatgtaacaggacgcgtgttgcaacccccttccatcctgtacggtggaaggaacaaggcaatagcaacacccgtgcagggagtgtgggacatgaggaataagcagttccataccggtatcgaaataaaggtgtgggccatcgcatgtttcgcaccccagcgccagtgtacagaggtacaccttaagtcttttactgagcagctccgcaagatttcccgggacgcaggaatgccaatccaaggccagccatgcttctgtaagtacgcccaaggcgcggactcagtcgagccaatgtttcggcatctcaaaaatacttacgccgggctccagcttgtggtcgttattctgccgggaaagacaccagtgtatgctgaggtcaagcgtgtcggggatacggttctcggaatggcaacacagtgcgtccagatgaaaaacgtgcagaggaccacaccgcagacgctctcgaacctttgcctgaaaatcaatgtgaagctgggtggcgtgaataatattctgctcccgcaagggcgacccccggtctttcagcagcccgttatttttcttggcgctgatgtgacacatccccctgctggcgatggtaaaaagccgtcaatcgccgccgtggtgggaagcatggacgcacaccccaatcggtattgcgccaccgttcgcgtgcagcagcacaggcaggagatcatacaggacctagctgccatggtgcgagagctcctgatccagttttacaagagtacccgttttaagcctactcggataatcttttatagagacggcgtatcagaaggccaatttcaacaggtattacaccacgaactcctcgctatacgggaagcctgcattaagctggagaaggactaccagcccggcataacatttatcgtggtgcaaaaacgacaccacacacgcctgttttgtactgataagaatgaacggggcacatccaggcctagccattatcatgtcctgtgggacgataatagattcagtagtgacgagttgcaaattctcacgtatcagctttgtcacacctatgtgcggtgcacgcggtctgtgagcatccccgcccccgcatattacgctcatctggtggcctttagggcccgatatcaccttgtcgacaaagaacacgattctgctgaggggtcacacaccagcggccagtccaatggaagggaccatcaggctctcgccaaagcagttcaagtacatcaagacaccctccggaccatgtattttgcatag

SEQ ID NO: 116280 - DNA, 1881 bp, Artificial Sequence
  Description of Artificial Sequence: Synthetic coding sequence
atgtgcgaagtcctagacatccacaatattgatgagcaacccaggcccctcaccgatagccaccgcgtaaaattcaccaaagagattaaaggtttgaaggtggaggtcacccactgtgggaccatgagacgcaaatatagagtgtgtaatgtcacccgccggccagcaagccatcaaacgtttccattgcagctggagaacggccagaccgttgagcgcaccgtcgcccagtattttcgggagaaatacactttacagctcaaatatccccacctgccatgccttcaagtcggacaagagcagaaacatacttatctgccacttgaagtttgcaacatcgtggcggggcagcgttgcattaagaagttaaccgacaaccagaccagtactatgatcaaagccactgcccggtcagcccctgacagacaggaggaaattagccggctggttcggagcgccaattacgagacagatccattcgtccaggagttccagttcaaggtgcgagacgagatggctcatgtgacaggtcgagtactgcccgccccaatgctccaatacggcggtcgtaatagaaccgttgcgacaccctctcacggggtctgggacatgagggggaagcagttccacacaggagttgagatcaagatgtgggccatcgcctgcttcgcgacccagagacagtgcagggaagagattctgaaaggttttaccgaccagctccgaaagatctctaaggatgcagggatgcctatacaggggcagccatgcttttgcaaatatgcccaaggggcagacagcgttgagcccatgttccgacatctgaagaatacctactcaggcttgcaactgatcatcgttattctgccaggaaagacgccggtgtacgcggaggtgaagcgggtcggtgataccctgctggggatggccacccagtgtgttcaggttaagaacgttataaagacaagcccacaaaccctgagcaacctgtgcctgaagatcaatgtcaagctcggtggcatcaacaacatcttggttccccaccagcggccctcagtcttccagcaacctgtgatatttcttggggctgatgttacacaccctcccgctggtgacggaaagaagccttcgatcgcagctgtcgtgggttctatggatgcccatccatcccgttactgtgcaaccgtgcgggtccagagacccagacaggagatcatccaagatctggcatccatggttcgggagttgctcatccagttttataagtcaacgcgcttcaagccaaccaggataatattttaccgcgatggcgtctcagagggccagttccgtcaggttctttactacgagttgctggcgattagagaggcctgtatatccttggaaaaggactaccagccaggcattacatatatcgttgtgcagaaacgacaccatacgaggctattttgtgcagatcgcacagagagagttggcagaagtgggaacatcccggccggtacaaccgttgatacagacatcacccacccatacgagtttgacttctacttgtgctctcacgctggaatccagggtacatctaggccttcccactaccatgtgttgtgggatgacaattgttttacagcggatgagcttcaactcctcacctatcagctgtgtcacacatatgttcgctgtactaggagcgtttctatccccgctcccgcatattacgcgcatttggtagccttccgcgcaagatatcacttggttgacaaggagcacgacagcgccgaaggcagccatgtttcaggccagtccaatggtcgggatccgcaagctttggcgaaggccgtccagatccaccaggacacactgcgcacaatgtattttgcctag

SEQ ID NO: 116281 - DNA, 690 bp, Artificial Sequence
  Description of Artificial Sequence: Synthetic coding sequence
atggaaatcgggtccgctgggcctgctggcgcccagcctctgctcatggtgccgaggaggccgggctatgggaccatgggaaagcccattaagctgctggcaaactgttttcaggtcgagattccgaaaattgacgtatacctgtatgaggtcgacatcaaacccgacaaatgtcctcggagagtgaaccgggaggtggtagacagtatggtgcagcattttaaagtaacaatcttcggggaccggcgcccagtatatgacggcaagcggtcgctttataccgccaatccacttccagtggccacaaccggtgtggacctggacgttacccttcctggggagggcggcaaggatcgaccatttaaggtgtcaattaaatttgtctcccgggtgtcttggcacctgctgcacgaagtccttactggacggactctgccagagccactcgagttggacaagcctatctccaccaatcctgtacatgccgtggatgtggtacttcgacacttgccttccatgaagtacactcctgtgggacgaagcttcttttctgcccctgaaggatatgaccatcctctggggggaggacgggaggtttggtttggttttcaccaaagcgtgcggccggccatgtggaagatgatgcttaatatcgacgagcgcgatctttggcaacagtgtggcgagtag

SEQ ID NO: 116282 - DNA, 2583 bp, Artificial Sequence
  Description of Artificial Sequence: Synthetic coding sequence
atggagatcgggtccgccggacctgccggagctcagccgctcctcatggtgccaagacggcccggctacggaacaatgggtaagcccatcaagctcctggcgaactgctttcaagtggaaataccaaaaatagatgtgtacctgtatgaggtggacattaaaccggacaaatgcccaagacgggtgaatcgggaggtggtggactccatggtgcagcacttcaaggtgacaatctttggcgatcgcagacccgtgtacgatggcaagcgtagcttgtatacagcaaatccacttcctgtcgccactactggcgtggacttagatgtaacactgcccggcgaggggggaaaagatcggccatttaaggtgagcattaaattcgtaagtagagtgagctggcacctgttacacgaggtgctcaccgggagaaccctccccgagccgttggagctcgataaacctatctcaacgaatccagtgcacgcagttgatgtggtacttcggcatttgccatcgatgaaatatactccagtaggtcggtccttcttcagcgcccccgagggttacgaccaccctctgggaggaggaagggaggtatggttcgggtttcatcaaagcgtgagacccgccatgtggaaaatgatgctaaacattgatgtgtccgctacggccttctacaaggcccagcccgtaatccagtttatgtgcgaggtgttggatatccataacattgacgagcagcctcgcccattgaccgactcccatagagttaagttcaccaaagaaatcaaggggctgaaggtcgaagttacccattgtggcacgatgagacggaaataccgcgtgtgcaatgttacccgacggcccgccagccaccagaccttcccgcttcagctggaaaacggtcaaaccgtcgagagaactgtggcccagtatttccgtgagaagtatacgctacagctcaagtaccctcatctgccttgccttcaggtgggccaggaacaaaagcacacctatttgccccttgaggtgtgcaatattgtggcagggcagcggtgcatcaaaaagttgaccgacaaccagacctcaaccatgattaaggccacggctcgaagcgcaccagatcgtcaggaggagatcagcaggcttgtgagaagcgcaaattatgaaacagatcctttcgtacaagagttccagttcaaggtaagggatgaaatggcccacgtaacaggaagggtcttgccagctccaatgctgcagtacggcggacgaaatagaacagttgccacaccctcacatggcgtgtgggacatgcgagggaagcaattccacacgggtgtggagataaaaatgtgggccatcgcatgctttgctacacagcgccagtgcagagaggaaatacttaaagggttcacagaccaacttagaaagatatccaaagacgcaggcatgcccatccaagggcagccatgtttttgtaagtatgctcaaggggcggatagcgtggagccaatgttccggcatttgaaaaatacctatagcggcctccaacttatcatcgtgattctccccggcaagacccccgtatacgccgaagtcaagcgcgttggcgatactctgttaggtatggccacccaatgcgtacaggttaagaacgtaataaagacatcaccacagactcttagcaacctgtgccttaaaattaatgtcaaactgggaggaatcaacaatatcctcgtgccgcatcagaggccctctgtctttcaacaacctgtcatctttctcggagccgatgttacccaccctcccgcgggagatggcaaaaaaccgtccattgcagcagtcgtagggagcatggacgcccatccgagcagatattgcgccaccgtcagggtgcagcggcctaggcaggagattattcaggacctggcgagcatggtaagagaactgctcattcagttttacaagtctactagatttaagccgacccgtataatcttctaccgggatggtgtctctgagggtcagtttcgtcaggtcctgtattacgagctgctggcaatcagggaagcttgtatcagtttagagaaagattatcaacctgggattacttacattgtggtccagaaaagacaccacacaaggcttttctgcgcggaccgcacggaaagggtgggccggtctggcaatattcccgcgggaactaccgtggacaccgacattactcacccgtatgagttcgatttctacctgtgctctcacgccggcatccaaggaacttcacggccctcccactaccacgtcttgtgggacgataattgctttaccgccgatgaacttcagttactgacttaccagctttgccacacatatgtgagatgtacacgaagcgtatctattccagcccctgcctactacgcacacctggttgcatttcgggcgcgttatcatctcgttgacaaagaacatgattcggccgaaggctctcatgtgtcagggcagtcaaacgggcgtgatcctcaggctctcgcgaaggccgtgcagatccatcaggataccttgcggactatgtatttcgcatag

SEQ ID NO: 116283 - DNA, 690 bp, Artificial Sequence
  Description of Artificial Sequence: Synthetic coding sequence
atggaaattggtagcgccggcccagccggcgcccagccactcctgatggttccaaggcgacccgggtatggcaccatgggcaaacccataaagctgttagccaactgttttcaggtagagattccgaagattgacgtttacctctatgaagtggacatcaaacccgataaatgcccgaggagggttaacagggaagtcgtggatagcatggtccagcatttcaaggtaactatttttggtgatcgtcgacccgtgtatgacggcaaacggagtctctatacagctaatcctctgcctgtggcaactactggcgtcgatcttgacgttaccctgcctggagaaggcggaaaagacagacccttcaaagtgtcaatcaagttcgtgagcagagtgagttggcacctgttgcatgaggtcctgactgggagaacactgccagaaccactggagctcgataagcccatttcgaccaatccggtgcatgccgtggatgtcgtgctcaggcacctgccgtcaatgaaatatacacctgttggccgctccttcttcagcgccccagaaggctacgatcaccctctgggaggagggcgcgaagtgtggttcgggttccatcaaagcgtgcgcccggcaatgtggaaaatgatgttgaacatcgacgagcgggatctatggcagcagtgcggggaatag

SEQ ID NO: 116284 - DNA, 2586 bp, Artificial Sequence
  Description of Artificial Sequence: Synthetic coding sequence
atggaggctctgggcccagggccgcctgcctcattatttcagccaccacggagacccggtttaggaacagtgggcaaacctatccgcttgctggctaaccatttccaagtccaaatcccgaaaatcgacgtttaccattacgacgtcgacataaaacccgagaaacgccctcgaagggtcaatcgcgaggttgtcgatacgatggttaggcatttcaaaatgcagattttcggcgatagacagcctggatacgacggcaaacgaaatatgtacactgcccaccctctgcccatcggcagagaccgggttgacatggaagtaactctgccaggagaaggaaaagatcagacatttaaagtctctgtgcagtgggttagtgtggtgtccctgcagctcctcttggaggcgctcgccggccacttgaacgaggtgccggacgatagcgtgcaggccttagatgtgattacaaggcacttaccctcaatgcgatacactcctgtgggtcgcagtttctttagcccccctgaaggttactatcaccccttgggaggaggcagagaggtgtggtttggcttccaccagtccgtgaggcccgcaatgtggaatatgatgttgaacattgatgtcagcgccaccgcattttacagagcacagccgattatagagttcatgtgtgaggtgctggacatacaaaacataaacgaacagaccaaacctctcaccgattcccagagagtaaagttcaccaaagagatcagaggactgaaagtggaagtgacccactgtggtcagatgaaaaggaagtatagggtgtgcaacgttacacgacgtcctgcgtcccatcagacatttcctctgcagctggagaacggacaggcaatggagtgtaccgtggcgcagtactttaagcagaagtacagcttgcagttaaagtaccctcacctgccgtgcctccaggtgggacaggagcagaagcacacatacctgccattggaagtatgtaacattgtggctggccagaggtgtataaagaaactgactgacaatcagaccagtactatgatcaaagcgaccgcaaggtcagcacccgatagacaagaggaaatctctaggctcgtgaagagcaactccatggtggggggcccagacccttatctgaaagagttcggaatcgttgtccacaatgagatgactgagcttaccgggcgagtgttgcccgcgccaatgttacagtatggaggacgaaacaaaactgtagcaactccaaaccagggggtgtgggacatgagaggcaaacagttttacgccgggattgagatcaaagtctgggcagtggcctgtttcgctcctcagaagcagtgtagagaagacctcctgaagtctttcacggaccagctccggaagatatccaaagatgccggcatgcctatccagggccagccttgtttctgtaaatatgcccagggtgcagatagtgtcgagccaatgttcaagcatctaaaaatgacatacgtggggctccagcttatcgtagtcattctgccaggtaagactcctgtttacgccgaggtgaagagagtgggagatactctgctagggatggctacccaatgtgtccaagtgaagaatgtcgtgaagacctcccctcagacattgagcaatttgtgtcttaaaataaatgctaagctgggtggcattaacaacgtcctcgttccacatcagagaccctccgtcttccaacagcccgtaatctttctgggagcagatgtaacgcacccccctgccggagacgggaagaagccctccatcgccgcagtcgtggggtctatggatgggcacccctcccggtactgtgctactgtccgagtacagacctcacggcaagagatctcccaagagctgctgtacagtcaagaggtgatccaggacttgacaaacatggtcagggagttgttgattcaattttataagagtacacgctttaagccaacacgtataatctactatcgaggcggcgtatccgaagggcagatgaagcaggtcgcctggccggagctgatcgcaatcagaaaggcctgcatctccctggaggaagattatcgcccgggcattacgtacatcgtagtgcagaagagacatcacactcgactgttttgcgcagataaaaccgagagggtgggtaaatccgggaatgtgcctgcaggtacgactgtggactccaccataacacacccgtcagaatttgatttttacctctgtagtcacgccgggatccaggggacgagccgccctagccattatcaggtgttatgggatgataactgtttcacagcagacgagctccaactcctaacttaccaactctgtcatacatacgttaggtgtacgaggtccgtgtctataccagctcccgcctactacgcacggctcgtagctttcagagcccgatatcatttggtggacaaggatcatgactccgctgaggggagccacgtctcaggccagtctaatggaagggacccacaggcactggcaaaggccgtgcagatccaccacgatacccaacatacaatgtactttgcctag

SEQ ID NO: 116285 - DNA, 1755 bp, Artificial Sequence
  Description of Artificial Sequence: Synthetic coding sequence
atgtttgctaaagcttttagagtcaaaagcaatacagcaattaagggatcggaccgaaggaaactgcgggcagatgtgaccacggcctttcccactctcggtaccgatcaagtctccgaattggtccctggaaaggaggaactgaacatagtaaagctatacgctcataaaggagatgcggtgacagtgtacgtttctggtgggaatcctatcctatttgagctggagaaaaacctgtacccgaccgtctatacactctggagttatccagacctgctccccacgttcacaacttggcctctcgtgctggagaaacttgtgggaggagcagatctgatgcttcctggcttggttatgccccctgccggtctgccgcaagttcagaagggagatctctgcgctatttctctggtgggaaacagggccccagtggccataggtgttgctgccatgtcaacagccgagatgcttacctccggactgaagggccgaggcttctccgtgttacatacctatcaggatcatctgtggcgaagcggcaacaaatcatcccccccctccattgcgcctcttgctctggacagtgcagatctgtcagaggagaaaggttccgtccagatggactccactctgcaaggggatatgagacacatgacccttgaaggcgaggaggagaacggtgaagtacaccaggcaagagaggacaaaagcttgagcgaggctcccgaagatacatcaacacggggcctgaaccaggactcgaccgacagcaagaccctgcaagagcagatggacgagctcctacagcagtgtttcctacacgccctgaagtgccgcgtaaaaaaagcagacctgccgctgcttacatctaccttccttgggtcccacatgtttagctgctgtcccgaaggacgacagctggacattaagaagtcctcctataagaaactgtctaaattcctgcagcagatgcagcaggagcaaataattcaagtgaaggaactgtctaaaggcgtggaaagtattgtcgcggtggattggaagcatccaaggatcacttcctttgtgatacctgaaccaagccccactagtcaaacaatacaggaggggtctcgcgagcagccctatcacccacctgacatcaagcctctgtactgcgtgcccgctagcatgacattgttatttcaggagtccgggcacaagaaaggcagctttctggaaggatccgaggtaaggactatcgtgattaactacgctaagaaaaacgacttagtcgacgccgacaacaagaatctcgttcgactggaccccatcctctgcgattgtattttggagaaaaatgagcagcacacagttatgaagctgccatgggacagtttgctcactaggtgtctggagaagctccagccggcttatcaggtgacattacctggccaggagccaatagtaaagaagggccgcatctgccccattgacattactctcgcccaacgcgccagcaataaaaaagtgaccgtagtcagaaatctcgaagcttatggccttgacccctatagcgtggccgcaatcctgcagcagcggtgccaggcgtccactaccgtcaacccggccccaggcgcaaaggatagcctccaggtccagattcagggaaaccaggttcatcacttgggctggctcctgttagaagagtaccagctccctcggaagcatatacagggactggaaaaagccctgaagccgggaaagaaaaaatag

SEQ ID NO: 116286 - DNA, 816 bp, Artificial Sequence
  Description of Artificial Sequence: Synthetic coding sequence
atgtttgcaaaagctttccgggtcaaatctaacacagccattaagggctccgataggcggaaattgagggcggatgtaaccacggcttttcctacactcggcactgaccaggtatcagagctggtgcctggaaaagaggagctgaacatcgtgaaactgtatgcccataaaggcgacgccgtgactgtgtacgtgagcggcgggaatccaattctttttgaactggagaaaaatctgtatcctacagatctcatgttgccgggactcgtaatgcctccggctggacttcctcaggttcaaaagggcgacttgtgtgctatttctctggtggggaatcgggcacctgtggctattggggtggccgccatgtccactgctgaaatgctgacaagcggtctgaaaggtcgaggcttttctgtcctgcatacctatcaggatcacttatggcgctccggaaataaatccagtccccctagcatcgcgcctctggcactggattcggccgacctgtccgaggagaagggaagcgtacaaatggattcaacgctgcagggggacatgcgacatatgaccctcgaaggcgaggaggagaacggtgaggttcaccaggcccgtgaggacaagtcgctttccgaggcacctgaggacacatccacaaggggtcttaatcaggactccaccgattctaaaacgctacaggaacaaatggatgagcttttgcagcagtgtttccttcatgccctcaagtgtagggttaagaaggccgatctccccctgcttacaagcacttttctagggtcacacatgtttagttag

SEQ ID NO: 116287 - DNA, 1383 bp, Artificial Sequence
  Description of Artificial Sequence: Synthetic coding sequence
atgttcgcaaaggccttccgggtaaagtccaatactgctatcaagggttcagataggcgaaagttacgggctgatgtcacaaccgcctttcctaccctggggacagatcaggtaagcgagctcgtacctggtaaggaggaactgaatatcgtaaagctgtacgcccacaaaggtgacgccgtgacagtgtacgttagtggagggaaccccatcctctttgagctggagaagaacctctaccccacagtctacaccctgtggtcgtaccctgacctactccctacctttacaacatggcctctggtcctggaaaagctggtcgggggcgcagacctgatgctgccaggcctggtgatgcccccagctggcctgcctcaggtgcagaagggtgatctctgcgctatcagcttggtcgggaaccgagcacctgtcgcaatcggcgtggctgccatgagcaccgccgaaatgcttaccagcggactgaagggtcgaggcttttcagtgctgcacacttaccaggaccacctctgtcccgagggcagacagctagacattaagaagtctagctataaaaagctcagtaaatttctgcaacagatgcagcaggagcagattattcaggtgaaggaattgtcaaagggggttgaatccatcgtagccgtagattggaaacatccgcgaattacctcgttcgtcatccccgaaccgagccctacgagtcagaccattcaggagggcagccgcgaacagccctaccaccccccagacatcaagccactgtactgtgtgcccgccagtatgaccctcctcttccaggaatccggccacaagaagggtagcttcctagagggatctgaggtcagaactatcgtgatcaattatgccaagaaaaatgatctcgtcgatgccgacaataagaacctggtaaggctggatcctatattgtgtgactgcatcttggagaaaaacgagcagcacactgttatgaagctcccttgggacagcctgcttacacgctgcctggaaaagctgcagcccgcctatcaagttacactccccgggcaggagcctattgttaagaaagggaggatttgtcccattgatattactctcgcacagagagcgtcaaataagaaggtgactgtcgtcagaaacctcgaggcgtatggactcgacccctacagtgtggcggccattcttcagcagagatgccaggcatccacaactgttaatcctgcgcctggagccaaggatagtctgcaggtccagattcagggaaatcaagttcatcacttggggtggctgctgctggaggaatatcagcttcctcgcaaacatatacagggcctggagaaggctttgaaacccggcaagaagaagtag

SEQ ID NO: 116288 - DNA, 816 bp, Artificial Sequence
  Description of Artificial Sequence: Synthetic coding sequence
atgttcgctaaggcctttcgggttaaaagtaacaccgccattaaaggatccgatcggcggaagctaagagccgacgtaaccacagccttccctacgctggggactgatcaggtgtcagaactcgtgcctgggaaagaagaattgaatatagtgaagctgtacgcccacaaaggggacgcagtcactgtgtatgtgtccggaggcaatccgatcctgttcgagctggagaagaatctctatcccactgatctgatgctgcccggacttgtgatgcccccagcaggcttaccccaggtccagaagggagacctctgtgccatttctttagtcggcaaccgtgcccccgttgccattggcgtggccgctatgtctacggccgaaatgttgacctccggactgaaaggtagagggttcagcgtgcttcacacataccaggaccacctgtggcggagtgggaacaagtcttcacctccctctatcgcccccttggcccttgactcagctgatctgagtgaggaaaagggttccgtccagatggacagcacactgcaaggtgatatgcgccatatgaccctggaaggtgaagaggaaaacggggaggtccatcaggctagggaggataaatccctgagcgaagcccccgaagatacgtcgacccgcgggctgaaccaggactctactgactccaaaaccctgcaagagcaaatggatgagcttttgcagcagtgttttctgcacgctttgaagtgccgggtgaagaaggctgatctgcccttgctgacctcgacattccttggaagccatatgttttcatag

SEQ ID NO: 116289 - DNA, 2742 bp, Artificial Sequence
  Description of Artificial Sequence: Synthetic coding sequence
atgagccgcttctttaccaccggctctgactctgaaagtgaatctagtttgtcaggggaggaactggttacaaagccggtaggcggcaactatggcaagcagccactgctcctgagcgaggacgaggaggatacaaaacgcgttgtcaggagtgcaaaggacaagagatttgaagagctcacaaacctgattagaactatccgtaacgccatgaagattcgtgatgtgacaaaatgtttggaagaatttgagctactgggaaaggcctatggaaaggcaaaatccattgtcgacaaggagggggtccctagattttacattaggatcctggctgatctggaagactatttgaacgagttgtgggaagataaggaaggaaagaaaaaaatgaacaaaaataacgcaaaggcactgagtacattgaggcagaaaatcagaaagtataacagggacttcgaatcccacatcacgagttacaagcaaaatccggagcaaagcgccgacgaggatgccgaaaagaacgaggaggattccgagggatccagcgatgaagatgaggatgaagatggcgttagtgctgcaacctttctgaaaaagaaaagtgaggctccatccggggagtctcgcaagttcctgaaaaagatggacgacgaggatgaggacagcgaagacagtgaggatgacgaagattgggacaccggcagtactagcagtgactctgattctgaggaagaggaggggaagcagaccgccctggcaagccggttcttaaagaaagctccaaccacagacgaagacaaaaaggccgcggagaagaaacgcgaggacaaagccaagaaaaagcatgaccggaaatccaaaaggctggatgaggaggaagaggacaacgagggtggggagtgggagcgggttcgaggaggggtccctctggtcaaagagaagcccaaaatgttcgccaaaggcacagaaatcacacacgcggtggtcattaaaaagctcaatgagatcttacaggccaggggaaagaaggggacagatagggccgcccagatcgagctgcttcagctactggttcagatcgccgctgagaacaatctgggtgagggcgtaatagtaaagattaaatttaatattatcgctagcctgtatgactataacccaaatctcgcaacctacatgaagccggaaatgtggggaaaatgcctggattgcatcaatgagctgatggatatcctgtttgccaaccctaatatcttcgtcggcgagaacattttggaagaaagcgaaaacctgcacaacgcggaccagccactgagagtgcgcggatgtatccttactctcgttgagcgtatggatgaagaatttacgaaaatcatgcagaacacagacccacattcacaggaatacgttgagcacctgaaagacgaagcacaggtctgtgccataattgagagggtacaacggtatttggaggagaagggcaccaccgaggaagtgtgtcgtatctatctgttgagaatactgcatacctattataaattcgattacaaagcccaccagcgccagttaactcctccagaaggatcatccaagtccgagcaggaccaggccgagaacgaaggggaggactccgcagtgttgatggaacggctatgcaaatacatatacgcgaaagatagaacggaccggattagaacctgcgccatactgtgtcatatctatcaccacgctttgcattctcggtggtaccaggccagggacctaatgttgatgtctcatctgcaggataacattcagcatgccgaccctcccgttcagatcttgtacaatagaaccatggtccagttgggcatctgtgcattcaggcagggtttaaccaaggatgctcataatgctctgttggacattcagagctcggggcgggcaaaagagttgctgggacaggggctgcttttgcgttccttgcaggagcgtaatcaggagcaggagaaagtggaacggcggcgtcaggtacccttccacttacatatcaatctggagcttcttgagtgcgtttacctggtctctgcaatgctgttggagatcccatatatggcagcacatgagtctgacgctcggcggaggatgatttccaaacagtttcaccaccaacttcgagtgggggagagacaaccactgttaggcccacctgagagtatgcgggagcatgtggtggccgcctcgaaagctatgaaaatgggtgattggaaaacttgtcactcctttatcatcaacgaaaagatgaacgggaaggtctgggacctcttcccagaggcagacaaggtgaggacaatgctggtacgaaaaattcaggaggagtcgctgaggacctatctcttcacttattcttcggtgtacgattccatctctatggagacactctcggatatgtttgaactggacctgcccaccgttcacagcattattagcaaaatgatcatcaacgaggaactgatggccagcttagatcagcccacacagaccgtggttatgcatcggactgaacctacagctcagcagaatcttgccctgcaattggcagagaagctcggttcactcgtcgagaacaacgaaagagtctttgatcataaacagggcacatacggcggctattttcgagaccaaaaggatggatatagaaagaacgaggggtacatgagacggggtggctacaggcaacagcaatcacaaactgcatattag

SEQ ID NO: 116290 - DNA, 4149 bp, Artificial Sequence
  Description of Artificial Sequence: Synthetic coding sequence
atgccagcttactttcagcggcccgagaacgcacttaaaagggcaaacgaattcctggaagtaggaaaaaaacagccagctctggatgttctttatgatgttatgaaaagcaaaaagcacaggacctggcaaaaaattcatgagccaattatgttgaaatatctggagctttgcgtggatctgcggaaaagccacctggccaaagagggcttataccagtataagaacatatgtcagcaagtaaacattaagagcttggaggacgtcgttcgggcttatctgaagatggccgaagagaagaccgaggcggctaaggaagagtcacagcagatggtgcttgatatcgaagatctcgacaacatccagacaccagagtctgtcctcctgtcagccgtgtctggtgaggacacacaggaccgcactgataggctcctgctgacgccgtgggtgaaattcctgtgggagtcttatcgccaatgccttgatctattgaggaacaattctagggtcgagcgactgtatcacgacatcgcacagcaggctttcaagttttgcctccagtacaccaggaaagcggagtttcgcaaactgtgtgacaacctcaggatgcatctgtcccagattcagaggcaccacaaccaatccaccgcaatcaacctgaacaacccagaaagtcagtcaatgcatctagagacaagactcgtccaactggactcagcaattagtatggagctgtggcaggaggcatttaaggctgtcgaggatattcatgggctgttttccttgtccaaaaagcctccaaagccacagctcatggccaactactataataaagtttccaccgttttctggaaaagtgggaatgcactgtttcacgcatctaccctgcaccgactgtatcatctgtcgagagaaatgaggaaaaacctaacccaagacgagatgcaacgcatgtctactcgggtcctcctggcaacattgtccattccaattaccccagagaggaccgacattgcaagattgcttgatatggacggcatcattgtcgagaaacaacgccgcctcgctaccctgctaggactgcaggcacccccaacccgaatcggcttgatcaatgatatggtgaggtttaatgtcttgcagtatgttgtcccagaagtaaaagatctgtacaactggctggaggtggaattcaacccgcttaagctatgtgagcgggtgacaaaagttttaaattgggtgcgggagcagcccgaaaaggaacctgagctccaacagtatgtgccacaactccaaaacaataccatcttgagactgttgcagcaagtgtctcagatctatcagagtatcgaattctcacgcctaacctctctcgtgcctttcgtagatgccttccagctggagagggctatcgtggatgccgctcgccactgtgacctgcaggtgaggatcgatcacaccagtagaactctatccttcggcagtgatctcaattacgccacccgcgaagatgcacctattggcccacacctgcagtcaatgcctagcgaacagattcgaaatcagctgacagcaatgagcagcgtgctggcaaaagcactggaggtgattaagcccgctcatatcctgcaggagaaggaggaacagcaccagctcgctgttactgcatacttgaagaattcacgcaaggaacatcaaaggatcttagcccgcagacaaacgattgaggagcggaaggaaaggcttgagtccctaaatatccagagagagaaggaggagcttgaacagagggaagctgagttgcagaaggtgcggaaggctgaggaagagcgcctcagacaagaagctaaggagagagaaaaggaacgcattctgcaggagcatgaacagatcaaaaagaaaacggtgcgcgaaagactcgagcagataaagaagactgagctgggagccaaagcgttcaaggatattgatattgaggacctggaggagcttgaccccgacttcattatggcaaaacaggttgagcaactcgaaaaggagaagaaggagctacaagaaaggctgaagaaccaggagaagaagattgattatttcgaaagggctaaaaggctggaagagataccgctcattaagagcgcttatgaagaacaacggatcaaagacatggatctctgggagcagcaagaagaggaacgcataaccacaatgcagttggagcgcgagaaggccctggagcataaaaatcgcatgagccgaatgctggaagatagagacttgtttgtgatgaggctcaaggccgcccgtcaaagcgtttatgaagaaaagttgaagcagtttgaggagcgtctggccgaggaacggcataaccggttagaagaacgaaagaggcaacgcaaggaagagcgtaggatcacatactacagggagaaggaggaggaggagcagaggcgagcagaggaacagatgctgaaagagcgcgaggagagggagcgcgccgaacgtgccaagagagaggaggaactgcgagagtaccaggagagagtcaaaaagcttgaagaggtggagaggaagaagcggcagagggaactggaaattgaagagagagaacgccgcagagaagaggagaggagactgggggatagttccctctctaggaaagacagccggtggggcgatcgtgactctgagggaacctggagaaaggggccagaagcagactctgaatggcggagagggcctcccgagaaggaatggagacggggcgagggtcgcgatgaggatagatctcacagacgggatgaggagaggccccggcggcttggcgacgacgaagatcgtgagccctcattacggcccgatgatgatcgcgttccacgcagaggcatggacgacgacaggggaccccgccgcggtcccgaggaagatagattttcccgcagaggggccgacgacgataggcccagttggcgcaacacggacgacgacaggccaccaaggaggatagcagacgaagacaggggcaactggagacacgcagatgacgaccgccctccacgcagaggcttggacgaagatcgcggttcgtggagaaccgcagacgaagatcggggaccacggcgagggatggatgacgatcgtgggccccgcagaggcggcgccgacgatgagcgcagctcatggaggaacgccgatgacgatcgaggcccaagaaggggactcgatgatgacagggggcctcgaaggggcatggacgatgatcggggtcccaggcgaggcatggatgacgataggggccccaggaggggaatggatgatgaccgtggtccgaggaggggccttgatgacgataggggaccatggcgtaacgctgacgatgaccgcataccccgcaggggggctgaggacgatagagggccttggaggaacatggatgacgataggctcagccgtcgcgcagatgatgaccgattccctaggcggggggacgatagccgaccgggcccatggcgaccgctggtgaagccaggaggctggagagagaaggagaaggctcgagaggagagttggggccctccacgggaatctagaccttccgaagagcgtgagtgggatcgtgagaaagagcgcgaccgcgacaatcaagatcgggaggagaacgataaggaccctgaacgggagagggacagagaacgagacgttgacagggaagatcgatttaggcggcctagggacgaaggaggctggaggcgcggccccgccgaagaatcaagctcctggagggactcttcccggcgggatgaccgcgacagggatgacagacgcagagagcgggatgaccgaagggatcttagggagcggcgggatctgagggacgatagagacagaagaggacctccactccggagtgagagagaggaggtaagttcttggcgaagagctgatgacaggaaggatgaccgggtcgaagagagggacccccctagacgggtaccccctcctgcactttcacgtgatcgtgaaagagatagagatagggaacgggagggtgaaaaagaaaaagcttcttggagagctgaaaaggaccgtgagtcactcagacggaccaaaaacgagaccgatgaggacggatggacaactgtgaggagatag

SEQ ID NO: 116291 - DNA, 4047 bp, Artificial Sequence
  Description of Artificial Sequence: Synthetic coding sequence
atgaaatccaagaagcacaggacctggcagaagattcatgagcccatcatgctgaaataccttgaattatgtgtggacttgcgcaagagtcacctcgcaaaggaaggcctttaccagtataaaaacatatgtcaacaggtaaatatcaaatccttagaagacgtggtgcgcgcctacctgaagatggccgaagaaaagaccgaggccgcaaaagaagaatcccagcagatggtgctagacatcgaagatttagacaacatccagaccccagaaagcgtcctgctgtccgccgtgtccggagaggacacacaggacagaaccgaccgtcttctcctgacaccctgggtgaagttcctgtgggaaagctacagacagtgtctggacctgctcaggaataatagtagggtcgagagactttatcatgacatcgcacagcaggccttcaagttttgcctgcagtatacaagaaaggctgagtttagaaaactgtgtgataaccttaggatgcacctctcccagatccagcggcaccacaaccagagcacagcgataaatttgaacaaccctgaatcacagtcgatgcacctggagacaagactagtgcagcttgattcagccatctctatggagctctggcaggaagcttttaaagcagtcgaagacattcatggacttttctcgctgagcaagaagccccctaagcctcagttaatggcaaattattataataaagtgtcgacggttttctggaagtccggtaatgctttatttcatgcatccacccttcaccgcctgtaccacctgagcagggaaatgagaaagaatctaacacaggatgagatgcagagaatgagtacaagggtactcctggctactctgtccataccgattactcccgagagaacagatatcgcacgcctgcttgatatggatgggataattgtcgagaagcagagacgtctcgctactctgctcgggctgcaggcaccccccacaagaatcggtctgattaacgatatggtccgattcaacgtcctccagtatgttgttcctgaagtaaaggatttgtataactggctagaagttgaattcaacccccttaaactgtgcgagagggtgacaaaagtgcttaattgggtgcgcgagcagcctgagaaagaaccagaactccaacaatacgtgccgcagctacagaacaacacaatactgcggctactgcagcaggtcagccagatttaccagtctatagagttttcccggctgacatccctggtgcccttcgtggacgcgttccaattggaacgcgctattgttgacgcagcccgccattgtgacctgcaggtgcggatcgaccataccagccgcaccctgtctttcgggtccgatctcaactatgctactcgagaagacgcacctatcggcccccacctccagtcaatgcccagcgagcagattcggaaccagctgacagccatgagcagcgttctggcgaaggccctcgaggttataaaacctgcacacattcttcaggaaaaagaggaacagcatcagctggccgtaaccgcttatttgaagaattctaggaaggagcaccagcgaatcctggccaggaggcagacaattgaagagaggaaagaaaggcttgaatctctgaacatccaaagggaaaaagaggagctggagcaacgcgaagccgagctgcagaaagtcaggaaggctgaggaggaaagattgcgacaagaggccaaggagagggagaaggagcggatccttcaggagcatgaacagattaagaaaaagacagtgagagagaggctcgaacagatcaagaagaccgagcttggggccaaggcttttaaagatatcgacatcgaggaccttgaagaattggatccagactttataatggccaaacaggtcgaacagctggaaaaagagaaaaaggagctgcaggaaagactaaaaaatcaggagaaaaagatcgattatttcgaacgcgcaaagcgtctggaggagatcccccttattaaatctgcctacgaggagcagaggataaaggacatggacctgtgggagcaacaggaagaagaacggataactactatgcagttggaacgggagaaagcactcgagcataagaaccgaatgtccaggatgcttgaggaccgcgatctcttcgtcatgaggttaaaagcagccagacagagtgtctatgaggagaaactgaaacagttcgaggagaggcttgccgaggaacgccacaatagactggaggaaaggaagcgccagcggaaggaggagagacgaataacgtattaccgtgagaaagaggaggaggaacagcggcgggccgaagaacagatgctgaaggagagagaggagagggaacgcgccgaacgcgcaaaacgagaagaagagttaagagaataccaagaaagagtcaaaaaactcgaggaagtggaacgcaagaagaggcaacgcgagctggagatcgaggagcgcgaacggaggcgcgaagaggagcgaagactcggcgatagctcactatctcggaaagattcgagatggggtgacagggacagcgaggggacttggagaaaaggtccagaggcggacagtgagtggcggaggggcccgccagagaaggaatggcgacgaggagaaggaagagacgaagaccgctcacaccgcagggacgaggaaaggccaaggagactgggagatgacgaggatcgtgaaccctcactgaggcccgacgacgaccgcgtgcctcggagaggaatggacgatgaccggggccctagacgaggcccagaggaggacagattctccagaagaggcgcagatgatgacagaccatcctggagaaataccgatgatgaccgccctccgaggcggatcgccgacgaagataggggtaattggagacatgctgatgacgacagacctccccggcgcggtttggatgaggatcgaggatcttggaggaccgccgacgaggacaggggtccacgcagggggatggacgacgatcgcgggcctaggagaggaggtgccgacgacgagcgttcatcctggcgaaatgccgacgacgacaggggcccgcggagaggtctcgatgatgaccggggacccaggcgcgggatggacgatgatagggggccgcggagagggatggatgacgacagaggtccacggcgtggaatggatgatgaccgtggcccccgccgaggcctagatgacgatcggggcccttggcgaaacgccgatgacgataggattcctcggagaggcgccgaagatgaccgggggccatggaggaacatggacgatgaccgcctgtcccgcagggccgacgacgaccgcttccctcggcggggcgatgattccagacctggtccttggcgccccttggttaagccaggagggtggagagaaaaagagaaagccagggaggagagctggggaccccctcgggaatcaaggccgtctgaggagcgggagtgggatcgcgagaaggaacgcgaccgagacaaccaggatcgagaggagaatgataaggaccctgaacgagagagagatagagaaagggacgtggatagagaagatcgcttcaggcggccaagggatgaaggtggttggagaagaggaccggccgaagagtcctcttcctggcgcgactccagccgaagagatgatcgggatcgagacgaccggcggcgagaacgagacgataggcgcgatttgagagaacggagggatcttcgtgacgaccgggataggcgtggaccacccctgaggtccgagagggaggaggttagttcatggcggagggcagacgaccgcaaggacgaccgggtcgaggagcgggaccccccccggcgggtcccccccccggcgctatctcgtgatagagagagagatagagatcgcgagagggagggagaaaaggaaaaggcttcctggagggccgagaaagaccgagagtccttgaggcggaccaaaaacgagaccgatgaggatgggtggacaacagtccgcagatag

SEQ ID NO: 116292 - DNA, 2619 bp, Artificial Sequence
  Description of Artificial Sequence: Synthetic coding sequence
atgcaggacgcagaaaacgtcgctgtccctgaggcagcggaagagcgcgccgaacccggtcagcaacagccggcagccgagcctccccctgctgaggggctcctgcgcccggctggacccggagcccccgaagccgctgggaccgaagcaagttccgaggaagtcggcattgccgaagccgggcctgaaagtgaagtccgaactgagcccgcggcagaggcagaagccgcaagcggcccttccgaaagcccatcacctcccgcagctgaggagcttcctggatctcatgccgaacctccagtaccggctcaaggtgaggctccaggagagcaggcccgggatgaaagatcagacagtagagctcaagccgttagtgaagatgctgggggcaacgagggccgggcggcggaagcagaacccagggcactagaaaacggcgatgctgacgaacccagttttagtgaccccgaagattttgtggacgatgtcagcgaggaagagttgctgggtgacgtgctgaaggaccgacctcaggaggcagacggaattgacagcgtgattgtggttgacaatgtgccgcaggtcgggcctgatcggttggaaaaactcaagaatgtgattcacaagatctttagcaagttcggcaagattactaatgatttttatcctgaagaggatggaaaaactaagggctatatctttctggagtacgcatcccctgcccacgccgttgacgctgtgaaaaacgcagatggatacaagcttgataagcagcacactttcagagttaatctgttcacggacttcgataaatatatgactattagtgatgagtgggacatccccgagaaacaaccgttcaaagacttgggaaatttgagatactggttggaagaagccgaatgtcgggaccagtacagcgtcattttcgagtcgggtgacagaactagtattttctggaacgatgtaaaagatccagtgtcgattgaggagcgtgcacgttggacagaaacttacgttagatggtcccctaagggaacctacctggctacttttcatcagaggggcattgccctctgggggggtgagaagttcaaacaaatccagcggttctcacaccaaggggtgcagctcatcgacttttcaccctgcgaaaggtatctcgttacattttcacctctgatggacacgcaggatgacccccaagctatcattatctgggacattctgacgggacacaagaagcggggttttcactgcgagagtagcgcccattggccaatctttaagtggtcccacgacgggaagttctttgctaggatgactctggacaccttatcaatctatgaaaccccatccatgggactgctggacaagaagagtctcaagatctcaggaattaaagactttagctggtcaccaggagggaatattatagcgttttgggtccctgaggacaaagatataccagccagggtgacgttgatgcaactccctacaaggcaggagatacgagttcgtaatttgtttaatgtggtagactgcaagctccactggcagaagaatggcgactatctgtgtgtgaaggtcgaccggacacccaaaggcactcagggcgttgtgacaaattttgagatattccggatgcgagaaaagcaagtacctgtagacgtcgtcgaaatgaaggagaccattatcgccttcgcgtgggaacccaatggctctaagtttgccgtgcttcatggagaggctccaaggatctcggttagcttttaccatgtcaaaaataacggaaaaatcgagctcattaaaatgtttgacaagcagcaagccaacacaatcttctggtcgccgcagggtcagtttgtggtcctcgccgggctccgttcaatgaatggtgcacttgccttcgttgacacatctgactgtacggttatgaacatcgcagagcactacatggcgagtgacgtcgaatgggatcccaccggacgttatgtggtgactagcgtgtcctggtggagccataaggtggataacgcttattggctctggaccttccagggcagacttcttcaaaaaaataataaggaccggttctgccagctcctgtggcggccgaggccacctactcttctgagtcaggagcaaattaaacagataaaaaaggacctgaagaagtacagtaaaattttcgagcagaaggatcggctcagccagagcaaagcaagcaaagagttagttgaaaggcgtaggaccatgatggaagactttaggaagtatcgcaagatggctcaggaactctatatggagcagaagaatgaacgactggagctcagaggaggagttgacaccgacgaactggacagcaatgtggatgactgggaagaagaaactatcgaatttttcgttacagaagagatcatcccaggaattaggtctgacctggagcattgcgctcagccgtgtgtcctgtggtccagaggacgaccggctggatcccgcgtgacccccgcctcgtctctgtgttccctcgccctggactgtgactgcgcctggattctacccttacggcacatctttgttcccttctccccgtggtgcctgcagtgggggatatag

SEQ ID NO: 116293 - DNA, 2445 bp, Artificial Sequence
  Description of Artificial Sequence: Synthetic coding sequence
atgcaggacgctgaaaatgtggcagtgcctgaggcagccgaagaacgcgccgagcccggccagcagcagccagcagctgagccgcccccagcggagggattactgaggccagcagggcccggcgctcccgaagctgccggaactgaggcaagcagtgaagaggttggcattgcggaggcgggccctgaatcagaagtgaggacagagcccgccgccgaggccgaggccgccagcgggccatcagaatcacccagccccccagccgctgaagagcttcctgggagccacgccgaaccaccggttccagctcagggggaagcccctggcgagcaggcaagggacgaaagaagcgactcccgagctcaggctgtgagtgaagacgctggtggtaacgaagggcgcgctgccgaggccgaaccacgcgctctggaaaacggggacgccgacgagccatcctttagcgaccccgaggacttcgtggacgacgtgagtgaggaggaactcctgggtgacgttctgaaagacagaccccaagaggctgacgggatcgacagcgttatagtggtggataacgtcccacaggtgggtcctgaccgcctagagaagctgaagaacgtcattcataagatcttctctaaatttgggaagatcacaaatgacttctacccagaggaagatggcaagacaaaaggatacatctttctagaatatgcaagcccggcccacgctgtggatgcagtgaaaaatgccgatgggtacaagctcgacaaacaacacacattcagggtcaacctgttcaccgatttcgataaatacatgacaatctccgatgagtgggacatccccgaaaagcagccctttaaagatctcgggaacttgaggtattggctggaggaggctgaatgtagagatcaatattccgtgatcttcgaaagtggcgatagaacatctattttctggaacgacgtgaaagatccggtgtctatcgaagagcgtgccaggtggaccgagacatacgttcggtggtcaccgaagggcacctacctagctaccttccaccagagaggaatcgccctgtgggggggcgagaaatttaaacagatacagcggttcagtcaccagggtgtccagttgatagacttctccccctgcgaaaggtatctggttacattctcccctctgatggatacccaggatgatcctcaggccattataatctgggacattctcactggacataaaaagagaggttttcactgtgagtcaagtgcccattggcctatcttcaagtggtcacacgacggaaagttttttgctaggatgacactcgacaccctgtctatttacgaaactccttccatgggcttactggacaagaaatctctgaaaatttctggcatcaaggatttttcatggagtccaggtggcaatatcattgccttttgggtgccagaagacaaagatattccagccagagtgactctaatgcagttgcccacaaggcaggagattcgggtgcgcaatttgttcaatgtggtcgattgtaaacttcactggcaaaagaacggagactatttgtgcgtgaaggtcgaccggacacccaaaggaacgcaaggcgtggtaacaaacttcgaaatcttccggatgagagaaaaacaggtgcccgtggatgtagttgagatgaaagaaaccattatcgctttcgcttgggaacctaatggaagcaaatttgctgtgctgcatggcgaggctccacggatctctgtctcgttctaccatgtgaagaataacgggaagatcgagctcataaagatgttcgacaagcagcaggccaacaccatattttggtcaccccagggccagttcgtggtgttggcaggattaaggtcgatgaacggtgcattggcattcgtggatacatctgactgtaccgtcatgaatattgcggagcactacatggcatctgacgttgagtgggatccaaccggtaggtatgtggtgacaagtgtttcctggtggtcacacaaagtcgataatgcttactggctgtggactttccaaggacgtcttctccaaaaaaacaataaagaccggttttgccaactgctctggcgccctagacctcctactcttctaagccaggaacagattaaacaaatcaagaaagaccttaagaagtatagtaagatttttgagcaaaaagacaggctgagccagtctaaagcctcaaaggagctcgttgaaagaagaagaacaatgatggaggattttaggaaatatcggaagatggctcaggaactgtacatggagcaaaaaaatgaacggctggaacttcgcggaggagtcgatacagatgagctggacagcaatgttgacgattgggaggaggagaccattgaattctttgtgacagaggaaattattccacttggcaaccaggaatag

SEQ ID NO: 116294 - DNA, 2445 bp, Artificial Sequence
  Description of Artificial Sequence: Synthetic coding sequence
atgcaggatgccgagaatgtcgccgtgccggaagccgccgaagagcgggccgagcctgggcagcaacagcctgcagctgagcccccccctgcagagggccttctccgacccgccggccccggggccccggaggcagctggaaccgaggcaagcagcgaggaggtcggcatagcagaggccgggcctgaatccgaagtgagaacggagcccgcagcagaagctgaagctgcctccggaccttccgagagtccctcccctcctgccgctgaggagctacccggctcgcatgcagagccaccagttcctgcacagggcgaggccccgggcgaacaagccagagatgagcgcagtgattcccgagcccaagccgtatctgaagacgccggggggaacgaaggaagggccgccgaagcggaaccgagagctctggagaacggggatgccgatgagccctctttctcagatccggaggattttgtggatgatgtgtcagaggaggaattattaggcgatgttttgaaggatcgaccacaggaggccgatggcattgacagcgtgatcgtggttgacaatgtgccacaggtgggccctgacaggctggaaaagttaaagaacgtgatccacaaaatcttctcaaagtttgggaagattacaaacgacttttaccctgaagaagatgggaagacgaaggggtacattttcctcgagtacgcatccccagcacacgccgttgacgccgtgaagaatgcagatggctacaagttggataagcagcacacgtttcgcgtaaacctctttacagattttgacaaatacatgactataagcgacgagtgggacataccagaaaagcagccttttaaggaccttggcaatctcaggtattggttggaggaggcagagtgtcgcgatcagtactccgttattttcgaatctggcgatcgaacttctattttttggaacgatgtgaaagatccagtctcaattgaagaacgcgctagatggaccgagacatacgtgcgttggtcccctaagggcacctatttggccacgttccaccagcgggggatcgctctgtggggaggggaaaaatttaagcaaattcagcgcttctcccatcagggcgttcagctgattgacttttctccctgcgaaaggtacctcgtgacattctctcccctgatggacacacaagacgacccacaggccatcataatctgggacatacttaccgggcataaaaagagaggcttccattgcgagtcatcagctcattggcccattttcaaatggtcacacgatggcaagttcttcgcgagaatgacccttgacacactaagcatctacgagacaccatccatgggattacttgataagaagtccttaaagataagcggcattaaggacttcagctggtctcctggtggaaacataatcgctttttgggttccggaggacaaagacatccctgcgagggtgacattgatgcagcttccgacccgccaggaaatccgtgttaggaatctatttaatgtcgttgattgtaagctgcactggcagaagaatggggactatctgtgcgtgaaagtggaccgaacacccaagggaacccaaggagtcgttacgaactttgaaatctttaggatgcgagagaaacaggtccccgtggacgtcgttgagatgaaagagaccatcattgccttcgcctgggagcctaacggtagcaagttcgcagtattgcacggtgaggccccgaggatctccgttagtttttatcacgtgaagaacaatggcaagatcgaactaatcaaaatgttcgacaagcaacaagccaataccatcttttggtctccacagggccaattcgtggtcctcgccgggcttagaagtatgaacggagcactcgcattcgtggatacgtctgattgtactgttatgaacatcgccgagcactatatggcctccgacgtcgaatgggatcctacaggccgctatgtggtgacatcagtgagctggtggtcccataaggtcgacaacgcatactggctctggacctttcagggccgcttgctacagaaaaacaacaaggaccgtttctgtcaactcctttggaggccacggccgcccactctgttatcccaagagcagatcaaacagatcaagaaggaccttaagaagtacagtaaaatctttgagcaaaaggatagactgtcacagtctaaagcctcaaaagaacttgttgagaggcgccgtacaatgatggaggactttagaaaataccgcaaaatggcccaggaactctacatggagcaaaaaaacgaacggctcgagctgcgggggggcgttgacacagacgaacttgactctaatgtcgatgactgggaggaagaaaccattgaattttttgtgacggaggagatcatacctttaggcaatcaggaatag

SEQ ID NO: 116295 - DNA, 2217 bp, Artificial Sequence
  Description of Artificial Sequence: Synthetic coding sequence
atgcaagatgcagaaaatgtggcggtgcccgaagccgctgaggagagggcagggtctcacgccgaaccgcccgttccagcacagggggaagccccaggagaacaggcaagagatgaacgttccgatagccgcgcgcaggcagttagcgaggatgctggcggcaacgagggaagggctgccgaggcagagcccagagctctggagaacggagatgccgacgagccctccttcagcgatcctgaggacttcgtagatgatgtcagtgaggaggagctgctgggcgacgtgctgaaggaccggccacaggaagctgacggaatagacagcgtgattgtagtggacaacgtccctcaggtaggcccagaccgtctggaaaaactgaaaaacgtgatccataaaatcttcagcaagttcggcaagatcacaaacgacttctatcctgaagaggatgggaagaccaagggttacatatttctggagtacgcatcccctgcccacgcagtcgacgctgtgaagaatgccgacgggtacaaattagataaacaacacacattcagggtcaatctcttcacagacttcgataaatacatgactatcagcgacgagtgggatattcctgagaagcagccattcaaggacttaggtaatctaagatactggctggaagaggcagaatgccgagaccagtattcagtgatctttgagtccggcgaccgcacatccattttctggaatgacgtcaaggatccggtgtctatcgaagagcgagccaggtggacagagacctatgtgcggtggtctccaaagggtacgtacctggccacctttcatcagcgtggcatagccttgtggggaggagagaagttcaaacagattcaacgcttctcacatcagggagtccaactaatcgatttcagcccgtgcgaacgatacctggtgacattctcaccactcatggacacccaagatgatccacaggcaatcataatttgggacatcctcacaggtcataagaagcgcggtttccattgcgaatcctcagcccattggcccatattcaaatggagtcatgatgggaagttcttcgctcggatgacactggacacattgagtatttatgaaacgccttccatgggactgcttgacaagaaatctctcaagatttcaggcattaaggatttctcctggagcccgggggggaacatcatcgccttctgggtaccagaggacaaagatatcccagccagggtcactttgatgcagttgccaacacggcaagaaattcgtgtgaggaacttattcaacgtggtggactgcaagctgcactggcagaagaacggcgattacctgtgcgtcaaggtggacaggacccccaagggaacccagggggtggtgactaactttgagatttttaggatgcgggagaagcaggttccagtggacgtggtcgagatgaaggagaccattattgctttcgcatgggagcccaatgggtctaagttcgccgtcctccacggagaagcccctagaatctccgttagcttttaccacgtcaagaataacggcaaaatagagttgattaagatgtttgacaaacagcaggctaatactattttctggtcaccacaaggccagtttgtggtgctcgcaggcctgaggtctatgaatggagcccttgcctttgttgacacttcagattgcacagtcatgaacatcgccgagcattacatggcaagcgatgtggagtgggaccctacaggaaggtacgttgtgaccagcgtaagctggtggtcacacaaggtggacaacgcctactggctttggacattccagggccgtctgctgcaaaaaaacaataaggatcgtttctgccaactgttgtggaggccccgtcctcctacccttctgtcccaggaacagataaaacagataaagaaagaccttaagaagtacagcaaaatctttgaacagaaagacagattatctcaatccaaggcaagcaaggagctggtggagcgccgaaggactatgatggaggactttcggaaatatagaaagatggcccaagagttgtacatggagcagaaaaatgagagactggaactaagagggggcgttgatacggatgagttagactcaaacgttgacgattgggaggaggaaaccatagaattctttgttacagaggagatcattccactggggaatcaggaatag

SEQ ID NO: 116296 - DNA, 2742 bp, Artificial Sequence
  Description of Artificial Sequence: Synthetic coding sequence
atgtccaggttctttacgactggctccgactctgaatcagagagttcccttagtggcgaggagctcgtgactaaacctgtaggcggcaactacggtaagcagccacttttactcagcgaagacgaagaggacaccaaaagagtcgttcggagcgcaaaggataaaaggtttgaggagctcaccaacctgatcaggacaattagaaacgcgatgaaaattcgggatgttactaagtgtctagaagagttcgaactcctaggtaaggcttacggcaaagccaagagtatcgtcgataaggaaggtgtcccaagattttatataaggatccttgctgacctggaggactacctcaacgagctttgggaggacaaggaaggcaagaagaagatgaacaagaacaacgccaaagccctttctactcttcgccagaaaatcaggaagtacaacagggactttgagagccacataacttcatacaagcagaaccccgagcagtctgccgatgaagacgctgaaaagaatgaagaggattctgaaggatctagtgatgaagatgaagatgaggatggagtgagcgccgctacattcctgaaaaagaagtccgaagccccgagtggcgaatctcgaaagttcctgaaaaagatggacgacgaggacgaagattcggaggacagcgaggacgatgaggattgggatactgggagtacttctagcgattccgatagtgaagaagaagagggtaagcagacagcactcgctagccgctttctgaagaaggcccccacaacggatgaagataaaaaagccgccgagaagaagcgggaggataaggctaagaaaaagcatgatcggaagagcaagcgcctggatgaagaagaggaagacaacgagggtggcgagtgggaacgggtgcgcggaggagtaccactggtgaaggagaagccaaaaatgtttgcaaaaggcaccgagatcacccacgccgttgtaattaagaagctgaacgaaatcctgcaagcgagggggaagaaaggcaccgaccgagcagctcagattgagttgctgcagctgctggtgcaaattgccgccgagaataacctgggggagggggtgatcgttaaaatcaagttcaatatcattgcttcactttatgactacaacccaaatctggccacctatatgaagccagagatgtggggtaagtgcctcgactgtatcaatgagctgatggacattttgttcgccaatcccaatatttttgtcggtgagaatattctggaagagtccgaaaacctgcacaacgctgatcagccacttagagtgcgagggtgtatccttactctcgtggagcgcatggatgaagagttcaccaagatcatgcagaatacagatccccactcccaagaatacgtcgaacacctgaaggatgaggcacaagtgtgcgccatcattgaacgcgtgcagcgctacctagaagagaagggaaccaccgaagaagtgtgtaggatttatcttctgcggatcctgcacacctattacaaatttgactacaaggcccaccagaggcagctgaccccgcctgaaggctcatcaaaatccgagcaggaccaggctgaaaacgaaggggaagacagcgccgtgctgatggagaggctgtgcaagtacatttacgccaaggaccgaaccgacagaatacgcacctgtgccatcctgtgtcacatatatcaccacgccctccacagccgctggtaccaggcccgggaccttatgctcatgtcccatctccaggacaacatccagcacgctgatccacccgtgcagatcttgtataaccggacaatggttcaactcgggatttgtgcctttcggcaaggtctaacgaaggatgcccacaacgccttactagatattcaatcaagtggccgcgctaaggagctgttaggacagggtctgctgttgcgctctttgcaagaacgaaatcaagagcaggaaaaggttgagcggcgcagacaggttccattccatctgcatatcaacctcgaactgctggagtgcgtctacctggtgtccgccatgttactcgagataccatacatggcggcccacgaatcggacgcgcgccgccgaatgatatccaaacaatttcaccaccagttgcgcgtgggcgagcgccagcccctgctcggcccgcctgagtccatgagggagcacgtggtggcggcatcaaaagccatgaagatgggagactggaagacatgccacagtttcattatcaatgagaagatgaatgggaaggtgtgggaccttttccccgaggctgacaaggtgaggaccatgcttgttcgaaaaatccaagaagagtcactgcgcacctatctgttcacctactcatctgtgtatgatagcattagtatggaaacccttagcgacatgtttgaactcgacctacctactgtgcattctatcattagcaaaatgatcatcaacgaagagctgatggcatccctggaccagccaacccagacggtagtcatgcatcgcacagagcccactgcacagcaaaatctcgcgctgcaattggcggaaaaactggggagcctggtcgagaacaatgaaagggtctttgaccataagcagggaacatatggcggctactttcgcgaccagaaggatggttatcgaaaaaatgaaggatatatgcgccggggcggatacaggcagcaacaaagccagactgcctactag

SEQ ID NO: 116297 - DNA, 2286 bp, Artificial Sequence
  Description of Artificial Sequence: Synthetic coding sequence
atgagcaggttcttcaccactgggtctgactctgaaagcgagtcgtccttgagcggtgaagaactcgttactaaacccgttgggggcaattacggtaaacagcctctcctcctgagcgaagatgaagaggacactaaaagggtagtgcggagcgccaaggacaaacgttttgaagaactgacaaatctcattaggacaattcgaaacgcaatgaagatcagggatgttactaagtgcttagaggagttcgaattactcggaaaagcttacgggaaggctaaatcgatagtggacaaggagggcgtgccacgtttctatattagaattctggccgatctggaggattatctgaatgaactgtgggaggacaaggaggggaaaaaaaagcatgatagaaaaagtaagagattagacgaggaggaggaagataacgaggggggggagtgggagcgagtgagggggggcgtaccgctggtcaaagagaagcccaagatgtttgccaaaggaacagagatcacccacgccgttgttataaaaaaactcaatgagatactccaggccagaggaaagaaggggactgacagggccgctcagatagagctcctccagttgctggtacagatcgccgccgagaataacttaggtgagggcgtgattgtcaagatcaagttcaatatcattgcttccctctacgactacaaccctaacctagccacctatatgaagcctgagatgtgggggaagtgcttagactgtatcaatgagctgatggacatcctttttgctaatcctaatatattcgtgggcgagaacattctcgaggaaagtgagaacctccataacgcggatcaacccctcagagtgcggggctgtatcctaacactggtggaaagaatggacgaagagttcactaaaatcatgcagaataccgatccccacagtcaggaatacgtagagcacttgaaggatgaggcacaggtgtgtgctatcatcgagagggttcagcgctatcttgaagagaaggggacaacagaagaagtgtgtaggatttatctgcttcggatcctccacacttattacaagtttgactacaaggcccaccagagacagttgacacctcctgaaggtagcagcaaatccgagcaggatcaggcagagaacgaaggggaggacagcgctgtgttgatggaacggctttgcaaatacatatatgcgaaagatagaaccgatagaattagaacatgcgccatactgtgccacatctaccaccatgccttacatagcagatggtaccaggccagagatctgatgctgatgagccatttgcaagacaacatccagcatgcagatccgccagttcagatattgtataaccggacaatggtccagcttggaatatgcgcctttcgccagggactgacaaaagatgcccacaacgcacttttagacatacagtctagcgggcgggccaaagaactcctggggcagggtctgctcctgcgctccctgcaggagaggaatcaggagcaggagaaggtggaacggaggagacaagtcccattccatctgcacatcaacctggaactccttgagtgcgtctatttggtgtctgccatgcttctcgaaattccctacatggcagctcacgaatcggatgctaggcgaagaatgatctctaagcagttccaccatcagctcagggtgggggagagacagccacttctgggaccaccagaatctatgcgcgaacacgttgtggccgcctcaaaagccatgaaaatgggcgactggaagacctgccactcttttattattaatgaaaagatgaacggcaaagtgtgggatttattcccagaggcagataaagtgcgcacgatgctggtaagaaagattcaggaggaatctctccgtacctatctgtttacatattctagtgtttacgacagtatcagcatggagaccctttccgacatgtttgagttagatctgcctacggtgcactcaataatatcgaaaatgattatcaacgaggaactcatggcatcccttgatcaacccactcagacagttgtgatgcaccgaacagagcctacagcccagcagaatctcgccttgcagttggccgaaaaactgggctccttagtggaaaataacgagcgggtgtttgatcacaaacagggaacctacggaggatactttagagatcagaaagacggctacaggaagaacgagggatatatgcgtcgtggagggtatcgtcagcaacaatcccagaccgcctactag

SEQ ID NO: 116298 - DNA, 2742 bp, Artificial Sequence
  Description of Artificial Sequence: Synthetic coding sequence
atgtcccgattcttcaccaccggaagtgacagcgaatctgagtcttcactgtccggcgaagaattggtgacaaaacctgttggcgggaactacggcaaacagcccctgttactctccgaagacgaagaggataccaagagggtggtgaggagcgcgaaagacaaaaggtttgaagagttgaccaatctaatccgcaccatccggaacgcgatgaagatccgggacgtgaccaagtgtctcgaggagtttgaactgctgggaaaagcatatggtaaagctaaatctatcgtggacaaggagggcgtgccacgcttctatatacgcatcctggccgatctggaggattacttaaacgagctgtgggaggacaaggaaggaaaaaaaaaaatgaacaaaaataatgctaaagccctcagcacactgagacaaaagatccgaaagtacaatcgggactttgagtcgcacatcacctcttataagcagaacccggagcagtctgccgatgaggatgcagaaaagaatgaggaggacagtgagggcagcagcgatgaggacgaggacgaggacggggtgtcagctgcaacctttttaaaaaagaagtctgaggccccatcaggggagagccgaaaattccttaagaagatggatgatgaagacgaagattccgaagacagcgaggacgatgaggactgggacaccgggtcaactagcagtgactcagattctgaggaggaagagggcaaacagaccgccttagcatctcgatttctcaagaaagcccctaccactgacgaagacaaaaaggcagctgaaaagaaaagggaggacaaagctaaaaagaagcatgatcggaagagtaaaagacttgacgaagaggaagaggataatgaggggggcgagtgggagcgcgtgcgggggggcgtaccattagtgaaggaaaagccaaagatgtttgcaaaggggaccgagatcacccatgcagtagtcattaaaaaactgaatgagattcttcaggcgcgcggcaaaaagggcacggatcgcgccgcacagatcgaacttctgcagttgctggtgcaaattgctgctgaaaataatctaggcgaaggggttatcgtgaagattaaattcaatatcattgcgagtctgtacgactacaatccaaacttggctacgtacatgaaacccgaaatgtggggcaagtgcctggactgtattaatgaactcatggatatcctcttcgcgaatcctaacatatttgtcggtgagaatatcttagaagaatccgaaaatcttcacaatgccgatcagccactcagagtcaggggttgtatactgacacttgtggaacggatggatgaagagtttaccaagatcatgcagaatacagacccgcactctcaagagtatgtagaacatcttaaggatgaggctcaggtctgtgcgattattgagagagtgcagcggtatctggaagagaaaggcaccacggaggaggtgtgtagaatttacttgctcagaattctgcacacatattacaaatttgattataaagcgcaccagcgtcagttgactccgccagaggggagttcaaagtccgaacaggatcaggccgaaaacgagggggaggatagcgccgtgctaatggaaagactgtgcaaatatatttacgctaaggacagaaccgataggattcggacatgtgcaattctgtgccacatctaccatcatgctctgcacagcaggtggtaccaggcccgagacctaatgctcatgtcacatctgcaggacaatatccagcacgccgatcccccagtccagatcctctataataggaccatggttcaactggggatctgtgcattccgccaagggctgaccaaggatgctcataatgcactgctggatatacagtcctcaggtcgtgctaaagaactgctagggcagggcctcctccttaggtctctgcaggaaaggaatcaagagcaggaaaaggtggagcgaaggcggcaggtgccatttcacctccatattaaccttgaactgctggagtgcgtgtatctggtatccgcaatgctgcttgagatcccatatatggctgctcacgagtcagacgcccgccgccggatgatctctaaacagtttcaccaccagctgagggttggagaacgccagcccctgctcggccctccagagtccatgcgcgagcacgtggtcgcagcctctaaggctatgaaaatgggagattggaagacctgccattctttcatcatcaacgagaaaatgaatggtaaggtgtgggatttatttccagaggcggacaaggtgaggacgatgctggtcaggaagattcaggaagagagtctgcgtacctatctgtttacatactcatctgtttatgactctatctctatggagacccttagcgacatgtttgaactggacttgcccacggtccacagcattatttccaaaatgatcataaatgaggagctcatggcctctcttgaccagccaacacagaccgtcgtaatgcatcggactgaacctaccgcccaacagaatctcgcgctgcagctggccgagaagctggggagtctggtcgagaacaatgaacgggtttttgaccacaagcagggaacttacggaggctactttcgcgaccaaaaggatggctaccggaagaacgaggggtatatgcgccgcgggggttatcgccaacagcaaagtcagaccgcctactag

SEQ ID NO: 116299 - DNA, 2208 bp, Artificial Sequence
  Description of Artificial Sequence: Synthetic coding sequence
atgagccgattcttcactaccgggtcagattcggaatctgagtcttctttgtccggtgaagagctggtcactaaaccagtcggcggaaactatggcaaacagccactgcttctgagcgaggatgaagaagacactaaaagggtggtgcggtccgccaaggacaagaggtttgaggagctgaccaaccttatccgaactattcgaaacgcgatgaagatccgcgacgtcactaaatgtttggaggagtttgagcttctgggaaaagcgtacgggaaggcgaaatcaatcgtggacaaagcaaagaagaagcatgatcgtaaatccaaacgcttggatgaagaagaggaagataacgaagggggagaatgggagagagtgcgtgggggcgtgcctctagtcaaggagaaacccaagatgttcgcgaaggggaccgaaattacccacgccgtcgtaattaagaaactaaacgaaatcctgcaggcaagaggcaaaaaggggaccgatcgggccgcgcagatagaattgctgcagcttctggtccagatagcggcggagaacaacctaggcgagggcgtcatcgtcaaaattaagttcaacattattgccagcttgtacgactacaacccaaacctcgccacctatatgaagccagagatgtgggggaagtgcttggactgtataaatgagctcatggacattttattcgcgaaccctaacatctttgtgggagagaacattttggaggagtctgaaaatctccacaatgccgatcagccactaagagtaagagggtgtatccttaccctcgtagagcgtatggatgaggagttcaccaaaatcatgcagaacacggatccccacagccaagaatacgtggagcatctaaaagacgaggcccaggtgtgtgcaattattgaacgggtgcagaggtatctcgaggagaagggcacaacggaggaagtgtgccgcatttacttgctcaggattctgcacacttactacaaatttgattacaaggcgcaccagagacagctgaccccgccagagggatctagcaagagcgaacaggatcaagcagagaacgagggggaggattccgcggttctaatggaacgactctgcaaatacatatacgccaaagaccgcactgatagaatcagaacctgtgccatcctgtgccatatctaccatcatgccttacacagccgctggtaccaggccagggacctgatgctgatgagccacctgcaggacaatattcagcacgccgatcctcctgtgcagatcttatacaatcgtaccatggtgcagctcggcatctgcgcatttaggcagggacttaccaaggatgctcataatgctcttctagacattcagagttctggtcgggctaaagagctgttaggccaggggctgctgttacgtagtctgcaggaacggaatcaggaacaggaaaaggtggaacggcgccggcaggtgccatttcacctgcacatcaatctggagctcctggagtgcgtatacctggtttcagctatgttacttgaaatcccatacatggctgcacatgagtctgatgcgcgccggaggatgataagcaaacagtttcatcatcagctgcgtgttggggaacgccagcccttgctggggccccccgagtctatgagagaacacgttgttgctgccagtaaagctatgaaaatgggtgactggaagacatgtcactcgttcattatcaacgagaagatgaacggtaaggtatgggacctctttcccgaggccgataaggtgagaaccatgctggttcgcaagatccaggaagaaagtcttagaacctacctgtttacgtatagtagcgtgtatgatagtatatcaatggagacactgtctgatatgtttgagctggacctgcctaccgttcactccataatctcaaagatgattattaacgaagaactcatggcctcccttgatcagcctacacagaccgtggtcatgcatcgtaccgagccgaccgcccagcagaatctcgccctccagttagccgaaaagctgggcagtttggtggaaaataacgagagagtctttgatcataagcaggggacctatggcggctatttcagagatcagaaggatgggtataggaaaaacgagggctacatgcggcgcggcggttacaggcaacagcagtcccaaacagcttactag

SEQ ID NO: 116300 - DNA, 2697 bp, Artificial Sequence
  Description of Artificial Sequence: Synthetic coding sequence
atgagcaggtttttcacaaccggtagcgattcagagtccgagagctcactctcgggtgaagagcttgtaacgaaacctgtgggtggaaactacggtaaacagcctcttctgctgagcgaagatgaggaagatactaagagagtcgtaagaagcgccaaggacaaacggttcgaggaacttacaaatctgatccgaacaattcgaaacgccatgaagatccgtgacgtcaccaagtgcctggaggagttcgagcttctcggaaaggcgtacgggaaggccaagtcgattgtggataaagagggagtaccacgtttctacattcgtattttggccgacctcgaggattacctcaatgaactctgggaggataaggagggaaagaagaagatccgtaagtataatcgcgatttcgagtcccacatcaccagctacaagcaaaaccccgagcaaagcgcggacgaagatgcagagaagaacgaagaagatagcgaaggatcctccgacgaggatgaagacgaggatggcgtaagtgctgccacttttctcaagaaaaagagcgaagcccccagcggggaatccaggaagtttctaaaaaagatggatgacgaggacgaagattccgaggatagcgaagacgatgaggactgggatacaggaagcaccagctcagacagtgatagcgaagaggaggaaggaaaacagaccgccctggcgtcacgttttcttaagaaggctcccactaccgacgaggacaagaaagctgctgagaaaaagcgagaagacaaggccaagaagaagcatgatcgaaagtccaaaaggctggatgaggaggaggaagataatgagggaggggaatgggagcgcgtccgcggtggcgttcccttggtcaaagaaaaaccaaagatgttcgcgaaaggaaccgaaatcacccacgctgtcgtgattaaaaaattaaacgaaattctgcaagctagggggaagaaggggacagacagagctgcccagatcgaattgctgcagctgctggttcagatagctgctgaaaataacctgggcgaaggtgtcattgtgaagatcaagtttaatattatagccagtctgtacgactataatccaaacctcgccacctatatgaagcctgagatgtggggcaagtgtctggactgcattaatgagttgatggacattctctttgccaacccaaacatcttcgtaggagagaatattctggaggagtccgaaaacctgcacaatgcagatcagccactgcgcgtgcgcggatgtattctgactctcgttgaacgcatggacgaggagttcacaaagatcatgcagaatactgatcctcattcccaggagtacgttgagcacctgaaggatgaagcccaggtgtgcgccataattgaaagggtgcaacgttatctcgaggagaagggtacaaccgaggaggtctgcagaatttatctcttgcgcatactgcatacctattataagtttgactataaagcccatcagaggcaactgacgcctcccgagggatcatcgaagtcagagcaggatcaggcagagaacgagggcgaggactctgcggtcctgatggaacggctgtgtaaatacatatatgccaaagacagaaccgatcgcatccgtacttgcgccatcctgtgccacatatatcaccacgccctccatagcaggtggtatcaagctcgcgatcttatgttgatgtcacacctccaggacaatattcagcatgcggatcccccagtgcagatcctttataaccggacaatggtgcagcttggaatatgtgcatttcggcagggcctcacgaaggatgcgcacaacgcgctgctcgacattcagagtagcgggagagccaaggaactccttggccaaggtctgctcctccggagccttcaggagcggaatcaggaacaggagaaagtcgagcggcggaggcaggtgccatttcatctgcacatcaacctagaattacttgagtgtgtttacctggtcagcgcaatgttgctcgagatcccttatatggctgcgcatgagtctgacgctaggagaagaatgatttctaaacagttccaccaccagcttagggtgggagaacggcagcctcttctgggcccaccggagtctatgcgggaacacgtggttgcagctagtaaagccatgaagatgggagattggaaaacctgccattcatttattatcaacgaaaaaatgaatgggaaggtttgggacctgttcccagaagcagataaagtgcggacaatgttggtgcggaagatacaggaggagagcttgcgcacatatctcttcacgtatagctccgtgtacgactccattagtatggagacactgtccgatatgttcgagctagatttacctacggtgcattctataatctctaaaatgattatcaacgaggaactaatggcaagtctggatcagccgacacagacggtggtgatgcacaggacagagcctaccgctcaacagaacctggcactgcagctcgcggagaaattgggctccttagtggaaaacaacgaaagggttttcgaccacaagcagggcacctacggaggatacttccgcgaccaaaaggatggctaccggaagaatgaggggtacatgcggcggggtggctatcgccaacagcagtcgcagaccgcgtattag

SEQ ID NO: 116301 - DNA, 2055 bp, Artificial Sequence
  Description of Artificial Sequence: Synthetic coding sequence
atggggctaagcgctgctgccccactttggggccctcccggtctcctacttgccatcgcactccatcctgctctctcagtgccccctcgcagagactattgcgtactgggagcggggcctgctggcctgcagatggcatattttctgcagagagctgggagagattatgcagtgttcgaaagggcccctcgaccgggcagcttctttacccgctacccacgacaccgcaagctgatcagtattaacaagcgatatactggaaaggcgaacgctgaattcaaccttaggcacgactggaattcactgctgagccacgaccctagactgttattcaggcactattcccgcgcttacttcccagacgcccgcgacatggtgcgctatctcggagatttcgctgacacactcggcttgcgggtgcaatataacaccacaatcgcccacgtgacactggacaaagaccgacaagcttggaatgggcactactttattctgactgatcaaaaggggcaggtccaccagtgcagcgtcttgtttgtggccactggcctgagtgtgcccaaccaagtggattttccaggcagcgagtacgccgaagggtacgagtcagtaagcgtggaccctgaagactttgtggggcagaacgtgcttatcctgggcagaggaaacagtgccttcgaaacagctgaaaacattctcggagtgaccaatttcatacacatgctttccagaagtcgtgttaggctttcatgggccacacactatgtgggggacttaagggcaatcaacaacggactcctggacacctaccagctgaagtctttagacggtttactggagtcagacctgacagatcttgccattttgaaggacagcaaaggcaaattccacgttaccccgaagttttttctggaggaagctaataccaaccagtcagccgactctatcactctgccacaggacgacaacgacaactttgccatgcgcgtgccctacgatcgggtcataagatgtttagggtggaatttcgattttagtatctttaacaagtcactgcgcctaaactctgggaacgcattcggtaagaagtacccacttatacgggctagctatgaaagtaagggtagccgcggcctcttcatattgggaactgccagccacagcgtggactaccgtaagagcgcaggagggtttattcacggttttaggtataccgtgagagccgttcatcggttgctagaacaccggcaccactccgtgacatggcctgccactgaactgcctattacccagctgacctcttcaatcgtgcgcagagtgaatgaggcatccggcctgtaccagatgttcggagtgctggcggatgtaatactcctgaaggagaactccactgccttcgagtatctcgaggagtttcccattcagatgttggcccagctggagacgctgacgggcaggaaggcgaaacacggcttgtttgtgattaacatggagtacgggcggaatttttccgggcccgacaaagatgttttctttgacgatcgcagcgtcggtcatacagaagatgcttggcagtctaactttctgcatcctgttatctattattaccggtacctacctaccgaacaagaagtgaggtttagacccgcgcattggcccttgcccaggcccacggctattcaccacatcgtcgaagatttcttgactgactggaccgctcccattggccatattctccctttaaggcggttcctggagaattgcctggacactgacttacgctccttttacgctgagtcttgtttcctgtttgcacttacaaggcagaagctgccaccattttgccaacagggctacctgaggatgcagggactagtgtccacagagagcctgtggcaacatcgagtggagtctagactgttgcgtgattatgccccaacagggcggcgacttgaggattcatcccagcagcttggcgatcaggagccactaggtagccctctggccccaggaccactggcccagagtgtcgacagtaataaagaagagctgtag

SEQ ID NO: 116302 - DNA, 1602 bp, Artificial Sequence
  Description of Artificial Sequence: Synthetic coding sequence
atggctaaattcatgacccccgtaatccaagataatccttccggctggggtccatgtgccgttccagaacagtttagagatatgccttaccagccttttagtaaaggcgacaggctcggaaaggttgccgattggaccggggcaacgtatcaggataagaggtacactaacaagtactcatctcaattcggtggcggatctcagtacgcctacttccatgaggaggatgagtctagttttcaactcgtggatactgctcgcactcagaaaacggcttatcagcgaaacagaatgcggtttgcgcaaaggaacctgagacgagataaggatagaagaaatatgctccagtttaatctgcaaattctgccaaagtcagctaagcagaaggaacgagagcgcattcgacttcagaagtcacagaagcctagggattctagcgtggaagttagatctgactgggaggtcaaagaagagatggactttccgcagctcatgaaaatgagataccttgaagtctcagagccacaagatatcgaatgctgcggtgctctcgagtattatgataaggcctttgatagaattacgactagatcggagaagccgctcaggtccataaagcggattttccacaccgtgactaccaccgacgacccggtcatacgaaaactggcaaagactcaggggaacgtgtttgctactgatgctatcttggccactctaatgtcatgcaccagaagtgtgtactcgtgggacatagtcgtgcagcgcgtcgggagtaagctctttttcgacaaacgagacaattcggactttgacctgctaactgtcagtgagactgcgaacgagcctccacaggacgaaggcaactcttttaactctccacgcaacctcgctatggaggcgacatacattaaccacaatttttctcagcaatgcctgagaatggggaaggagcgatacaactttccaaatcctaatcccttcgtcgaagacgatatggataagaatgagatagccagcgtagcataccgctatcgcagatggaaactgggggatgacatagatttgattgtgcgctgcgaacacgacggtgtcatgaccggcgcaaatggcgaagtctctttcatcaatattaagactctgaacgagtgggattcgcgacactgtaatggcgtagactggcggcaaaagctcgactcccagcggggagccgtgattgcgacagaactgaaaaataactcctacaaacttgctcggtggacctgctgtgctcttttagctggctcagagtacctcaagttgggatatgtatctagataccatgtgaaggactcctcacgtcacgtgatccttggcacacaacaatttaagccgaacgagttcgcctctcaaatcaacctgtccgtcgagaacgcttggggcatcttgagatgtgtcatcgatatctgcatgaagttggaggaagggaagtatctcattctgaaggacccaaataagcaggtgatcagagtatatagcctgccagatggcactttcagctctgatgaggacgaggaagaagaggaagaagaggaggaggaggaggaggaggaagagacatag

SEQ ID NO: 116303 - DNA, 372 bp, Artificial Sequence
  Description of Artificial Sequence: Synthetic coding sequence
atggcaaaatttatgactccggttattcaagacaacccttcgggatggggaccttgtgcagtacctgagcagttcagagatatgccgtaccagccatttagcaaaggcgatcggctgggcaaggtcgccgattggacaggcgccacctaccaagacaagcgatatactaataaatattcttctcagttcgggggtgggtctcagtacgcttacttccatgaggaggatgaaagttccttccagttggtggatactgcaaggactcagaagacggcctatcagcgcaacagaatgcgttttgcgcagcgcaacctgcgaagggataaagaccgacgcaacatgttgcaatttaacctccagatcctgccgtag

SEQ ID NO: 116304 - DNA, 1647 bp, Artificial Sequence
  Description of Artificial Sequence: Synthetic coding sequence
atggccaagttcatgacccctgtgattcaggataacccttcaggttggggcccatgcgccgttcccgagcagttccgggatatgccttatcaacctttttccaagggcgataggctggggaaggtggcagactggacaggtgcaacctaccaggacaagcggtataccaacaagtactcaagccagtttggcggaggttcccagtacgcctactttcacgaagaggatgaatcctctttccaactggtagatacggcccgcacccagaaaacagcctaccagcggaacaggatgcgctttgctcagaggaatcttagacgggataaggatagaaggaacatgcttcagtttaatctccaaatcttgcctaaatcagcgaaacaaaaagaaagggaaaggatacgcctgcaaaaaaaattccagaaacagttcggcgtgcgacagaagtgggatcaaaagagccaaaaacctcgcgatagcagtgtggaggtaagatctgactgggaagtgaaagaagagatggattttccccagctgatgaagatgcgctaccttgaagtgagcgaaccacaggacatcgaatgctgcggtgcgttggagtactacgacaaggcttttgatcggatcaccacacgcagcgaaaagcctctcaggtcaatcaagagaatttttcatacagtgaccactacagacgatcccgtgattcggaaactagcgaagacccagggaaacgtttttgccacagatgctattctcgcaacactgatgtcctgtactaggtcagtctactcttgggacatagtggtgcagcgggtggggagtaagctgttttttgataaacgcgacaacagtgatttcgacctgctgacagttagcgaaacggctaatgagcctccacaggatgagggaaattctttcaactcaccacgaaacctggctatggaagcaacttatatcaaccataatttctcgcagcagtgtctcagaatgggcaaggagaggtataattttccaaatcctaatccatttgtggaggacgatatggataaaaacgagatcgctagcgtcgcatacagataccgcagatggaagctcggagatgatatcgacctcatcgtgcgatgcgagcatgacggggtgatgactggcgcaaacggcgaagtgtcattcattaatattaaaaccctgaatgagtgggactcacgacattgtaatggagtagattggcgtcagaaactcgacagtcaacgcggggccgtcattgccaccgagctgaaaaacaactcttataaactggctcgttggacttgctgcgccttgctcgcaggcagcgagtacctgaaacttggctacgtgtctagataccatgtgaaggatagcagtcgtcatgtgatactgggaactcagcagttcaaaccaaacgagttcgcttcccagattaacttatcagtcgagaatgcctggggtattctccgatgcgtgattgatatttgtatgaagcttgaagagggcaagtatctcatcctgaaagatccgaacaagcaagtgattcgtgtttattccctgcccgatgggacattctcgtccgatgaagatgaggaggaggaggaagaagaggaagaagaggaggaggaggaggaaacctag

SEQ ID NO: 116305 - DNA, 519 bp, Artificial Sequence
  Description of Artificial Sequence: Synthetic coding sequence
atggacaagaatgaaatcgcaagcgtcgcatatcggtataggcgctggaaactcggagacgacatcgacctgattgtgaggtgcgaacatgatggtgtgatgactggcgctaacggcgaggtgagctttataaatataaagactctcaatgagtgggacagccgtcactgcaacggggtcgactggagacagaaactggattcccaaagaggagctgtgatcgcaactgaactcaaaaacaactcctacaagctcgcaagatggacctgttgtgctctactggccggatccgaatatctgaagctcgggtacgtgtcaagatatcacgtaaaagacagcagtcgtcacgtgattctcggcactcagcaatttaagccgaatgagtttgcttctcagataaatttgtctgtagaaaatgcatggggaatactgcgctgtgtgattgacatatgtatgaagctcgaggaagggaaataccttatcctgaaagatcccaacaagcaagttatacgggtttag

SEQ ID NO: 116306 - DNA, 561 bp, Artificial Sequence
  Description of Artificial Sequence: Synthetic coding sequence
atggcaaaattcatgactcccgtgatccaggataacccttcgggctggggaccctgtgccgtacccgaacagttcagagatatgccctaccagccattcagcaaaggagatagactcggcaaggtggcagactggaccggagcgacctaccaggacaagagatataccaataagtatagctcacaattcgggggcggatcccagtatgcctattttcacgaggaagatgagtcgagcttccagctcgtagacacagctcggacccaaaagacagcataccagcgaaatcggatgaggttcgcccaacgtaacctgcgccgggacaaggacaggcggaacatgctgcaatttaatctccagatcctgcctaagtccgcaaagcaaaaagagagagagaggatcagactccagaagaaattccaaaagcagttcggcgttcgacaaaaatgggatcagaagtcacaagtcatgtacttataccagaactcagcccttgagtttgggagcgtgtacctcgttgtgtttatcaactccttggacgagatctacttcacttattag

SEQ ID NO: 116307 - DNA, 810 bp, Artificial Sequence
  Description of Artificial Sequence: Synthetic coding sequence
atggctaaatttatgactcccgttatccaggacaatcctagtggatggggcccatgtgccgttcccgagcagttccgagatatgccttatcagcctttttcaaagggagaccgccttggtaaagtcgccgactggacaggagcgacttaccaggataaaagatacactaacaaatactcgtcccaatttggaggaggttctcagtacgcctactttcacgaagaggatgaatccagtttccagttggtggacacggctcgtacgcaaaaaacagcctaccagcggaaccgcatgaggttcgcccaacgcaacctccggagggacaaagacaggagaaatatgctccaattcaatcttcagatcctgccaaagtcagctaagcagaaagaacgggagcgaatccgtctccagaagaagtttcagaaacagtttggagtgcgtcagaaatgggaccagaagtcgcagaaaccccgcgattcgtccgtcgaggtgcgatctgattgggaggtgaaggaggagatggacttccctcagctgatgaaaatgagatacctcgaggtcagtgaaccacaggacatagaatgctgcggagccctggaatactatgataaagcctttgataggatcaccacaagatctgagaaacctctgcgttcaatcaagaggatttttcatacagtgactaccaccgacgatcccgtaattcgtaagctggctaagacccagggaaatgtcttcgctaccgacgctatcttagcaaccctgatgtcttgcacccggagtgtgtattcctgggatatagtcgtctag

SEQ ID NO: 116308 - DNA, 522 bp, Artificial Sequence
  Description of Artificial Sequence: Synthetic coding sequence
atggctaaattcatgacgccggtgatccaggacaacccgtctggctggggaccatgcgctgtgcctgagcagtttagagatatgccctaccagcccttcagcaaaggagatcgcttaggaaaggtggctgactggaccggtgctacttatcaggataagaggtacacaaacaaatactcatcccagtttggcggcggctctcagtatgcctactttcacgaggaggatgagagctccttccagctcgtcgatactgcccgaacacaaaaaacggcataccagcggaatagaatgagatttgctcaacgcaacctgcgcagagacaaggatcggcggaacatgctgcagtttaacttgcagatcctcccaaaaagcgcaaaacagaaggagagggagcgcatcaggttgcagaaaaagttccagaagcagtttggggtgaggcagaagtgggatcagaaatcacaaaaaccaagggactcctctgtggaagtgaggagcgattgggaggtgaaggaggagtag

SEQ ID NO: 116309 - DNA, 498 bp, Artificial Sequence
  Description of Artificial Sequence: Synthetic coding sequence
atggaggcaacctatataaaccataattttagtcaacagtgcctgaggatgggaaaggaacgttacaattttcctaatcccaaccccttcgtcgaagacgacatggacaagaacgagatcgccagtgtggcctacagatatcggaggtggaagctcggtgacgacatcgatttaatcgtccgctgtgagcatgatggagttatgaccggagctaatggcgaagtgagttttatcaatataaaaacattaaacgaatgggacagtcgccactgcaatggtgttgattggagacagaagctggactcacagcgcggcgcagtgatcgcaacagagctcaagaataactcctataagctggcacgatggacttgctgcgctctcttggcagggtcagaatacctcaagctgggctacgttagccgctaccatgtgaaagattcatcacgccacgtcatcctgggcacacaacagttcaagccaaacgagtttgccagctag

SEQ ID NO: 116310 - DNA, 1500 bp, Artificial Sequence
  Description of Artificial Sequence: Synthetic coding sequence
atggctaaatttatgacccccgtgattcaagacaacccctctggatggggcccttgtgcagtgcccgaacaattccgggatatgccctaccagccattctccaagggtgataggctgggcaaagtcgccgactggacaggggcaacttatcaggacaagcgcaatctccgcagagataaagacaggaggaatatgctccagtttaatctccagatactccccaagtccgctaagcagaaggagcgggagcgaatccgcctgcagaagaagttccagaagcagttcggtgtgcggcagaaatgggaccaaaagtcacagaagccacgcgatagtagcgttgaagtgcgctcagattgggaagtgaaggaggagatggatttcccccagttgatgaaaatgcgctacctggaagtgtccgaaccacaggatatcgaatgctgcggcgctcttgagtactatgacaaggcgttcgacagaataactacacgtagcgagaagcctttgaggagtattaaacgtatctttcacaccgtgacaaccacagacgatccagtgattagaaagctcgctaagacacaggggaacgtgttcgccaccgatgctatcctggcaactctgatgtcttgtactcgctctgtgtatagttgggacattgttgtgcagagggttggatcgaaactgtttttcgacaaacgagataacagcgatttcgacctccttacagtttccgaaaccgcaaacgaaccccctcaggacgagggcaattcctttaatagccctcgaaacctggccatggaggcgacatacatcaatcacaatttctctcagcagtgtttaagaatggggaaggaacgctataactttcccaatcccaatccattcgtagaggacgatatggacaagaacgagattgcttccgtggcgtacagatataggaggtggaagctcggcgacgacattgatttgattgtccggtgcgagcacgatggggttatgacaggagctaatggtgaagtgtcattcatcaacatcaaaactctgaacgaatgggacagtcggcattgtaacggagtcgattggaggcagaaactggactctcaacgcggcgccgtaatcgcaacagagctaaagaacaatagctacaagctggcaaggtggacatgctgtgcgcttctggcaggaagtgaatatcttaagttaggatatgttagtagataccacgtaaaggactcctctcggcacgtaattctgggaacccaacagttcaagcctaatgagtttgccagccaaataaacctctccgtcgagaatgcgtggggtatacttcgatgcgtgatcgacatatgtatgaaacttgaagaggggaaataccttattcttaaagatccgaacaaacaggtcatcagggtctattctctgccggacgggactttttcctctgacgaggatgaggaagaggaagaagaggaggaggaggaggaagaagaagaggaaacatag

SEQ ID NO: 116311 - DNA, 1215 bp, Artificial Sequence
  Description of Artificial Sequence: Synthetic coding sequence
atgttcacagagaagaccacgacctaccagtaccccagggccattcttagcgtggacctgtctggcgaaaacctttccgacgtcgacttcctggacgactctagcacggaatctctgctgctttccggtgacgaatacaatcaggactttgactcaacgaatttcgaggaaagccaagatgaagacgatgcccttaacgaaatcgtgagatgcatatgtgagatggacgaagagaatggcttcatgattcagtgcgaagagtgtttgtgttggcaacactccgtttgcatgggtctgttggaagagagtatccctgaacagtacatatgctacatttgcagggaccctcctgggcaaagatggtccgcaaaatatcgctacgacaaggagtggttgaataatgggaggatgtgcggactgtcattttttaaggagaactacagccacctgaacgcaaagaagatcgtgagcacacaccacctgctcgccgacgtgtacggagtgactgaagtgctccacggcctccaactcaaaatcggaatcctgaaaaacaagcaccaccccgatctgcacctttgggcttgtagtggcaagcggaaagaccaggatcagattatcgctggcgtggagaaaaagatcgcccaggataccgtcaatcgggaagagaagaagtacgtccaaaaccacaaggagccacccaggctcccgctgaagatggagggcacctacattacatcggagcactcctaccaaaaacctcagtctttcggccaagattgcaaatcacttgctgaccccggaagttccgacgacgatgatgtgagtagtctggaagaagaacaagagtttcatatgagaagcaagaattcactccaatactcagctaaggaacacggaatgccggagaagaatcccgcagaggggaacacagtcttcgtgtataacgataaaaaagggacagaggacccaggcgactcacacctgcagtggcaactaaatctgctgacccacatcgagaacgtccagaatgaagttactagccggatggacctcattgagaaggaagtggatgtattggaaagctggctggactttacaggtgaattagaaccaccagacccacttgctcggctcccacagcttaagaggcacatcaagcagcttctcatagacatgggcaaggtacagcagatcgctactctgtgttctgtgtag

SEQ ID NO: 116312 - DNA, 1074 bp, Artificial Sequence
  Description of Artificial Sequence: Synthetic coding sequence
atggctacaccggccgtgccggttagtgctcctcccgccactccgactcccgtgccggccgccgctcctgccagcgtccccgctccgaccccagccccggccgccgctcctgtccccgctgctgcccctgcatccagtagcgacccagcagccgctgccgcagccaccgctgcccccggacagacaccagcttccgcccaggctccggcacagacacctgcccccgcacttcctggacctgccctccccgggccattcccgggtggaagggtggtgcgactgcacccagtgattctggcctcaatcgtggatagctatgagcgtaggaatgagggggctgcacgcgtcatcgggactctccttggtaccgtggacaagcattccgtggaggttacgaactgtttttctgtgccgcataatgagtccgaggacgaggtcgctgtggacatggagtttgctaagaacatgtatgaactgcacaaaaaggtgtctccgaacgagttgatcctgggatggtacgcaaccggccatgatatcaccgagcacagcgttctgatccacgaatattattctagggaagctcccaatcccatccatttgactgttgatacctccctccagaacggtagaatgagtataaaagcctatgtgtcaacacttatgggcgtgccagggcgcaccatgggggtgatgtttacaccactgacagtgaagtatgcctactatgatacagaaagaatcggggtggatttaataatgaagacctgcttcagccccaatcgcgtgattgggttaagtagtgaccttcagcaagtcggaggagcctcagccagaatccaggacgctttgtctactgtccttcagtacgctgaggacgtgctgagcggaaaggtatctgctgataacacagtcggccgctttcttatgagtttggtcaatcaggtgcccaagatcgtacccgacgatttcgagaccatgctgaattccaacattaacgatctgctgatggtgacctacctcgctaacttgactcagtctcaaattgccctgaacgagaaactggtaaatctttag

SEQ ID NO: 116313 - DNA, 627 bp, Artificial Sequence
  Description of Artificial Sequence: Synthetic coding sequence
atggaattcgctaaaaacatgtatgagctccacaaaaaagtctcgccaaacgaattgatcctgggttggtacgctaccggccacgatatcaccgaacattcagtgcttattcacgagtactacagtcgcgaggctcctaatcccatacatctaacggtggatacaagcctgcagaacggacggatgtccatcaaagcgtacgtctccaccctgatgggtgtgcccgggcgtaccatgggggtgatgtttacccccctcactgtgaagtatgcctactatgataccgagaggatcggagtggacctgataatgaaaacgtgtttcagtcccaatcgggtgatcgggctctcaagcgatctccaacaggtcggcggcgccagcgcaaggatacaagacgccctgagtactgtgctgcaatacgcagaggatgtactgtccggaaaagtctccgccgacaacaccgttgggaggtttttgatgtcgctggtcaaccaggtgcctaaaattgtgcccgacgattttgagacaatgctgaatagcaacattaacgaccttctcatggtgacctacttggctaatctgacacagtcccaaatagccttgaatgagaaattagtcaacctgtag

SEQ ID NO: 116314 - DNA, 1074 bp, Artificial Sequence
  Description of Artificial Sequence: Synthetic coding sequence
atggctactcccgctgtgcctgtctccgccccacctgccactcccacacccgtgccagccgctgctccggcctctgtcccagctcctacacctgcccctgcagccgcccctgtgcccgccgccgcgcccgcctcctcttcagatcccgcagccgctgccgccgctacagccgcgcccggccagaccccagcctctgcacaggctccagctcagacccccgcgccagcgctgcctggacctgccctccctggacccttccccggcgggcgtgtggtgcgacttcatcctgtgattctggcgagtatcgttgacagctatgaaagaaggaatgagggtgccgcaagagtaattggaacactgctgggtacagtggacaagcattccgttgaggtgacaaattgcttttccgtcccgcataatgagtcagaagacgaagtggcagtcgacatggagttcgctaagaacatgtatgagctgcacaagaaagtgtctccgaatgagctgattctggggtggtatgccacaggacatgacattacggaacattccgttcttatccacgaatattacagtcgagaagcgcccaaccctatacatctgaccgtggatacatctctacagaacggtcggatgtctattaaggcctacgtctcgaccctgatgggggtgcctggcaggaccatgggcgtgatgtttacaccgctaaccgtaaagtacgcttattacgacactgaacgcatcggggtggaccttataatgaagacatgtttctctcctaaccgcgtgattgggctcagcagtgatctgcagcaggtgggtggagcatctgcgagaatccaggatgcattgtctacagtattgcagtatgccgaggatgtgttgtcagggaaagttagtgccgacaacaccgtcgggaggtttctaatgagtctcgttaaccaggtccccaaaatcgtcccagatgattttgagaccatgctgaatagcaacataaacgatctcctgatggtaacgtacttagccaatctgacgcaaagtcaaatcgcactcaacgaaaagcttgtgaatctgtag

SEQ ID NO: 116315 - DNA, 1119 bp, Artificial Sequence
  Description of Artificial Sequence: Synthetic coding sequence
atgaacgcagtgatttctgcctccgcgagcttctttctggataaaatggcgactcctgctgtgccagtctctgcgccccccgccaccccaacgcccgtgcccgctgcggcccccgcaagcgtgccagcacccacgcccgcccctgcagccgctcctgtccctgctgctgccccagcttcctccagcgatcccgccgcggctgccgcagctaccgcagccccaggccagacacctgctagtgctcaggctcctgcccaaacccctgcccccgctttaccagggccagcactgcccggcccttttcctggcggacgggtggtgagattacaccccgtcatcctcgcttctatagtcgactcatacgaaagacgcaatgagggcgctgcccgcgttattggaactctgctcggcaccgtggacaagcacagcgtagaggtgaccaattgttttagtgtgccacacaatgagagtgaagatgaagttgctgtggatatggagttcgccaagaacatgtatgagctgcataagaaggtgtctccaaacgagctcatcttgggatggtatgccacaggtcacgatattaccgaacacagcgtcctgatccatgaatactatagtcgagaggcccccaaccctatccatctgactgttgatacttctctgcagaacggaaggatgtcaatcaaagcctatgtgtccacacttatgggcgttccaggaaggactatgggagtgatgtttacacctttgacggtcaagtatgcgtactacgacactgagcggatcggtgtcgaccttataatgaagacctgcttttcaccgaaccgggtcatcggcctgagctccgatctccagcaagttgggggggcctccgccagaattcaggacgctctttccaccgtcctacagtatgcagaggacgttctgtctggcaaagttagcgccgataacaccgtgggcaggttcctgatgtcattagttaaccaagtgccaaagatagtacctgatgattttgaaacaatgcttaacagtaatataaacgatttgctgatggtcacataccttgcaaacctcacacagtcacagatagcgctcaacgagaaattggtgaatttatag

SEQ ID NO: 116316 - DNA, 924 bp, Artificial Sequence
  Description of Artificial Sequence: Synthetic coding sequence
atggccacgccagccgtgcccgtgtccgcaccacccgccacccccacacccgttccagcggccgcccctgccccagctctacccgggcccgccctgccgggtccttttccgggcggaagggtcgtacgcttacatcctgtcatccttgcaagcatcgtggacagttatgaacgccgcaacgagggagctgctagggtgatcggcactctgctgggtacggtggacaaacactcggtcgaggtgaccaattgcttttctgttcctcacaacgaaagcgaggacgaggtggctgtcgacatggaatttgccaagaatatgtacgaactgcataagaaagtttcaccgaatgaactcatcctgggatggtatgcaactggccacgacattacagagcactctgtcctgatccacgaatactattccagggaagcacccaaccccatccacctgacggtggatacctcactgcaaaacggaagaatgtccattaaggcctatgtgtccactcttatgggcgtgcccggaaggaccatgggggtgatgttcacccccctgaccgtcaaatatgcgtactatgataccgaaaggatcggtgtcgacttgatcatgaaaacttgcttttctccaaacagggtgattggactgagtagtgatctgcagcaggtaggaggcgcttcagcgcgaatacaggacgcactgtctaccgtgttacagtatgccgaagatgtgctgtcaggtaaggtgtccgcagacaacaccgtgggtcgctttcttatgagcctcgttaatcaggttcctaaaatcgtgcctgatgactttgagaccatgcttaactctaatataaacgaccttctcatggtcacctatcttgcgaacttgacccaaagccagattgcgttaaacgagaaattggtgaacctatag

SEQ ID NO: 116317 - DNA, 963 bp, Artificial Sequence
  Description of Artificial Sequence: Synthetic coding sequence
atgcctacaggagacttcgactctaagcccagttgggccgatcaggtggaagaggaaggcgaggacgacaagtgtgtcacttctgagctacttaagggaattccactggcaaccggcgatacctctccagaacccgagttactgcctggtgcccccttaccgcctccaaaagaggtcattaacggaaacattaagacggtcaccgaatataaaatagacgaagacggcaaaaagtttaagatagtgagaacctttagaatagagacaaggaaagcgtctaaagctgtggcaagaaggaagaattggaaaaagttcgggaactctgagttcgaccccccaggcccaaatgtggctacaaccaccgtttccgacgatgtgtccatgactttcatcacaagtaaagaggatcttaactgccaagaggaagaagacccaatgaacaagcttaaagggcagaagatcgttagctgccggatctgcaagggagatcactggactactcggtgcccgtataaggacactctaggtcccatgcaaaaggagttggccgaacagcttggtctttccaccggggaaaaggaaaaacttcccggggagctcgaacccgtgcaagcaacccagaacaaaaccggaaaatatgtgcctccatccctgcgtgatggcgcttcccgacgtggagaatccatgcagccgaatcgccgggctgacgataatgccactatccgggtgaccaatttgtctgaagataccagagagacggatctgcaagagctttttagaccatttggttcaatcagtcgcatttatctggccaaggataaaacaacaggtcaaagcaagggttttgcatttatcagcttccatagaagagaggacgcggcccgggcaatcgcaggcgtatcggggttcggctacgaccacttaatcctcaatgtcgagtgggccaagcccagcactaactag

SEQ ID NO: 116318 - DNA, 1101 bp, Artificial Sequence
  Description of Artificial Sequence: Synthetic coding sequence
atgtattcccgccatgctcaaagaatccctccaggcaaaaaaatggcctcccgtaaggagggcacagggagcaccgctacttcttccagtagtactgctggtgccgctggtaaggggaagggcaaaggaggtagcggtgattctgccgtcaagcaggtgcagatagatgggctggtggtcctcaagattatcaagcactaccaagaggaaggccagggcactgaagttgtccaaggtgtgctcttggggctggtcgttgaggatcgcctggaaataaccaattgttttccatttcctcagcataccgaagatgatgcagattttgacgaagtacaataccagatggagatgatgaggagccttcgacatgtcaatattgaccacctacacgtggggtggtatcagtcaacgtactacgggtctttcgtcacacgagcactgcttgacagccagtttagctatcaacatgcaattgaagagtctgttgttctgatatacgatccaattaagacggcccagggtagtttgagccttaaggcttatcgccttacacccaagctgatggaggtatgcaaggagaaggatttcagtcctgaggccctcaagaaggccaatattacctttgagtacatgttcgaggaggtcccaatcgtaataaaaaattcccatctcataaatgtactgatgtgggagttggaaaagaaatcagcagtggccgacaagcacgagctcttaagcctagcgagtagcaaccacctcggcaagaacttgcagctgttgatggaccgcgttgacgaaatgtctcaggatattgtgaaatataatacatacatgcggaataccagtaagcagcaacaacagaaacatcagtatcagcagagacgccaacaggaaaacatgcagcggcagagtaggggcgagccaccgctccctgaagaggacttgtctaaactctttaagcctccccagcctccagctaggatggactccctgctgatcgcaggccaaatcaacacatattgtcagaatatcaaggaatttactgcccagaatttgggcaagctgttcatggcccaggcattgcaggagtacaataactag

SEQ ID NO: 116319 - DNA, 1059 bp, Artificial Sequence
  Description of Artificial Sequence: Synthetic coding sequence
atggccagccggaaagagggtacaggaagtactgccacgagctcttctagcacagcgggcgccgcagggaaaggaaaggggaaggggggcagtggggatagcgcggtaaagcaggtccaaatagacggactggtcgtcctgaagatcatcaaacattaccaggaagaaggacagggaaccgaggtagtccagggggttctgttggggttggtggtggaggataggctggaaatcactaactgctttccttttccgcaacataccgaggatgatgcagattttgatgaagtgcagtaccagatggaaatgatgcgctcactgcgccacgtgaatatcgaccacctccacgtggggtggtaccagtccacctattacggctcctttgtgacccgggccctgctcgatagccagtttagttaccagcacgcgatcgaggagtcagttgtcctgatctacgatcctattaagacagcccaagggtctctgtcactcaaggcctaccgactgacccccaagctcatggaggtctgcaaagaaaaagacttctcccctgaagcacttaagaaagcaaacattacattcgaatacatgtttgaggaggtcccaattgtgatcaagaatagccaccttatcaacgtgctgatgtgggagctggagaagaagtccgccgttgccgacaagcatgagctcttaagcctggcctcttccaatcatctggggaagaacttacagctcctaatggaccgggtagatgaaatgagccaggacatcgtgaagtacaatacatacatgcgcaatacaagcaaacagcagcagcagaagcaccagtaccaacaacggcggcagcaggagaatatgcagcggcagtcaagaggcgagccacccctcccagaagaggatttgtcaaaactctttaagcctccacagcctcctgccaggatggacagtctgctaatagccgggcagatcaacacatactgtcagaacataaaggaattcactgcgcagaaccttgggaaactgttcatggcccaggcactacaggaatacaataactag

SEQ ID NO: 116320 - DNA, 378 bp, Artificial Sequence
  Description of Artificial Sequence: Synthetic coding sequence
atgaagcctatcttgcttcagggccacgagcgttccatcactcagataaagtataaccgggagggtgatctgctgtttactgttgccaaggatcccatcgtaaatgtatggtacagcgtgaatggggagcgcctcggaacctacatgggccacaccggagcggtctggtgcgtggacgccgattgggataccaaacacgtcctgactgggagtgctgataactcctgccggctgtgggattgtgagaccgggaagcaactcgctcttctcaagaccaatagcgccgtacgcacctgcggattcgacttcggcggtaatatcatcatgtttagcactgataagcaaatgggttatcagtgctttgtgtcttttttttag

SEQ ID NO: 116321 - DNA, 978 bp, Artificial Sequence
  Description of Artificial Sequence: Synthetic coding sequence
atgaagccaatcctcctgcaaggacacgagaggtccattactcagattaaatacaatcgagaaggagacctgctcttcactgtcgccaaggatcccatagtgaacgtctggtattcggtcaacggcgagcgactagggacctacatgggtcataccggagctgtgtggtgcgttgatgccgactgggacacaaagcacgtcctaacaggatcagccgataatagctgccgcctgtgggattgtgaaacagggaagcaactcgccctccttaagactaattccgctgttagaacatgcggtttcgattttggcgggaacattatcatgtttagcaccgacaaacagatgggatatcagtgttttgtgagcttcttcgacttgcgggaccccagccagatcgataataacgaaccctatatgaagattccttgtaacgatagcaagatcacgtcggcggtttggggaccgctgggggaatgtataattgcaggacacgagtccggcgagctcaaccagtactccgcaaagtctggagaggttctggtgaacgtgaaggagcacagtagacagataaatgatatccagcttagccgcgacatgactatgtttgtgactgcctcaaaagataacactgcgaaactcttcgacagcaccacgctcgaacaccaaaaaactttccgcactgagagaccggttaacagcgcagcactgtccccgaattatgaccatgtcgttttaggtggaggacaggaggccatggacgtaacaaccacctccacaaggatcggcaaattcgaagccaggttttttcacctcgcttttgaggaagaattcgggagagtcaaggggcactttggccccataaattccgtggccttccacccagacggaaagagctactctagcggcggagaagacggatacgtccggatccattacttcgacccccagtatttcgaatttgaattcgaggcttag

SEQ ID NO: 116322 - DNA, 777 bp, Artificial Sequence
  Description of Artificial Sequence: Synthetic coding sequence
atggccgctgcagccgcagccgccggcgacagtgacagctgggatgccgacgctttttccgtggaggaccccgtccgaaaggtaggaggtggaggtaccgcagggggagatagatgggaaggtgaggacgaagacgaagacgtgaaggataattgggatgatgacgacgatgagaagaaagaggaggccgaggttaagcccgaagtaaagatatccgaaaagaagaagatagccgaaaagattaaggagaaggagcgtcagcaaaagaaacgtcaagaggagattaagaagcggttagaggagcctgaagagcccaaggtcctgacgccagaggaacagctagccgacaagttaaggctgaaaaagttgcaggaggaaagcgatcttgagttggccaaagagacttttggggtgaacaatgccgtgtatggcatagacgctatgaaccctagctcacgagatgatttcacagagttcgggaagttgcttaaggacaaaataacccagtacgagaaaagcttatactatgctagctttttggaggtcttagtgcgtgacgtatgcatctccttggagattgatgatctcaaaaagatcaccaacagtctgacggtcctgtgctccgaaaaacagaagcaggaaaaacagtcaaaggccaaaaaaaagaaaaaaggcgtggtgcccggtggtgggcttaaggctacaatgaaagatgatttggccgattatggcggctatgatggcggttacgtgcaggactatgaagatttcatgtag

SEQ ID NO: 116323 - DNA, 657 bp, Artificial Sequence
  Description of Artificial Sequence: Synthetic coding sequence
atggctatgttcgagcagatgcgggctaacgtcggaaagttacttaaagggatcgatcggtacaatcccgagaacctagctaccctggagaggtatgtagagactcaagcaaaagaaaatgcttatgacctggaggcaaacctggccgtcctgaagctgtaccagttcaatcctgcgttctttcagactaccgtaactgcccaaattctcctcaaggccctgaccaacttaccacatacagacttcacactatgtaagtgcatgattgaccaggcgcatcaggaggagcggccaattaggcaaatattgtacctgggcgaccttctcgaaacttgccacttccaggcattttggcaggcgctcgatgaaaacatggatttgttggagggtataactgggtttgaagactctgtcaggaaatttatatgccacgtagtcggcattacgtaccagcatattgatcggtggctgctagctgagatgctcggcgacctcagtgattcccagctcaaagtctggatgtctaaatacgggtggtcagctgacgagtccgggcagatattcatctgcagccaggaagaaagtatcaagccaaaaaatattgtcgagaagattgacttcgattccgtctcctcaataatggcctcctcccagtag

SEQ ID NO: 116324 - DNA, 375 bp, Artificial Sequence
  Description of Artificial Sequence: Synthetic coding sequence
atgatcgatcaagcacaccaggaagaacggcctatcagacagattttatacctaggcgatctgctggaaacctgccactttcaggccttctggcaggctctggacgaaaatatggacctgttagaaggaatcacaggctttgaggactccgtccgcaagttcatatgccatgtggtgggcataacatatcaacacattgatcggtggctgctagccgaaatgcttggcgacctctcggattcacaattgaaggtatggatgtcgaaatacggctggagcgctgacgaatctggccagattttcatttgctcccaagaggagagcattaagccaaagaacatcgtggagaaaatcgacttcgactcagaatggtag

SEQ ID NO: 116325 - DNA, 636 bp, Artificial Sequence
  Description of Artificial Sequence: Synthetic coding sequence
atggcaatgttcgagcagatgagggccaatgtgggcaagttgctcaagggcatagaccgctacaaccctgaaaacctcgccaccttagagagatatgtggagacccaggccaaggagaacgcctatgatctcgaggcaaacctcgccgttctgaagctgtatcaattcaatccagcctttttccagacaactgttacggcccagatcttgcttaaagccctgaccaatctcccccacaccgactttacactgtgcaagtgtatgattgaccaggcacaccaggaggagcgtccgattaggcaaatcctgtacctcggtgacctcttagagacatgccactttcaagcattctggcaggcactggatgagaacatggatctgctggaggggatcaccggcttcgaggacagtgtcagaaagtttatatgccatgtggttgggattacctatcagcacatcgaccgctggctgctagctgagatgctgggcgacttgagtgattctcagctgaaggtctggatgagcaaatatggttggtccgctgatgagtccgggcaaattttcatttgcagccaggaggaaagcatcaaacctaagaatatcgtcgagaaaatagattttgacagtgaatggtag

SEQ ID NO: 116326 - DNA, 1125 bp, Artificial Sequence
  Description of Artificial Sequence: Synthetic coding sequence
atgagtgtgcctgcttttatcgatatcagcgaggaggatcaggccgctgagcttcgtgcctaccttaaatctaaaggtgccgaaatttccgaggagaactccgaaggcggactgcatgtcgacctggctcaaatcatcgaggcctgtgatgtctgtctgaaggaagatgacaaagatgtagaatcagtgatgaacagtgtagtgtcgctgctgctcattcttgagcctgataagcaagaggcactgatcgagagcctgtgcgaaaaattagttaaattcagagagggcgaacggccatctctgcgcctgcagctgcttagcaaccttttccatggtatggacaagaacacacccgttcggtacactgtatactgcagcttgattaaagtggccgctagttgcggcgccattcagtacatccccacagaactggaccaggtgaggaagtggataagcgattggaacttgaccactgagaagaagcacacgctcctacgacttctgtatgaggcactagtggactgcaaaaaaagtgatgccgcaagtaaagttatggtagagttgttaggctcttacaccgaggataacgccagtcaagcgcgtgttgacgctcacagatgtattgtgcgggcactgaaggacccaaatgccttcctgtttgaccacttgctcacgcttaaacctgttaagttcttagagggtgaactaattcatgaccttctcactattttcgtttccgcaaagctggccagctacgtgaaattttatcaaaacaacaaggatttcatcgacagcctgggcctactccacgagcagaatatggcgaagatgcggctgttaactttcatggggatggccgttgaaaataaggaaatttcatttgataccatgcaacaggagctgcagatcggagcggacgacgtcgaggccttcgtgattgacgcagttcgaacaaagatggtgtactgtaagatagatcagacccagcggaaagtggtggtttctcatagcactcataggaccttcggaaagcagcagtggcagcagctgtatgacaccctgaatgcctggaagcagaatctgaataaggttaaaaactcactgctgagcctgtctgacacctag

SEQ ID NO: 116327 - DNA, 2724 bp, Artificial Sequence
  Description of Artificial Sequence: Synthetic coding sequence
gtcgagtcagccattgccgagggcggggctagcagatttagcgcttctagcggcggcgggggaagtagaggagccccgcagcactaccctaagacagccggcaactctgaattcctaggaaaaacgccgggtcaaaatgcacaaaaatggatcccagccaggagtaccagacgggacgacaacagtgctgccaacaacagtgccaacgagaaagagaggcatgatgctatcttcaggaaggtccggggtattcttaacaagctgacccctgagaaatttgacaagctgtgtctggaactcctgaacgtgggagtggagtcaaagctaatcctgaagggagtgatcttactcatcgtggacaaagccctggaagagcctaagtattcctccctctacgcccagctctgtttgcggctggccgaggacgccccgaacttcgacggaccagccgctgagggccagccgggacaaaaacagagtacgaccttcagacgactgttgatttcaaaactgcaggacgagttcgagaatcgaactagaaacgtcgacgtctatgacaagcgggagaatcccctcctacccgaggaggaggagcagcgtgcgattgcaaagattaagatgctgggcaatataaaatttattggggagctgggaaaactagacctcatacacgagtctattctgcacaaatgtatcaagacattgctggaaaagaaaaagcgagtccaactcaaagacatgggcgaagacttagaatgtctctgccaaatcatgcggactgttgggcccaggcttgaccacgaacgcgcaaagtccctcatggaccagtactttgcaagaatgtgcagcttgatgcttagcaaagagctcccagccaggataaggttcctcttacaggataccgtggagctgcgggagcatcactgggtgccgaggaaggcttttctggataacgggccaaaaacaataaaccagatccgacaagatgccgtgaaggacttgggcgtatttattcctgcaccaatggcacagggcatgcggagcgacttttttcttgagggcccattcatgcctcccagaatgaagatggatcgcgacccgctgggtggcctggccgacatgtttggccagatgcccggctctggaatcgggacgggccccggggtgatccaggacaggtttagtccgacaatgggccggcacagatcaaaccagctctttaacggtcacggaggacacatcatgccccctacacaatcgcagttcggagagatgggaggcaagtttatgaagagtcaaggattatctcagttgtaccacaatcaaagtcaaggactcctgagccagctgcagggacagagtaaggatatgccccctagattttcaaagaagggccagctaaacgcagacgaaatttccctacgacccgcccagtcctttctgatgaacaaaaaccaggtgcccaagctgcaaccgcaaatcaccatgatcccaccatctgctcagcccccgaggacacagacccccccactgggccaaactcctcagctggggctgaagactaatcccccgttaattcaggagaagcctgcgaaaacatccaaaaaaccaccccccagtaaggaagaactgcttaagctgacagaaacagtcgtcactgagtatctcaactcagggaacgccaatgaggctgtaaacggggtgagggaaatgcgggccccaaagcacttcttaccagagatgctgagcaaagtaattatcctctccttggaccgtagcgacgaggacaaggagaaagcgtccagcctgatcagcctgctgaagcaagaagggatcgcgacctccgataacttcatgcaggctttcctcaatgtgctggatcagtgtccaaaattggaggtggatataccacttgtcaagagctatctcgcacagttcgctgcacgggcaataattagcgagcttgtgtctatctccgaactggctcaacctctggaatccggcacccatttccccctgttcttactgtgtctgcaacaacttgctaaactccaagaccgcgaatggctcacagagttatttcaacagagcaaagtcaacatgcagaagatgctgccagagattgaccagaacaaagatcggatgctggagatcctcgagggcaagggactgtctttcctcttccctttgctgaaactggaaaaggaattactcaagcaaattaagcttgacccttccccccagactatctacaaatggatcaaggataatatcagccctaagctgcacgtggacaagggctttgttaacattctcatgacctcattcttacagtatattagtagtgaggtgaaccccccgagcgatgaaaccgacagttccagtgccccttcaaaagagcagttggaacaagagaagcagctgctcctctccttcaagccagtgatgcaaaagttcctgcacgatcatgtggatctgcaagtttccgccctgtatgccttacaggtgcactgctacaactccaacttcccaaagggcatgcttctcagattcttcgtccacttctatgacatggaaatcatcgaggaagaggctttcctcgcctggaaagaggacatcactcaggagttcccgggcaaagggaaagcacttttccaagttaaccagtggttgacctggctagagacggccgaagaggaagaaagtgaggaggaggctgactag

SEQ ID NO: 116328 - DNA, 762 bp, Artificial Sequence
  Description of Artificial Sequence: Synthetic coding sequence
atgcaggctttcttaaatgtcttagaccagtgccccaagctggaggtggacatcccgctcgttaaatcctaccttgctcaattcgcagctagggccatcatctccgagctggtttccatttccgagctggcgcagccacttgagagcgggactcattttccattgtttctcttgtgcctacagcaactggctaaactacaggatagagagtggctgaccgaattgttccaacagagtaaagtgaacatgcaaaagatgctccctgagatcgaccagaacaaagatcgaatgcttgagatcttagaaggtaaggggctatcattcttgtttcctctcctgaagttggagaaggagctgcttaagcagatcaaactggatccatctccgcaaacgatctacaagtggatcaaggacaacatatccccaaagctgcatgtggataaaggattcgtcaacattcttatgacatccttcttgcagtatatctcttcggaggtgaatcctccgtctgacgaaacagattcatctagcgctcccagcaaggagcagctggagcaggagaagcagctcctactctccttcaagccagtgatgcagaaattccttcacgatcacgtagaccttcaagtgagcgctctttatgctctgcaggtccactgttataattcgaacttccctaagggtatgctcttatttctttgtacctctatgacctggaagctcctgaagaaaaagttatcctggctgggaaaaaaaatttag

SEQ ID NO: 116329 - DNA, 2610 bp, Artificial Sequence
  Description of Artificial Sequence: Synthetic coding sequence
gtggagtccgccattgcagaaggaggcgcatcaaggttttcagccagcagtggtgggggcggatcaaggggagcaccgcaacattaccccaagacagccggcaattctgagtttttaggaaagaccccaggtcagaatgctcaaaaatggatacctgctcgtagcacccgacgggatgacaatagcgccgccaacaattccgcaaacgagaaagagcggcacgatgctatttttcgtaaagtgagggggatacttaacaagttgaccccagaaaagtttgacaaactctgcctggagctgttaaacgtcggagtggaaagtaagctcatcctcaaaggagtgattctattaattgttgacaaagcgcttgaggaaccaaaatatagcagcctatacgcccagctctgtcttagactggcagaagacgcaccgaatttcgatggtccagccgctgagggtcagccaggacagaaacagtccactacctttcgaaggctgcttatcagtaaactgcaggatgagttcgaaaacaggactcggaacgtggacgtctacgacaagcgggagaatcctttgcttcccgaggaagaggagcagagggctattgcaaagattaaaatgctcggaaacataaaatttatcggagaactaggaaagctagacttgatacacgagtctattcttcacaagtgcatcaagaccctgctggaaaaaaaaaagagagtgcaactgaaggacatgggagaagacttggaatgcctgtgccagattatgagaacagttggtccaaggttggaccatgagagagcaaaatctctgatggatcagtatttcgcacggatgtgcagcttgatgctcagtaaagagttaccagcacggatcagatttctgctgcaggacacagtggaacttagagaacatcattgggtcccccgtaaggccttcctcgacaacggccctaagacaatcaatcaaatcagacaggatgcagttaaagacctaggagtgtttatcccagcaccaatggcgcaagggatgcggtcagatttcttcctggaaggaccatttatgcctcccaggatgaagatggacagagacccccttggtggactggctgatatgtttggccaaatgccgggctctggtatcggcacaggcccaggagtcattcaggatcggttcagccctaccatggggaggcatcggtccaaccagttgttcaatggccacggtggccatattatgccccccacccaaagtcagttcggtgaaatgggagggaaatttatgaagtcccaaatttctctcaggccagctcaaagcttccttatgaataagaaccaagtcccaaagcttcaaccccagataacgatgataccacctagcgcacagcctccccggactcagacgccacctctcggacaaaccccccagctcggactgaagactaatcccccgctcatccaagaaaaaccagccaagacatccaagaagccaccacccagtaaagaggaactgcttaagctcaccgagactgtggtcaccgagtatctcaactccggtaatgcgaacgaagcagtgaacggggtcagagagatgagggcgcccaagcactttctaccagagatgttgtcaaaagttatcatcctgagcctcgaccgcagcgacgaggacaaagaaaaggcctcttcacttatctcactcctgaaacaagaagggattgccacaagtgataatttcatgcaggcatttctgaacgtgttggatcagtgccccaagctagaggtagacattcctctggtcaaatcctatctggcccaatttgcggcaagggcaattatcagtgaacttgtatcaatcagcgagctggcccaaccgcttgaatccggcactcacttccctctctttctcctgtgcttgcaacaacttgcaaagctgcaagatagggaatggttgactgagttatttcagcaaagcaaggttaacatgcagaagatgcttccagagatcgatcaaaacaaagaccgtatgttggagattctagaagggaaaggcctgtctttcctatttccccttctgaagcttgaaaaagagcttctgaagcagatcaagcttgatccgagcccacagactatctacaaatggatcaaggacaacatctcgcctaagctgcatgtggacaagggatttgtcaatatcctgatgacatcctttcttcagtatataagttctgaggtgaatcctcctagcgatgaaaccgattcctctagcgccccttctaaggaacagctcgaacaagagaagcagctgttgctctctttcaaacccgttatgcagaagtttctccatgaccatgtggacctgcaggttagcgccttgtatgctcttcaagtccattgttacaactctaacttccccaaagggatgctgctgaggttcttcgtccacttctatgacatggaaatcattgaggaggaagccttcctagcttggaaggaagacatcactcaggagtttcccggaaagggcaaggccttgttccaagtgaatcagtggctgacttggctggagactgcggaggaggaggaaagtgaagaggaagccgactag

SEQ ID NO: 116330 - DNA, 2943 bp, Artificial Sequence
  Description of Artificial Sequence: Synthetic coding sequence
atggccgggtggcctactcccgcgggcactaggccatggagaacagaggcaagactctgttcagacggggagggggcctggctgggaccgcttgccccgtggagagaggctcgtctggccagtcgcagaggaggaatctcattcttgctctcgccaccattgcccactccctccatcaacatcatcctgctgaaaatcctacgctgccaggctgctaaggtggaaagcgccatcgccgaaggtggtgcctcccggtttagtgcatcatctgggggtggcggctcccgaggcgctccacagcactatccaaagactgcgggcaacagcgagttccttggaaagacccccggtcaaaatgcccaaaagtggatcccagcacggagcaccaggcgcgacgacaattcagcagctaacaatagcgcaaacgaaaaagaacggcatgatgctattttccggaaggtgaggggtatcctgaacaagctcacgcccgaaaaattcgataaactgtgtttggagctgctgaacgtcggagtggagagcaagcttattttgaagggcgtgattctgctcattgttgataaggctttggaggagcctaagtactcaagtctgtatgcgcagctctgccttcgcctcgcagaggatgcgcccaattttgacggcccggccgcagaaggacagccaggacagaaacagtcaacaactttccgtcgtcttctcatttcgaagcttcaggatgagtttgagaatcggacccggaatgtcgacgtgtatgataagagggagaatcctctcctaccagaagaagaggaacaaagggctattgctaagataaaaatgctcggcaatataaaatttatcggggaacttggaaaattagacctgattcacgaatccatcctgcacaaatgcatcaaaactctcctcgagaaaaaaaagcgtgtccagctgaaggacatgggcgaagaccttgagtgcctatgtcaaattatgcgaacagtggggcctcgtcttgaccacgaaagagccaaatccttgatggatcagtacttcgctcgcatgtgctctctgatgctttccaaagagctccctgccagaatcagattccttttacaggatactgtcgagctgagagagcaccattgggtacctcgcaaggcattcctcgataatgggccaaaaaccatcaaccagatccgccaagatgccgtcaaagacctgggagtgttcatcccagccccaatggcgcagggaatgagaagtgacttcttcctcgaggggcctttcatgccacctcgaatgaaaatggacagagaccctctgggggggctggcggacatgtttggccagatgccaggcagcggtattggaactggtcctggcgttatccaggaccggtttagccctacaatgggccggcaccgttccaaccagctctttaacggacacggtggccacattatgcccccgactcagtcccagtttggggaaatgggcggaaaatttatgaagagccaaggtcttagccaactgtaccacaaccagtcacagggtctcctttcccagctgcagggtcagtccaaggacatgcctcctaggttctctaaaaaaggacagctgaatgcagatgaaatctctttgcgcccagctcaaagcttcctaatgaataagaaccaggtaccaaagctgcagcctcagatcacaatgataccaccatcggctcagccacctcggacacaaacaccaccattggggcagactccacagctgggcctcaaaacgaatcctcccctcattcaggagaagcctgccaaaacgtcaaaaaagccaccaccaagcaaggaggagctcctcaaactgacagaaacggtggtaaccgaatacctgaattccggaaatgcaaacgaggcagtcaacggcgtccgggagatgcgcgcgccgaagcattttttgccagagatgctttctaaggtcattattctgtcattggatcgcagcgacgaagataaggagaaagcttctagcctgatttctttgctgaagcaggagggcatcgccacttccgataattttatgcaagcattcctaaatgttctcgaccagtgtcctaaattagaagtggacatccccttggtgaaatcatacctggcccagttcgcggctcgcgcaatcatcagtgagcttgtttcgatctcagaactcgctcaacccttggaaagcggaactcattttccactgtttctactgtgtctgcagcaactggcaaagctgcaagatcgcgaatggttgacagagctgttccaacagtccaaggtgaatatgcagaagatgctgccagaaatcgatcaaaataaagatagaatgctggagatactggaaggaaagggattatcttttttgtttccactcttaaagctagagaaagaactgttaaaacaaatcaagctcgatcctagcccacagacaatctataaatggatcaaggataacatatcaccgaaacttcacgtcgacaaaggttttgtgaatatactcatgacctcattcctgcagtacatcagctccgaggtcaacccaccatccgacgagacagattcctcctctgccccctcgaaggagcagcttgaacaggagaaacagctgctcttatcttttaagcccgttatgcagaagttcttgcacgatcacgtggaccttcaggttagtgctctatacgcgctccaggtgcactgttataattctaactttccaaaaggcatgctgttgcgatttttcgtccatttctacgacatggaaatcatcgaagaagaagctttcctggcatggaaagaagatatcacacaggagtttcctggaaagggcaaggcattgttccaggtgaatcaatggctcacttggctggagaccgctgaagaggaggaatctgaagaggaggcagactag

SEQ ID NO: 116331 - DNA, 735 bp, Artificial Sequence
  Description of Artificial Sequence: Synthetic coding sequence
gtggaatcagctattgctgaaggaggcgcttccaggttttccgcctcttctggcgggggtggtagtagaggcgccccacagcattaccctaaaaccgcgggaaactctgagttccttggcaaaacaccggggcagaacgcacagaagtggatcccagccagatctacacgcagggacgacaacagcgcggccaacaactcggctaacgaaaaggaacggcacgacgccatttttcgcaaagtgagaggcatccttaacaagctgactcccgagaagttcgacaaactctgtctcgagttgttaaacgtgggggtggagtcaaagctaattctaaagggagtgatcttactcatcgtagacaaagcacttgaggagcccaaatattcttctctgtatgcacagctctgtctcaggttggcagaagatgcacccaatttcgatggacccgctgcggaggggcagcctggccagaagcagtctaccacctttcggagactcctgatatctaagcttcaggacgaatttgaaaacagaactcgcaatgtcgacgtgtacgacaagagggagaaccccctactgcccgaagaggaagaacagcgtgccattgccaaaatcaaaatgctgggtaatattaagttcatcggcgagttgggcaagctcgaccttattcacgaaagcattctccataagtgcatcaagacattgctcgaaaagaagaaacgcgtgcagttgtag

SEQ ID NO: 116332 - DNA, 2724 bp, Artificial Sequence
  Description of Artificial Sequence: Synthetic coding sequence
gtggagagcgctatagcggagggaggagcttctagattttcagcatcttcaggtggcgggggctccagaggggctccgcagcattacccaaagacagcaggcaatagcgaatttctgggcaaaacgccaggtcaaaacgctcagaagtggatccctgcccggtcaacgcggagggatgacaattcggctgccaacaattctgctaacgaaaaggagagacacgacgccatctttcggaaggtgcgcggcattcttaacaagctgacacccgaaaagtttgacaaattgtgcttggagctgctgaacgtgggtgtcgaaagcaagctcatcttgaagggcgtgatacttctaatcgtcgataaagccttggaggagcctaagtactcttccctctatgcacaactgtgtctgcgactggctgaagatgctcctaatttcgatgggcctgctgccgagggccagcccggacaaaaacagtcaactacgttccggcgcctcctcatttccaagctgcaggacgagttcgagaatcgaacacggaatgtggacgtttatgataagagggaaaacccacttctgcccgaggaagaagaacagcgtgcaattgctaaaatcaaaatgctggggaatatcaaattcatcggcgagctcgggaagttagatctgatccacgaatctattctccataagtgtatcaagaccctgctggaaaaaaagaagcgcgtgcagctgaaggatatgggagaggacctggaatgtctatgtcaaattatgaggactgtcggcccgcggcttgaccatgagcgtgctaagtccctgatggaccagtacttcgctcggatgtgttcgttgatgctgtctaaggaactgccagctagaataagattcctcctccaggacactgttgaattgagagagcaccattgggtcccacgcaaggctttcctggacaacgggcccaaaacaataaaccagattagacaggatgccgtaaaggacttgggagtgttcattccggctcctatggcacagggcatgcgtagcgattttttcttagaggggccatttatgccacctcgtatgaagatggaccgcgaccccctcggaggcctggcggatatgttcgggcagatgcctggctctggaatcggcaccgggcccggcgttatccaagacaggttctctcctaccatggggcgccaccgatccaatcaattgttcaacggccacggggggcacattatgcctccaacccagagccagtttggcgagatgggcgggaagttcatgaaaagccagggactctcacagctgtaccataaccagtcacagggtctcctgagccagcttcagggccagtcaaaggacatgccacctcgcttcagtaagaagggtcagttgaacgcagatgaaatctctctaaggcctgcacaatcctttcttatgaataagaaccaggttcccaaactgcagccacagattacgatgatacccccttcagcccaaccacctaggactcaaacccctcccctgggacaaacccctcagctaggtctgaaaaccaatcctcccttgatccaagaaaagccggctaagaccagtaagaagcctcccccatctaaggaagaactgctcaagctcacggagaccgttgtaacggagtacctgaactccggcaacgcaaacgaagctgttaatggagtgcgagaaatgcgggcgccaaagcattttctgcccgagatgctgagcaaggttatcattctctctttggaccgatcagatgaagacaaagaaaaggcctcttcgcttatttcactgttgaagcaagaggggattgccacttcagataacttcatgcaggccttcctcaacgtgcttgaccagtgcccgaagctagaggttgacatacctctggttaaaagctatcttgctcagttcgctgcccgtgcgattatctccgagctggtgtcaatttccgagctggcccagcctctggagagtggaacccattttcctctcttccttctttgcctccagcagttagcaaagctccaagaccgagagtggttgaccgagctgttccaacagtcgaaagtgaacatgcagaagatgctccctgagatcgaccaaaataaggataggatgctagaaatcctagagggcaagggactttcttttctgtttcctctcctgaagttggaaaaggaattgctgaaacaaattaagctggatccttctccgcagacaatctataaatggattaaggacaatatttcaccaaagcttcatgtcgacaagggctttgttaatatcctgatgaccagtttcttgcagtatatttcgtccgaagtgaatcccccgtcagacgaaaccgactcatcttccgccccttccaaagagcaactcgagcaggaaaagcagctgctgctgtcattcaagcccgtgatgcagaagttcctacatgatcacgtcgatctgcaagtcagcgctctgtatgctctgcaagtgcactgttacaactctaatttcccgaaaggcatgcttttaagattcttcgtacatttctacgacatggagataatagaggaagaggctttcctcgcttggaaggaggacatcactcaggagtttcctggcaagggcaaggccctgttccaagtgaatcaatggctaacgtggttggaaactgcagaagaagaggaatccgaagaggaagctgactag

SEQ ID NO: 116333 - DNA, 2724 bp, Artificial Sequence
  Description of Artificial Sequence: Synthetic coding sequence
gtggagtctgctatagccgaggggggggctagcagattctccgcctccagcggcgggggaggatctagaggggcgcctcaacactatcccaagacagcaggcaacagtgaatttctcgggaagacaccggggcaaaatgcccagaaatggatacctgcccgtagtactcggagggacgataacagtgcggccaacaacagtgctaacgaaaaggaacgacatgatgccatcttcagaaaagtacgggggatactcaacaagctgacacctgaaaagtttgataagctctgcctcgagttgctgaacgtgggcgttgagtcaaaactgatcttgaagggagtgatccttctcatcgttgacaaggccctcgaggaacccaagtattcaagtctttatgcccagctatgtttgcggctagcagaggacgcgccgaatttcgacggcccagcagccgagggacagccggggcagaagcaatcaacgacatttcgcaggcttcttatctccaagctgcaggacgagttcgagaatcgaactaggaatgtggacgtgtatgacaagcgggagaaccccctgctgcccgaagaggaagaacagcgagccattgccaaaataaagatgttaggtaatattaaattcattggagagcttgggaagttagacctaatccacgaatctatcctgcacaagtgtatcaagaccctgctggagaaaaagaagagagtacaattgaaagatatgggagaggatttagagtgtctgtgtcagattatgcggacagtagggccaagactggatcatgagagagccaagtccttgatggaccagtactttgctagaatgtgtagcctgatgctatccaaggagctgccagctcggatcagatttttgttgcaagatactgtggaactccgggagcatcactgggtccctagaaaagccttcctggataatggacccaaaaccataaatcaaatcaggcaggacgcggtaaaggatcttggtgtgtttattccagccccaatggctcaagggatgcgttcagattttttccttgaaggacctttcatgcctcctcgaatgaagatggatagggacccgcttggcggtttggcggacatgtttggtcagatgccgggctctggcattgggaccgggcctggtgtgatacaggaccggtttagccccacaatgggccgtcacagaagcaaccagctcttcaatgggcatggtggccacatcatgcccccaacacaaagtcagttcggtgaaatgggggggaagttcatgaagtctcaagggctgagccagttgtaccacaaccagtcccagggtctactgtcacaactgcagggccagtcaaaggacatgccacccaggttctccaaaaaggggcagctgaacgccgacgaaatctcacttaggccagcccaaagcttccttatgaacaagaatcaggtgcctaagcttcagccccagatcacaatgatcccgccttccgcccaaccgccaaggacacagacgccaccactcgggcagacccctcagctcggactgaagactaacccaccactgattcaagagaaacctgcgaagacctccaaaaagccgcctcccagtaaagaagagctactaaaactcaccgaaactgtggttacagagtatctgaacagtggcaacgccaacgaggctgtcaacggcgtgagggaaatgcgcgcgcccaagcacttcctgcccgagatgctctctaaagttattattctttctctcgatcgcagcgatgaggacaaagaaaaggccagctctctcatttccctgctgaagcaagagggaatagccactagcgacaatttcatgcaagcatttctgaacgtactggaccagtgcccaaagctggaagtcgacatcccactggtgaagagctatcttgcacagtttgccgctagggctatcatttccgagctggtcagcatcagcgagttagcccagcctctggaatccggtacgcactttcccttgtttttgctatgcctccagcagctggccaagctgcaggatcgagagtggttgacagaactctttcagcagtccaaggtaaatatgcagaaaatgcttcccgagattgaccagaacaaggatcgaatgctggagatccttgaggggaagggcttgagcttcttattccctctgctgaaattggaaaaggagctgctcaagcagatcaaattggatcctagccctcagactatttataagtggatcaaggataatattagccctaaactccatgtagacaaaggctttgtgaatattctgatgacgagctttctgcagtacataagctcagaggtcaacccccccagtgacgaaactgacagcagttctgccccgtccaaagaacagctcgagcaggaaaagcagttattactaagctttaagccagtgatgcaaaagtttctgcatgatcacgtggatctgcaggtgtcagcattgtatgcactgcaggtgcactgttacaactctaactttccgaaaggcatgctgctgcggttttttgtccacttctacgacatggaaattattgaggaagaggcgttcctcgcctggaaagaggacattacccaggaattccccggcaaaggaaaggctctcttccaggttaaccagtggctgacctggctggagacagctgaagaggaggagtccgaggaggaagcagactag

SEQ ID NO: 116334 - DNA, 375 bp, Artificial Sequence
  Description of Artificial Sequence: Synthetic coding sequence
gtcgagagcgccattgccgagggtggcgcttcccgattctcagcgtcgagtgggggggggggctcaagaggagctccccagcactatccgaagaccgccgggaattctgagttccttggcaagacacctggacagaacgcccagaaatggattcctgctagaagcacgcggagagacgataatagcgccgccaataatagtgccaacgaaaaggagcggcacgacgcgatctttcgcaaggtgcgcggcatattgaacaagttaactccggagaaattcgacaagttatgtctggagctgctgaatgtcggggtggagagcaagctgatcttaaaaggagtcatcctgctaatcgtggataaggccctggagtag

SEQ ID NO: 116335 - DNA, 339 bp, Artificial Sequence
  Description of Artificial Sequence: Synthetic coding sequence
gtggagtctgccatcgcagaagggggagcttctcgcttttccgcgagttcaggagggggtggttccagaggcgccccccaacactatccgaaaacagccggtaattctgagtttcttgggaagacccccggtcagaatgctcagaagtggattcctgcgaggagtacccgaagagatgacaattccgctgctaataactctgcaaacgagaaggaaagacacgacgctattttccgcaaggtcagggggattctcaacaagttgacacccgagaagtttgacaagctatgcctggagctgttgaatgttggcgtggagtctaagctcattctgaaatag

SEQ ID NO: 116336 - DNA, 351 bp, Artificial Sequence
  Description of Artificial Sequence: Synthetic coding sequence
gtcgaatccgccattgccgagggcggcgcaagtcggtttagtgcttccagcggcggtggaggctctcggggcgctccccagcattatcccaaaacagccggcaactccgagtttctgggaaaaactcccggacagaacgcgcagaaatggataccagcaaggtccacgagaagggatgacaatagtgctgcaaacaatagcgctaacgagaaggagagacatgacgccatttttcgaaaggtgcggggcatactaaacaaactgacccccgagaagtttgacaaactgtgccttgaactgctaaatgtgggcgttgaaagcaaactgatcctcaagggcgtcatcctctag

SEQ ID NO: 116337 - DNA, 1335 bp, Artificial Sequence
  Description of Artificial Sequence: Synthetic coding sequence
gtcgaaagcgcgatagccgagggaggcgccagcaggttttccgcatcatctggtggcggaggatcaaggggcgcgccacagcattaccccaagaccgctggcaatagtgagtttcttggaaaaacccccggacagaatgcccaaaaatggatccccgctcgcagtacaagacgcgacgataactctgccgccaacaatagtgccaacgagaaggaacgtcatgacgctatcttccggaaagtgcggggtatactgaataagcttactcctgaaaaattcgacaagctgtgtctggagttgcttaatgttggcgtggaatccaaactgatactgaagggggtgattctgttgattgtagacaaagcgctggaggaacctaagtattcctcgctgtatgctcagctatgtttacgcctggccgaagacgcgcccaattttgatggtcccgctgcagaaggccaacccggccaaaagcaatcgacaacttttaggaggctgctgattagcaaactgcaggatgagttcgagaatcgcaccaggaacgtcgacgtgtatgataaacgtgagaacccactgttacccgaggaggaagaacagagagccatcgcaaaaatcaagatgctggggaatataaaatttatcggggagctgggcaaactggacctgattcacgagagtatcctccataagtgtatcaagacattgctcgaaaagaagaaacgagttcagctgaaggatatgggcgaggatctggagtgtctgtgtcagatcatgcgaacggtgggacctcgattggatcatgaaagagccaagtcccttatggaccagtacttcgctagaatgtgcagcctgatgctctctaaggagttgccagccaggatccgcttcctcttgcaggacacagttgagctgcgggaacatcattgggtgccccgcaaagcgttccttgataatggcccaaagacaattaaccagatccgacaggacgccgtcaaggatctgggagtgttcattcctgcgccaatggcccaggggatgcggtcagatttttttttggaggggccattcatgcccccgcgaatgaaaatggaccgggatccactgggaggtctcgccgatatgttcggccagatgcctggctctggtatcggaaccggtcccggtgtgattcaagaccgcttctcgcctacaatggggaggcaccggtcgaaccagctctttaatgggcatggcgggcatatcatgccaccaactcagagccagttcggtgagatgggcggcaagttcatgaaatcgcagatctctctcagacccgctcagtcgtttctgatgtag

SEQ ID NO: 116338 - DNA, 849 bp, Artificial Sequence
  Description of Artificial Sequence: Synthetic coding sequence
gtggagtcagccatcgctgagggaggcgccagtagattcagcgcctcttccggaggcggaggcagtcgcggcgccccacagcattatccgaagaccgccgggaacagtgagtttcttggcaaaacaccaggccagaacgcccagaaatggatacccgccagaagcacgcgacgcgacgacaattccgccgcgaataattccgctaatgaaaaagagcgccatgacgcaattttccgcaaggtgcggggaatcctgaataaattaacacctgagaagttcgataagctgtgccttgagcttctgaacgtgggcgtggagtcgaaacttatactaaaaggtgtgatcctgctcattgtagacaaggccctggaggagcctaagtattcttcactgtatgctcagctgtgccttagactggctgaagatgcaccaaatttcgacgggcccgccgcggagggacagccgggtcagaagcagagtactacattccgcaggctgctcattagcaaattacaagacgaattcgaaaacagaactaggaatgtggacgtgtacgacaagcgtgagaatcccttgctgccagaggaggaggaacagcgggccattgccaagatcaagatgctgggcaacataaaattcatcggcgagttaggcaaactagatctaatccacgaatcaatcctccacaaatgcatcaaaacgcttctagagaagaagaaacgagtgcagctgaaagacatgggtgaggacctagagtgcctgtgtcagatcatgagaacagtggggccgaggctggaccacgaaagggccaagtccttgatggaccaatactttgcacgaatgtgctag

SEQ ID NO: 116339 - DNA, 393 bp, Artificial Sequence
  Description of Artificial Sequence: Synthetic coding sequence
gtggagagcgccatcgctgaaggcggcgcaagcagattttctgccagtagcggtggtggaggtagtcggggtgcaccgcagcattatccgaaaaccgccggcaattcagaattcctcggaaagacccctggtcaaaatgcccaaaagtggattcctgcccggtcaacacgccgcgacgacaattctgctgctaataattcagcaaacgagaaagaaagacatgacgccatctttagaaaagtccgcggcattctaaacaagctgactcccgagaagtttgataaactgtgtctggaactactgaatgtgggggtggagagcaaacttatcttaaagggagttatcctgttgattgtggataaggcacttgaagaaccgaagtacagcagttag

SEQ ID NO: 116340 - DNA, 1221 bp, Artificial Sequence
  Description of Artificial Sequence: Synthetic coding sequence
atgtctgctagccaagattcgcggtcaagggataacggccctgatggcatggagccagaaggagtaatcgagtcaaactggaacgagatcgttgactcctttgatgacatgaatctgtctgagtcactgctgcgcggaatttatgcctatggttttgagaaacctagcgctatccagcagcgagccatcttaccttgtatcaaaggctacgacgtgattgcccaggctcaatccggcacagggaagacagcaacatttgcaatctccatcttgcagcaaatagagctcgacctaaaggcaacccaggctctggtgctcgccccaacacgagaattagcacagcagattcagaaggtcgtgatggccctgggcgactacatgggagcgtcctgtcatgcatgtattggggggaccaatgtgcgtgctgaagtgcagaagttacaaatggaagcaccccatataatcgtgggtacacctggaagagtgttcgacatgctcaatcggagatatctttcacccaaatatataaagatgttcgtgcttgacgaagctgatgagatgctgtcccgcggttttaaggatcagatctatgatatatttcaaaagcttaatagcaatacacaggtggtgctcctcagcgcaaccatgccgtccgacgtgcttgaggtgaccaaaaaattcatgcgagatccaattcggatcctggtgaagaaggaagagctcacactggaaggcatcaggcagttctacatcaatgtggagcgcgaggaatggaagttggataccctttgtgatctgtacgagacattaaccataacccaggcagtgatcttcatcaacacaagacggaaggtggattggctcacagagaagatgcatgcccgggactttacggtatccgctatgcacggggacatggaccagaaggaaagagatgttattatgagagagtttaggtctggatcctccagggtgctgattaccacagaccttcttgcccgggggattgacgttcagcaggtttcattggttataaactatgacctgcccactaaccgggaaaactacatccacagaatcggccgcggaggccgtttcggcagaaagggagtggccatcaacatggtgacagaagaggacaaacgcacattgagagatattgaaacattttataacactagtatcgaagaaatgcctctgaacgtcgcagatttgatctag

SEQ ID NO: 116341 - DNA, 441 bp, Artificial Sequence
  Description of Artificial Sequence: Synthetic coding sequence
atggagcccgagggcgtgatagagtctaactggaacgaaatcgtggactccttcgatgatatgaacctgagcgagtcccttctccggggaatctacgcttatggatttgagaaaccttcagcaattcagcaacgcgctattctaccctgtatcaaggggtacgacgtgatcgcgcaagctcagagcggcaccggtaagaccgccactttcgccattagtatccttcagcagatcgaacttgatctgaaagccacccaggcactggtcctggcgcctactagggaactcgctcagcaggttagagtagctagcattccctcttttagagctgatctcggcatgatgtcgatcatacaggggccagaaaaaagctctctgattactactctgggcggacgacatggctgccctaacactctggagacctgctgggtgaactag

SEQ ID NO: 116342 - DNA, 603 bp, Artificial Sequence
  Description of Artificial Sequence: Synthetic coding sequence
atgtttgtgctggacgaggctgacgaaatgctgtcacgtggatttaaagatcagatctacgatatctttcagaaactgaatagtaacacgcaagtggtgctgctttccgcaaccatgccctccgatgttctagaggtgactaagaaatttatgagagatcccattaggatccttgtcaaaaaagaggaacttaccctggagggaattcggcagttttatatcaatgtggagagagaggagtggaagctggataccctctgtgatctgtacgaaaccctgaccataacacaagccgtaatatttattaacactcgccggaaggtcgattggctgaccgagaagatgcatgctagggacttcactgtgtccgcgatggtgtgcctccctgccgcctcgcttctctgggtatgccccagtgaggtctcctacctgaagcccggtttcttagaaccaagatgcctccctgggctgctgcacatctgcttcctgttccagcatggggatatggatcaaaaggagcgggatgtgatcatgagagagttccggagcggttcctctagagtgcttataacaacggacctgctggtgtccagagggaactag

SEQ ID NO: 116343 - DNA, 1026 bp, Artificial Sequence
  Description of Artificial Sequence: Synthetic coding sequence
atgtccgccagccaggattcacgatcccgagacaatggacccgatggcatggagccggaaggagtgattgaatctaactggaacgagattgtagatagcttcgatgacatgaacctgtcagaaagcctgctgcgtggcatatacgcttatgggtttgagaaacctagcgctatacaacagcgcgctattttgccctgcatcaagggttatgatgtgatcgcccaggcacaatctgggacaggaaagacagccacttttgcaatatccatactgcagcaaattgagctcgacctaaaggcaacccaggctttagtactagcccctacaagagagttagctcagcagattcagaaagtggtaatggccctgggggactacatgggagcatcgtgccatgcttgtatcggaggaacaaacgtgagggcagaagtgcaaaagctgcagatggaagcaccacatatcatcgtggggactcctggacgggtgttcgacatgctaaaccggcgttacctgtccccaaagtatattaagatgttcgtgcttgacgaggcggacgaaatgctcagtcggggcttcaaggaccaaatttatgatattttccagaagttgaatagcaacactcaggtcgttctgctcagtgcgacaatgccatctgacgtccttgaggtgactaagaagtttatgcgcgatccgatcaggattctggtcaaaaaggaagaactcacactggagggaatacgccagttttacatcaatgtggaacgagaggaatggaaactggacactctttgtgatctgtatgagaccctgaccatcacccaggctgtaatcttcataaatacgagaagaaaggtggactggcttactgaaaaaatgcatgctagagacttcaccgtcagtgcaatgcatggagatatggatcaaaaggagcgggatgtcatcatgcgtgagttccggtcagggtcctcccgagttttaatcacgacagatctgctgaacaggtcccgctggactgtgtggccatag

SEQ ID NO: 116344 - DNA, 1224 bp, Artificial Sequence
  Description of Artificial Sequence: Synthetic coding sequence
atgtcaggaggtagcgccgactataatcgggaacatggcggaccagaggggatggaccccgacggtgtcatcgaatctaattggaatgagatcgttgataactttgatgatatgaaccttaaggagtcccttctgcgcggaatatatgcatacggatttgaaaagcctagtgctatccagcaaagagctatcatcccttgtatcaaaggctatgatgtgattgctcaggctcagagcggcacaggcaagaccgcaacgtttgctatcagcatcctgcagcagctggaaatagaattcaaagagacccaggccctggtgctggcgccaactcgagaactagcccagcaaatccagaaagtcattctggcactgggagactacatgggtgcaacgtgtcatgcctgcatcggaggcacgaacgttcgtaatgagatgcaaaagctgcaggccgaggccccacatattgttgtcggaaccccgggacgggttttcgatatgctcaaccgccgatatctgtcgccaaagtggattaagatgttcgttctggacgaggcagatgaaatgttgagcaggggctttaaagatcagatttacgaaatatttcagaaactgaacaccagcattcaggtggttcttctgtccgccactatgccgaccgatgtcctggaggttacgaaaaaatttatgcgtgatcctatacggatcctggtgaagaaggaagagttaacactggagggcattaagcagttttacattaatgttgagagggaagagtggaagctcgacaccctgtgtgatttgtacgagaccctgacaataactcaggctgtgatatttctaaataccagacggaaggttgattggttaaccgagaaaatgcacgcacgagattttactgtttccgcgcttcatggagacatggaccagaaggaaagagatgtaataatgcgcgagttccgctccggatcaagtagggtgctgatcaccaccgatctgctagccagaggcatcgatgtgcagcaagtaagccttgtgatcaactacgatctccctactaatagggaaaattacatacatcggattgggaggggaggcaggtttggtcgcaagggagtcgccataaatttcgtgacagaggaagataagcgcattttgagagacatcgaaactttctacaataccacagtggaagagatgcccatgaatgtagccgacttgatttag

SEQ ID NO: 116345 - DNA, 939 bp, Artificial Sequence
  Description of Artificial Sequence: Synthetic coding sequence
atgctaactgtgctgcgcagtcttccattgttttcccgggaacttctgtttcctgtgcttaagatacagaaagtgattttggcgctgggggattacatgggggcgacctgtcacgcctgcattggcggcactaacgttaggaacgaaatgcagaaactgcaagcagaagccccgcacatcgtagtcggaacccccggacgagtgttcgatatgctaaaccggagatatctgtcccctaagtggattaaaatgttcgttctggatgaagctgatgagatgctctctagaggatttaaggatcaaatctacgaaattttccagaaactcaacaccagtatccaagttgtgttgctttccgccacaatgcccacagacgttcttgaagttacaaaaaagtttatgcgagatccaataagaattcttgtcaagaaagaggaactgactctcgaagggatcaagcagttttacattaatgtagaaagagaggagtggaagctcgacaccctttgtgatctgtatgaaaccctgacgatcacgcaggcagtcatctttttaaataccagacggaaagtggactggctgacagagaagatgcatgctcgcgatttcacggtgtccgcattgcatggcgacatggaccagaaggagcgggacgttattatgcgcgaattccggtccggcagctctcgggtgttaattactacagatctgctcgctaggggcatcgacgtgcagcaagtgtcactagtgatcaattatgatttgcccacgaatagagaaaattacatacaccgcattgggcgcgggggccggttcgggcggaagggtgtggctattaactttgtcaccgaggaggataaacgtattctgagggacatcgagaccttctacaacaccactgtggaggaaatgcctatgaacgttgcggacctaatttag

SEQ ID NO: 116346 - DNA, 1227 bp, Artificial Sequence
  Description of Artificial Sequence: Synthetic coding sequence
atgagcggaggctcagccgattataacagccgtgagcacggaggcccggaagggatggaccccgatggggtgattgaatcaaactggaatgaaatcgtggataacttcgacgatatgaatttaaaagagtccctgctccggggcatttatgcatacggattcgagaaaccaagcgctatccaacaaagagccatcatcccttgcattaaagggtatgatgtgatcgcacaggcccagagtggaacgggcaaaacagcaacctttgctatcagcatcctccagcagctcgagatcgaatttaaggaaacacaagcactcgtgttagcgcccacgagggagcttgcacagcagatacagaaggtcatcctagcactcggggactatatgggggccacctgccacgcctgtattggcggcaccaatgtccgcaacgaaatgcagaagctgcaggctgaggctccacacattgtagtgggcaccccaggccgggtgtttgatatgcttaaccggcgatacctgtcaccaaagtggatcaaaatgtttgtgttggacgaggccgatgagatgctgagtcgcggtttcaaggatcaaatttacgaaattttccagaagcttaatacgtcaatccaggtggtcttactaagcgccacaatgcccactgacgtgttagaggtgactaagaaatttatgagagaccctattcgcatcctagtgaaaaaagaagaactcacactagaaggcatcaaacaattttatatcaacgtcgagcgcgaggagtggaagctggataccctctgcgacctgtacgagaccctgacaatcactcaagcagtgatctttttgaacacccggaggaaggtcgactggctgaccgaaaagatgcacgcacgagacttcacggtgagtgcgctccatggtgatatggaccaaaaagagcgtgatgtgattatgcgggaatttcggagcggctcatcacgcgtgctgattaccacggatcttctggctcgcggcattgacgttcaacaggttagcttagttataaattacgatttgcccacgaatagagagaattatatccaccggattggtaggggtggaaggttcgggcgcaagggggtggccatcaatttcgtaacggaggaggacaagagaattctcagagatatagagaccttctataataccaccgtcgaagagatgccaatgaacgtggctgatctaatctag

SEQ ID NO: 116347 - DNA, 174 bp, Artificial Sequence
  Description of Artificial Sequence: Synthetic coding sequence
atgtctggagggtccgccgattacaatagggaacacggcggtcctgaaggcatggatcctgatggggtcattgagtccaattggaatgagatcgttgacaatttcgacgatatgaatcttaaggagagcctcctgcgggggatatatgcttacgggttcgagaagccttcttag

SEQ ID NO: 116348 - DNA, 297 bp, Artificial Sequence
  Description of Artificial Sequence: Synthetic coding sequence
atgagcggcggaagtgctgactataatagagagcatggagggcctgagggaatggatcctgacggcgtcattgagagtaactggaatgaaattgttgacaacttcgatgacatgaatctgaaagaatctctgctgcgaggcatatacgcctatgggttcgagaaacccagcgcaatccagcagagggcaattatcccctgcattaaaggttacgacgtgatagctcaggcccaaagtgggacagggaagactgcgacattcgcaatctcaatcctgcaacagctggagattgagtag

SEQ ID NO: 116349 - DNA, 363 bp, Artificial Sequence
  Description of Artificial Sequence: Synthetic coding sequence
atgagcagtagcgccggcagcgggcaccagccttcccagtcccgtgcgatccctacacgcactgtggcaatttctgatgccgctcagctgccccatgattattgcaccactcctgggggaacattattcagcacgacacctggaggcactcggataatctatgatcggaaatttctcctggataggcggaactctcccatggcacagacccctccctgccacctgccgaatatccccggggtcactagtcccggcactctgattgaggattctaaagtcgaagtgaacaacctgaacaatctgaacaaccatgatcgaaaacatgccgttggggacgacgcacagtttgaaatggatatttag

SEQ ID NO: 116350 - DNA, 738 bp, Artificial Sequence
  Description of Artificial Sequence: Synthetic coding sequence
atgaataacaaatttgatgccctaaaagacgatgattccggcgatcacgaccaaaatgaggagaacagcacccagaaagatggtgagaaggagaaaacagagcgcgataaaaatcagagcagctctaagaggaaagcagtcgtccctggtcccgcggaacatcctctccaatataattacactttctggtatagccgccgtacacctggcagacccacctcaagccagagttacgagcagaacatcaaacagatcggaacgttcgcctctgtggagcagttttggcgattctacagtcatatggtccggccaggagacttaaccggacattctgactttcatctctttaaggagggcatcaaacccatgtgggaagatgatgcaaacaaaaatggagggaagtggatcataaggctccgcaaagggcttgctagccggtgttgggagaacctcatccttgctatgttaggggagcagtttatggtcggtgaggagatctgcggagctgtggtctcagtgaggttccaggaggatattatcagcatctggaataaaactgcgagcgatcaagctacaactgctcggattcgtgacacactccggcgagttctgaatctgcctcctaacaccatcatggagtacaaaacccacaccgactctatcaaaatgccaggaagattaggcccccaacggctactctttcaaaacttatggaaaccaagactgaatgtgccctag

SEQ ID NO: 116351 - DNA, 705 bp, Artificial Sequence
  Description of Artificial Sequence: Synthetic coding sequence
atgaacaacaagttcgatgcgctgaaggacgatgattccggcgatcacgatcagaacgaggagaattctactcagaaggatggggagaaagagaagaccgaacgggacaagaaccagtcaagtagcaagaggaaggcagtggttcctgggccggcggaacatcctctgcagtacaattacactttctggtactccagaagaacaccaggtaggcccacatcctcacagtcttacgaacaaaacatcaaacagatcggcactttcgcgtctgtcgaacaattctggcgcttctactcccatatggtgcggccaggggacctgaccggccacagcgactttcacctttttaaggaggggataaaaccgatgtgggaagacgacgcaaacaagaatggcgggaagtggatcattaggcttagaaaagggctcgcttcccgctgctgggaaaacctgatcctcgccatgctgggggagcaatttatggtgggagaagaaatttgtggcgcagtcgtctctgtgagattccaagaggatattatctcaatctggaataaaacggccagcgatcaggctaccaccgcacgcatacgcgatactctccgtagagtcctgaatctgcccccgaacactatcatggaatataagacgcatactgatagtattaaggacaatagctctttccgcaatactaagatcactctttag

SEQ ID NO: 116352 - DNA, 567 bp, Artificial Sequence
  Description of Artificial Sequence: Synthetic coding sequence
atgaataataagtttgacgctctcaaggatgacgactccggggatcacgatcagaacgaggaaaactcgacccagaaagacggcgagaaggagaaaactgagcgtgacaagaaccagagctctagcaagcgtaaagtggagcagttttggagattctacagccacatggtgagaccaggtgacttgaccgggcacagtgacttccacttattcaaggaaggaatcaaaccaatgtgggaggacgatgcaaacaaaaacggcgggaagtggataattaggctcaggaagggtctggcaagccggtgttgggagaatctgatcctggcaatgctgggcgagcaatttatggtcggggaggagatctgtggcgcagtagtgtccgtcaggttccaggaggacatcatttctatatggaataagactgccagtgatcaagcaacgacagcccggatcagggatacactacgtcgggtactaaatctgccaccaaacaccattatggagtataaaacacataccgacagcattaagtatgtgcttggggggtacggaagaacatgcccttag

SEQ ID NO: 116353 - DNA, 357 bp, Artificial Sequence
  Description of Artificial Sequence: Synthetic coding sequence
atgaggggggagcgcaggcctctgtgggaagaagagagtaacgcaaaaggcggtgtctggaaaatgaaagtccccaaagatagcacatccaccgtctggaaagagctgctactcgcaacgatcggagagcagtttaccgattgtgcagcagcagacgacgaggtgatcggcgtgtcggtttccgttcgggatagggaggatgttgtgcaggtctggaacgtgaatgcctccctcgtaggggaagccacggtccttgagaaaatctacgagctcctaccacatatcaccttcaaagccgtgttctacaagccacacgaggagcaccatgctttcgagggcggaagaggaaaacactag

SEQ ID NO: 116354 - DNA, 357 bp, Artificial Sequence
  Description of Artificial Sequence: Synthetic coding sequence
atgcgcggcgagcgccgcccactctgggaagaagaaagtaacgctaaggggggagtctggaagatgaaggtgcctaaagactccactagcaccgtgtggaaggagctcctactggctacaatcggtgaacagttcaccgactgcgcagcggccgacgatgaagtgattggggtaagcgtgtcagtccgcgacagggaggatgtcgtccaggtatggaacgtaaacgccagcttagtaggtgaagctacagtgctggagaaaatctatgaactcctgcctcatataaccttcaaggccgtgttctataaaccccacgaagaacaccacgcgttcgagggaggtagagggaaacactag

SEQ ID NO: 116355 - DNA, 357 bp, Artificial Sequence
  Description of Artificial Sequence: Synthetic coding sequence
atgagaggagaacgccggcccctgtgggaggaggagagcaacgctaaggggggtgtgtggaagatgaaggtccccaaggacagtacgtcaacggtgtggaaagagttgttacttgctacaattggggaacaatttaccgattgcgccgcggcagacgacgaggtgatcggcgttagtgtgtccgtccgggaccgcgaagatgtcgtacaagtgtggaatgttaacgctagcctggtaggcgaggccaccgttcttgaaaagatttacgagctacttccgcacatcaccttcaaggcggtcttctataagccccatgaggagcatcatgcctttgaggggggacggggaaaacactag

SEQ ID NO: 116356 - DNA, 675 bp, Artificial Sequence
  Description of Artificial Sequence: Synthetic coding sequence
atggcgctgcctccagcagctgcaccacctgcgggtgcacgcgaacctccgggctcacgcgccgccgccgcagctgcagctcccgagccacccctgggactgcagcagctttctgcccttcagcccgaaccggggggtgttcctttacattcttcttggacgttctggctcgatcggagtctgcctggggccaccgcagctgagtgcgcatccaacctcaaaaagatctacactgtacagaccgtacagattttttggtctgtgtataacaacataccacctgtaacctcattgcccctgcgatgttcatatcacctcatgcgtggtgaacgcagacccttatgggaagaggagtcaaacgccaagggaggagtttggaaaatgaaagtgcctaaggacagcacctctactgtctggaaggagctgctactggcgacgattggcgagcagttcaccgattgtgctgctgctgatgatgaggtcataggagtgtctgtctctgttcgtgacagggaggatgtggttcaggtatggaacgtcaatgcttccctggtgggagaggctactgtgctcgaaaaaatctacgaattattaccacacatcactttcaaggcagtattctacaagcctcatgaagagcatcacgcatttgagggcggacggggaaagcattag

SEQ ID NO: 116357 - DNA, 357 bp, Artificial Sequence
  Description of Artificial Sequence: Synthetic coding sequence
atgcggggtgaaagacgccctctttgggaggaagagtctaatgcgaaaggcggagtatggaagatgaaggtcccaaaggatagtacgtccacagtgtggaaggaactgctgctagctactattggagaacaatttaccgattgtgccgccgccgacgacgaagtaattggagtgagtgtatctgttcgcgaccgggaggacgtggtgcaagtatggaacgttaacgcatccctggtgggggaggccactgtgctcgagaaaatctatgaacttttgccccatattacattcaaggccgtgttctacaagccgcatgaggagcaccacgctttcgaagggggtaggggaaaacactag

SEQ ID NO: 116358 - DNA, 135 bp, Artificial Sequence
  Description of Artificial Sequence: Synthetic coding sequence
atgcgtggggagcgccgtcccctctgggaggaggagtcaaatgcgaaggggggtgtttggaagatgaaggtgcccaaggattctacaagtaccgtctggaaggaactcctactggctacgatcggggagcaatag

SEQ ID NO: 116359 - DNA, 156 bp, Artificial Sequence
  Description of Artificial Sequence: Synthetic coding sequence
atgaggggggaacggaggccactttgggaagaggagagtaacgccaaaggcggagtatggaagatgaaagtgcccaaggattctacttctacagtgtggaaagaacttcttctggccacaatcggcgaacaatttaccgattgtgcggctgcgtag

SEQ ID NO: 116360 - DNA, 282 bp, Artificial Sequence
  Description of Artificial Sequence: Synthetic coding sequence
atgcgaggcgagcgacggccgctctgggaggaggaatccaatgcaaaaggcggagtgtggaaaatgaaggtcccaaaggactccacatcaactgtgtggaaagaactgcttctggctactatcggtgagcagttcacagattgtgcagcagctgatgacgaggtgattggtgtcagcgtctcagtacgagatagagaggatgtggtgcaggtctggaatgtaaacgcgtctttagtgggtgaggccacggtgctggaaaagatttatgagctgctcccgtag

SEQ ID NO: 116361 - DNA, 2958 bp, Artificial Sequence
  Description of Artificial Sequence: Synthetic coding sequence
atggataggcggagtatgggagagaccgaatccggcgacgcttttttggacctgaaaaagccccctgcctctaagtgtccacacaggtacaccaaagaagaactgttggacatcaaggaacttcctcactcaaagcagagaccttcctgcctgtcagaaaagtacgacagcgacggggtgtgggatccagaaaagtggcacgcatccctgtatccagcctcaggaaggagcagtcctgtggagtcactgaagaaggagcttgacaccgaccgtcccagcctggttagaagaatagttgatccacgcgagagagtgaaggaggatgacctggatgtggtgctcagccctcagcgccgctcttttggcggcgggtgtcacgtcaccgcagccgtgagctctagaaggtccgggtctcctttggagaaagactcggatggtcttcgtcttttgggcggtaggaggattgggtctgggcggattatttccgctcggacttttgagaaggatcaccggctaagcgacaaggacctccgcgatctccgagatcgggacagagagcgggatttcaaagataaacgattccggcgagaatttggtgactctaaacgcgttttcggtgagcggaggcgcaatgacagttacacggaagaagagcctgagtggttctcggcggggccaacctctcagtccgagacaatcgaattaaccggctttgacgataaaatactagaagaggaccataaggggaggaaaagaactaggagaagaaccgcatccgtgaaggagggtatcgtagaatgtaatggtggtgtggctgaggaggatgaggttgaggtgatactggcgcaggagccagctgctgaccaggaagtaccacgcgacgccgtcttgcccgaacagtctccaggcgacttcgattttaacgaattttttaacctggataaagttccatgcttagccagcatgattgaagatgttttgggtgaaggctccgtctctgcaagccggttctcgcggtggttctccaacccaagcagaagtggaagtaggagtagcagtctgggatcaaccccccacgaggagctagaaaggctggccgggctggagcaggcgatcctgtctcccgggcagaactctgggaattacttcgcccctatccctctcgaagaccacgctgagaacaaagtggatatccttgaaatgctgcaaaaagccaaggtggacctgaagcccctgcttagctcattgtccgcaaataaagaaaagctgaaggaaagttctcattccggtgtggtgctttccgtggaggaagtggaagccgggctcaagggtctgaaagtggaccaacaggttaagaactcaactccattcatggccgagcacctcgaagagaccctgagtgccgtaacaaataataggcagcttaagaaggacggggatatgactgcgtttaacaagttggtttccacaatgaaagcatcaggcactcttccaagccagccgaaggtctctcgaaacctggagtcacatctgatgagtcctgccgaaataccaggacagcctgtgcccaagaatattctgcaggagcttctgggccagcccgtgcagcgacctgccagctccaacctgctgtccggccttatgggttctttagagcccaccacatccctgctgggccagagagccccctctcccccactatcacaggtgttccagacccgcgccgcgtcagcggattacttgcgcccccgaattccatcacctattgggtttacaccaggtccacaacagcttttaggcgatccctttcagggcatgcgcaagcccatgtcaccaataacagctcaaatgtctcagctcgaactgcagcaagccgccctcgaagggctggccctgccccacgatctggctgttcaggccgccaacttctatcagcccggcttcggtaagcctcaagttgataggacgcgcgacggttttcgtaatagacagcagagggtcactaagtcaccggcccctgtgcatcgtggtaactcttcgtcccccgccccggcagcgtccattacctcaatgttatccccaagctttactcctaccagcgttatacggaagatgtacgagagtaaggagaaatctaaagaagagcccgcctcaggaaaagcggctctgggcgattcaaaagaagatactcagaaagcctccgaggagaatctgctttctagctcttcagtgccatccgcagatcgagactcctctcccacaactaatagtaaactgtccgcactacagcgctcatcttgcagcacacctttaagccaggccaaccggtacaccaaggagcaagattacagacctaaggccaccggccgcaagaccccaacactcgcctcacctgtgcccaccacaccatttctaaggcctgttcaccaggtgcctcttgtcccccatgttcccatggtgaggcccgcccaccaactgcaccctgggctcgtccaacgcatgctggcccagggggtccacccccaacatctgccttcactgctgcagaccggcgtgctaccaccggggatggatctctcacacttacagggaatttcaggcccgatccttgggcagcctttttaccctctgccagcggcgtctcacccactgttgaatcccaggcctggcaccccactgcatctcgctatggtgcagcaacagctgcagagatccgtcctgcaccctcctggctccggttctcacgctgcggccgtatccgtgcagaccacaccccaaaatgtgccttcccggagtggcctgccccatatgcactctcaattagaacaccgcccctcacagaggtcttcctctccggtgggactcgcgaagtggtttgggtcagacgtactgcagcagcctctgccgagcatgccagcgaaagttattagtgtggatgagcttgaataccgccagtag

SEQ ID NO: 116362 - DNA, 2436 bp, Artificial Sequence
  Description of Artificial Sequence: Synthetic coding sequence
atggacaggcgtagtatgggggagacagaatcaggcgacgcatttcttgacttgaagaagcctccggccagtaagtgtccgcaccgctacaccaaggaagagttgctggacataaaggagcttcctcactcaaaacagcgtccttcctgcctctcagagaaatatgactccgatggagtatgggatccagaaaagtggcatgcctctctgtacccggcctccggtcgcagctccccagtcgaaagcctcaagaaggagctggatactgacagaccatctttggtgcggcgaattgtgggcatagtggaatgcaacggaggggtggccgaggaggatgaggtggaggttatcttggctcaggagcctgctgctgaccaggaggtgcctagagatgccgtccttccagagcagagcccaggtgacttcgacttcaatgagttcttcaacctcgacaaggtcccgtgcctcgcatctatgattgaagatgtgctgggtgaaggatcggtgtcagccagcagatttagccggtggttctccaacccctctagaagcggctctcgttcttcgtccttgggttccaccccccatgaagaattggagagactggctgggctggagcaggccatcttgtccccgggacagaactccggaaactattttgcccccatcccactggaggatcacgctgagaataaggtcgacatactcgagatgctgcaaaaagctaaggtcgacctgaaacctctcctctcctccctaagcgcaaataaagaaaagttgaaggaatctagccattccggagtagtgttatccgtggaagaagtcgaggctggtcttaaggggctcaaagtggaccagcaggtcaagaatagtacccccttcatggccgagcacttggaagagactttgtctgctgttacaaacaatcggcagcttaagaaagatggcgacatgaccgcgttcaacaagctcgtgagcacaatgaagagaaatttagagtcacacctgatgtcccccgccgaaatccctgggcaacctgtgccgaaaaacatcctgcaagaattgctaggtcagccggtccagcgaccagcctcatctaatctgctgagtgggctgatgggttccctggagccgacgacatcactgttgggccagcgcgccccaagtcctcctttgagccaggtgttccagacgcgcgctgcaagcgccgactatctaagacccagaataccctcgccaattggatttacacccggcccacagcagctgttaggcgaccccttccaaggaatgaggaaaccaatgtctccgatcacagctcagcagatgagtcagcttgaacttcagcaggctgcactcgagggcttagcacttccccacgacctggcggtccaggccgccaatttctatcagcccgggtttgggaagccccaggtcgaccgtactcgtgatggttttcgaaatcggcagcagcgcgttaccaaatccccagccccggtgcaccgaggtaacagcagttcacctgcccccgccgcgtcaattacctctatgctgtccccttcttttaccccaacttcagtgattcgtaaaatgtacgaatctaaagagaagagcaaggaagagcccgccagcgggaaggccgccctgggagatagcaaggaagatacacagaaagccagcgaagaaaacctgctgagcagctcttcagtgccttcagctgatagagactcgagcccaacgaccaacagcaaactgagcgccctccagcgcagcagctgcagcacccccctgtcccaagctaaccggtacactaaagaacaggattaccggccgaaggccactggtaggaagacaccaaccctagcgagccccgttcctaccacccctttcctccgacccgtacaccaagtgcccttagtccctcacgtgccaatggtacgaccagcacaccagctccatcccggactggttcaaagaatgctggctcagggcgtccatccacagcacctgccttcactgctacaaacgggggtgcttcctcccggaatggacctatcccaccttcaaggcatcagcgggcccattcttggtcagcccttttatcctctgccagcggcctctcatccgctcttaaacccgcgacccgggactcctttgcatttagctatggtgcagcaacagctacagcgatccgtcttgcacccccctggttccggatcgcacgccgccgcagtctctgtgcaaaccactccacagaatgtgccaagccgctccggtctcccccacatgcactcacagcttgagcacagaccttctcagcggagtagcagcccggtcgggctcgccaagtggttcgggtcagacgtgctccagcaacctctgccctctatgccggcaaaggtcatttcggtggacgagctcgagtataggcagtag

SEQ ID NO: 116363 - DNA, 1923 bp, Artificial Sequence
  Description of Artificial Sequence: Synthetic coding sequence
atgatcgaggacgttctgggagagggctccgtgagcgcaagcagatttagtagatggttttcaaacccaagcagatcaggatcccgttcttccagcttaggaagcacaccacatgaagaattggaaagactggccggactggagcaggctatcttatctccagggcagaacagcggtaattatttcgcccccattcctctcgaagaccacgcagagaacaaggtagacattttggaaatgctccagaaggcaaaggtggatttgaagcccctgctcagctccctaagcgctaataaggaaaaactcaaagaaagctcacactctggcgtggttttatcagtcgaggaagtggaagccgggctaaaggggctgaaagtagatcagcaggtgaagaatagtactccattcatggctgaacatctagaggagacgctgtcagcagtgaccaacaatcggcagctgaaaaaagacggcgacatgacagcgttcaacaagctggtcagtaccatgaaagcctcaggaacactgcccagccagcctaaggtgtccgagctgctcggccagccagtgcagaggcctgccagctccaacttgctgtctgggctcatgggctctctggagcccactacttctcttctcggccagagagcccctagtccgcctttgagccaggtcttccagacaagggctgcttccgccgactatcttagacctcgtatcccttctcccatcgggttcacacctgggccacagcaactgctgggcgatccctttcagggaatgagaaagccaatgagcccgattaccgcccaaatgtcccagttggagttacagcaggcagccctggaggggctggccctacctcatgatcttgcagtgcaagcggccaacttctatcagcctggatttggaaagccccaagtcgacaggacccgcgacgggttcagaaaccggcagcagcgggtcactaaatctcctgctccagtacatagaggcaattcctctagccctgcgcccgctgcttccattacatctatgttatcaccgtcttttacacccacgtccgttataaggaaaatgtatgaatccaaggagaagagtaaagaagagcctgcatctggaaaggccgcactcggcgacagcaaggaggacacacagaaagcctccgaagagaatctcctgagctcttctagtgtaccgtccgctgacagggacagcagcccaacaacaaattcaaagctctccgcactccaacgtagctcttgctctactcctctgtctcaggcaaacagatacacgaaggagcaagattaccgccccaaggccactgggcgtaaaacaccgactctggcttcccctgtcccaactacgccctttctgcgtcctgtccatcaggtgcccctagtgcctcacgtccctatggtgcgccctgctcaccagcttcaccctggactggtgcaaaggatgctggcccagggggtgcacccgcagcacttaccctcactgctgcaaactggggtgctgcctccaggcatggacttgagccatctgcagggaatatcaggacctattctgggccagccgttctacccactcccagctgcatctcacccgctcctcaacccacggccaggcaccccgctacaccttgccatggtccaacagcagctgcaacggagcgtcctgcacccccccggttctggatcacacgcagccgctgtgtcagtacaaacaacaccccagaatgtgccgtcccgtagcggcctgcctcatatgcatagtcagctggagcacagacccagtcaacggtcatcttcccccgtggggttagcaaagtggtttggctctgacgtattgcagcaaccactaccatctatgcccgcaaaagtcataagtgtcgatgaactggagtataggcaatag

SEQ ID NO: 116364 - DNA, 192 bp, Artificial Sequence
  Description of Artificial Sequence: Synthetic coding sequence
atggataggcgctcaatgggggagaccgagtcaggtgacgccttcttggatctaaaaaagccaccagcctctaagtgcccccatagatatactaaggaggagttgcttgatatcaaggagctgccccacagcaaacagcgcccctcctgtttgtctgaaaagtacgatagcgatggtgtgtgggacccctag

SEQ ID NO: 116365 - DNA, 192 bp, Artificial Sequence
  Description of Artificial Sequence: Synthetic coding sequence
atggacaggaggtcaatgggagagactgagtctggcgatgcctttctggatcttaaaaaacctccggcctcaaaatgtcctcatcggtatactaaagaggagctgctggacatcaaggaactgccgcattccaagcagcggccctcctgcttgtcggagaaatacgattcagatggcgtgtgggacccctag

SEQ ID NO: 116366 - DNA, 2886 bp, Artificial Sequence
  Description of Artificial Sequence: Synthetic coding sequence
atggataggagatcaatgggggaaaccgagtccggggacgccttcttggacctgaagaagcctcccgctagcaaatgcccccatcgctacacgaaagaggagctgctcgacataaaggaactcccacatagcaagcagcggccgtcttgtctgtctgaaaagtacgactctgacggtgtgtgggaccctgagaagtggcacgcatcactgtatccagccagtggtcgttcttctccagtcgaatccctgaaaaaagaactggacactgaccgcccttccttagtccgccgtattgtggacccacgcgaacgcgtgaaggaggacgatttagacgtagtgctgagtccccagcgacgctccttcgggggcgggtgccacgtgactgccgcagtcagttcaagacgcagtggttcaccattggagaaggactccgatgggctgaggttgctgggcgggaggcgaattggttccggacgcatcatcagcgcccggacttttgaaaaggaccatcggctctccgacaaggacctgcgagaccttagggatagggatcgggaacgcgactttaaagataagaggttccgtagggagtttggtgactcaaagagagtgttcggcgagcgtaggcgtaatgactcatacactgaggaggagccagaatggttttccgccggccccacgagccagtctgagacgattgaattaacaggcttcgatgataaaatcttggaggaagaccacaaaggtcgaaagcgcacccgcaggcgcaccgcctccgtgaaagaaggaatcgtcgagtgcaacgggggagttgccgaggaggatgaggtggaagtgatcctcgctcaggagcccgccgcagaccaggaggtccctcgcgatgccgtattgcccgaacagtcaccaggtgattttgatttcaatgagtttttcaacctggataaagtgccatgcctggcctctatgattgaagacgtgctgggggaaggctcagtcagtgcatcaagattctctcgttggtttagtaatccgtcccgttccggaagtcggagcagctctctgggatccaccccacacgaagagcttgagcggctggcaggcctggaacaggcaatcctgtcgcctggccagaatagcgggaactatttcgcaccgattcctctcgaggatcacgcagaaaacaaggttgacatcctggaaatgcttcaaaaagcaaaagtggatctcaaacccttgctcagtagtctttcagcaaacaaagagaaattaaaggagtcttcccacagtggcgttgtcctgtcagttgaagaggtggaggccggcctaaagggtctgaaagtggaccaacaagtaaaaaacagcactccctttatggcggagcacctcgaggagacactgagcgccgtgacgaataatcggcagcttaagaaggacggagacatgacagccttcaataagctggtatcaaccatgaaggcctctggaacattgcccagtcagcctaaggtttccgaacttttgggtcagcctgtccagcgcccggcgtcgagcaacctgctgtccggattgatgggctcactggagcccaccacatccctgttaggtcaaagggcaccctcacccccactctcccaggtgtttcaaacaagagctgcaagtgccgattacctcagacctcgcattccttcacctataggatttacgcctggcccccagcaactcctgggggatccattccagggaatgcgtaagcccatgtcaccaatcactgcacagatgtcacagctagagctacagcaggcagcactcgagggccttgcacttcctcacgacttagccgtgcaggcagcaaacttttaccagccaggttttggaaagcctcaggtcgataggacaagggatgggtttcgcaaccggcagcaaagggtcacaaagtccccagcgccagtgcaccggggcaactcaagttcaccagcacctgcggctagcataacgtctatgctgtcaccctcattcaccccaacctctgtgatcagaaagatgtacgaatccaaagaaaaatcaaaggaggaacccgcctctgggaaggcggcgctgggggattctaaggaggatacccaaaaggcctccgaagaaaacctcctctccagctcaagcgtcccaagcgccgatcgcgacagctctcctaccacaaactcgaaactgtccgccctgcagagaagctcttgttcaacccctctctctcaggccaaccgctatacaaaggaacaggactataggcccaaggcgactggaagaaaaactcccacactggcctcccccgtacccaccactccttttctgaggcccgtgcaccaggttcctctggtcccgcatgtgccaatggttcgccccgcacaccaattgcacccaggcctcgttcagagaatgctcgcccagggggtgcaccctcaacatctcccctcattgctccagactggcgtgctgccccctggaatggaccttagtcacctccagggaatcagtggaccaatactcggccagccattctacccattgcccgcagcttcccatccgctgttgaaccctcgccccggaaccccacttcacctggctatggtccagcagcagctgcaaagaagtgtgctccacccaccggggtcaggcagccatgctgcagctgtttcggtgcagaccacaccgcagaacgtcccatcccgcagcgggcttccgcacatgcactctcagctggaacacagacctagtcagagatcatcctccccagtgggactggctaagtggttcggttccgacgtcctgcagcagccgctgccgagcatgcctgccaaagtcataagcgtcgatgagctcgagtacagacagtag

SEQ ID NO: 116367 - DNA, 2958 bp, Artificial Sequence
  Description of Artificial Sequence: Synthetic coding sequence
atggatcgaaggtcgatgggtgagacagaaagtggcgatgcctttctcgatctaaagaaacctcccgccagcaaatgccctcacagatacaccaaagaagaactcctggacattaaggaactccctcactcaaaacagcgccccagttgtctatccgaaaagtacgattctgacggagtttgggacccagagaagtggcatgcctcactttatcctgccagcgggcgctccagcccagtggaaagtctgaagaaagagttggacacggatcgaccaagcctcgtccgcaggattgtggatccgcgggaacgggttaaggaagacgacctggatgtcgtgttatcccctcagaggcggtcattcggcggggggtgtcacgtgaccgcagcagtaagctcaagacgaagcggaagtcctctggagaaggatagcgacggtctgcgcttgctgggcggaaggaggattgggagcggcaggattatctcagcgagaaccttcgagaaggatcaccgcctgagtgacaaggacttgcgcgacctgcgggacagggatcgcgaacgtgactttaaggacaagcggttccggagggagtttggtgacagtaaaagggtgtttggcgaacgaaggaggaatgactcctatacagaggaggagcccgagtggttcagcgccggccctacatcacagagcgagactatagagctgacgggcttcgatgacaagatcctggaagaagatcataagggacgcaagagaactcgacgtaggactgcaagtgtgaaagagggcatcgtggagtgcaatggaggcgtggcagaggaggatgaagttgaggtgattttggcccaagagcccgccgccgatcaagaggtccccagggacgctgtgcttcccgaacagtctcccggagactttgattttaacgaattcttcaacctggataaggtgccttgccttgcgtccatgattgaggacgtcttaggggagggctcagtgtccgcctcccggttcagccgctggttcagcaatccctcaaggtctggcagtcgcagctcttccctcggatcaaccccccacgaggagctcgagagactggccggcctggagcaggccatactgagtccaggccagaattctggcaattattttgcacctatccctctcgaggaccacgctgagaacaaggtcgatatacttgagatgcttcaaaaagcgaaggtggacctgaagcccctcctcagttcactttcggccaacaaggagaagcttaaagaatcctcccattcaggcgttgttctgtctgtggaggaggtggaggccggactgaagggcctaaaagtggaccagcaggtgaaaaattccacccctttcatggctgagcatttggaagaaacactctcggccgttacaaataacaggcagctcaagaaagatggcgatatgaccgcttttaacaagcttgtgagtacaatgaaggcctccggaactcttccctctcagccaaaggtaagcaggaacctggaatcccacttgatgtctcccgcagagatcccgggtcagcccgtgcctaaaaatattctgcaggaactcctcggccaacccgttcaacggcccgcctcttctaatctgctttctgggctaatgggcagtctggaaccaacaacaagcctgctggggcagcgagctccttccccgcccctgtcgcaagtcttccaaacccgagcagcatccgcagattacttgaggcctagaatccccagtcccattggttttacccccgggcctcagcagctactcggcgatccttttcaggggatgcgcaagcccatgagccctatcacagctcagatgtctcagctcgagctgcaacaagcagccttggagggactagctctgcctcacgatctcgcagtgcaggccgcaaatttctaccagccgggcttcggtaagcctcaagtcgaccggactagagatgggttccggaaccgacagcagcgagtgaccaaatctcccgccccagttcatcggggtaattcatcttcccctgcccctgccgcctccattacgtccatgctgagcccctcgttcacgcccacctccgtgattcggaaaatgtacgaatcaaaagagaagtccaaggaggaacccgcttctgggaaggctgcacttggtgattccaaggaggacactcagaaagcatctgaggaaaatctactgtcatcctcaagcgtcccgagtgcagaccgcgactcaagccctaccactaattccaaactatcagcactgcagcgcagcagctgcagcactccccttagtcaggcgaaccgttatacaaaggagcaggactatcgacccaaggctaccgggcgcaaaacacccacgttagccagccccgtgccgaccacccccttcttgcgaccagtgcatcaggtgcccttagttccccatgtgccaatggtacgccctgcacatcaactccaccccggtctcgtgcagcgcatgttggcgcaaggagtgcatccccagcatctgccttctctgctccagaccggcgtccttccacccgggatggacctctcacatttgcagggcataagcggaccgatactggggcagcctttttatcctttgccagccgcttcgcacccgctgctgaatccaagacctggtactcctctgcatcttgccatggtgcaacaacagttgcaacgaagcgttctgcaccccccgggtagtgggagtcatgcagccgccgtctcagtgcagaccactccacagaatgttccctctagatcggggctcccccacatgcactctcagttggagcatcggcccagccagagatcttcttctcccgtcggtttggccaagtggttcggatctgacgtcctccagcaacctcttccttccatgccagccaaggtgatttctgtggacgagctggaatacagacaatag

SEQ ID NO: 116368 - DNA, 1311 bp, Artificial Sequence
  Description of Artificial Sequence: Synthetic coding sequence
atggatcgcaggagtatgggcgaaaccgagagcggcgacgccttcctggacttaaagaagccgcctgcttcaaagtgtccccaccggtatactaaagaagaattacttgatattaaggaactgccgcatagtaagcagcggccgtcatgtctttccgagaagtatgatagcgacggagtgtgggatcctgaaaagtggcatgcaagtctgtaccccgcttccggacggagctctcctgtggagagcctcaagaaggagctggacaccgatcggcccagccttgtgcggcgcatcgtggatccacgggagcgcgtaaaggaagatgacctagacgttgtactcagcccacagagaaggtcattcgggggtgggtgtcatgtcactgcagccgtgagctctcgtagatccggctctcccttggagaaggactccgatggcctgaggctcttgggcggacgtagaataggtagcgggaggataatcagcgccagaaccttcgagaaggatcaccgccttagtgacaaagatctgagggatcttcgggatcgggaccgcgaacgagactttaaagataagcgcttccgtagggagtttggcgattcgaaaagggtgttcggggagcgtaggcgaaacgatagttataccgaggaagaaccggagtggttttccgcaggccctacaagtcagagtgagaccatcgagttgacgggatttgatgataagattctggaagaggatcacaaggggaggaagcgtacccgtaggcgtacagcctcagttaaagaaggaatagttgagtgtaacggtggagtggccgaagaggacgaggtcgaggtcatccttgcccaggaacctgccgccgaccaggaagttccccgcgatgctgtgttgcctgagcagtcaccgggagacttcgatttcaatgagttttttaacctcgataaagtcccatgtttagcctcgatgattgaagatgttttgggcgaagggtccgtaagcgccagccggttttctcggtggttctcaaatcccagccggtctggctctcggagctcatctttggggagtacacctcacgaggaactggagaggctggctggcctggaacaggccatcctaagccctggccagaattctggaaactatttcgcacctatacctctggaggaccacgctgaaaacaaggtggacatcttagagatgcttcagaaagcaaaagtcgacctgaaacccctcctgtctagcctgtccgcaaacaaagagaaactgaaggagagcctgcgtctgagtccgaagaagaaaaaaaagtag

SEQ ID NO: 116369 - DNA, 567 bp, Artificial Sequence
  Description of Artificial Sequence: Synthetic coding sequence
atggacagacggagtatgggcgaaactgagtcgggggatgctttccttgacttaaagaagccccccgcgtcaaaatgtcctcatcgatacaccaaagaggagctgttagatatcaaagagcttccccactcaaagcagcggccttcttgccttagcgagaagtatgacagtgatggggtatgggatcccgaaaaatggcatgctagtttgtatccagcatccggacggtcctctccggtggaaagcctgaagaaagaactggacacagatcgtcctagcctagtccggaggatcgtagatccacgagaacgcgttaaggaggatgacctcgatgtggtgttgtctccccagcggaggtcatttggcgggggatgtcacgttacagcggccgtatcgtcgagaaggagtggctccccacttgaaaaggattcagacggcctcagactactggggggcaggaggattgggtccggccggattatcagcgccagaactttcgagaaagatcacagattatcagataaggacctgcgggacctccgtgatcgagaccgggagcgggactag

SEQ ID NO: 116370 - DNA, 747 bp, Artificial Sequence
  Description of Artificial Sequence: Synthetic coding sequence
atggctgattttgacacttacgatgatagggcgtactcctcattcgggggtggccgagggtcacggggatcagcaggcggccacggaagcaggtctcagaaggagctacctaccgagccaccttatactgcctacgtgggtaatcttcccttcaatacagtgcagggagatatcgatgctattttcaaggacctgtccattaggagtgttcgcctggttagggataaggacaccgataagtttaagggcttctgctatgtggagttcgatgaggttgattcactgaaggaggccctcacctacgacggtgctctcctcggcgaccggagtctacgcgttgacatcgccgagggcaggaagcaagacaaaggaggctttggctttcggaagggaggaccagatgaccggggaatggggagcagtcgggaatcccgcggcggatgggacagcagggacgacttcaactctggatttcgcgacgacttcctcgggggaagaggtggaagccgccctggtgaccgaaggactggacctcctatggggtcccgttttagggacggccctcccctgcgcggcagcaacatggactttcgcgaacctacggaggaggagcgcgcccaaagaccgcggttgcagctcaaacctagaaccgtagccacaccccttaatcaggtcgctaaccctaattctgccatcttcggaggcgctcgcccacgggaggaagtggtccagaaagaacaggaatag

SEQ ID NO: 116371 - DNA, 687 bp, Artificial Sequence
  Description of Artificial Sequence: Synthetic coding sequence
atggctgacttcgacacatacgatgaccgagcatattctagtttcggggggggccggggttctcgtggatcggcgggcggccacggctcgcgcagtcagaaagagctaccaacagaacctccttatacagcctatgtggggaacctgccctttaataccgtccagggtgatatcgatgctatattcaaggacctgagtataaggtccgtgcggttagtgagggacaaagacactgacaaattcaaggggttttgctacgttgagtttgatgaggttgactccctgaaggaggcgctgacgtatgacggggccctactaggggataggtcactgcgggtggacatcgccgaggggaggaaacaggacaaaggaggttttggcttcagaaaagggggacccgacgaccgtgggtttcgagatgattttttgggggggcggggtgggtctaggcctggggacaggagaacagggccacctatgggaagtcgtttcagggacgggccccccctccgggggtccaacatggacttccgcgaacctaccgaggaggaaagagcccagcgaccccggctccagcttaaacctcggaccgtagctacacccctcaaccaggtggctaatccaaattccgctattttcggaggagcccggcctcgtgaggaggtggtgcagaaggaacaggagtag

SEQ ID NO: 116372 - DNA, 1050 bp, Artificial Sequence
  Description of Artificial Sequence: Synthetic coding sequence
atggaggctcacaacgcatctgctccattcaactttactttgccgccaaactttggcaaacgaccaactgatctcgctcttagcgtgattcttgtgtttatgctcttcttcattatgcttagcctgggctgtaccatggagttcagcaagattaaggcgcacctgtggaaacccaaaggccttgcaattgctcttgtggcccagtacggaatcatgcctttgaccgctttcgtcttagggaaggtcttccgcttaaagaatatcgaggcattagccattctggtgtgcggttgcagcccaggcggtaacctttcgaacgtcttttcccttgcaatgaaaggcgacatgaatctgtccatcgtcatgacaacctgcagtacattctgtgccctggggatgatgccattacttttgtacatatacagtagggggatatacgatggggacctcaaggataaggtgccttataaaggtatagtcatttcacttgtgctggttctgattccatgtactatcggtatcgtgctgaagagcaagcgccctcagtatatgcgttatgtgatcaagggagggatgatcatcatactgctctgctccgtcgcagtcactgtgctgtctgccattaatgtcgggaagtccatcatgtttgccatgactcccctgctaattgccactagctcactcatgccattcatcgggttccttctgggatacgtactctcagcccttttctgcttgaacgggcggtgtagacgcactgtatccatggagacagggtgtcaaaacgtccagctgtgttctaccatcctgaatgtggctttcccaccagaggtaatagggcccttgtttttcttccctctactatatatgatatttcagcttggagaggggctattactcattgcaattttttggtgttacgaaaaattcaagacgcccaaggacaagactaagatgatctacactgcggctaccactgaagaaacaattcccggggctctgggaaatgggacttataaaggggaggattgctcgccatgcaccgcatag

SEQ ID NO: 116373 - DNA, 1296 bp, Artificial Sequence
  Description of Artificial Sequence: Synthetic coding sequence
atgtctgtcaatgtgaaccgctccgtctccgaccaattctacagatacaaaatgcccagactaatcgccaaagttgaggggaagggcaatgggataaagactgtaatcgtgaatatggtggatgtggcgaaagccctcaatcgtccaccaacctacccgacaaagtacttcggttgtgagttgggtgctcagactcagttcgatgtgaaaaatgatcgatatattgtaaacgggtctcatgaagcaaataagctgcaggacatgttggacggatttatcaagaaatttgttctatgcccagaatgtgaaaatccagagactgacttgcacgtgaatcctaaaaagcaaaccatcggaaattcatgtaaagcttgtggctaccgtgggatgctcgatacccaccataagctgtgcaccttcatcctgaagaaccccccagagaactcggactccggcaccggcaagaaagaaaaggagaagaaaaatcgaaagggaaaagacaaggaaaacggtagtgtctcaagctctgagacaccccctccccctcctcctcctaacgaaatcaacccaccgcctcacactatggaagaggaagaagacgacgattggggcgaagacaccactgaggaggcccagagacgaaggatggacgagatctcagatcacgccaaagtgctcacactttccgacgacctcgagaggactattgaggaacgggtgaatatcctgttcgatttcgtcaagaaaaagaaggaggaaggtgtcatagacagtagcgacaaggaaattgtcgcagaagccgaaaggctggacgtcaaggccatgggaccccttgttctgaccgaggtgctcttcaacgagaaaattcgtgagcagattaaaaagtatcgacggcactttctacgcttctgccacaacaataaaaaggcacaaagatatctcctgcatggcctggagtgcgtagtggccatgcatcaggcccagctcatcagcaagatcccgcatattctgaaggaaatgtatgatgccgacttattggaagaggaggtgattatttcatggagcgagaaagcctccaaaaaatatgtgagcaaggagctcgctaaggaaattcgagtcaaagctgagcctttcatcaagtggctgaaggaggccgaagaggaaagctctgggggagaggaagaggacgaagatgaaaatatagaagtggtctactctaaggcagcttcagtgccaaaagtggagaccgtcaagtctgataacaaggacgacgacattgatatcgacgccatttag

SEQ ID NO: 116374 - DNA, 603 bp, Artificial Sequence
  Description of Artificial Sequence: Synthetic coding sequence
atgtctgttaacgtgaataggtcagtcagtgatcaattttacaggtataagatgccacggctgatcgccaaggtcgaggggaaggggaacggaatcaagacagtgatagtgaacatggtggacgtggccaaagctctgaaccggccacctacctatccaacaaagtattttggctgcgagttaggagctcaaactcagttcgatgttaagaatgaccgatatatagtcaatggcagccatgaggccaacaagttgcaggacatgttggacggcttcattaagaaattcgtgctctgtcccgagtgtgagaaccccgaaacggaccttcatgtgaatcctaaaaagcagaccatcgggaattcttgcaaggcatgcgggtatagagggatgctggatacccaccacaagctgtgcacatttattctcaaaaacccgccggagaactcagattcaggtaccggtaaaaaggaaaaggagaagaaaaaccggaaaggaaaggacaaggaaaacggtagcgttagtagcagtgagaccccacccccgcctccaccccccaatgaaatcaatccccctccacacacgatggaggaggaggaggactag

SEQ ID NO: 116375 - DNA, 441 bp, Artificial Sequence
  Description of Artificial Sequence: Synthetic coding sequence
atgagcgttaatgttaaccgcagcgtttctgaccagttctatcgatacaagatgcctcgcttaatcgcaaaagtcgaggggaagggcaacggaataaagaccgtaatcgttaacatggtggacgttgcgaaagcactgaatcgccctcccacataccccacaaagtacttcgggtgcgagcttggagcccagactcaattcgatgtaaagaacgataggtacattgtcaacggatcgcacgaagccaacaaacttcaggatatgctcgacggattcatcaagaagttcgtcctttgcccagaatgtgagaatccggagaccgaccttcatgtgaatcccaaaaagcagactatcgggaactcctgcaaagcctgtgggtatagaggcatgcttgatacacaccacaagctttgcacctttatccttaagaatccaccgtag

SEQ ID NO: 116376 - DNA, 1296 bp, Artificial Sequence
  Description of Artificial Sequence: Synthetic coding sequence
atgtccgttaacgtgaacagaagtgtgagcgatcagttttaccgctacaagatgcctagacttattgccaaagtagaaggcaagggaaacggtattaaaaccgtcattgtcaacatggtggatgtggccaaggccctcaaccgccctcccacctacccaacgaagtacttcgggtgcgaattaggagcccagactcaatttgacgtgaaaaacgataggtatatcgtgaatggctcacacgaggccaataagctgcaggacatgctggacggcttcatcaaaaaattcgtgttgtgccctgaatgtgagaacccagagacagatctccacgttaatcctaagaagcagactattggaaactcctgcaaggcttgcgggtacaggggtatgctagacactcatcacaagctctgcactttcattttaaagaatcccccggagaacagtgacagcgggactgggaagaaggagaaggaaaagaagaaccgcaaaggcaaggacaaagagaatggatccgtgtcatcaagtgaaacacctccacctcccccccctccgaatgagattaacccacctccgcacacgatggaggaggaggaggatgatgactggggagaggacaccaccgaagaagcgcagaggagacgtatggacgaaatatcagaccacgcaaaagtcctcacgttgtcagacgacttggagcggaccatcgaggagcgggtgaatattttgttcgactttgtaaagaaaaaaaaggaagaaggcgtaatagattctagcgataaggaaatagtggccgaggcggagcgactagatgtgaaagccatggggccattagtcctaaccgaggtgcttttcaacgaaaagataagagagcaaatcaagaagtacaggaggcacttcctgagattctgccataacaacaagaaggctcagcgctatcttcttcacggattagagtgcgtggtggctatgcatcaagcccagttaatcagcaaaatccctcacatcctcaaggaaatgtatgacgcggacttactggaggaggaagtgattatcagctggtccgagaaagccagcaagaagtacgtttcgaaagagttggcaaaagaaataagggtaaaagctgaaccgtttattaagtggctgaaggaagccgaagaggagagcagcggtggagaagaggaagatgaggacgagaacattgaggttgtgtactccaaggcggcctctgtccctaaagtggagacggtgaagagtgacaacaaggatgatgacatcgacattgatgcaatttag

SEQ ID NO: 116377 - DNA, 210 bp, Artificial Sequence
  Description of Artificial Sequence: Synthetic coding sequence
atgtcagtgaacgtgaacaggagtgtttcggatcaattttatagatacaaaatgcctcggctgatcgccaaggtggaggggaagggcaatggtataaagacagtgattgtgaatatggtggacgtggctaaagcactcaaccggcctccaacatatccaactaaatacttcggatgtgaactgggggcacagactcaattcgacgtttag

SEQ ID NO: 116378 - DNA, 330 bp, Artificial Sequence
  Description of Artificial Sequence: Synthetic coding sequence
atgagcgtgaatgtaaatcgctccgtcagtgaccagttttacaggtataaaatgcccaggttgattgcaaaagttgagggcaagggtaacggcattaaaaccgtgattgtgaacatggtggacgtggcgaaagccctgaaccggcccccaacatatcctactaaatattttggttgtgagctcggcgcgcagacacagttcgacgtgaagaatgaccgatacatcgtgaacggcagccacgaagctaataaactccaggacatgctggacgggttcatcaagaagtttgtcctatgtccagagtgcgagaatccagaaaccgatctctag

SEQ ID NO: 116379 - DNA, 306 bp, Artificial Sequence
  Description of Artificial Sequence: Synthetic coding sequence
atgagcgtgaatgtcaatcggtccgtgtcagaccagttctatagatataagatgcccaggttaattgccaaagtcgaagggaagggaaatggaattaagactgtaatcgtcaatatggtcgacgtcgccaaggcacttaacaggcctccaacgtatcctacaaaatactttggctgcgagctgggagcccaaacccaatttgacgtcaaaaacgaccggtatatcgtgaacggcagccacgaggcaaacaaactgcaggacatgctggacggctttatcaaaaaattcgtgctgtgccctgaatag

SEQ ID NO: 116380 - DNA, 156 bp, Artificial Sequence
  Description of Artificial Sequence: Synthetic coding sequence
atgagcgtgaacgtcaaccgaagcgtcagcgaccagttctaccgatataaaatgcctaggctcatcgctaaagtcgagggaaagggtaacgggataaaaactgtgatcgtgaacatggtggacgtggccaaggcccttaaccgcccaccaacatag

SEQ ID NO: 116381 - DNA, 330 bp, Artificial Sequence
  Description of Artificial Sequence: Synthetic coding sequence
atgtctgtgaacgtcaataggagcgtcagtgaccagttctatagatacaaaatgcccaggttgattgctaaggtggagggcaaagggaatgggatcaagaccgtcattgtcaacatggtcgatgtggcgaaggccctcaaccgacctcctacctatcccacaaagtacttcggttgcgagttgggcgcacagacgcagttcgacgtgaagaacgatagatacatcgtcaacggtagtcacgaagcgaataagttgcaggacatgcttgacgggttcattaaaaaattcgtcctttgccccgaatgtgagaatcccgagaccgatctgtag

SEQ ID NO: 116382 - DNA, 555 bp, Artificial Sequence
  Description of Artificial Sequence: Synthetic coding sequence
atgtgtgggactggaggaacggacagtaagacgagacgccctccccacagagcttcttttctgaagaggctggagagcaaacccctgaaaatggcggatgatctggactttgagaccggagacgctggagcatccgctaccttccctatgcaatgtagcgccctgcgaaagaatggtttcgtggtgttgaaggggagaccatgcaaaattgttgagatgtctactagcaagaccgggaaacatgggcacgccaaggtgcacctcgtcgggatcgatatatttacagggaagaagtacgaggacatctgcccctcaactcacaatatggacgtgccgaatattaaacgtaatgattttcagcttattggaatccaagacggctacctctctcttttgcaggattctggagaggtaagagaggacttgcgactgcctgagggagatttagggaaagagattgagcaaaagtatgattgtggagaagagatcttaataaccgtactgagcgccatgaccgaggaggctgccgtcgccattaaagccatggctaagtag

SEQ ID NO: 116383 - DNA, 465 bp, Artificial Sequence
  Description of Artificial Sequence: Synthetic coding sequence
atggctgatgacttggacttcgaaaccggggacgccggtgcgagtgcaactttccccatgcagtgttctgcacttagaaaaaacgggtttgtcgttctgaagggacggccttgtaagattgtcgagatgagcacgtcaaagacaggcaagcacgggcacgctaaggtccacctcgtggggatcgacatttttacgggaaagaagtacgaagatatttgtccttccacccacaacatggatgtcccaaacatcaaacggaacgatttccagcttatcggcattcaagatgggtacctgtcccttctgcaggattccggcgaagttcgtgaggatttgagactgcctgaaggcgatcttggcaaggaaatcgagcagaaatacgattgcggagaggagattttgatcaccgtactttccgcaatgacagaagaagccgctgttgcaatcaaggctatggccaagtag

SEQ ID NO: 116384 - DNA, 645 bp, Artificial Sequence
  Description of Artificial Sequence: Synthetic coding sequence
atgacttggacgtcccggcaggaaatgcagggacctcagcctccttcccagtgctctgctcagcattacgtcaggatggctttatggtgttcaaaagccggccatgtccggtcatcacggtgcctcttgagacgattagccagtaccgccacaccacgcctggaattccatctgcgtatattgccctccccatgcctccagtacttatggaggtctcaacagcaggccgctaatagtgctgacttccccctcactctgctacttctatcagactgcttctgcctagccctgtccctccacacccactctgacaattatacgtgctcaccagtgtttagcctgttttgtggttatccttcggtgccagcctcgttctcggggagtccaagcgtgtcaccagccctgtgccagtccctgcagttcattggactctatgcgttggccatccagctattactcccctattcctggttctctctgtttttgtcgagtcttgagccgcttttgtcagggtgctttcatcatgttgcgcagggattctccaacagcactccctcccccggaggaacgcccgcttctatcctgtcatttcaggtgacactgctcctaagatcgcccgtcctggccttcccgctcgaactctag

SEQ ID NO: 116385 - DNA, 465 bp, Artificial Sequence
  Description of Artificial Sequence: Synthetic coding sequence
atggcggacgatctcgatttcgaaacgggggatgccggggcctccgcgacattccccatgcagtgtagcgctctgcggaagaacggcttcgtggtcctcaaagggcggccctgtaaaatcgtggaaatgtcaacgtctaaaacggggaaacacggccacgccaaggtccacctcgtcggcatcgacatttttaccgggaaaaaatatgaagatatttgtccctcaacccacaatatggacgtgcctaatatcaagcggaatgactttcagttgattggaattcaggacgggtatctgagcctgctgcaagacagcggcgaagttcgggaagacctgagacttcccgaaggtgatttgggcaaagagattgagcagaaatatgattgcggtgaggagatactgatcaccgtgttgagcgctatgacggaggaggccgccgtagctattaaagccatggccaagtag

SEQ ID NO: 116386 - DNA, 465 bp, Artificial Sequence
  Description of Artificial Sequence: Synthetic coding sequence
atggctgatgatctagacttcgaaacgggggacgccggtgcctctgccactttcccaatgcagtgttcagccctacgaaaaaacggctttgtagtactaaagggacgcccttgtaagatcgtcgagatgtccactagcaaaacaggaaagcatgggcacgcaaaagtgcacctggttggcatagacatcttcaccggcaaaaaatacgaggatatttgtccctccacacataacatggatgtccccaatatcaagagaaacgacttccaattgataggcatacaggatgggtacctttcattgctccaggactctggtgaggtcagagaagatttgaggctgcccgagggtgaccttggaaaagaaatagagcagaaatacgattgtggtgaggaaattcttattacagtgctgtccgctatgactgaggaggctgcagtggcaatcaaagctatggctaaatag

SEQ ID NO: 116387 - DNA, 462 bp, Artificial Sequence
  Description of Artificial Sequence: Synthetic coding sequence
atggctgatgaaatcgattttacaaccggagatgccggcgcgtcatctacataccccatgcagtgttctgccctcaggaagaacggattcgtggtgctgaagggcagaccatgcaaaatcgttgagatgtccaccagtaagaccggcaagcacggacatgctaaagtccaccttgtgggaatcgatattttcaccggcaagaagtacgaagacatctgcccttcaacccacaacatggacgtgcccaacattaagcgaaacgactaccagcttatttgcattcaggacggctacctttcgctgctgaccgaaaccggcgaggttcgagaggacctaaagctgccagagggcgaactcgggaaagagatcgaaggcaagtacaacgccggggaggatgtccaagtgagtgtgatgtgcgccatgagcgaggagtatgccgtagcgattaaaccttgtaagtag

SEQ ID NO: 116388 - DNA, 738 bp, Artificial Sequence
  Description of Artificial Sequence: Synthetic coding sequence
atggccgtcagagcatcatttgaaaataactgtgagatcgggtgcttcgccaagctcactaacacatactgcctggtggccataggggggagcgaaaatttttattctgtttttgagggagagctatccgatacaatccccgtcgtacacgcctcaatcgcagggtgtcgcattatcggacgcatgtgtgtgggcaataggcacggtcttctggtgcctaataacacaactgatcaggaactccagcatatccgaaactctctgcccgacactgttcagatcaggcgcgtcgaggaacggctgtccgccctcggcaatgtcaccacctgtaacgattacgtggccctggtccatcctgacctggatagagaaaccgaggagattctggcggatgtccttaaggtggaggtgtttagacagaccgttgccgatcaagtgcttgtcgggtcttactgtgtgttcagtaaccaaggtggactggtccacccaaaaacctcaattgaagatcaggacgagttatccagcctccttcaagtgcccctggtcgccgggaccgttaaccgcgggtccgaggttatcgctgctgggatggttgtcaatgattggtgcgcattttgcgggctggacacaacgagcacggagctctctgtggtggagagcgtgtttaaactgaatgaggctcagccatccaccatagcaacatctatgcgtgattccctgatcgattcactgacatag

SEQ ID NO: 116389 - DNA, 681 bp, Artificial Sequence
  Description of Artificial Sequence: Synthetic coding sequence
atggcagtgcgtgcgagcttcgagaataactgcgaaataggatgcttcgcaaaattgaccaatacctattgtttggtggccattggtggttccgaaaatttttatcgctgtggcgggtcacctggcgcctatggcggcggagaagcctgtgcaggggtcaaatcaagcggttccgggcgcgtgcctgcacccctgccccgacatcatcgcgtacatgtaccgacggtctgcagtcgggcctcctcacccatcccaagcccttggtgcacccggctgagtcccgcagccgcctcttcgggcgcatgcgtttgggagacagaggaaattctagctgatgtacttaaggtcgaggtgttccggcagactgtggccgaccaggttttggttgggtcatactgcgtcttttcaaaccaaggaggtctcgttcacccaaagaccagtattgaagatcaggacgagctgtcgtccttattgcaagtcccactcgtcgcaggaacagtcaatagggggtctgaggtgatcgccgctggaatggtggtgaatgattggtgcgccttttgcggccttgacaccacctcgactgagctgtccgtggtggagtcagtcttcaagctcaatgaagctcagccctctacaatcgcaacctcgatgcgtgacagtctcatcgacagtctgacatag

SEQ ID NO: 116390 - DNA, 738 bp, Artificial Sequence
  Description of Artificial Sequence: Synthetic coding sequence
atggccgttcgtgcttctttcgaaaataattgcgaaataggatgctttgcgaaactgacaaatacctactgtttggtagccatcgggggctcagagaatttttacagcgtgttcgagggagagctttcggacaccataccagtggtgcacgcaagcattgccggctgtcggattatcggccggatgtgtgtagggaacagacatggcctgctagtgcctaataacactaccgaccaggaactgcagcatatccgcaattcccttccggataccgttcaaatcaggagggtagaagagcggctgtcagcgctgggtaacgtcacgacgtgtaacgactacgtggcactggtacatccagaccttgacagggaaactgaggaaattctagcagatgttctgaaggtagaagtgttcaggcaaaccgtggccgaccaggtcctcgtcgggtcgtactgcgttttctctaaccagggaggtcttgtgcatcctaaaacctctatcgaggaccaagatgagctgtcaagtctgttacaagtccctctcgtggctggcaccgtgaacaggggcagcgaggtgattgccgcaggcatggtcgtgaacgactggtgcgctttttgtggcctggacactactagcacggagttgtccgtcgtggagagcgtttttaaactcaacgaagctcagcccagtactattgcgacatctatgcgcgattctttgattgatagccttacctag

SEQ ID NO: 116391 - DNA, 327 bp, Artificial Sequence
  Description of Artificial Sequence: Synthetic coding sequence
atggccgtgcgcgccagcttcgagaacaactgcgaaattgggtgttttgcgaagctaactaatacctactgcctggtcgcaatcggcggaagcgaaaacttctatagcgtatttgaaggcgaacttagtgacactatcccggttgtgcatgcctctattgcaggttgtagaatcattgggcgtatgtgcgtggggaataggcacggtctgctggtcccaaacaacactaccgatcaggaacttcagcacattcgcaattcgctccccgacactgtgcagatcagacgcgtcgaggaaagactgagcgccctggggaacgttacatag

SEQ ID NO: 116392 - DNA, 1314 bp, Artificial Sequence
  Description of Artificial Sequence: Synthetic coding sequence
atggccgacgatccgtctgctgctgacaggaacgtggaaatttggaagattaaaaagttgatcaagagcctcgaggccgctcggggaaacggaacatccatgatctctctgattattccacctaaagatcagatctctagggtggccaaaatgctagcagatgagtttggcacagcctccaatatcaaaagtcgcgtgaacagactttcggtgctgggggctatcacgagtgtgcagcagcggctgaagctgtacaacaaggtcccccccaatggtctggttgtgtactgtggcactattgtcacagaggaaggcaaggagaaaaaagtaaacattgattttgaacccttcaaaccgattaataccagcttatatttgtgcgacaataagtttcacaccgaggctcttaccgcactcctctccgacgatagcaaatttgggttcattgtgatcgacgggagtggagcactgttcggcacgctgcagggtaatacgagggaggtgctgcacaaatttactgtggacctgcccaagaagcatggcaggggaggccagtccgctctgagatttgccaggttgcgcatggaaaaaaggcataactacgtgagaaaggtggccgagactgcagtgcagctattcatttctggagacaaagtgaacgtggctggtctggttctggccgggagcgcggatttcaaaaccgaactgtcccagagcgatatgtttgatcagagactccagtccaaggtcctcaaacttgtggacatttcatatggaggcgaaaacgggtttaaccaagctattgagcttagcaccgaagtgctcagcaatgtcaaatttattcaggagaagaaactgatagggcggtattttgatgaaatctcccaggacaccggaaaatattgctttggtgttgaagataccctgaaagcattagaaatgggtgccgtggaaattctgatcgtgtacgaaaatctggacatcatgaggtacgtactgcactgccaggggactgaggaagaaaagatattatacctaacgcccgagcaagagaaggataagagccacttcaccgataaggagaccggtcaggaacatgagctcattgaatcgatgccgctgctagagtggttcgcaaacaattataagaagtttggcgccaccctggagattgtgacagataaaagtcaagaaggaagccaattcgttaaggggttcggcggcattggaggcatcctgcggtacagagtagacttccaggggatggagtaccagggtggggacgacgaattctttgatctcgatgattactag

SEQ ID NO: 116393 - DNA, 1215 bp, Artificial Sequence
  Description of Artificial Sequence: Synthetic coding sequence
atgatctctctgattattccacccaaagaccagatctcacgagtcgcaaaaatgctcgcagatgaatttgggacagccagcaacattaagtctcgagttaaccgcctcagtgtcctgggggctatcacatctgtccagcaacgcctgaaactgtacaataaggtgcctcccaatggtctggttgtgtattgcggcacaattgtgaccgaggagggaaaagaaaaaaaggtgaatattgacttcgaacctttcaagccaattaatacatcattatatctttgtgacaataaattccacactgaagccttaaccgccctgctctccgatgacagtaagttcggtttcatcgtcatagacgggagcggcgccctgttcgggaccctgcagggcaatactcgggaggtcctacacaagttcaccgtggatttacctaagaagcacggaagaggcgggcagagtgccctgcgtttcgctaggttaaggatggaaaagcgccacaattatgtgcggaaggtggccgagacggcagttcagctttttattagcggcgacaaagtaaacgtggccgggctcgtgctcgccggaagtgccgatttcaagacagagctctctcaaagtgacatgttcgaccaacgcctacagtccaaggtgttgaaactcgttgatattagttatgggggggaaaacggattcaaccaggcaatagagttatcaacggaggtcctcagcaacgtgaaatttatccaggaaaagaaactgattgggagatatttcgacgaaattagccaggataccgggaaatactgcttcggcgtggaggatacgctgaaagccctcgagatgggggccgtggagatattgatagtttacgagaacctggacataatgcgttatgtgctgcattgtcagggaacggaggaagagaaaattctctaccttaccccagagcaggagaaggataagtcccacttcacggataaggagaccggccaggaacatgagttgattgaatcaatgcctctgttggaatggtttgcaaacaattataaaaaattcggagcaaccctcgaaatcgtgaccgacaagagccaggagggttctcagttcgtaaagggttttggaggaattggcgggatattacggtaccgtgtagacttccagggaatggagtatcaggggggcgatgacgaattcttcgacctggatgattactag

SEQ ID NO: 116394 - DNA, 1272 bp, Artificial Sequence
  Description of Artificial Sequence: Synthetic coding sequence
atgaagcaagatgtgctgaattgtacagaaggccccattcattccaacggaacgtccatgatttccctgataatccctcccaaagaccagatttctcgagtggcaaagatgctggccgatgaatttggcaccgcctccaatattaagtctagggtcaaccgactctctgtcctaggtgccatcacttctgtccagcaacggttaaaattatacaataaggtgccacccaacggtttagtggtttactgtggaacaatagtcactgaagaaggaaaagagaagaaggtgaacatcgactttgaacccttcaagccaatcaatacatcattatatctatgcgacaataaattccatacagaggctctcacggcactgctcagcgacgacagtaagtttggcttcatagtgattgacgggtctggcgccttgtttggcacccttcagggtaacaccagagaagtgctccacaagtttaccgtggacctgccaaaaaaacatggccgtggcggccaatcagctctgcgattcgccagactcaggatggaaaagaggcataattacgtgaggaaagtggcagagaccgctgtgcagctgttcatctctggtgacaaggtgaatgtcgcaggtttagtactcgccggatccgcagactttaaaaccgaactgagccaatcagacatgttcgaccagaggcttcagtcgaaggtgcttaagctggttgatatttcttacggcggggaaaatgggttcaatcaggccatcgagctgagcacggaagtgctctctaacgttaagttcattcaagagaagaagctgatcggccgatattttgacgagattagccaggataccggaaagtactgtttcggggtggaggacactctgaaagcattggaaatgggagctgtggagatcctgattgtgtacgagaacctggacattatgcgatacgtgcttcactgccagggcactgaggaggagaagattttgtacttaacacccgagcaggagaaagataagagtcactttacagacaaggagactggacaggaacacgagttaatcgagagcatgcctctcttggaatggtttgccaataattacaaaaagtttggagctactctggaaatcgtcactgacaagagtcaggagggaagtcagtttgtaaaaggatttgggggcatagggggtattctgaggtaccgcgtggatttccaggggatggagtatcagggaggggatgacgagtttttcgacttggacgactactag

SEQ ID NO: 116395 - DNA, 1224 bp, Artificial Sequence
  Description of Artificial Sequence: Synthetic coding sequence
atggagagtaggaaagatatggtggtattcctggatggtggccagctgggaaccctggtcggaaaaagagtgagtaacctctccgaggctgtcgggtcgcctctgccagagccacctgaaaagatggtgcctcgaggttgtttaagtccacgggccgtcccaccagctactagagagagaggaggtggcgggcccgaggaggaacctgttgacggacttgcagggtcagctgcaggcccgggtgctgaaccgcaggtggctggcgcagccatgcttggtcccggtcctccagctccttcggtcgactctctgtccggccagggccagccgagcagctcggatacagagtctgacttctacgaggaaatagaagtgagctgcacaccagactgcgcaactggcaacgctgagtaccagcactccaaagggagtggcagtgaagccctcgtggggagtcctaacgggggctctgaaaccccgaagagtaatggcggcagcggcgggggcgggtcacagggcaccctcgcctgctctgcctccgaccagatgaggcgctacaggaccgccttcacgagggagcagatcgcccgtttggaaaaggagttctaccgggagaattacgtaagccgtcctcgcagatgcgagttggccgccgcgctgaacctcccggaaacaaccattaaagtttggttccagaaccgaaggatgaaggacaagagacagcggctggccatgacatggccacaccctgcggatcccgccttctatacctatatgatgtctcatgccgctgctgccggcgggctgccttatcccttccctagtcatcttccactcccttactatagccctgtaggcctcggagcagcctccgccgcttccgcagccgcctcgcccttctcaggatccctgagaccactggacacctttagagtgttatcccagccctatcctcgccctgagctgctctgtgcttttcgccatccccccctgtatccggggcccgcccatggactcggggcttctgctggcggtccctgcagctgcctcgcctgccattcgggccccgcaaacggtctcgccccacgggccgctgccgcatccgacttcacatgcgcttctactagtcgctccgattcattcctgacctttgccccctccgttctatccaaggcttcgagcgtggcactcgaccagagagaggaggtccccctcacacggtag

SEQ ID NO: 116396 - DNA, 678 bp, Artificial Sequence
  Description of Artificial Sequence: Synthetic coding sequence
atgcggcgctacaggacagccttcacgagggagcaaatcgcaagactcgaaaaggagttctatagggagaactatgtaagtagacctcggcgctgtgaactcgcggccgccctgaatctgccggagacaaccatcaaggtctggttccagaaccggcgcatgaaagataagcgtcagcggctggccatgacatggccgcaccctgcggaccccgccttctacacgtacatgatgagccatgcagcagcagctggcgggctgccttaccccttccctagccacctgcccctcccctactacagccccgtcggcctgggtgccgcgtccgccgcctctgccgccgctagccccttttctggaagcctacgccctcttgatacttttagggttcttagtcaaccttatcccagaccggagctcttatgtgctttccgtcatccacctttgtacccgggtcccgcccacggactcggagccagcgccggcggcccttgttcatgcctggcctgtcattcgggccctgcaaatggacttgctccacgggccgcagcagcttctgactttacctgtgcctctacatccagatccgactcattcctgacttttgctcctagcgtgctcagtaaagcaagctcagtagctctcgaccaacgcgaagaggttccacttactaggtag

SEQ ID NO: 116397 - DNA, 1431 bp, Artificial Sequence
  Description of Artificial Sequence: Synthetic coding sequence
atgatggagagaatcagaaaagagatgattctgatggagagggggttacattcgcccacagccggtaagcgcttctccaatctttctaacagcgccggcaacgcagtcctggaagccctagagaatagccagcatcccgctaggctgtcacctcgacttcccagtgctcccctccattcagcactgggagaactcccagcaaaagggaaatttgaaatagataccctcttcaacttacagcacactggcagcgagtcaaccgtgtcctccgagattagctcggccgccgaatccagaaagaaaccaggtcactattcagaggctgctgccgaagccgatatgtccagcgacgtggaagtcggttgtagtgcgctccggtcacccggcggactgggagccgcgcagttaaaggagaataacggtaaaggctatgcagaaagtggctcagccgcaggtactaccacctcagcaagtgggtccggcctggggagtctgcacggcggaagtggagggtcgggtgggtctgccgccctaggcggtagcggaagcggtgcagatcaagtgaggcgatatcgcacggctttcacgagggaacagatagcccgcctcgaaaaagagttctatcgagaaaactatgtgagtcgtcctcggagatgcgagcttgccgcagcgctcaacttaccagaaacaaccatcaaggtatggtttcaaaaccgtagaatgaaagacaagcgccagaggctggctatgagttggccgcaccccgccgaccccagcttctacacatatatgatgactcatgcagccgctaccggaagtctgccataccccttccatagccacgtgcctctgcattactaccctcacgtgggcgtgaccgcagccgctgcggccgcagccgctagcggggcagccgccgcagcctcttccccctttgccacgagcatcaggcccctggatacatttcgagctctcagtcacccttattcaaggcccgaactgttgtgctctttccgtcatcccgggctttatcaggccccagcagctgccgcaggactcaacagcgcggcaagcgccgccgccgctgctgccgccgccgccgccgcagccagctcagccgcagctgccggggcccctccctccggagggtctgccccctgcagttgcctaagttgtcattcctctcagtctgctgccgccgcagcagctgcagccgcggccgcactcggatcacggggaggcggagggggcggaggtggtggcggaggagggggtgggggcggggctggagccggaggaggtagtgactttgggtgttcagcggcagcgcctagaagcgagtcaggctttcttccctacagcgccgccgttctatccaagacagccgtaagtccaccggaccaacgggatgaggcccctctgactcgatag

SEQ ID NO: 116398 - DNA, 2781 bp, Artificial Sequence
  Description of Artificial Sequence: Synthetic coding sequence
atgtcacggaggaggaagcacgatgattcgcctagccccaaaaaaaccccacacaagactgtagcggctgaagaatgcgggtcagttgttgaacccggcaggagacgactgagatcagctaggggatcctggccatgtggcgcccgcgaaggcccacccggccccgtacggcagcgcgaacagccaccgacagcagcactctgctccaagagtaaccctgaagagagatacgagacccctaaaagggccctgaagatggactccctcagttctagcttcagcagcccgaatgaccccgatggccagaacgatattttttgggaccagaacagccccctaacaaaacagctcgggaaggggaggaagaagcagatctatactaccgacagtgatgagatcagtcacatagtgaaccgtatagccccacaggatgaaaagcccactaccaattccatgctggacatgtggattggagaaacggcgatcccctgtaccccctctgtcgccaagggtaaaagcagagctaagatttcttgcacaaaactgaaaacacaatcccaggaggaggaactcatgaaattggctaaacagttcgataagaacatggaagaactggatgtgatccaggagcagaacaagagaaactacgattttacccagatgatctccgagaccgaaatcttgagcaattataaggacaacatccagatgtggtctttgcacaacattgtgccagaaatcgataatgctacaaaaaagcccatcaagggaaacacaaagatatccgtggctaacaaccagaactcctcccagaaacccttcgatcagattgcggaggctgccttcaatgccatcttcgacggcagcacacagaagtgttcaggacagctgagccaggagctgcccgaagccttttggtctacgtctaatacgaccttcgtgaagacaaatgcattaaaagaggaaaagataattaccaatgaaactctggttatcgagaagctttctaataagactccgcgaagtctcagcagccaggtcgacactcccattatgaccaagtcatgcgttacttcttgtaccaaagaaccagagaccagcaacaagtatatagacgctttcaccacttctgatttcgaggacgattgggaaaatcttttaggctccgaaccattcgccatgcagaatatcgacatgccagagctattccctagcaagaccgcacacgtgaccgatcaaaaggagatctgtacttttaactctaagactgtgaagaatacctcaagggccaacacctctcctgacgctagactaggtgactctaaggttctgcaggatttatccagtaagacatacgacagggagctcatcgatgccgagtataggttttcaccgaactccaacaagtctaataagctgagcaccggcaacaagatgaagttcgaaaattcctctaataaaatcgtgatccaggatgagatacagaactgcatcgttacctctaatcttactaagatcaaagaggatatacttacgaacagtactgaggccagcgagcggaaaagcgccctcaatacacggtactccaacgagcagaagaacaagtgcatcctgaaccagagtatcaaggctccagtaaacactgacttgtttggcagcgctaacctgggttcgaaaacgtcggtgagcaatcccaaccagacctccgcatcaaaagtcgggtcattctttgacgattggaacgatccttcttttgccaatgagatcattaaagcctgccatcaactcgacaacacctgggaagccgacgatgtggacgacgatctgctgtatcaggcgtgtgacgacatcgagcgactcactcaacagcaggatatcaggaaagactcaaagacgtccgagtctatttgcgaaattaataacaactccgaacacggcgcgaagcttactcagcagcaggacatcaggaaagacagcaagacctctgagtctatttgtgaaatcaacaataatagcgagcacggagccaagaacatgttcgccatctccaagcagggcagtaacctggtgcagagcaaacacctcaatccaggaagcatttctgttcagacatccctgacaaatagctcccagatcgataaacccatgaagatggaaaagggcgagatgtacggcaacagtccacgcttcctaggtgctaccaatttgaccatgtactccaaaatctccaattgtcaaattaacaacctccacgtttcctacaccaacactgacgtaccaatccaagtgaactcctctaagttggtgctgcccggctcttctagtctaaatgtcaccagcgatcacatgaacactgagattacaacctacaaaaagaagctgagcaccaaccaaccctgtcataaaaccgtcacagatgaggctcagagcaatctgaacacgaccgtaggcttctcaaagttcacattcacccggatgaaaaactcacagattctgtcacagtttaatcagaattgtataacaggttccatgagcgacaccaaaatcacccagggtgtggaaaaaaagaagggtgtaaaccctctcctggaggaagctgttggtcagcaatcacttgtgaagctgtccgagagcctgaaacagtcctcaaaggaggaagaagagaagaacagaaagtgtagtccagaagaaatacaaaggaaaaggcaagaggctctggtccgaaggatggccaaggctagagcctctagtgtgaatgccgcaccgacttcctttctgtag

SEQ ID NO: 116399 - DNA, 2349 bp, Artificial Sequence
  Description of Artificial Sequence: Synthetic coding sequence
atgggaaagcgcgacagggccgacagggataagaaaaaatcccgaaagcgtcactacgaggatgaagaggatgatgaggaagatgccccggggaacgatccccaagaagccgtcccttccgcagccggcaaacaggtggatgaaagcggcactaaagtggatgagtatggagccaaggactaccggctgcagatgccgcttaaggacgatcacacaagccgcccactgtgggtggccccagatgggcacatttttctagaggcattcagtccggtttacaaatacgcccaggacttccttgtggccatagccgagcctgtctgccgtcccacacacgtgcatgaatacaaactgacagcctatagtctgtatgctgccgtaagtgtgggccttcagaccagcgacatcacagagtatttacggaaactttcaaagacaggggtcccagacgggattatgcaatttattaagctgtgcaccgtgagttatggcaaggttaaactggtgctgaaacataatcggtattttgtggagagttgtcatccagatgtcatccaacatcttttacaggacccggtgattcgcgagtgtagattgcgtaatagcgagggggaggcaaccgagctgattaccgagaccttcacatccaaatcagcaatatctaagactgctgagtcctcgggtggtccttccacctctcgagtcaccgatccgcagggtaagtcagatatcccaatggacctctttgacttctacgaacagatggacaaagacgaggaagaagaggaggaaactcagaccgtctcttttgaggttaaacaagagatgattgaagagctgcagaagagatgtattcacctggaatatccactgctggccgagtacgacttccggaatgattcagtaaacccagatataaacatcgatttgaagcctaccgccgttctcagaccctatcaggaaaagagcctccggaagatgttcggcaacggacgggcccgcagtggggtcattgtgctgccatgcggagctggcaagagcctggttggcgtaaccgccgcctgcaccgtcagaaagcgctgcttggtgctgggcaattccgcagtcagtgttgagcagtggaaggcccaatttaagatgtggtcaaccattgacgactcccaaatttgcagatttacttctgatgcaaaggacaagccaatcggctgttccgtggcaatcagtacgtacagtatgttagggcacacaacaaagagaagctgggaggctgaacgagtgatggagtggcttaagacccaggagtggggcttgatgattctggacgaggtccatactatcccagccaagatgtttagaagggtgctgacgattgtgcaggctcattgcaagctgggactcacagctacattggtgagggaggatgataagatcgtcgacttaaactttctcataggtccaaaactgtatgaggccaactggatggaactgcagaacaacggttacatcgctaaagtgcagtgtgccgaggtgtggtgtccaatgagccctgaattttacagagaatatgtggccatcaagaccaaaaagaggattctgctgtacacaatgaatccgaataaatttagggcctgtcagtttctgatcaaattccatgagcggcgcaatgacaagataatagtgtttgctgataacgtctttgccctcaaggagtatgccatccgacttaacaaaccatatatctacgggcccacttcccagggggagcggatgcaaatcttgcagaacttcaagcataacccaaagatcaatacaatatttatttccaaggtgggagataccagcttcgatctcccggaggcaaatgtcctcattcagatttcctctcacggcggatcccgaagacaggaggcccaacggctgggacgggtgctccgtgccaagaagggtatggtcgcagaggaatacaacgcgttcttttacagtcttgtttcccaggacacccaggagatggcgtactcgacaaagcgccagcggttcctggtagaccaaggctatagtttcaaagtcatcacaaagctagctggcatggaggaggaggaccttgccttttccaccaaagaggagcagcagcagctgctgcaaaaggtcctagctgctacagatctcgacgccgaagaagaagtcgtggctggcgagttcggctcgcgaagctctcaggcatctcgacggttcgggaccatgagctccatgagtggcgcagacgataccgtgtacatggagtaccactcatctagatccaaagcacctagtaaacacgtccaccccttattcaagaggtttagaaaatag

SEQ ID NO: 116400 - DNA, 2157 bp, Artificial Sequence
  Description of Artificial Sequence: Synthetic coding sequence
atgcccctgaaagatgatcacactagcaggcctctgtgggtcgcacccgatgggcatatttttttggaggccttcagtccggtgtacaagtatgcacaggattttttggtggctattgcggagcccgtctgccgccctacccatgttcacgagtataaactcaccgcttacagcctctacgcagccgtctccgtcggcttgcaaacatctgacattaccgagtacctgcgcaaactgagcaagaccggggtgccggacggtattatgcagtttataaaactgtgtacagtctcatatggtaaagtaaaactggtgctgaagcataaccgctatttcgtcgaatcgtgccaccccgacgtcatacaacacttgctgcaggacccagttataagggagtgccgcctgcggaatagcgaaggtgaagccacagagttgatcacagagaccttcacaagcaagtcagccatatctaagaccgctgaatcgtcggggggaccttctactagccgcgtgacagatccgcagggtaaaagtgacataccaatggatcttttcgacttttatgaacaaatggataaagacgaggaggaagaagaagaaactcagactgtttcgttcgaagttaaacaggaaatgattgaagaattgcagaagcgctgcattcacctggaatatcctctgctggcggagtatgacttcaggaacgacagcgtcaatccggatattaacattgacctgaagccaactgctgtacttagaccatatcaggagaaaagtctgagaaaaatgttcgggaatggccgcgcacgcagcggagtcattgttctgccctgtggagctggtaagtctctcgtgggtgtgactgctgcgtgcacagtgagaaagcggtgtttagtgctcggaaattccgctgtctccgttgagcagtggaaggcgcagttcaagatgtggagtacaatcgacgactcccagatttgccggttcacgagtgatgccaaagacaagcccatcggctgcagtgttgccataagcacatattcaatgctcggacacactaccaagcgaagctgggaagctgaacgggtgatggagtggctgaagacccaagaatggggcctaatgattctcgacgaagttcatacaatccctgccaaaatgttccgccgtgtgctcaccatcgtccaagcacactgtaaacttggcctgactgctaccttagtcagggaagacgataagattgtggatttaaactttctcattggaccaaagctgtacgaagctaattggatggagctacagaataacggctacattgccaaagtccagtgtgcggaggtgtggtgtcccatgtcgccggagttctatcgtgaatatgtcgcaattaagacaaaaaagagaattctgttatacacaatgaaccccaacaagtttagggcttgccaattcttgatcaaatttcatgagcgaagaaatgataaaatcattgtctttgctgacaatgtgtttgcattaaaggaatatgctatcaggcttaataaaccttacatttacggacccacatctcagggagagaggatgcagatcttgcaaaactttaagcataaccccaaaatcaatactatcttcatctcaaaggtgggcgacacatccttcgacctgcccgaggctaacgtgttgatccagatttcttcccatggcgggagcaggcgccaggaggcccagcgtctggggcgggtcctgcgcgctaagaaagggatggtggcggaggagtataacgcattcttctattctctggtgtcccaggatacacaggagatggcctattcaacaaagcgccagcggtttctagtggatcagggctattcctttaaggtgatcaccaagctcgcaggcatggaggaggaagaccttgccttttccactaaggaagaacagcagcagctcctccagaaggtgctcgccgcaaccgacctagacgctgaagaagaggtcgtggccggcgagttcggatcaagatcctcccaggcctccagaaggttcggcacaatgtctagcatgtccggggccgatgatactgtatatatggagtaccactcgagtcggagtaaggccccaagcaagcacgttcacccactgttcaaacggttccggaagtag

SEQ ID NO: 116401 - DNA, 3753 bp, Artificial Sequence
  Description of Artificial Sequence: Synthetic coding sequence
atggaggcgagccgacggtttcctgaagccgaagccctaagtcctgaacaagctgcccactacctgcgttacgtgaaagaagccaaggaagccacgaagaatggagacctcgaggaagcattcaagctttttaaccttgcaaaagacatcttcccaaacgagaaggtgctgagcagaatccagaagattcaggaggcccttgaggagctggcagagcagggcgacgacgaattcacagatgtatgtaacagcgggctgcttttatacagggagcttcataaccaactgttcgagcaccagaaggaagggatcgctttcttgtactcactgtacagagacggccgtaagggcgggatcctggccgacgatatgggccttggaaagactgtccagataatcgcctttctatctggtatgttcgatgcatccctggtcaatcacgtgctgttgattatgcccactaatctgattaatacctgggtcaaggaatttatcaagtggacccccggcatgagagtgaagaccttccacgggccaagcaaggatgagcggacccgtaatttaaatagaatccaacagaggaacggcgtcataattaccacttaccagatgctgattaacaattggcagcaactatcttcattccgtggacaggagtttgtatgggactacgtgatcctggacgaggcgcacaagatcaaaacatcctccactaagagcgctatctgcgcacgggcaattcctgccagtaatcggctgctcctgactggcacgccgatccagaacaacctccaggagctatggtcgctgttcgactttgcgtgtcaagggtcacttttgggaaccttaaagactttcaagatggagtacgagaatcccatcaccagggcgagggaaaaagatgctaccccaggcgaaaaagccctgggtttcaagatttcagaaaacctcatggccataatcaaaccctatttccttcgcaggaccaaggaggatgtgcagaagaagaagagctctaacccagaggcccgcctgaacgaaaaaaatcccgatgtggacgctatctgtgaaatgcctagtttgagcagaaaaaatgacctcatcatttggatccggcttgtgccgctgcaggaggagatttaccggaaattcgtgagcctggaccatattaaggagttgcttatggaaacgaggtctccactggctgagctcggcgtgctgaaaaaattgtgcgatcacccgagactgctgtctgcgagggcatgctgtctgttgaatctcggaactttttcagcccaggacggcaacgagggagaggacagccccgatgtcgatcatatcgaccaagtcaccgatgacaccttaatggaggagtctggcaaaatgatattccttatggatttgctcaaacggctgagggacgagggccaccagactcttgttttttcacagagtagacagatcctgaacattattgaaagactgctgaagaatcgccacttcaagactctgcgcatagatggtacggttactcatctgctggaacgcgaaaagaggattaatttgtttcaacagaataaggactatagcgtgttcctcctgaccactcaggtaggaggtgtcggccttactcttactgctgccaccagagtggtgattttcgacccttcctggaaccccgcaactgatgcacaggcagtggaccgcgtgtataggatcggacagaaggaaaacgtcgtcgtgtacaggctcatcacttgcggaacagtcgaagagaagatttacaggcgccaggtgtttaaggactctctcattagacaaacaacgggggagaaaaagaacccattccggtacttcagcaagcaggaactgagagagctgttcaccatcgaggatctccagaatagcgtaacacagctccagctgcagagtctccatgccgcgcagcggaaatccgacattaagctggatgaacacatcgcctatctccagtccctcggaattgctgggattagtgaccacgacctgatgtacacgtgtgacttgagcgtcaaagaagaacttgacgtggttgaagaatctcactatatccagcagcgggtgcaaaaggctcaattcctggtcgaatttgagagccaaaacaaagagttcctgatggaacagcagcgaacacgcaacgaaggagcttggctccgcgaaccagtttttccctcctcgacaaaaaagaaatgccccaagctaaacaaacctcagccacagccaagtcccttattatcgactcaccatacacaagaggaggatatttccagcaagatggctagtgtggttatcgatgatttgccaaaggagggcgagaagcaggacctcagctctataaaggtgaacgtgacaacactgcaagatgggaagggtaccgggtctgccgactccattgccacacttcctaaaggatttggatccgtcgaggaactgtgcacaaattccagtttaggaatggagaagtccttcgctactaagaatgaggcagtgcaaaaggagaccctccaggaaggacctaagcaggaggcgctgcaggaagacccactggagtcattcaattatgtgctttcaaagtcaacgaaagccgacataggcccaaacttggaccagctcaaggacgacgagatcctgcgacactgtaacccctggccaattatcagcattacaaatgagtcccagaatgctgaaagtaatgtaagtatcatcgagattgcagacgacctgagcgcatcacactctgccctgcaggacgctcaggcctccgaagctaagctggaggaggagcctagtgctagttcaccccagtacgcgtgtgactttaatctgtttttggaggattccgcggacaatagacagaatttctcttcacaatctctcgagcacgtggaaaaggagaattccctttgcggcagcgcccctaattccagggcaggttttgtgcacagcaagacttgcttaagctgggagttttccgagaaggacgacgagcctgaagaggtggtggttaaagcgaagatccggtcaaaagcaagacgaatcgtgtcagatggcgaagatgaggacgattcgttcaaggacacaagctctattaatcctttcaacactagtctctttcagtttagcagcgttaagcagttcgatgctagtacccccaagaatgatatctcccctcccggaagattcttctctagccagattccaagctcagtgaacaaatcaatgaatagtcgtaggtccttagcttcccgtaggtcactgatcaatatggtgctggatcacgtagaagacatggaagagcgtctggatgacagttctgaagcaaagggcccagaagactatcccgaagagggggtggaagaaagcagcggggaagcgagcaagtataccgaagaggacccaagcggcgaaaccctgtcaagcgaaaacaagtcctcctggctgatgacctctaaacctagcgccctcgcccaggagacctccctcggcgcccccgagcccctgtccggagagcagctggtgggatctcctcaggataaagcagccgaagctactaatgactacgagacgctagttaaaaggggtaaagagctgaaagaatgtggcaagatccaggaagcactgaactgtcttgtcaaggctcttgatatcaagagtgccgatcctgaggtgatgctgctgactctaagcctgtataagcagctgaacaacaactag

SEQ ID NO: 116402 - DNA, 2685 bp, Artificial Sequence
  Description of Artificial Sequence: Synthetic coding sequence
atgaccgcgattaaacacgccctgcaaagagatatctttacccccaacgatgagaggttgcttagtatagttaatgtctgcaaagcagggaagaaaaagaaaaattgtttcctctgcgctacagtgactactgagaggcccgtgcaggtgaaggttgtgaaggttaagaagagcgacaagggtgatttctataagcggcaaatagcatgggctctgagagatctggccgtggtggacgccaaggacgccattaaagaaaacccagagtttgacctgcatttcgagaaaatctacaaatgggtggcttcttccacagcagaaaaaaatgccttcatatcttgcatatggaaactaaatcagcgatatctgcggaagaagatagattttgtcaatgtctccagccagctcctagaagaatcagtaccttctggcgaaaaccaatctgtcacagggggcgacgaggaagtggtagatgagtaccaagaattgaacgcgcgggaggaacaggatattgagattatgatggagggatgcgaatatgccatctctaacgcagaagcttttgccgaaaagctgtctagagagctgcaggttctggatggcgcaaatatccagtccattatggccagtgagaagcaggttaacatccttatgaagctgctggatgaggccttgaaggaagtggaccagattgagctgaagctgagctcttacgaagaaatgctgcaaagcgtaaaggaacagatggaccagatctcagagtcgaaccacctgattcatctcagcaacacgaacaatgtcaagttactgagtgagattgagttcttagtgaatcatatggatctcgccaagggccatattaaggcactccaggaaggggacctggcatccagtcgcgggatcgaagcttgcacaaacgcagccgatgcgctgctgcagtgcatgaatgtcgcgcttcggcccggccacgatctgcttctggctgttaagcagcagcaacagagattcagcgacctgagggaactatttgctaggcgactggccagccatctgaataacgtcttcgtgcagcagggccacgaccaaagcagtacattggctcagcactcagttgagttgaccctccctaaccatcatccatttcaccgtgacctgttgagatatgctaagttgatggaatggctcaagagcaccgactacggcaaatatgagggattgaccaagaactatatggattacttgtctaggttatacgagcgcgaaattaaggatttctttgaggtggctaaaataaaaatgacaggaaccacgaaagagtctaagaaatttgctaccctgcctagaaaggagagtgcggtgaaacaagagacagaatcactgcatggctcatctggaaaactaactggaagcacctcgtccctaaataagctgagcgtgcagtcatccggaaatcggcgctcacaaagcagctccttacttgacatgggaaatatgagtgcgtctgacctggatgttgctgatcggacgaaatttgacaaaatcttcgagcaggtcctctctgagctggagcctctttgcctggctgaacaagattttatctctaagtttttcaagcttcagcagcaccagtccatgccgggaacgatggccgaggctgaggatctcgatggaggaaccctctcccggcaacacaattgcggtacgcccttgcctgtctcctccgagaaagatatgatccgacaaatgatgattaagatcttcagatgcattgaacccgaactgaataacctgatcgcgttgggtgacaaaatcgattcattcaactctctctatatgttagttaaaatgtcccatcacgtgtggaccgcccagaatgtggatcctgctagcttcctgtcaacaaccttgggtaatgtccttgtgacagttaaaaggaacttcgataaatgcattagtaaccagatcaggcagatggaagaggtaaagatttctaagaaatctaaagtggggatcctgccattcgtggcggagttcgaagagttcgccggtcttgccgagagcatttttaaaaacgccgagaggcgcggggacctggataaggcatatacaaagctcattcgcggtgtttttgtcaatgtcgaaaaggtggcaaatgaatcacagaagacaccccgtgacgtggttatgatggagaattttcatcacatcttcgccaccctgtctcgcctcaagatcagctgcctggaagcagagaaaaaggaggccaaacagaaatacacagatcacttgcagtcttatgtgatatatagcctgggccagccactagagaagcttaatcatttttttgaaggggttgaagccagggtggcgcagggtattagggaggaagaggtatcctatcaattggccttcaataaacaggagctgcggaaagtcattaaggaataccccggaaaggaagtgaagaaaggattggacaatttgtataaaaaggtcgacaaacacctgtgtgaggaggagaatctccttcaggtcgtgtggcatagcatgcaggacgaattcatccgccagtacaagcactttgagggcttgattgccaggtgctaccccgggagtggagtaaccatggaatttacgatccaggatatcctcgactactgcagctctattgcccaatcccactag

SEQ ID NO: 116403 - DNA, 2640 bp, Artificial Sequence
  Description of Artificial Sequence: Synthetic coding sequence
atgacggccatcaagcatgctctacagagggacatctttactcccaacgacgaacgtctgcttagtatcgtcaacgtctgcaaagctggtaagaagaagaaaaactgttttctatgcgccactgttacgacggagcgcccggtgcaggtaaaggtagtgaaggtaaaaaagtctgataagggggatttttacaagcggcagatcgcttgggccctgagggatcttgcggtggtggatgcaaaggatgccattaaagagaatccagaattcgatctacacttcgagaagatctataagtgggtggcctcctctaccgccgagaagaacgctttcatctcctgcatctggaaactgaaccagcggtacttgcgcaaaaaaatcgattttgttaacgtgagctctcagttgctggaagagtctgtaccaagcggggagaaccagagcgtgacgggaggcgatgaagaggtggtggacgagtatcaagaattaaacgcacgagaggagcaggatatcgaaataatgatggaggggtgtgagtatgctatttcgaatgctgaagcctttgctgaaaaattgagtcgcgaactccaggtgctcgatggagcaaatatacagtccataatggccagcgagaagcaagtcaacattctgatgaagctgttggacgaagcactgaaggaggtggatcaaatcgaactgaagctgtcgtcctatgaagagatgctgcagtcggtcaaagagcagatggaccaaatatctgagagcaatcacttgatccacctatccaacaccaataacgtgaagctgctatcagaaattgaattcctcgtgaaccacatggacctcgccaaaggacacatcaaagcacttcaggaaggcgacctggccagcagccggggtatagaagcttgtaccaacgcagctgacgctcttctacagtgcatgaacgtggccttacgtcctgggcatgatctcctcctcgcagtaaagcagcaacagcagagattcagtgatttgcgcgaactctttgcaagacgcctggctagccatctgaacaatgtctttgtacagcaagggcatgatcagtcctccacgctggcccagcattctgtggagctgacactgcccaatcaccacccgttccacagggacttgctgaggtacgcaaagctgatggaatggttgaagagcactgattatgggaaatacgagggcctgactaagaactatatggattacctgagtagactgtacgaacgcgagattaaggatttcttcgaagtggctaaaattaagatgaccgggacgaccaaagagtccaagaaatttggtctgcacggcagttcaggcaagctcactggaagcacctcttcactgaataagctaagcgtccagtcatccggcaatcgacgctcacaatcaagttccctactggatatggggaacatgagcgcgtcagatttagatgtggctgatcggacaaagttcgacaaaatatttgagcaggtgctctcagaactagagcctctgtgcttagctgagcaagactttattagtaaattcttcaaattacaacaacaccaatccatgccagggactatggccgaggcagaagacctggatggaggcaccctcagtcgacagcataattgcgggactcccctgcccgtgtcctccgaaaaggatatgattagacagatgatgatcaaaatctttagatgcatcgaacctgagctgaacaatctcatcgctctcggggataaaatagatagtttcaattcattgtatatgctggtaaagatgagccatcacgtgtggaccgcacagaacgtggatcccgcatccttcttaagtaccactttagggaacgtcctggttacagtgaaaagaaactttgataagtgcatctcaaatcagatcagacagatggaggaagtgaagatatccaaaaaatcgaaggtaggcatccttcctttcgtagccgagttcgaggagtttgcaggactagcggaatcaatctttaagaatgcggaacggcgcggagacctcgataaggcatacaccaagttaatccgtggagttttcgtgaatgtggaaaaggtagcaaacgagtctcagaaaacacctagagatgtggttatgatggagaatttccaccatatcttcgctacgctgagccgcctcaagatttcttgtctggaagctgagaaaaaggaggctaagcagaaatacactgatcaccttcaatcatacgtgatatactcgttgggccagcctctggaaaagctcaaccatttttttgaaggcgtcgaggcaagagtggcccaggggatcagagaagaagaagtgtcctaccagctagcgtttaacaagcaggaactcaggaaagtgatcaaggagtatcccgggaaggaggtcaagaagggtttagacaatctctataagaaggttgataagcatttatgcgaagaagagaaccttttacaagtggtgtggcattccatgcaagacgaatttatccgtcagtataaacacttcgaaggcctaatagctaggtgctaccccggctccggagtcaccatggagttcaccatccaagatatcttagattattgcagctccattgcccagagtcactag

SEQ ID NO: 116404 - DNA, 2685 bp, Artificial Sequence
  Description of Artificial Sequence: Synthetic coding sequence
atgactgcgattaaacatgccctgcagagggatatatttacgccgaatgatgagcggctattgtccattgtcaacgtatgtaaggcaggaaaaaagaagaagaactgtttcctctgcgccaccgtgactactgaaaggcccgtgcaggtcaaggtggtcaaggtcaagaaatccgataagggggacttctacaaaaggcagatcgcgtgggcgctcagagacttggccgtcgttgatgctaaggatgccattaaagagaacccagaatttgacctgcattttgagaagatatataagtgggtcgcgagttctaccgccgaaaagaacgccttcatatcatgtatttggaaactgaaccagcggtatctgcggaaaaagatagacttcgtgaatgtctcatcccagctgctagaagagagtgtcccaagtggcgagaaccagtcagtcaccggcggcgatgaggaggttgtcgatgagtatcaggagctcaatgccagagaagaacaggatattgaaatcatgatggagggctgtgagtacgctatcagtaatgcggaggctttcgccgagaagctgtcccgggagctgcaagtgctcgatggtgctaacatacaatctataatggcatctgaaaagcaggtcaacatactcatgaagttgcttgatgaagcccttaaggaggtggatcaaatcgaactaaaacttagctcctacgaggagatgctacagagcgttaaggaacagatggatcagatcagcgagagcaatcaccttattcatttgtccaacaccaacaatgtgaaactgctgtccgaaatcgagttcctcgtcaaccatatggacctcgcgaaaggtcatattaaagccttgcaggagggcgacctcgcctcatcccgggggattgaagcttgtactaacgcagctgatgcgctgctccagtgcatgaacgtagcactgcgacctggacatgaccttctgctggctgttaagcagcagcaacaaaggttcagcgatctgcgtgagctgttcgcaaggcgcctggctagccacctgaataatgtcttcgtacaacagggtcatgatcagagcagcacccttgcccagcactcagttgagttaacccttcccaatcatcatcccttccacagggacctcctgagatatgctaagctgatggaatggcttaagagcaccgactatggtaaatatgaaggcctcacaaagaactatatggattaccttagccgtttgtacgagcgcgaaatcaaagattttttcgaggtcgcaaagataaagatgactggtactactaaagagagtaagaagttcgccacactgccccggaaggagtccgcggtcaagcaggaaacagagtcccttcacggctcctccggaaaactaacagggtccacttcctcactgaacaaactgtcagtgcagtcctcagggaatcgccgcagtcagagctcatcactactggacatggggaatatgtctgcaagcgatctggacgtggccgataggactaagttcgacaagatcttcgagcaagtgcttagtgagctcgagcctttgtgcctggcggagcaggactttatctctaagttttttaagctgcaacagcatcagtcaatgcccggcacaatggccgaagcagaggatctggatgggggaactctgtcccgacaacataactgcgggacacctctgcccgtctcttccgaaaaggacatgatcaggcagatgatgattaagatcttcaggtgcatcgaacctgaactcaacaacctcattgcattaggcgataagattgactccttcaactccctctatatgctcgtgaagatgtcccaccatgtctggaccgctcaaaatgtcgatcctgcctcatttctgagcaccacgctcggtaatgtgctggtgactgtcaagagaaatttcgataagtgtataagcaatcaaattagacagatggaagaggtgaagatctccaagaagtccaaggtggggatactcccctttgtcgccgagttcgaggagttcgccggactggccgagtctatctttaaaaacgctgagaggcgcggcgatctggataaagcatatacaaaattgatacggggtgtttttgtgaatgtcgagaaggtcgccaatgaatcccagaaaacccctagggatgtggtgatgatggaaaatttccatcatatatttgccaccctgtcccgcctgaaaatatcttgtcttgaggctgaaaagaaggaggccaaacaaaagtacaccgaccatctgcaatcatacgtgatctactccctgggccagccactggagaagctgaatcacttctttgaaggcgtcgaggctcgggtggcccaaggtatcagggaagaagaagtgagttatcagctggccttcaacaagcaggaactcagaaaagttatcaaggagtaccccggcaaagaggtaaaaaaggggctagacaacttatataaaaaggtggataagcatctgtgtgaagaagagaacctccttcaggtggtctggcattctatgcaggacgaattcatacgccaatacaagcactttgaggggctgattgcaaggtgctacccaggatctggcgtgacaatggaatttacgatccaggacatcctggattattgtagtagcatcgcgcagagtcattag

SEQ ID NO: 116405 - DNA, 2238 bp, Artificial Sequence
  Description of Artificial Sequence: Synthetic coding sequence
atgaaagagacggaccgtgaagctgtggcgaccgccgttcagagggttgccgggatgctgcagaggcccgaccagctggataaggtcgagcagtatcggaggagggaggcacgcaagaaagcgagtgtagaagccaggcttaaagctgccatacagagccagcttgacggtgtgcgcacaggcctgtcacagctgcacaacgccttaaatgacgttaaggacatacaacagtctttggctgacgtctctaaagattggcgtcagtctattaacacgatagaatcgctcaaggatgtgaaggatgcagtggtacagcactcccagcttgcagccgcagttgagaacttgaagaatattttttctgttcctgaaatcgtgagagagacccaggatctgatagaacagggggctctgttgcaggcccacaggaagcttatggaccttgagtgtagccgggacgggctcatgtatgaacagtatagaatggacagtggcaacacaagagatatgaccctcattcatggctactttggatcaacccagggactctctgacgaactggcaaagcagttgtggatggtcctgcagaggtcgctcgtaaccgtgcgacgggatccgaccctgctcgtgtctgtggtgaggatcatagaaagagaagagaagattgaccggcgcattctggatcggaagaaacagacagggttcgtccctccaggccgtccaaagaactggaaggagaagatgtttacaatcctggagaggaccgtaactacaagaattgagggcacacaggccgacacgcgggaaagcgataagatgtggctggtacgtcacctggagataattcggaagtacgtgctggacgatctcattgtggcaaagaatcttatggtgcaatgtttccccccacactacgaaatattcaagaacctacttaatatgtaccaccaggccctctctacgagaatgcaggatctcgcatctgaagacctcgaggcaaatgagatcgtcagcctgctgacttgggttcttaatacttatacgagtactgaaatgatgaggaacgtggagcttgccccggaggttgacgtgggaaccttggaacctcttctgagcccacatgtggtgagcgagctgctggacacttacatgtccacactgacctcgaatataattgcttggctgcgcaaggccctcgagacggataaaaaagattgggtgaaggagactgagccagaggctgatcaggatggttactaccagaccacccttcccgcaatagtgtttcaaatgttcgagcagaacctccaggtcgcagcacagatcagcgaagacctgaagacgaaggtcttagttctttgcctgcaacagatgaattctttcctgagccggtacaaggatgaagcccagctttataaagaggaacacctgagaaaccggcaacaccctcactgttacgtacagtacatgatcgctatcataaataattgccagacctttaaggaatctatcgttagcctgaaaaggaagtatttgaaaaatgaagtggaggagggggtgagccctagccaaccttccatggatgggattctggacgcaatcgccaaggagggctgttcggggctgcttgaggaggtgttcctggatctggagcaacatctgaatgaacttatgacaaagaagtggttgttagggtctaacgccgtagacattatttgtgtgaccgtggaagactatttcaacgacttcgccaaaattaagaagccgtacaagaaacgcatgaccgccgaagcccatcgaagagtggtggttgagtacttgagagctgtcatgcagaagaggattagcttccgctctcctgaagagcggaaagagggggcagagaaaatggttagagaggctgagcaacttcggtttcttttccgcaaactagcttctggcttcggagaggatgtggacggatactgtgatactattgtcgctgtggctgaagttattaagctcaccgatccttcccttctctatctcgaagtgtccacacttgtgagtaagtaccccgacatcagggatgaccatattggggcattgctggctgtaaggggggacgcttctcgcgatatgaagcaaacaatcatggaaacactggagcagggaccggcccaagcttccccatcttacgtgccgttgtttaaggacattgttgtcccgtccctgaacgtggccaagctgttgaaatag

SEQ ID NO: 116406 - DNA, 1923 bp, Artificial Sequence
  Description of Artificial Sequence: Synthetic coding sequence
cagtgcgaagatagtacgtcattctttaccatgaaggagacagatcgtgaggccgtcgccacagccgtgcagagagtggctggaatgttgcaaagaccagatcagctggataaggtggagcaatatcgacgacgcgaggcccggaagaaggccagcgtggaggccaggctgaaggcagcgatccagtcgcagctggacggcgtgcggacaggtctctcccaactccacaatgctctgaatgacgtaaaagatatccagcagtcactcgctgacgtatccaaggactggcggcaaagcattaacacgatcgagtctttaaaggatgtgaaggacgccgtggtgcaacacagccagctcgccgccgccgtcgaaaacctgaagaacatcttcagcgttccggagatagtccgagaaacccaggacctgattgagcagggtgctttgctgcaggcacaccggaagctgatggacctggagtgttctagagatggactgatgtacgagcagtatcgtatggacagtggcaatacacgcgatatgaccctgatccacggatacttcgggagcacacaggggctgagcgatgaattggccaagcagctgtggatggtcctgcaaaggagcttggttacggtgcgccgagatccaaccctgctggtatcggttgtgcggattatagagagagaggagaagatcgaccgccgcattttggatcgcaagaagcagacgggcttcgtgcctcctgggcggccaaagaactggaaagaaaagatgttcactatactcgaacgcactgtgacaactcggatagagggaacacaggctgataccagggaaagtgacaaaatgtggctggtgcgtcacttggaaattatccgcaagtacgttctcgacgatctcatcgtcgctaaaaacttgatggtgcaatgctttcccccacattatgagatctttaaaaatctcctcaacatgtatcaccaggcactgtccaccaggatgcaagatctggcatccgaggatctggaagctaacgagatcgtgtctctgttgacttgggtcttgaacacatacacacgatataaagacgaagcgcagctttataaggaggagcatttacgcaacagacagcatccacattgctatgtgcaatacatgatcgcaatcattaacaattgccagacgtttaaggagagcatcgttagcctaaaaagaaagtatctcaagaatgaggtggaggagggagtaagccctagccagccatccatggacggtatcctcgatgcaatagccaaggaaggctgtagtggcctgttagaggaagtcttcttagacctcgagcaacatctgaacgagctgatgactaaaaaatggctgctgggctccaacgctgtcgatataatctgcgtcacggtggaggactatttcaacgactttgccaagattaagaagccatataaaaaacggatgaccgcagaggctcatcgaagggtagtggtcgaatacctcagggccgtgatgcaaaaaagaatatcattccggtcaccagaggaaagaaaagaaggagcggaaaaaatggttcgggaggctgagcagctccgcttcttgttcaggaagctagccagtgggttcggggaagacgtcgacggatattgtgacacaatcgtggctgtggcggaagtgattaagctcacagatccatcattactctatttggaggtcagtaccctcgtgtccaaatatccggatatccgtgatgatcatatcggagcactcttggctgtgaggggtgatgcctcaagggacatgaaacagaccatcatggaaaccctggagcagggcccagcccaggctagccctagttacgtgccgctgttcaaagatatcgtcgttccatcattgaatgtggccaaactgctgaaatag

SEQ ID NO: 116407 - DNA, 210 bp, Artificial Sequence
  Description of Artificial Sequence: Synthetic coding sequence
atgaaggagactgatagagaggccgttgccaccgccgtccagagggtagcaggcatgctgcagaggccagaccagctggataaagtcgagcagtatagacgccgcgaagcacgcaaaaaagcatccgtagaagcacggttgaaagcggctattcaaagtcagttagacggagttcggaccgggctaagccaactacataatgccctgtag

SEQ ID NO: 116408 - DNA, 2238 bp, Artificial Sequence
  Description of Artificial Sequence: Synthetic coding sequence
atgaaagagactgatagagaagccgtcgcaaccgctgtccagagggtggccgggatgttacaaagaccagatcagctggataaggtggagcagtatcggagaagagaggcacggaagaaggcaagtgtcgaggcacgcctgaaggccgccatccagagccagctcgatggcgtgcgcaccggcctctctcagctccacaacgccctgaatgatgtcaaggacattcaacaatcgttggcagatgtatcaaaggattggagacaatccattaatactatagaatcactgaaggacgttaaggatgccgtcgtgcaacacagtcaactcgccgccgccgttgagaatctcaagaatatattctctgtccctgaaatcgtccgggagactcaggatctaatcgagcagggggcgctgcttcaggcacaccgaaagcttatggatctggaatgttcacgggacgggctcatgtacgagcagtataggatggactctggcaatacccgcgatatgacgttgattcacgggtatttcgggtcaacacaaggtctcagtgacgaactggctaaacagctgtggatggtgctccagcgatccttagtgaccgttcgccgggatccgaccctgcttgtgagcgtcgtccgcatcatcgaaagagaggagaaaattgaccggcggattttagatagaaaaaagcagaccggatttgtgcctcccggccgtcccaaaaactggaaggagaagatgttcaccattttggaaagaaccgtgacgacccgtatcgaggggacccaggctgataccagggaaagtgataaaatgtggctggtgcgtcacctggaaataattcgcaagtacgtgttagatgaccttatcgtggctaagaatcttatggtgcagtgcttcccccctcactacgagattttcaaaaacctcttgaacatgtatcaccaagctctgtcaacccgaatgcaggacctggctagcgaggatctggaagccaacgaaattgtcagcctcctgacttgggtgctgaacacctacacatctacagaaatgatgcgcaacgtagagcttgctcccgaggtcgacgtggggaccttagagcccttgctgtctccccatgtggtcagcgagctgctggatacctacatgagcactctgacatcaaacattatcgcctggctgcggaaggcccttgaaacagacaaaaaagattgggtgaaggagaccgagcccgaagctgaccaggatggctattaccagacaacactgccagctatcgtcttccaaatgttcgaacagaaccttcaagtagcagcacagattagtgaggatcttaagacaaaggttctcgtcctatgcctgcaacagatgaattcattcctgagtagatacaaagacgaggcacagctgtataaggaggagcacctcagaaaccgccagcatcctcattgctacgtgcaatatatgattgctatcatcaacaattgccaaacctttaaggagtctattgttagcctgaagaggaagtacctcaagaatgaagtggaggagggagtttctccatcccagccctcaatggatggaatattagacgccattgccaaggaggggtgctcaggcctacttgaggaagtgttcctggatctggaacagcaccttaacgagctgatgactaaaaagtggctcttaggtagtaatgccgttgacattatttgtgtgaccgtggaagattacttcaacgactttgcaaaaatcaagaaaccttataaaaaacgtatgaccgccgaagcccatagacgtgtcgtcgtggaatacctcagggcagtgatgcagaagcggatatccttccgctccccggaagaacgcaaagaaggcgccgagaagatggtgcgggaagccgaacagctgaggttcctcttccgcaagcttgccagcggcttcggtgaagacgtggatggttattgcgatactattgtagccgtggccgaggtaattaaactgacagacccatccttgctatacctggaagtctcaacactggttagcaaatatccagatattagagacgaccatattggcgcactgctggctgttcggggagacgcttcccgagacatgaagcagacgatcatggaaacactcgagcagggtcctgctcaggcttctccctcctatgttccgcttttcaaggacattgtggttccctctttaaatgtggccaaactgttaaagtag

SEQ ID NO: 116409 - DNA, 2034 bp, Artificial Sequence
  Description of Artificial Sequence: Synthetic coding sequence
atggacagcgccgccaaggatgagatgcagccagcactaagccccggctctagttttcctggaccggagtggcccgaacaggaaagagcagaacaactggcccgaggggccgccttgaaatgggcctcagggatattttataggccagaacagctcgccagactggggcagtacagaagccgggaagtgcagcgcacctgttccctcgaatcacgcctaaagtcggtgatgcagtcatatttggagggggttcagaccgtgcctgcggccgtaagccatacccagactttaatagacggccagcaatttctcgaggcatacgtgtctttaagagaactggagcagctacgggaggatacgtgggctcctcttgggggtctggagcttcccgtgttccagggactcgacttactgtttgaagctctgggacaggcggttgaggctgccgccggggcagcaggtaaacttgccagagaagacccggcattgctagtcgcagctgtgcgcgtcgccgaagtcgagaccgggagaacaacacctcttggccaggtgcctagggattggcggcagcgctgtttgagggcactgcaggaaggacttgaacaggcccactttggttcccctctcttacctgctccaggagccttaccgggctggctcgaggctctgcgcgtagctctcccagtggaacttgccacagccgaagccctggtggccccttgctgtcccccgcagtacaacgtggttcagctatgggcccacaccctgcatagtggtcttaggcggtccctgcagaatttgctggctggccccgagctcgaggctgctgacgcgttcgctctcctgcactgggctctccacgtttacctgggccaggagatgatgggctccctggagctgggcccggaagccgacgtgagtcagctggagccactcctgaccctggagaatattgaacagttagaggccacttttgtcgcaaacatccagatcctggaggagaacatccgggtcgctagcctggtctctgagagccttcaacagcgggtccacggcatggctctctctgagcttggaaccttcctaagaagctttagcgatgcgctgatccgcttcagtcgtgatcacttcagagggaagagcatggcgcctcattacgtgccctacctactggcggccctgaatcacaaaagcgccctttcaagcagtgtgtcagtcctgcagttagacggagctccaagcggggccctggctcctgtggaagctgcgctagatgaactgcagcgcagaatctacaggctcgtcctggaagccctacaggctgagttacagcccctcttcgccgatcttccctcccgtcagtggttgagtagccctgaactgctgcagtcagtgtgcgaacgcacgggaagattttgtcgtgatttctggagagttaggaaccctaccgtgcagctacttctcgccgaggccgagcgggccgtggttctacagtacctgagcgctctcatgcaaggacgcttggtgtgccgcggggccgacgagcgcactcaggctgcagagcgattgcggcatgacgctgctcagcttcagcaactcttcctgagtctggtaagggccagttgggccggtcgccgcgcccgagtgtccgtcgcaggctgggagaggggcctcgcccgcgacccaacgcccacatgttccggtcctgggggagaacgggccctgagggcaggggcggcgcggcctgaaggtgctgccaagcctccccggccacgcgccgctggcccgggaggcggctggcccgccgccaccatttcaaggagggagcgcggtccgaggctacggcccctgggtcccgcacgggggctggtgccgggcgccgcacccgggagggcccagttgccagctggatgcgcggccgccgttgctccgcgggaaccccctaggcccctgcagccttccgcaagggcaagagctccggcgagttgtcttcctagtgggtcctgcgcacgggccctcctgttggccgagtag

SEQ ID NO: 116410 - DNA, 2241 bp, Artificial Sequence
  Description of Artificial Sequence: Synthetic coding sequence
atggattccgccgcgaaagatgagatgcagccagccctgagcccgggccccgagtggcctgaacaggaacgcgctgagcaattagccaggggagccgcactcaaatgggcatccggcattttctaccgccccgaacagctcgcccgcttaggccagtacagatcccgtgaggtccagcgcacgtgctcactcgaatctaggctgaagtctgtgatgcaatcctatttggagggagtccagactggagtttggcaactggcccaggctattgaggtagttcaggggacgcgcgaagccctgagtcaagcccgagggcttctccaagggatgagccaagcattacagaccttggaacctttgcgggaacgggtggcacagcataaacagctgcaagctctcagccacctcctgccaagactgcgagctgtgcctgcagccgtgagccatactcagacacttatagatggacaacagtttctcgaggcctacgtctccctgcgggaactcgaacagctccgggaagacacatgggccccattgggtggcttagagcttcccgtattccagggacttgatctgctgtttgaagccctgggacaggcagtggaagcagcagcgggcgccgcaggtaaactcgcccgtgaggatccagcactgctggtcgcggcagtgagggttgctgaagtagaaactggcagaaccactcctttaggacaagtgcccagagactggagacaacgatgcctccgggccctgcaggaggggcttgaacaggcacattttggaagccctctgctccctgctcccggcgcgctgccagggtggttggaagctttgcgtgtcgcgctcccggttgagctggccactgccgaggccctagtcgccccgtgttgtccgccccaatacaatgtcgtccaactttgggctcatacgctgcactccggactgaggcgctctctgcagaacctgctcgccggaccagagctggaggctgctgacgcgtttgccctattgcactgggccctgcatgtgtatcttggccaggaaatgatgggttccctggaactgggtcccgaagctgacgtgtcgcaactcgagccattgttgacactagagaatatagagcagctcgaagcgacatttgtggcaaatatccaggcatccgtgtcccagtggcttcagaacgccctcgacggtgaggtcgccgaatgggggagagagcacggtcctaacacagacccgagtggttcctactacagccctatgcccgccattgtgctgcaaattcttgaggagaacatccgggtggcatctcttgtgtccgagagcctccaacagcgggttcacggaatggcactgtccgagctagggaccttcttgagaagcttcagtgatgccctgatccgtttttctagagatcacttccggggaaaatctatggccccccactacgttccatacctcttggcagcactcaatcacaaaagcgctttgtccagctccgtctctgtgctgcaactggacggtgccccctccggagcactggcaccagttgaagctgctttggatgaactgcaaaggcggatttataggctggtcctggaagcgctgcaagccgagctccagcctctgttcgcagacctgcccagcaggcagtggctgtcaagccccgagctactgcagtccgtttgtgaacgcaccggccggttttgcagagatttctggagagtgcgcaacccaaccgtgcagctactcctagcagaagccgagcgggctgtggttctgcagtacttgagcgctctgatgcagggcagactcgtgtgtagaggcgctgatgaaaggactcaggctgccgaacgacttcgccacgacgctgcacaactgcagcagctatttctctctctgggactggaggagaacgctcactgtgcccccgttcttctggcattgcgcgaattgctcaacctgcgcgaccccgccctgctgggattagaagtggcaggactgcgacagcaatttccagatgtcagcgaggatcacgtgagcgcactgctcggcttgagaggcgacctcagccgggagcagcatctcgccgcgttgtcatctctacaagcagcactgcctccttccccaagggcgagccggagagttctcttcagtttggtacccgcgccggccctggcccctgccagctgtcttcctagtggatcttgtgcgcgcgccctccttctcgcggaatag

SEQ ID NO: 116411 - DNA, 2040 bp, Artificial Sequence
  Description of Artificial Sequence: Synthetic coding sequence
atggactctgccgccaaagacgaaatgcagccagctctgtctcctgggcctgaatggcccgagcaagaaagggcggaacaactggctcggggcgctgccctgaagtgggcttcaggcattttctacagacccgagcagctggccagactcgggcagtaccggagcagggaggttcagcggacatgctcccttgaaagtcggctgaagagcgtcatgcagagttacctcgagggtgtacagactgtacccgctgccgtgtcacatacgcaaaccctgatcgatggacagcaatttctggaagcttacgtctctctgagagagttagagcagctgagagaggacacctgggcacccttggggggtctggagctgccggtattccagggactggatctactgttcgaggcgcttgggcaagccgttgaagccgccgccggggctgcaggcaaactggccagagaagaccctgctctgctcgtggcggcagtccgcgtggcagaagtggagacaggccgcaccacccctcttggtcaggttccacgggactggaggcagcgctgcctgcgcgcgttacaggagggactagaacaggcccacttcggttccccactgctcccggctcccggagcgcttcccggatggttggaagcgttgagggttgctctacctgtggagttggcaactgccgaggccctggttgctccgtgctgcccacctcagtataatgttgtgcagctgtgggcacacacactccactctggactgagacgctctctgcaaaatcttctggctggccctgaattggaagccgctgatgctttcgctctcttgcactgggcccttcatgtttacctcggccaggagatgatgggcagcctagaattgggtcctgaggcagacgtgtcacagctggaacctcttctgacactcgaaaatatcgaacagttggaggctacttttgtcgccaatatacagatcctggaggagaacattcgtgtcgcatccttggtctcagagtccctccagcagagggtgcacggcatggctttatcagagctgggaactttcctaagatctttctcggacgccttaattaggtttagcagggaccactttcgcgggaagtccatggcaccgcattatgtgccttacctgctggctgcgttgaatcacaagtcggcactttcatcctctgtgtctgtcctgcaactcgatggggccccatccggagcattggccccagttgaggcggccttagacgagcttcaaagaagaatctacaggttagttttggaggctctgcaggccgagctgcagccactcttcgctgaccttcccagtcggcaatggctgagtagcccggaacttttacagtccgtgtgcgagcgaactggacgattctgccgagatttttggcgtgtgagaaatcccaccgtccaacttctcttagccgaggccgagagagccgttgtgcttcaatacctctcagccctcatgcaaggtcgcctcgtgtgcagaggagctgacgagagaacccaggccgcagaaaggctgcggcacgacgccgcgcaactgcagcagctctttttaagtcttgtccgggcctcctgggccgggcgaagggcccgcgtgagcgtagcaggatgggagcgaggactcgctcgggaccctaccccaacctgttcaggccctgggggcgaaagggccttgagagctggggcagctaggcccgagggggctgcaaaaccgccgaggccccgggccgccggcccaggtggcggctggccggctgcaaccatctccaggagggagagagggccccgcctgaggccacttgggccagctcgggggctggtgccaggggccgctcccggccgtgctcagctcccagccggctgcgccgcagcagttgcacctcgggagccacccagaccattgcagccttccgcaagggctcgggccagggcaggccttctcccagctctcggggtcttaagaccttcccccgcagccaggcgaataaaccacggctgcaggtag

SEQ ID NO: 116412 - DNA, 2925 bp, Artificial Sequence
  Description of Artificial Sequence: Synthetic coding sequence
atggcggccgaggcagcgggcggcaagtacagatcaacggtgtccaaatcaaaagatccatctggattactgatctctgtcattcgcaccctttctacatctgacgatgtagaggacagagagaacgaaaagggtcgcttggaagaagcatatgaaaaatgcgaccgagacctagacgaacttatagtgcagcattacactgaattgaccactgcgatcaggacttatcagagcatcactgaacgcattaccaactccagaaacaaaatcaagcaggtcaaggaaaatctactcagctgcaagatgctgctgcactgcaaaagagatgagcttcgtaaactgtggatcgagggcatagaacacaagcatgtgctcaacctgctggatgagatcgagaatataaagcaggtgcctcagaagctcgagcaatgcatggcttcaaagcactacctgtctgcaaccgacatgctcgtgtcagccgtcgaaagcctggaaggccctctgctgcaggttgaggggctgagcgacctgcgcctggagctgcactctaagaagatgaatcttcatttagttcttatagatgagttgcacaggcatctgtatatcaagtctaccagtagggtagtccagaggaacaaagagaagggcaagatttcaagccttgtgaaggacgcctctgtcccactcattgacgtcaccaaccttcctactcccagaaagtttctggacacttcccattatagcactgccggctccagttcagtgcgcgaaatcaacctccaggacattaaggaagaccttgagcttgaccccgaagagaactccacactctttatgggcatcctaatcaagggcctcgctaagctgaaaaagattccggagacagtgaaggctattatcgagcgactggagcaagaactgaaacagatagtcaaacgcagcaccactcaagtagccgattcaggctatcagcgtggggagaatgtcaccgtggaaaatcagcctcggttgctattagagctcctcgagctcctgttcgacaagtttaatgctgtggccgccgctcatagtgtagtcctgggatatctccaggatactgtagtgacacctctgactcagcaggaggacattaagttatatgatatggccgatgtctgggtcaagatacaggatgtcctccagatgcttcttacagagtatctggatatgaaaaataccagaacagcctctgagccatcggctcagctgagctatgcatccaccggtagagaattcgctgctttcttcgccaagaagaaaccgcagagaccgaagaacagtctgtttaagtttgagtccagcagccatgcaattagcatgagcgcttatctgcgtgagcaaagaagggagctgtacagtaggagcggagagctgcagggcggcccagatgataatctgattgaaggcgggggtacaaaattcgtgtgtaaacctggtgcccgcaatataaccgtgatttttcatccactgctcaggttcattcaggagattgagcacgccctggggctgggcccagccaaacagtgccctctgcgcgagttccttacagtgtatattaaaaatatattccttaaccaggttctcgcggagatcaacaaagagattgagggcgtgactaagacatctgaccccctgaagattctggccaatgctgataccatgaaggtgctgggcgttcagaggccactccttcaatccaccattattgttgagaagacagtgcaggatttgctcaatctcatgcacgatctgtccgcttattcagaccagttcctgaatatggtatgtgtaaagttacaggagtacaaggatacgtgcacggctgcttaccgtggtatcgtgcagtctgaggagaagcttgtcatctctgcatcttgggctaaggacgatgacatcagtcgcctgctgaagtcactgcccaactggatgaacatggcccagcctaagcaactgcgaccaaagcgcgaagaagaagaggattttattcgcgcagcatttggaaaggagagcgaggtactgatcggcaaccttggagacaaacttattccgccacaggacatcctacgcgatgtgtccgacctgaaggccctagcaaacatgcatgaatccctggaatggctggcatctcggacaaagtccgccttttccaatctgagtacctctcagatgctgagccccgcccaggacagccataccaacaccgatctgcctcctgtgagcgagcaaatcatgcaaacacttagtgaactggccaaaagcttccaggacatggctgatagatgtctcttggtactccatttagaggtgcgggtgcattgcttccactacctgatcccactcgcaaaagaaggcaattatgcaatcgttgcaaatgtcgagagtatggattatgacccactggtggtgaagctgaacaaggatatttcagcaattgaggaggcaatgtctgcctctctgcagcagcacaagtttcaatatatcttcgaaggtctcggccatctgatctcctgcatactaatcaatggcgctcagtacttcaggcgcatatccgagtcaggaattaaaaaaatgtgcaggaatatctttgtcctgcagcagaacttgacaaacattaccatgtccagggaagcagacctcgatttcgctcgtcagtactatgagatgttgtacaatacagccgacgagctcttgaatctggtggttgatcaaggggtgaaatatactgagctggagtacattcacgccttaacattattgcacaggtcgcagaccggagtgggtgagctgacaacacagaacacgcggctccagagattgaaagaaataatttgtgagcaggccgccatcaaacaggccacgaaagataaaaagatcacaaccgtgtag

SEQ ID NO: 116413 - DNA, 1422 bp, Artificial Sequence
  Description of Artificial Sequence: Synthetic coding sequence
atggcagccgaggccgcgggcggcaaataccgaagtaccgtgagcaagtctaaagacccgagcggtttgttgatttccgtcatcaggaccctgagcacgagtgatgatgttgaagacagggagaatgagaaaggccggctagaggaggcctatgagaaatgtgatagagatttagacgagttgatcgtgcagcattacacagagttaaccacagctattaggacctaccagtccatcaccgagaggatcaccaattcccggaacaaaataaagcaggttaaggagaatttactcagctgcaaaatgctgctccactgcaagcgtgacgagctgcgcaagctctggattgagggtatcgaacacaagcatgttctgaacctgctggatgaaatcgaaaatatcaagcaggtcccccagaagctggagcagtgcatggcaagcaaacattacctatccgccaccgacatgctggtgagtgccgtggagagcttggagggaccgcttcttcaggtggaaggtctgtcagatctgcgtctcgaattgcactcaaagaagatgaatctccacctggtcctgattgatgaactacaccggcacctgtatatcaaaagtacatccagggtagtgcagagaaataaggagaaggggaagatctcctcactggtcaaggacgcctccgtgcccctaattgatgtgaccaacctcccgaccccaagaaaatttctcgacacaagtcattatagcacagcgggctcgagttctgtcagggagatcaatttgcaagatatcaaggaagatttggaactcgacccagaggagaatagtaccttgtttatgggcatcctgattaagggacttgccaagcttaagaagatcccggaaacagtaaaggccatcattgagcgactggaacaggagctcaagcagattgtcaagcggagtactacgcaggtggctgattctggatatcagaggggtgagaatgtcaccgtagagaatcaacctcgccttctgcttgagcttctggaactgctgtttgataaatttaatgcagtagccgccgcccattcagttgtactgggctatctgcaggacactgtagtcacacctctcactcaacaggaggatattaagttatacgacatggccgacgtgtgggtgaaaatccaggacgtgctgcaaatgctactaaccgagtacctggatatgaagaacacaaggactgcttctgagccttccgctcagctctcgtacgcatccacgggccgcgagttcgcggcgttttttgcaaagaagaagccacaacggccgaaaaattccctatttaagtttgaatcttcttcccacgctatcagtatgtccgcttaccttcgggaacagaggcgggaattgtacagcaggtccggagaactgcagggctag

SEQ ID NO: 116414 - DNA, 2622 bp, Artificial Sequence
  Description of Artificial Sequence: Synthetic coding sequence
atgttactgcactgtaagcgggacgaacttcgcaaactttggatcgagggcattgagcacaaacacgtgctgaaccttttggatgagatagagaacatcaaacaggtgcctcagaagctggagcagtgcatggcctcaaagcactacctctctgccaccgacatgctggtgtccgcggtggagtcactggaaggcccactgctccaggtggagggtctcagcgatctgagattagagcttcatagcaagaaaatgaatctccacctagtgttgatagacgagctccacagacatttgtatattaagagcactagtagggttgtgcagcgcaataaagaaaaggggaagattagctcgttggtgaaagatgcaagcgtgccactcatcgatgtgacaaatctcccaacgcctagaaaatttctcgatacctcacactactcaactgctgggtctagtagtgtccgcgaaataaacctacaggacataaaagaagatctggaactggatccagaggaaaacagcacgctgtttatgggtatattaatcaagggcttagccaagctaaagaagatcccagaaacagtgaaggccatcattgaacgcctagaacaagagctcaaacagatcgtgaaacgcagtactactcaagtcgctgattccggatatcaacggggtgagaatgtgacagttgagaaccagccccgattgctgctagagctcttagaactattatttgataagtttaatgccgttgccgcagcccacagcgtagtcctgggatacctccaggataccgttgtgacgcccctgactcaacaggaggatataaaactttatgatatggccgacgtgtgggtgaaaatccaagacgtgctgcagatgctgctgaccgagtatctcgacatgaagaatacgagaacagcgtctgagccaagcgcccaactctcatacgccagcacaggccgcgagtttgccgctttcttcgcaaagaaaaaacctcaacggcctaaaaactccttatttaaatttgaaagtagtagtcacgcaatttcaatgtcagcatatctgcgagagcaacgtcgggagttgtactcacgcagtggcgagctgcaggggggccccgacgacaacttgatcgaagggggaggaaccaaatttgtgtgtaaacctggcgcccgcaatataaccgtgatctttcatcctctgctccggttcatccaagagatcgaacatgccctcggactgggaccggccaagcagtgcccgctgagagagttcctcacagtgtacattaagaacatctttctgaaccaggttctggccgagataaataaggagattgaaggggtgaccaagacttccgatccactgaaaatactagctaatgcagatactatgaaagtcctcggagtccagcgacctctcctgcagtcgaccattattgtggaaaaaactgtgcaggacttgcttaaccttatgcatgacttgagtgcatactccgatcagtttttaaatatggtgtgcgtgaagttacaggagtataaggacacatgcactgcagcctatcgtggcatcgtgcagtccgaagagaagctcgttatctctgcaagctgggccaaagatgacgatatttctcggctgctgaagtccttgccaaactggatgaacatggcacaaccaaaacagctgaggccaaaacgagaggaggaggaggactttatccgggctgccttcggcaaggagagcgaggtgcttattggcaatctcggggacaagctgataccaccacaagacatccttcgggatgtttcagatcttaaagctttggccaacatgcacgaatccctggagtggctggcctcccgcacaaagtctgctttttcaaacctgtcgacgagtcagatgttatctccagcacaagattcacatactaatacagacctgccaccagtctcagagcagattatgcagacactcagtgagctcgctaaaagttttcaggacatggcagatagatgcctcttagttctccacttggaggtgcgcgtgcactgtttccattacctgattccactggcaaaagaaggcaactacgccattgttgccaatgttgagtctatggattatgatccgctggtagtgaaacttaacaaagacatctctgctatcgaggaagccatgtccgcatctctccaacaacacaaatttcagtacatctttgaaggactcggccacctgatcagctgcattctcattaatggggctcagtacttcaggcgtatctctgagtcaggaatcaaaaagatgtgtaggaatatctttgtattacagcaaaatcttacaaacatcactatgagtcgtgaggctgatctcgacttcgccagacaatactacgagatgctctataatacggcagatgaactgcttaacctggtcgtggaccagggcgtaaagtacaccgagctggaatacattcacgcgctaaccctgttacaccgaagccaaaccggggtgggggagttaaccactcagaacacgagactgcagaggctcaaggagatcatttgcgaacaggcggccataaagcaggccaccaaggacaaaaaaatcaccactgtgtag

SEQ ID NO: 116415 - DNA, 789 bp, Artificial Sequence
  Description of Artificial Sequence: Synthetic coding sequence
atgcacgagagcctcgaatggctcgcatctaggaccaagagcgcctttagcaatctgtctacttcccagatgctgtccccggcccaggatagtcacactaacacagacttaccccccgtatccgagcaaataatgcagaccctctctgagttggcgaagagttttcaggacatggccgataggtgtttgctggtattgcatctggaagtgcgcgttcattgtttccattacctcatccctctggcgaaggaaggtaactatgccatagtagccaacgtggagtcgatggattatgacccgttagttgtgaaattgaacaaggacatttccgccatcgaagaggctatgtcggccagcctgcagcagcacaagtttcagtatatttttgaggggttgggccacctcatttcatgtattctgataaacggagctcagtatttccggcgcatctccgagtccgggatcaagaagatgtgtcgcaatattttcgtgctgcagcagaacctgactaacattaccatgagtagagaggcagatttggactttgctcgccagtactacgagatgctctacaacactgcagatgagctcctcaacctcgtcgtcgaccagggcgtgaaatacaccgagctggaatatattcacgcgctcaccctgttgcatcggtcccagaccggcgtcggcgaattgaccactcagaatacccgacttcagaggcttaaagaaatcatttgcgagcaggccgcaatcaaacaggccaccaaagataaaaagatcaccacagtgtag

SEQ ID NO: 116416 - DNA, 1755 bp, Artificial Sequence
  Description of Artificial Sequence: Synthetic coding sequence
atggcgaatctcgtgacagctagtaagaccaaaatgtcgaagggcgaggacccgaacaatcccaggagcattaagcggatatcccaggggggtagggacaaccatctagcgatcgccaagtgcgacttgacacagctgaagaaaaaacagagcgaggtctccaatggcagcagagagacgatcagtatgaagacatgttgccaacacggcgatcggggctactggtctactgggtactactggagaggaggccccgatgacaacctcatcgagggggggggcactaagtttgtctgtaaacccggcgcacgcaacattacagtcatttttcaccccttgcttcgcttcatccaagagatcgagcacgctctggggctcgggccagccaaacagtgtcctctgcgcgagttccttacagtgtacattaagaatatattcctgaatcaggtgctcgcggagattaataaagagatcgagggggttacgaagacttctgacccattgaagattctggctaacgcagataccatgaaagttctgggcgtgcaacgaccattacttcaatccactatcatagtcgagaaaacagtgcaggatcttctgaatctgatgcacgacctgtccgcctactctgatcagtttttgaatatggtgtgcgtgaaactgcaggagtacaaggacacttgtaccgcggcatacaggggaattgtgcaaagcgaagagaagttggtcatctctgcatcatgggctaaagatgatgatatcagcaggctgttgaagtcactcccaaattggatgaatatggcccaacccaaacagcttagacccaaacgcgaagaggaggaggacttcattagagccgctttcggcaaagagagtgaggtcttaatcggcaatttgggcgacaagttgattccgcctcaggacatactacgcgatgtgtccgatctaaaggccctcgcaaatatgcatgagtccttggagtggctcgccagtcgtacaaaatccgcttttagtaatctttcaacatctcaaatgctatcaccggcgcaagattcccatacaaacaccgaccttccacccgtgagtgaacagattatgcagactctgagcgagctggctaagtcttttcaggacatggccgacaggtgcctgttggtattgcacctggaggtacgggtccactgtttccactaccttatccctctcgcaaaagaggggaattatgccatcgtcgccaatgtcgaaagtatggattatgaccctctggtcgtcaagctgaacaaggacatttctgccattgaagaggctatgagcgccagtcttcaacaacacaaatttcaatacatcttcgaggggctcggccaccttatttcctgtattcttatcaatggtgcccagtattttagaaggatatctgagagcgggattaaaaaaatgtgtcggaacatctttgtcctgcagcagaacttaactaatattacaatgtcaagggaggctgacctggacttcgcaagacaatactacgagatgctgtacaatactgcagacgagctgctgaatttagtcgtggaccagggagtgaaatacaccgaactggagtatattcatgcgctgaccctgttgcatcgaagccaaacaggggtgggggaattaacaacacagaacacccgcctgcaacgcctcaaggaaatcatctgcgagcaggccgccatcaagcaagccacaaaggacaaaaagataacgaccgtgtag

SEQ ID NO: 116417 - DNA, 1782 bp, Artificial Sequence
  Description of Artificial Sequence: Synthetic coding sequence
atggctgacgtctgggtgaaaatacaggacgtcctgcagatgctgctcactgagtatttggatatgaagaacaccagaactgcttccgagccctcagctcaactgtcatatgcttccaccggtcgggagtttgcagcatttttcgctaagaagaagccccagcgccccaagaattctttgtttaagtttgagagctctagtcacgctatttctatgagtgcctatctcagggagcaacgtcgggagctctacagcagaagcggcgagttgcagggggggcctgacgataacctaatcgaaggaggtggcactaagttcgtgtgtaaaccaggtgcaagaaacattaccgtcatcttccaccctctgctgcggtttatccaggagattgagcacgcgctcggcctcggccccgctaaacagtgccccctgcgcgaattcctgaccgtatacataaagaacatatttctgaatcaggtccttgcagaaattaataaagagattgaaggggtaaccaagacaagtgacccactgaagatactggccaacgctgatactatgaaagttctgggtgtacagcgcccactactgcagtctaccatcatagtggagaaaaccgtacaggatttattgaacctcatgcacgatctctccgcctattccgaccagtttctaaatatggtttgtgtcaaactacaggagtacaaagacacttgcaccgctgcttacagaggcatagtgcagagcgaagaaaagttggtgatctccgcctcctgggctaaagatgatgacatctccagactgctcaaatccctacctaactggatgaacatggcacagccgaaacagctccgacccaagcgggaggaggaagaggattttattagagccgcctttgggaaagagtctgaagttctcatagggaatctaggagacaaacttatcccaccgcaggacatcctgcgggacgtgagcgacctgaaggcactggcaaatatgcacgagtctctggagtggttggcaagtcgtacgaaaagcgcattctccaatctctccactagccagatgctatccccagctcaggactctcacaccaacaccgacctcccgcccgtgtcagagcagatcatgcaaacattgtctgaactcgccaaaagttttcaagacatggccgaccggtgcctgctggtactccacctagaagtcagggtgcactgttttcattacctgatcccgctggccaaggaaggaaactacgcaatcgtggccaacgttgagagcatggactacgacccattggttgtgaaactcaacaaagatatctctgctatcgaagaagccatgtctgcatcactgcaacagcacaaattccaatatatattcgaaggcttggggcatctcatcagctgcatacttattaacggcgcacagtattttcgaaggatctccgaatccgggattaagaagatgtgtaggaacatcttcgtcctccaacagaatctaaccaacattacaatgagtcgtgaagcagatctggactttgcacgccaatactacgagatgttatacaacacagcagatgagttgctgaacttggttgtcgatcagggggtaaagtatacagaactggaatatatccacgccctcactctcttgcaccgctcacagactggcgtgggtgagctgactacccagaacacacggcttcaaaggctgaaggaaatcatctgcgaacaggccgcgattaagcaggccaccaaagacaagaaaatcaccacagtgtag

SEQ ID NO: 116418 - DNA, 1932 bp, Artificial Sequence
  Description of Artificial Sequence: Synthetic coding sequence
atggctaccactgcagagctctttgaggagcctttcgtagccgacgaatacattgaaaggctggtgtggaggactcccggagggggttctcgtggcggccccgaagcctttgacccaaagcgtttgctggaagagtttgtgaaccatatccaagaactgcagataatggacgaacggatccaaaggaaagttgagaaactggagcagcagtgccagaaggaggcaaaggagttcgccaagaaggtgcaggagttacagaaaagcaatcagatcaaagaggccgctgacattatccagaaactgcatctgatcgcccaggaactacccttcgaccgtttcagcgaggtgaagagcaagatcgcgtccaagtaccatgatctggagtgccagctgatccaggagttcacgtcagcccagcgtcggggtgagatctctcggatgcgcgaggttgctgcagtccttcttcacttcaaaggatacagtcactgcgtggatgtatatatcaaacaatgccaagagggagcttacctcaggaatgatatatttgaggatgcagggatattgtgccagcgagtaaacaagcaggtcggagacatcttcagcaaccctgagaccgtgctggccaaactcattcaaaatgtcttcgagatcaagctccaatctttcgtaaaagagcagcttgaagagtgccgcaagtcagacgccgaacagtacttgaagaacttgtacgacctttatacaaggactacaaacctgagctccaagttgatggagtttaacttgggtaccgacaaacagacgtttctctccaagttaattaaatctatattcatcagctacttggagaactatatcgaggtcgagacggggtacctcaagtcgagaagtgccatgattctgcagagatactatgacagcaagaaccaccagaaaaggtccatcggtactggcgggatccaggaccttaaggagagaattcggcaaagaacaaaccttccactgggccccagcattgatactcacggcgagacgtttttgtcccaagaggtggtagtcaacctcctgcaggagacaaaacaggccttcgagcggtgtcacagattgtccgatccaagtgatctccccagaaacgctttccgaattttcaccattctggtggagttcctttgcatcgagcacattgattatgcgctggaaacaggcctggcagggattccatcatcggactctaggaatgctaatctgtacttcttagacgtcgtgcaacaggccaacactatctttcacctatttgacaagcagtttaacgatcacctgatgcccctcattagttcctctcctaaactatctgagtgcctccaaaagaagaaagaaataatagaacagatggagatgaagctagacaccggcatcgataggacgctcaactgtatgattggccagatgaagcatattctggccgcggaacaaaagaagaccgactttaagcctgaagacgagaacaacgtgttaatccagtatacaaatgcctgtgtgaaagtgtgcgcctacgtgcggaaacaggtagaaaagatcaaaaatagcatggacgggaaaaatgttgataccgtgttgatggagctcggcgtgcgttttcatcgcttgatctatgaacacctccagcagtactcttactcttgcatgggaggtatgctggctatctgcgacgtagccgagtatcggaaatgcgcaaaggattttaagattccaatggtgctgcatctgttcgataccctccacgcattgtgcaatctgctggtggtagcccccgataacctgaagcaagtgtgctcaggcgagcaattggctaatttagacaagaatatccttcacagctttgtacagctcagggcggattatcgatccgcacgtttagctcgacatttctcttag

SEQ ID NO: 116419 - DNA, 2127 bp, Artificial Sequence
  Description of Artificial Sequence: Synthetic coding sequence
atggctacaactgctgaactcttcgaagagccattcgtcgccgacgaatacatcgaacgcctagtttggcgtactccagggggcggctcacgtggcggccccgaggcctttgatcctaagaggttgctggaggaattcgtcaatcacatccaggagctgcagattatggatgaaagaatccaacgaaaagtggaaaaactagaacagcagtgtcaaaaggaggccaaggaattcgctaaaaaggtgcaggagttacaaaaatcaaaccaggtggcattccagcatttccaagaactcgatgagcatattagctacgtcgcaaccaaagtctgtcatctgggagaccaactggaaggagtgaacacaccgcgccagagggcggtcgaagctcagaagctgatgaaatattttaacgaatttttggatggtgagctcaaaagtgatgtgttcacgaactcagagaaaataaaggaagcagctgatattattcagaaacttcacctgatcgcccaggaacttccatttgacaggtttagtgaggtaaaatctaagatcgctagtaaatatcatgacttggaatgccaactcattcaggaatttacttccgcacagaggcggggggaaatttctcgcatgcgagaggtggcggccgtgctcctgcattttaagggctacagccactgtgtggatgtctatattaagcaatgtcaggagggagcttatctacggaacgacatattcgaggatgccgggattctttgccaacgcgtaaacaagcaagttggcgacatcttttccaatcccgaaactgtgctcgcaaagttaatccaaaacgttttcgaaattaaactccagtcctttgtgaaggaacagctagaggagtgcaggaaatccgatgccgagcagtacctgaaaaatttatatgatttgtacacacgcaccactaatttatccagtaagctaatggagttcaacctgggcaccgacaagcaaaccttcctgtccaaactcatcaaaagtatcttcatttcatatcttgaaaattacatagaagtagagacaggatatctgaagtcacggtctgccatgattcttcagcgctactacgactccaagaatcatcagaagcggagcatcggcacagggggcatacaggatctgaaggagagaatccgacagcggacaaatctgccactgggcccctccatcgacactcatggggaaacttttctgagccaagaggtggtggttaacctgctgcaagagactaaacaggcattcgagagatgccaccggctttctgacccctcagacctcccccggaatgctttccggatattcacaattcttgtggaattcttgtgcatagaacacattgactacgctttagagactgggcttgccggaatcccctcctccgacagtaggaacgcgaacctctactttttggatgttgtgcaacaagcaaataccatcttccatctgttcgacaagcagtttaacgatcacctgatgcctttaatctcatctagcccaaaactgtccgagtgtttgcaaaagaaaaaggagatcatcgagcagatggagatgaagttagacaccggcattgacagaactttgaactgtatgatcggacagatgaaacacattcttgctgccgaacagaaaaagacagatttcaagccagaggacgagaataatgtactgatccagtacacaaacgcttgcgtgaaagtctgtgcctatgtaaggaagcaagtcgagaagatcaagaattccatggatggcaagaacgttgacacagtgttgatggagttaggcgtcagatttcatcgtcttatctacgagcatttacagcagtattcgtacagttgtatgggcggaatgcttgccatttgcgacgtcgctgagtaccggaagtgcgccaaggacttcaagattccaatggttctccacttattcgacaccttgcacgcactatgtaatctacttgtggtagcaccagataacctgaagcaggtatgctcaggcgaacagttagctaacttggacaaaaacatactccattcatttgttcagctccgagcagactataggagcgcaagactggcccgccattttagctag

SEQ ID NO: 116420 - DNA, 2415 bp, Artificial Sequence
  Description of Artificial Sequence: Synthetic coding sequence
atggctgagaacagtgagtcactgggaactgtccccgagcatgagaggatccttcaggaaattgaaagcactgataccgcgtgtgtaggccccacgcttcgcagtgtctatgacgaccaacccaatgcgcacaagaaattcatggagaagctggacgcgtgtatccgaaaccatgacaaagagatcgaaaaaatgtgtaatttccaccaccaggggttcgtggacgctattaccgagctattgaaagtccggaccgacgctgagaaactgaaagtacaggttacagacacaaaccgccgcttccaagatgccggaaaagaggtcatcgtgcacaccgaggacatcattcggtgtaggatccaacagagaaacattactactgtggtagagaaactccagttatgtctgccagtcctggagatgtacagcaaactgaaagagcagatgtctgcgaagcggtattacagcgcactgaagactatggaacaactggagaacgtgtattttccttgggtgagtcaataccggttctgtcagctgatgattgagaacttacccaaattgcgcgaggacatcaaggagatttctatgtcagaccttaaagacttcctcgaatctatccgaaagcatagtgataaaatcggagaaaccgctatgaagcaggcacagcaccaaaaaaccttttctgtgagtttgcagaagcaaaacaagatgaaattcggcaagaacatgtacatcaaccgtgatcgaattcccgaggaaaggaacgagacagttctgaagcattccctggaggaggaggatgagaacgaagaggagatactgactgtacaggatctggtggacttctcaccagtgtatcgctgcctccacatttactcagtgttgggcgatgaagagacatttgagaattattacagaaaacagaggaaaaagcaggcccgtcttgtgctacagccacaatctaatatgcacgagactgtggacggctaccggcgctacttcacacagatcgtggggtttttcgtggtcgaggaccacatccttcacgtcacgcagggattggtgacaagggcctacaccgacgaactgtggaatatggctctctccaagataatcgcggtcctacgggcccattcatcatactgcaccgatcccgatctggtgctggaattaaagaaccttaccgtcattttcgctgacactctacagggttatgggtttcctgtcaatcggctgttcgatctcctttttgagatccgagatcaatacaatgaaaccctgctgaagaaatgggcgggggttttccgagacatttttgaggaagataattactcacctatacctgtggtgaatgaggaggaatacaaaatcgtcatctctaagtttccattccaggacccagatttagagaaacaatcttttcctaaaaaattcccaatgtcacagtccgtcccacacatttacatccaggttaaggaatttatttacgcctctttgaagttcagcgagtctctacacagatcttctactgaaatcgacgatatgttaagaaagtcaaccaaccttctgcttacaaggacactgtcttcttgcctgctgaacctcatacgcaaaccacatatcggtttaacagaactggtgcaaattattatcaataccacgcatctggaacaggcatgcaagtacctggaggactttattaccaatattaccaatatttcccaagagacagttcataccacccggctgtatggcctgagcactttcaaagatgctagacatgccgccgagggtgagatctacaccaagctgaatcaaaagatagacgagttcgtgcagttggcagactacgactggaccatgagcgaacccgatggacgcgcctccgggtacttgatggacctcattaatttcttgcgctcaatatttcaggtgtttacccacctcccaggtaaggttgcccaaaccgcttgcatgagcgcctgtcagcacttgagcacttctctaatgcaaatgttgctggatagcgaacttaagcagatcagcatgggagctgtgcagcagtttaacctcgacgtaatccagtgcgagttgtttgcatcaagcgagccagtgcctggattccagggcgatactttgcagctggcctttatcgacttgaggcaactgttggacctgttcatggtctgggactggtccacctaccttgcagattacggccagcctgcttctaagtacttgcgagtaaaccctaacaccgctctaacacttttggaaaagatgaaggacacgtcaaaaaagaataatatttttgcccagttccgtaagaatgatcgagacaaacagaaattgattgagactgttgttaaacagctcaggagcctggtcaacggaatgagccagcacatgtag

SEQ ID NO: 116421 - DNA, 462 bp, Artificial Sequence
  Description of Artificial Sequence: Synthetic coding sequence
atggctgagaactccgagagccttgggaccgttcctgagcacgagagaattctacaggaaatagaaagtactgatacagcctgtgtaggccctaccctgaggagcgtgtacgatgatcaacctaacgctcataaaaagtttatggagaaattggatgcttgcatccgcaatcatgacaaggagatagaaaagatgtgcaatttccatcaccaaggatttgtggacgccatcacagagcttctgaaggttagaaccgacgccgaaaaactaaaagtgcaggtcacagataccaatcgcagattccaggacgccgggaaagaggtgatcgttcataccgaagatatcattcggtgcaggattcagcaacgcaatattacgactgtcgtcgaaaaactgcagttgtgcctccctgtgctcgagatgtactctaagctcaaggagcaaatgagtgctaagagatag

SEQ ID NO: 116422 - DNA, 2463 bp, Artificial Sequence
  Description of Artificial Sequence: Synthetic coding sequence
atgtgctgcgtcgggggcgcaggcagctgttccgacacagggaagttgggtgcatgcagggctatgctggaggaagagaccgaccagacctatgaaaacgtgctagccgagatccaaagcttcgagctccccgtcgaggccaccctgcggagcgtatacgacgatcagcccaatgctcacaaaaagtttatggaaaaactggatgcatgcattcgcaaccacgacaaggagatcgagaaaatgtgcaactttcatcaccaaggcttcgtggatgccattaccgagctcttaaaagttagaactgacgcggaaaaactcaaggtacaggtgaccgataccaaccggaggttccaggatgcaggaaaagaggtgatcgtgcacaccgaggacatcatccggtgtagaatccagcagcgcaacatcaccacagtggtggaaaagctgcagctttgccttcccgtgcttgagatgtacagtaaattgaaggaacagatgagcgctaagcggtactactccgccctgaaaaccatggagcaactggagaatgtctattttccctgggtgtcacagtaccgcttctgtcaactgatgatcgagaatctgcccaagctgcgggaagatattaaagaaatctccatgtccgatttaaaagactttcttgagagcattagaaaacattctgataagatcggcgagaccgccatgaagcaggctcaacaccagaagacattttctgtgagcttgcagaagcagaacaaaatgaaatttggtaaaaacatgtatatcaacagagatagaatccctgaggagagaaacgagaccgtcctaaagcatagcctggaggaagaggatgaaaatgaggaggagattcttacagttcaggaccttgtggatttctcacctgtgtaccgctgcctccacatctactcagttctgggagacgaagagacattcgaaaactattatagaaaacaacgcaagaaacaggctagactcgtgttgcagccacagagtaatatgcatgaaaccgtagacgggtacagacggtattttactcagatcgttggattctttgtggtcgaggatcatatcttgcacgttactcaaggattggttacccgcgcctatacagacgaattgtggaatatggccctgagcaagattatagctgtgctcagggcccattcttcctattgtactgaccccgatctcgtcctggaattgaaaaacctgaccgtcatcttcgccgacacgctgcagggatatggcttccccgtgaaccggctgtttgacttgctctttgagattcgggatcagtacaacgaaacgctgttgaagaagtgggcaggtgtgtttagagatatatttgaggaggacaattacagtcccatccctgtcgtgaatgaggaagagtataagattgtgatttcaaagttcccatttcaagatcccgatctcgaaaaacaatctttcccaaagaagtttcccatgagccaaagtgtccctcacatctacatccaggtcaaggagtttatctatgccagccttaagttcagcgagagccttcaccgctccagcacagagatcgacgacatgctgcggaaaagcactaatctccttctgacccggactttgtccagctgcctactgaatctcatacgcaagccacacatcgggcttactgagctggtccaaatcataattaacaccacacacctggagcaagcatgcaagtatctggaggattttatcacaaacatcacaaatatctcccaggaaaccgtacacactacccgtctgtacgggctgagtactttcaaggatgctaggcatgcggcggaaggggagatatacactaagctgaatcaaaaaatcgatgaattcgtccaactggcagactatgactggactatgagtgagccagatggacgagctagtggttaccttatggacctgatcaacttcctgcggtcgatatttcaagtcttcacgcacctccccgggaaggtggcccaaacggcgtgcatgtccgcctgccagcaccttagcacttccctgatgcagatgctcttggactcagaattgaaacagatcagcatgggggctgtccagcagtttaatctcgacgtaatccagtgcgagctgttcgcttcctccgagcctgtgcctggctttcagggcgacaccctccaacttgcgtttatcgaccttagacagcttctggacctattcatggtgtgggactggtcaacctatctggccgattacggacagcccgcgtctaagtatctgagagtcaatcctaacactgcccttactttgctcgaaaagatgaaggatacctctaaaaagaataatatctttgcccagtttcgaaagaatgacagggacaaacagaaactgatcgagaccgtcgtcaaacagctgaggtcactggtcaatgggatgagccagcacatgtag

SEQ ID NO: 116423 - DNA, 2400 bp, Artificial Sequence
  Description of Artificial Sequence: Synthetic coding sequence
atgctagaggaggagacggatcagacttacgaaaacgtactggctgaaattcagtcctttgagttgcctgtcgaggccactctccgtagcgtgtacgacgaccaaccaaatgcgcataaaaagtttatggaaaaattagatgcctgcatccgcaatcacgacaaggagatcgaaaaaatgtgcaacttccaccaccagggattcgtcgatgccattacagagctgttgaaagtccgaaccgacgccgagaagctcaaggttcaggtgactgataccaatagacgcttccaggatgccggcaaagaggtcatcgtgcatactgaggacattattcgctgtcggatccaacagcgcaacattacgacagtggttgagaaactgcaactctgtctgcctgtactggagatgtactctaagctgaaagagcagatgagtgctaagcgctactactccgccttgaagacgatggagcagctggaaaatgtttacttcccctgggttagccaatatcgtttttgccagctgatgattgaaaacttgcctaagttaagagaggacatcaaagaaattagcatgtcggacctgaaggacttcctagagagcataagaaaacactcagataagattggggaaactgccatgaagcaggcgcagcatcagaaaaccttttcggtatctcttcagaagcagaataaaatgaaattcggcaagaacatgtatattaacagggatagaattccagaggaacgtaacgaaaccgttctgaagcacagtctcgaggaagaggatgagaatgaagaggaaatccttacggtgcaggaccttgttgacttttcccctgtctataggtgtcttcacatttatagtgtactaggtgacgaggagacatttgagaactactatagaaaacagcgaaagaagcaagctcggcttgttctgcagccccagtccaatatgcacgaaaccgtcgatggataccgccggtatttcacacagattgttggattcttcgtagtcgaagatcacatcctccacgtgacacaggggctggtgactcgcgcttacaccgatgaactgtggaatatggccctctctaagatcattgctgttctaagagcgcacagtagctactgcactgaccctgacctggtactcgagctcaagaacctcacagtcatcttcgcagacactctccagggctacggctttcctgtcaatcggctgttcgatctactcttcgagatacgagatcagtataatgagacactgctgaaaaagtgggctggtgtatttcgcgacatcttcgaggaagacaattacagcccaatccccgtggtgaatgaggaggagtataagatcgtgattagtaaatttccattccaggatcctgacctggaaaagcagagtttcccaaaaaagttccccatgtctcaaagcgtcccacacatttacatccaggtcaaagagttcatatatgcctctctcaagttctctgaaagtctgcaccggagcagcacagagatcgacgatatgttgcggaaaagcacaaatcttttgctgaccaggaccctttcttcttgcctgctcaatctgatccggaaacctcacatcgggctgaccgagctggtgcaaatcatcattaacacaacgcacctagagcaagcctgcaaatatctggaggattttatcacgaacatcacaaacatctcccaagaaacggtccatactacacgcctttacggcctgtcaacattcaaggatgcacgtcacgctgcagaaggcgagatttatacaaagctgaaccagaagatcgacgaattcgtgcaactggcagactacgattggacaatgagcgagcccgatggccgggccagcggatatctcatggacctcattaatttcctgagaagcatctttcaggtgtttacccatctccctggtaaagtggcgcaaacagcatgcatgtccgcttgtcaacacctaagcaccagtctgatgcagatgctcctggacagcgagctgaagcagatatcgatgggagctgttcagcagttcaacttggacgtgatccagtgcgaactgtttgcctcctcagaaccggtcccggggttccagggggacacactccagctggcgttcatagatctgagacaactcttagacctcttcatggtgtgggactggagcacttacctcgccgactatggccagcccgcatcaaagtatttacgagtgaacccaaatactgctttgaccctcctggaaaagatgaaagatacatccaaaaagaacaatatctttgcacagttccggaagaatgacagggacaagcagaagctaatcgaaactgtggtgaaacagttgagaagccttgtcaatgggatgagccagcatatgtag

SEQ ID NO: 116424 - DNA, 2106 bp, Artificial Sequence
  Description of Artificial Sequence: Synthetic coding sequence
atggccgagaactcagagtctctgggaacagtgcctgaacacgaacggatactgcaggaaattgaatccactgataccgcctgcgtggggcccacactgaggtccgtgtacgatgatcaacctaatgcacacaagaaattcatggaaaagctggacgcctgtatccgcaaccatgataaagaaattgaaaagatgtgtaactttcatcatcagggtttcgtggacgccatcactgaactgctcaaggtgcgcactgacgctgagaagctgaaggttcaagtgactgatacgaacagacggtttcaggacgcagggaaagaggtcattgtacacaccgaagatataatacggtgtaggatccaacagagaaacatcacaaccgtggtcgaaaagctacagttatgcctgcctgtgctggaaatgtacagtaaactgaaggagcagatgtcagccaagcggtactatagcgcactgaagactatggagcaactcgagaacgtgtactttccgtgggtcagccagtacaggttttgccagctaatgatagagaacctaccaaaacttcgggaggatatcaaagaaatctcaatgagcgacctgaaagattttcttgagagcatcagaaagcacagcgacaaaataggagaaaccgccatgaaacaagcccagcaccaaaaaaccttcagtgtgagcttacaaaagcaaaacaaaatgaagttcggaaagaacatgtatattaatcgtgatcgcatccctgaagaaaggaacgagactgtgctgaaacatagcctcgaagaagaagacgaaaacgaagaggagggtgacgaggagacgttcgaaaactattatcggaagcagagaaaaaaacaagccaggctggtgctgcagccgcagagtaacatgggctatgggtttcccgtgaatcgtctatttgacctcttatttgagattcgtgaccagtacaacgaaaccctcctgaagaaatgggcaggcgtttttcgggatattttcgaagaagataattacagccctatacccgtagtgaacgaggaggagtataagattgttatctccaagttccccttccaggatcccgatctggagaagcagagtttcccgaaaaaatttcccatgagccagagcgtgccgcacatatacattcaggtgaaagaattcatttatgcatccctcaagtttagtgaatctctgcatcggtctagtactgaaattgatgatatgttgaggaagagcaccaatcttttgctaacacgcaccctgagcagttgtctactgaacctgattagaaagccccatatcgggctgactgagctagtgcagatcatcatcaacactacccacttagaacaggcatgtaagtatttagaggactttataacaaatataaccaacatttcacaagagacagtgcacacaacccggttgtatggattgtcaaccttcaaggacgcccggcacgcagcggaaggcgagatatacactaaattaaaccagaagatcgacgaattcgtgcaactcgctgattatgactggacaatgagtgagccagatggccgcgcttcaggctaccttatggatctgattaatttccttcgttcaattttccaggtatttacacacctgcctggtaaggtcgcgcagacggcctgtatgagcgcgtgtcagcacctgtctacctctctgatgcagatgctgttggactctgaactgaagcagatcagcatgggcgctgttcagcagtttaatcttgacgtgatacaatgtgagctgtttgcctcttcggagcccgtgcccggattccagggggacaccttacaactcgcgttcatagacctgcgccaactgctcgacctcttcatggtgtgggactggagtacgtatttggccgattacggacagccagcaagcaaatacttacgcgtcaatccaaacaccgctctgacactccttgagaagatgaaggacacaagcaagaaaaacaatatatttgctcagttcaggaaaaatgacagagataaacagaaactgatcgagactgtggtaaagcagctgcgatctcttgttaatggaatgtcacagcatatgtag

SEQ ID NO: 116425 - DNA, 219 bp, Artificial Sequence
  Description of Artificial Sequence: Synthetic coding sequence
ggcaaggttgcacagacagcttgcatgtcagcatgtcagcacctttccacttctctgatgcagatgctgttagacagcgagcttaaacagatctcaatgggcgcggttcagcagttcaacctagacgtcatccaatgtgagttatttgcttcatccgagcccgtgcctggatttcagggcgacaccctgcagttggcattcatcgacctgaggcaatag

SEQ ID NO: 116426 - DNA, 2436 bp, Artificial Sequence
  Description of Artificial Sequence: Synthetic coding sequence
atggaacgtggcaagatggcggaggctgaatccctcgaaaccgccgctgagcatgaacggatcttgagagagatcgaatccactgatactgcttgtataggaccaacgctgagatcagtgtacgatggggaggagcatggccgattcatggagaagcttgagactcgaattcgcaatcatgacagggagattgagaagatgtgcaactttcactaccaaggcttcgtggactcaatcaccgagctccttaaagtacggggcgaggctcaaaagctgaagaaccaggtaacagatacaaatcgtaagctgcaacacgaagggaaggagttggtgatcgctatggaggagctaaagcaatgtcgcctgcagcaacgaaacatcagcgcaaccgttgataagctaatgttgtgtctacctgtactggaaatgtactccaagctgcgtgatcaaatgaaaaccaagagacattacccagccttgaagaccctggaacatttggagcacacctacctaccacaggtttcgcattataggttttgtaaggtgatggtggataatatcccaaagcttcgggaagaaatcaaggacgtctctatgtctgacctgaaggacttcctggaatcaatcaggaagcattccgataagattggggagacagctatgaagcaggctcagcagcagaggaacctggataatatcgtgctacagcagccccgcatcgggtcgaagcggaagtcaaaaaaggatgcatatattattttcgacactgaaatagaaagtacgtctcccaaatctgaacaagattcaggaatcctcgacgtggaggatgaggaagatgacgaagaggttccaggcgcacaggatctggtggatttctcccccgtgtaccggtgtttgcacatttatagtgtgcttggagcacgtgagacctttgagaattactatcggaagcagaggaggaagcaagcccgactggtgcttcagcctccctcaaacatgcacgagactctggacggttaccggaagtacttcaatcaaattgtgggcttttttgtggtggaggaccacatcctacacaccactcagggattagttaaccgggcttacatcgacgagctgtgggaaatggcactaagcaagacgattgcagcgctgaggacccacagttcctactgctccgatccaaacctggtgcttgacctgaagaatctgatcgtgctgttcgcagacacgctgcaggtgtacgggttccccgttaatcagctgttcgatatgctccttgagattcgcgatcaatatagcgaaaccttgctgaaaaagtgggctgggatttttagaaatatcctagacagcgataattactcacccataccagtgacatcagaagaaatgtacaagaaggtggttggtcagttcccttttcaggacatagagctcgagaagcagccgttcccgaagaagtttcctttttctgagttcgtgcccaaagtgtataaccaaatcaaggaattcatctatgcttgtctgaagttttcagaggacctgcatctgtcatctaccgaggtagacgacatgattcggaaatccactaatcttctgctcaccagaaccttatcgaatagtctacagaatgtgatcaaacgcaaaaatattgggctgaccgaactggtgcagattatcataaacaccacgcacttagaaaagagctgcaagtacctggaagagtttattaccaatattacgaacgttctcccggaaacagtgcacactaccaagctgtacggtacaactaccttcaaagacgcacgccacgccgcagaggaagagatttatacaaatctaaatcaaaagattgaccagttcctgcaacttgccgattatgactggatgaccggcgatcttggcaacaaggcgagtgattacctggtcgatctcattgcctttctccgttcaacttttgctgttttcacccacctccccggaaaggtagcccaaactgcctgcatgtctgcatgcaaacacttagctacaagcctgatgcaacttctgctggaggcagaagttcgtcagctgactctgggtgccctgcagcagtttaacctggacgttcgagagtgcgaacagttcgctagatccggtcccgtcccggggttccaggaagataccctgcagctagcgtttattgatctgcgtcagcttctagacctctttattcagtgggactggtccacatatctcgcggattatgggcagccaaactgtaaatatctgagagtaaacccagtaacagcattaactctgctcgaaaaaatgaaggacacctcccggaagaacaacatgtttgcccagtttcggaagaacgagagagataagcagaaattgatcgacaccgttgctaaacagcttcgagggctgatctccagccaccacagttag

SEQ ID NO: 116427 - DNA, 2016 bp, Artificial Sequence
  Description of Artificial Sequence: Synthetic coding sequence
atggaaaggggaaagatggccgaggccgagtcccttgagactgcagccgagcacgagagaattctaagggaaattgagtctacagacaccgcctgtattggtcccacactccggagtgtgtacgatggcgaggaacatggcagatttatggagaagctcgaaacccgcatccgtaatcatgaccgggagatagaaaagatgtgtaactttcactaccaggggtttgtcgactccatcacggaattgctgaaggtccgcggcgaggcgcagaagctaaagaatcaagtgactgacacaaatcgcaaattacagcacgaggggaaagagctggtgatagctatggaggaactgaagcaatgtaggctgcagcagaggaacatttccgccactgtggacaagttgatgctttgcctgccagtgctggagatgtattccaagctgagagaccagatgaagactaaaagacattaccctgctcttaaaacactagagcatctggagcacacctacctgcctcaagtgtcacattataggttctgtaaggtcatggtggataacattcctaaactcagagaggaaattaaagacgttagcatgtcagacttaaaagatttcctggaaagcataaggaagcactccgataagattggggagactgctatgaagcaagcacagcagcagcggaacctggataacattgttttacaacaaccccgcatcggaagtaagcgcaagtctaaaaaagacgcctacatcattttcgatacagaaattgagtcaacttcaccaaaatccgagcaggattctggtattctggacgtggaggacgaagaggacgacgaggaagtgcccggtgcccaggacctcgtggactttagcccagtgtaccggtgtctccacatctacagcgtattaggggcaagggagacttttgagaattattatcgcaagcagcggaggaagcaagcaaggttggtgctccaaccaccgagtaacatgcatgaaactttggacggttacagaaagtatttcaaccagatcgtaggttttttcgtggtggaagaccatatattgcacaccacacagggcctggtaaaccgggcctacatagatgaactttgggagatggctctcagcaagacaatcgctgcactgcgcacacactctagttattgcagtgatccgaatctggtgctagatcttaagaacttaattgtcctgtttgctgacactctgcaagtgtatggtttccccgtaaaccaactgtttgacatgttgctcgaaattcgggatcagtacagtgagactctactgaaaaagtgggccgggatatttcgcaacatactagattccgacaattactcacccatccccgttacatccgaggagatgtataagaaagtggttggtcagtttccatttcaagatattgaactcgaaaagcagcccttccccaagaagtttcctttttctgagtttgtgcctaaagtctacaatcagattaaggagtttatctatgcctgtcttaagttctcagaagatttacacttatcatccacggaagtggacgacatgattcggaaatccaccaatctcctgttgacgaggacgctttctaactcactacagaacgtcattaagaggaaaaatattggccttaccgaactcgtacagataataatcaatacaacccatctggaaaagtcctgtaagtacctcgaggaatttataacaaatatcactaatgtgctcccagagacagtacacaccaccaagctgtacggtacaacaacctttaaagacgcccgccacgctgccgaagaagaaatttatactaacctaaatcagaaaatcgaccagttcctgcaacttgccgactacgactggatgactggcgaccttggaaataaggcaagtgattatcttgttgaccttatagcattcctgaggtctacctttgctgtcttcactcatctgcccgtatctgggtcttgctattttgttttgtatatatag

SEQ ID NO: 116428 - DNA, 5970 bp, Artificial Sequence
  Description of Artificial Sequence: Synthetic coding sequence
atgacaaaagtcccccctgccttcgacttctctttcctcaatgacgaagaggctcgcaagatactgcaggttttagagcggaatgaggaactgcagcgagccgaaaaggatcgaatcagtaaactgcagaaaactaagcgcgatatacgctggttgcagggcgtgacaggtgagtggttcgaggaaatccagaggaagaaattttgtaatgagacagacgtgagccagatgcttaagcaaccccttacctatagactgtctaaggaaatggcgaaaaatgacccgattgagctgcccacatcgagaagcaagaatgtgacaaaccagaaaaaaccaacgcccttttcatcaagaatgtccttccgaagttccttcgccagtctgttcagtttccggaaatccgggaaggagacaagcaaattacccagcctggggcaaaaagggtgcgacggtcatgctggtcctccaatgcccgtccgcggcgcagcagtgcaagctaagatctacaacagtcctctcgaaaaccacttggtcgatagcaccttcgtccccaagcccgccgtgatgcgcgaggaatctggcatgccccccccctgggacgcatctctgctagaaaacgagtttttccaagtcttggacgacctcgattcaaagcttgcccaggagcaatcagcaagctccgtgaatacacgcacaccccttaattacggtagtaggacccagttcggccacttttattcatctggcaaccggcacggcaatatcacagaacggcacaagaagcactacaatgagacatctaacatgagtatttacgacatcctgcggcctggtactccgagagaaggtttcaaaaccttctccccgcgtacttcaaccatctacgacatgtatcggacacgcgaacccagggtgttcaaggaggactatgttcagaaaaatacctttggttctacatccttgtgcttcgattctcgacagaggtctgctctccccgcaactgggcactttaccgctagatccctgcatttccctgccacaacgcaatccaagtctgggtttatcccccctcgccaccagcaatcaccaaaacggacccccctgagtagtattatttggaacaggtccgatagctcccgcgatagagaaaatcaagaagagtttcttcgagccccctccccgatggagatagatccagcagacaagtacgtgtatcctcgcggttttcaggagaataaacgttacgaaagctaccactcccagaacgtataccagcgggtatcactaaacgcacccatggagaacgccatgagtccagacacatttgagaattctgaaaatatgcccttctaccatcaatcaaatacctttacccggtcgtttttctctaatacatttggtcgatccggcgaacaacgtagattcggccaaggtccattctgggggcaggaaaaaggtcatagcttctggtctgatttccataggtctaggaagtcgttctcctcctccgacagggacttcgagatgatatcaatggaggccaacagcgtctcagcgatccatggacacaatgtttcttccgagcattgggagagtttcagcagtggctatgggactgacgtttctcgagggcaggaggagcctcacccttggcagttcgattttcagcggtctactctggatagcatggttgtgagtcacggtaatgagacacaattgacaccccacttcggcacgcctaatgtctgcagcatgacgggcagttcttatcacgtcaagtccagcgaactggtgagtcagcaagattcctccccagtagaggtgcacataaacaaagaggcttccagctttggcatcgcacagacccttgcgtcatcatttaagacttctttttcccagatctcagacgacagaaggaaccctcaatctccgaatctccagaatcctaccgtcacactccagaaaatctttccaaataagcccgctagtcatccgatgcgaagccacacggaagtgaccgtaacctccagcaactccgtggactccttgcctctcgccaagtcgcagccaaacatattagtgactgaggtgaataacgagaaggatctgaatgaaagcatatcagaagaagacaagcagctcagtaagatggatcagacaaataaagcaggagaaatccctcagccagtgagccagaccggtatcagtaattctctgcccgactttcagaatcccctgtctcaggattccgcaaaaagcaacggcttcggttttaatgcgagtacaattatctcgagcaaaaaatccccccgagtttttagcaggaaagacacctccaagatgtacataccacacacagacaaatccaacgacatcaagcaggacaagcgtttcacagagaacagaaagctcggctccaccgcctcattgccattcatacaggaacatcggacgccaccgagcttcccccggaccgaccagggatgtcaccaagagctgacggtcaacaacgaggatataagccggatcattactaacaaccactggtctagcgccctcacagatacacagaacgcccagtattccaagtgcaagctgactcccgggcataaaactagttgcgattcgctggatctgtcctcagcggctcttcccgacagctcaccctccaagaattctagtttggatgcaccggtggtcccttctaccaccgttttttcgcggaggtcacctagcgacaaggacccttccctgggagagcgcgaggaaaaggacaatgccggaaaaaaccagaagaaccaatttatcgtgtcccatagcgaaaatcaggagcgtaatgacagcccagtgcccacgcacgatgaagtggtggacgtgaagtgccacagccattcccccttcaggaacgagagagggaagggtaagattcggcatcatatatcatgcatcgaaaaactctcaaagactgaaagtatctccgtgcctacctccgatcataggagcctgatagaagccaaccagtctaattctaaggtaagtgagctcgatactatttattgtaccctgcctcgaaagtcttctagctttctgattcatggaaggcagagcggatcgaagataatggcagcttcactacgaaacgggccaccccccttccaaattaaaaacaacgttgaagacgccatgggcaactacatgttaaacaagtttagcccctcgtctcccgagagtgctaatgagtgcagtaaggtcctgtctgattccgcactggaggcaccagaagctaccgagcgtatgactaatgtaaaatcttccggatctaccagcgtgcggaagggacccttgccttttttaattaatagggcgatgtcgtgccctagtggcgagcctcacgccagcactggaagggagggccgcaagaaaccacttacctccggtatggatgcgtcagaactgacccccagagcctgggaacgcataatttcccctgtggagagtgactcctctgtgcgcgattgttcgctgactaaacgccagcaccaaaaagagaattttcaggagtatacagaaaaggaagggaagatggcagcgtcgaggagatcggtgtttgccctaagcaacgaggaccctttaccgttctgctctgacctgtccggcaaagagaggggtaaaactctgcacaaagtgaagaccacgtcaactttctcagtttctggcgatgaggacaacgtcaaatgcctggaagtcgtatccatctactatactcttccaagaaagcctagcaaaaaattttgtaacttgcttcagcagtacacacagaatacgaatttgttaatcgaaagcccccaggtcgagaccgagacatttcccaacgccctagaaaaggataagcagaactacagcacaagagagcaatcaggcacacccagttgcgaaaatctgaaaatgagtgtaaactccgaccagaccctgaccacagaaaatatgacagccttccggctaagtaaccggggtccactggcccctaccctgcaggaaatggcatcagtcgaggccgcagtgtctctgccagaggaggaatcaaaggcgcgggagatctttagtgataatctggctaagactcccctgggagattctgagaacaaaaaagagcgcggcaaaaagcttcagtcggagactctgcacaccagtctgatgttgcagaggaaaaatgtgtcagaggagaagtcggaaaactgtcagcagagcatcaactcctccaattccgggcctagctccttgccagccctgagcgaggtgaatatcggtaattctcaaacacgtaggagctcctgggagtgcaccggatccgggcgagccatccccttcaccgggtccggaaaatgccctcagaaggatcacacgtcgacggccgtgggcgatggatcatcaggaagtcagccccgggaagggaggggcgacatcggaactaactgtcagaaaatgacaaacaaaacgctcagccactctgagagccaggtgttcgctctcacccctgcactgcataaactgcagcttggagaggagacccagtcggatgaacctaacttggaatccctccaatccgagccccgcgagttgcctcaaagatctcaggaggcgaatatgactgagtcccggaaggcggaagatgagatgcaaaaatccgcgtgggatcagccttctttgccagaggggaacaaaaataagaccaatttggatgatttggtgaagggcgaaaaccgcagttcagttaagcacagattagctgccatgtcaaaggccagccgcaaatttcctgccaaggatgtgagtccaagaagacatgttgccacaatctttccccagtccggaagccgatctggcttcgaccatctgagcttaggaaccgtggaatgtaatcctctcttcccagagccaacccccaagtcagcagagagcattggtgagagccgtctgtcggagaatggcaagcatgtgaaaaagagcgagaatctcctgcccataaccgtgttgccaaaccgggaaccttccacccacgtatcaaatcagaagtctaacagcatcagtcaacgccaccagaacgaatttaaaaacgtgtccgaaagcccatccaaacacgaaaacagcaaggatgtaacagccgcacaaaacctggtgagggaaagcggtgctcccagtcccatcacattcacctccttgcgagaggctgagttctcagacaatcaacgcaggttgtcaccacctttccctctagaaccggctcaaaaatcacgggtttcttcaccgcttgcgagctttctgcagcagcaacgctcagcctccagtctggaatgggaacctgaacctcacctctacaggagcaagagcctgaaaagtattaacgtgcacggggacctgctgagaaagtcacatccgccgaaggtcagagaaaggcacttcagcgagtccacctcaattgacaacgccctgagccggttaacacttggaaatgagttctccgtaaataatgggtacagccggcgcttccggagtttttcagagcttcccagctgtgacggcaacgaatcatgggcctataggtccggcaccaagaccgggccacgtagtgccataagcatttaccggcccattgactacggaattttcggcaaggagcagcagttggctttcctagaaaacgtcaagcggagcctgacacaaggtagactgtggaaaccgtcattcttgaagaaccccgggtttctcaaggacgatctgagaaacccgcccaatccatcagagtcattatcttcaaattccccatctagtcaggtccccgaggacggcctctctccaagtgaacccctgaacatttatgaagatgatcctgtcgactcaaactgcgacaccgacaccacaacagatgatgagtactacctggacgaaaacgacaaagagtcagaactttag

SEQ ID NO: 116429 - DNA, 5742 bp, Artificial Sequence
  Description of Artificial Sequence: Synthetic coding sequence
atgctgaaacaaccgctcacctatcggctaagcaaagaaatggcaaagaacgaccccatcgaattgcctaccagcaggtccaaaaatgtgaccaatcagaaaaagcctacaccattctcctcccgtatgagttttagatcctcttttgcatcactgttttcatttcgaaagagtggcaaagaaacgagtaaactcccttccttaggacagaaaggctgcgacgggcacgccggccccccaatgcccgtgcggggggcagcagtacaggccaagatctataatagtccactcgagaaccacctggtggactccactttcgtgcccaagccggctgttatgagagaagagtcaggcatgcctcctccatgggacgccagcctcttggagaatgaattttttcaagtcctggacgacttggattccaagcttgcccaagaacagagtgcatcctcagtcaatacaagaacgcctctgaactacggctccagaacacagtttggacacttctatagttccgggaaccgacatgggaatatcacggaacgtcacaagaagcactataacgagacgtcaaacatgtcgatttatgatatcctccgccctggaacccctagagaggggttcaagaccttttcaccgaggacttccaccatatatgacatgtatagaactagagagcctagggttttcaaggaggattatgtgcaaaagaataccttcggtagtacatctctctgttttgacagcagacaacgtagcgcattgccagctacagggcatttcaccgccaggtccttacattttccggcaacaacacagagtaagagcgggtttatccctcctaggcatcagcagagcccaaagcggactcctctgtcgagcatcatctggaatcgatctgacagttcaagagacagggagaatcaggaggaatttctgcgggccccttctcctatggagatcgaccccgccgataagtatgtgtaccctaggggctttcaggaaaataaacggtacgagtcttatcactctcagaatgtgtaccagcgggtttctctgaacgccccaatggagaacgccatgtctccggacacgtttgaaaactctgagaacatgcctttttatcaccagagcaacacctttactaggagcttttttagtaacacctttggaagatcgggcgaacagcggcggttcggtcaaggacctttctggggccaggaaaaaggtcatagcttttggagtgactttcataggtctcggaagtctttcagctcctcggatcgggacttcgaaatgataagcatggaggctaacagcgtgtccgcaatacacggacataatgtcagctccgagcattgggagtctttctcctccggttatggaaccgatgttagccggggccaggaagagcctcacccatggcagttcgacttccagcggtcgaccctggatagtatggtcgtttcccacggaaacgaaactcagctaactccacactttgggacccctaatgtctgctccatgaccgggagctcctatcacgtgaagagctctgagctcgtttctcagcaggatagttccccagtcgaggtccacatcaataaggaggcatcatcattcggaatcgctcagaccttggcgtctagctttaaaaccagtttctctcagatctccgatgacagaagaaacccccaatcgcctaaccttcaaaatccaacagtaacactccagaaaattttccctaataagcccgcctctcacccaatgaggtcccatacagaggtgaccgttacgagctcaaattccgtggacagtctcccgctggcaaagtctcagcccaacatccttgtgacagaggttaataatgaaaaagacctgaacgaatcaatctctgaggaagacaagcagctgtccaagatggaccagacaaataaagcaggagaaatccctcagcccgtatcccagaccggtatctccaactcgttacctgattttcagaaccccttaagccaggattcagccaaaagtaacgggttcggattcaatgccagtaccatcatctcaagtaagaaaagcccccgcgtgttcagtcggaaagacaccagcaagatgtatatcccacatacggataagtctaacgatatcaagcaggataagcgcttcaccgaaaataggaagttggggtccacggccagtctccccttcattcaggaacatagaacgccgccatcttttcctagaaccgaccagggttgccatcaggagctcaccgtcaataacgaggacatttctcggatcatcaccaacaatcactggtcttccgccctcaccgatacccagaatgcccagtattcgaagtgtaaactgacccccggccacaagacctcctgtgactctctcgatctgtcatcggcagctttaccagactcatctcccagcaaaaacagtagcctagacgcgcccgtggtgcctagtaccactgtgttttcgagaaggagtccttctgataaggacccatccctgggggaaagagaggagaaggacaatgcaggaaaaaaccaaaagaaccagtttattgtaagccatagtgagaaccaggaaagaaacgactctcctgtccctacacacgatgaagtcgtcgacgttaaatgtcatagtcactcaccctttcgcaacgagagggggaaaggtaagatcaggcatcatatcagttgcatagagaagttgtctaagacagaatcgatctcagtcccgaccagcgaccaccgcagcctaatagaagcaaaccaaagcaactctaaagtgagtgaactcgatacaatttattgtacacttccacgcaagagctcctccttcctgatacacgggagacagtccggcagcaagattatggccgccagtctcaggaatggcccaccgcctttccagattaagaacaatgttgaggacgccatggggaattatatgctcaacaagttttccccgtcgtctcccgaatctgctaatgagtgctctaaagtcctttccgatagcgccctcgaggccccggaggcgactgaaagaatgaccaacgttaaaagctcaggtagtacgtccgtgcgaaaaggccctttaccttttttgataaatagggccatgagctgcccatccggcgaacctcacgctagtactgggcgtgaaggacgcaagaaacccctgacctccggtatggatgcaagcgagctcaccccacgtgcctgggagcgcatcatctctcctgttgaatccgattcctccgtcagggactgcagcctgacaaagcggcagcaccagaaggaaaatttccaggagtataccgaaaaggagggtaaaatggctgccagtcgtcgatctgtgtttgctctttccaatgaagatccactccccttttgctctgacctctcaggcaaagaacggggcaagacactccacaaggtaaaaactaccagcaccttctctgtctccggcgacgaagataacgtcaaatgtctggaagtcgtgtcaatttactataccctccccagaaaaccctccaagaaattttgtaatctcctgcagcagtatactcagaatacaaacctgctcatcgagagccctcaggtcgaaaccgagacatttcccaatgctcttgagaaagacaagcaaaactactccacccgcgaacagtccggaacacccagttgtgaaaacctcaagatgtccgtgaactcggaccagaccctcacaacagaaaacatgaccgctttcaggttgagcaatcggggacctttggcccccacactccaggaaatggcaagcgtggaggcagccgtttctcttccggaagaagagtccaaggccagagagatcttctctgacaatctggctaagactcctctgggagactctgagaataaaaaggaacgtggtaaaaaactgcagagtgagaccttgcacacttccctgatgctccaacgcaagaacgtctccgaagaaaagtcagaaaattgccaacaatccatcaacagttctaactcaggacccagtagcctgccggcgttaagcgaggttaatatcggcaattcccagaccaggcggtcgtcatgggagtgtacaggcagcggtcgggccatcccattcaccgggagcggcaagtgcccacagaaggaccatacgagtacagctgtgggcgacgggtcgagtggttcccagccacgcgagggacggggagatataggcacaaactgccagaaaatgaccaacaaaaccctcagccattcagaaagtcaggtgttcgccttgactccagctctgcataagctgcagctgggtgaggaaacacagtccgacgaacccaatctcgaaagtctgcagagcgagccacgagaacttccccagcggagccaagaagctaacatgacagagagtagaaaagccgaggacgagatgcaaaagtccgcatgggatcagccttctttacccgaaggtaacaaaaataaaactaatctggatgacttggtgaagggtgagaacaggtcctcggtgaagcaccgcctagccgctatgagcaaagcctcccgcaaattcccagctaaagacgtaagcccgaggagacacgttgccaccatcttccctcagagtggatcaaggtccggctttgatcacctatcgctgggtaccgttgagtgcaatcctctgttcccagaacccacacccaagagtgccgaatccattggggagtccaggttgagcgagaatggaaagcatgttaagaaatctgaaaatctcctgcctattaccgtccttcctaacagagagccatcaacacatgtctcgaaccagaagagcaattctattagtcagagacaccaaaacgaattcaaaaatgtgtccgagagcccatcaaaacacgaaaacagcaaagatgtgaccgcagcgcagaatctggtgagggagtcgggggccccaagtcccataactttcacttccctcagagaagcagaattcagtgataatcaacggcggctgtccccacccttccccctggaacccgctcagaagagccgtgtgtctagccctcttgctagcttcctccagcagcaacgcagcgcgagttcactcgaatgggagccagaaccacatttgtaccgttctaaaagcttaaaaagtattaacgtacatggagatctgctgaggaagtcccatccacccaaagtgcgcgaacgccacttctccgaaagtacatcgatcgataacgcacttagccggctgaccttaggaaatgaattcagtgttaacaacgggtatagcagaaggtttcgtagcttctcagagttgccttcttgcgacggcaatgaaagctgggcttatcgatccgggacaaagactggcccgcggtcagctatttctatttacagacccattgattacgggatttttgggaaggagcaacaactcgcttttctggaaaatgtgaaaaggagtcttactcaaggccggctatggaagccctcatttctcaaaaatccgggcttcctaaaggacgacctaaggaacccccctaacccgtctgagtcattatcctcaaattcaccctctagccaggtccctgaggatggcctgagcccctcagagcccctgaacatatacgaggatgatccggttgatagcaactgcgataccgacaccacaacagatgacgagtattatctcgatgagaatgataaggagtcagagctgtag

SEQ ID NO: 116430 - DNA, 2460 bp, Artificial Sequence
  Description of Artificial Sequence: Synthetic coding sequence
atgcctgtgagaggggccgccgtgcaagccaagatctacaacagtcccttggagaatcatctggttgacagcacatttgttcccaagcctgctgttatgagggaggaatcagggatgccaccgccctgggacgcaagtctcctggaaaacgagttttttcaggtcctggatgatctggattccaaactcgctcaagagcaaagtgcaagttctgtcaatacacggactcctttgaattacgggtctcgcacccaattcggccatttctactcttccggcaatagacacgggaacattacagaaaggcacaagaaacactataatgaaacctcaaacatgagtatctacgatatacttcgccctggtacaccaagagaagggtttaagacattcagccccagaacgtctaccatttacgacatgtacaggactagagagcctcgggtttttaaagaggattatgtgcagaaaaacaccttcggctcaactagcctgtgtttcgactcccgccagcggtcagcgctcccagccaccggtcattttaccgcccggagtctgcacttcccggcgaccacacagagcaaatcaggcttcattccccctaggcatcagcaaagccctaaaagaacgccactaagcagcatcatctggaataggagcgactctagccgcgatagggagaatcaggaagaattcttgagggctccaagccctatggagatagatccagccgacaagtatgtctacccacggggatttcaggagaacaagcgctacgagtcctatcactcccaaaatgtgtaccagcgggtctctctcaatgcccccatggagaatgctatgagcccagatacctttgagaatagtgagaacatgccattctaccatcagagcaacaccttcacaagatcgttcttctcgaacacgtttggaaggtccggtgagcaacggcgatttggtcagggtccgttctggggacaggagaaaggtcactccttctggtctgacttccatcgttcccgaaagagcttttcttcttctgacagagactttgaaatgatttccatggaagcgaattctgtgtcagctatccacggccataacgtttcaagcgaacactgggaaagtttctcctcaggctatggaacagatgtcagtcggggacaagaggaaccccacccgtggcagttcgatttccaaaggtcgactttggattccatggtggtgtcccatggaaacgaaactcagctcactccgcactttggcactcccaatgtgtgcagtatgacgggtagtagttatcatgtgaaaagttcagagttggtcagccaacaggactccagtcccgtggaggtgcacatcaacaaagaggccagctcattcggcatcgcccagaccctcgcgtctagcttcaagactagctttagtcagatttccgatgatcgcaggaacccccaatctccaaacctgcaaaaccctactgttacactccagaaaattttccctaacaagcccgcctctcacccaatgcgaagccacaccgaggtcactgtgacatcctctaatagtgtggactctctaccgctggcgaagagccagccgaacatcctggtcactgaagtcaacaatgaaaacagcaaggacgtgaccgccgcccagaacttggtccgggaaagtggggcacccagtccaatcacttttacttctctgcgagaagcagagttcagtgataatcagcgtaggctcagtcctcccttcccccttgaacctgcacagaaatctcgcgtgtccagtcctcttgcttcattcctccagcagcagcgctccgcgagcagcctcgagtgggagccggaaccccacctttatagatccaaatccctgaagtcaatcaacgtccatggagacctgctgcgaaagtcacacccgccaaaggtgcgggagcggcacttcagtgaatccacgtccattgacaacgcactgtccaggctcaccctaggtaatgagtttagcgtgaacaacggctatagtagacggttccgatcctttagtgagttacctagctgcgatggtaatgaaagttgggcctaccgctcaggcaccaaaacgggcccgcggagtgctatatctatttaccgacctattgattacgggatttttggaaaagagcagcagcttgccttccttgaaaatgtgaagaggtccttgacacagggtcggctgtggaagccaagcttcctgaagaatcctggattcctgaaagacgacctccgcaaccctcctaaccccagcgaatccctctcttcgaattcaccgtctagtcaggtccctgaggacgggctgagtccaagtgaacctctcaatatctatgaagatgaccccgtcgattcgaattgtgacacagataccaccacagatgacgagtattacctggatgagaatgataaagagtccgaactgtag

SEQ ID NO: 116431 - DNA, 5406 bp, Artificial Sequence
  Description of Artificial Sequence: Synthetic coding sequence
atgcgagaagagagcggaatgccccccccttgggacgccagcttgctggagaatgaattctttcaggtgcttgacgacttagacagcaaattggctcaggaacagtctgcgagcagcgtgaatacgaggacacccctcaattatggcagcaggactcaattcggacacttctattcctccggcaataggcatggcaatatcaccgaacggcataagaaacactataatgagacgtcaaatatgagcatttacgacattcttcggcccggtacgccacgggagggttttaagaccttttcgcctcgaacatctacgatttatgatatgtaccgcaccagagagccccgagtgttcaaggaggactacgtgcagaagaacacctttggatctactagcttatgcttcgatagtaggcagcgcagcgccctccccgccacagggcacttcacagccagatccctccacttccccgcaactacacagagcaaaagcggctttatccctccacggcaccagcagtcccctaagagaacacctctgagctcgatcatttggaataggtcggactccagccgcgatcgcgagaaccaggaagaatttctccgggcgccatctccaatggagatagacccggccgataagtatgtgtatcccagggggtttcaggagaataaacggtacgagtcataccactcccagaacgtctaccagcgcgtgagcttgaacgcacctatggagaacgcgatgtcaccagacacattcgagaattctgagaacatgcctttttaccaccagtcaaataccttcacacggagcttcttctccaacacgttcggtcggagtggggagcagcgccggtttggccagggcccattctgggggcaagagaagggccactcattctggtccgacttccatcgctcgaggaagagcttctccagttctgaccgcgacttcgagatgatctcaatggaggcgaatagcgtgtccgctattcatgggcacaacgtgagctcggagcactgggagagcttttctagcggctacggcacggacgtgtcacgcggtcaggaagaacctcacccttggcagttcgattttcagcgctctactctggactcaatggtggtaagtcacggaaacgagacccagctcaccccccattttgggacgccaaatgtatgtagcatgaccggatcaagctaccacgtcaaatcatccgagctggttagtcagcaggactcatccccggtagaggtgcacatcaacaaagaggcaagctcttttggcatcgcacagacgctggcctcatcattcaaaacctccttttcacagatctccgacgacagaagaaacccacagtctcccaacctccagaatccaactgtcacactgcagaaaatctttccaaacaaacccgcttcccaccctatgaggtcccacactgaagtaacggttacatcatcgaatagtgtagattctctgcctctggccaaatctcaacctaatattttggtaactgaagtgaataatgaaaaagacctgaacgagtcgattagcgaggaagacaagcagctttctaaaatggatcagaccaataaggccggcgagattccccagcccgtgtctcagactgggatctccaatagtctgcctgactttcaaaaccctctgtctcaggacagtgcaaagtctaacgggttcgggtttaacgccagcacaatcatatcaagtaaaaagtctccacgggtgttcagtcgcaaggatacctccaagatgtacatacctcacacggacaagagcaatgatataaagcaggataagcggtttacagagaatcggaagctggggagtaccgcgtccctaccctttattcaagagcataggaccccacccagctttcctcgcactgaccaaggatgtcatcaagagctgacggtcaacaacgaggacatctctcgtatcattaccaataatcattggagtagtgctcttacggatacacagaacgcccagtacagtaagtgcaaacttacccctggccacaagacatcctgcgattccctggatctgagcagtgctgcattaccggatagcagcccttccaaaaattcctctctggacgctcctgtagtgccttccaccacagtgttctcacgccggagccccagcgacaaggatccttctcttggagagagagaggagaaagacaacgccgggaagaaccagaagaatcagttcattgtgagccattccgaaaatcaagaacgaaacgattcccctgtgcccactcacgatgaggttgtcgacgtgaagtgccacagccactctccgtttcggaatgagaggggaaagggaaagatccgacaccatatttcatgcattgagaaactgtccaagaccgagagtatctccgtgccgacttcggatcatcgtagcctgattgaggcaaatcagagcaacagcaaggtgagtgagctggatacgatctattgcaccttgcctcgcaagtcttccagtttcctcatccatggacggcaatctggttcaaaaattatggcggcctctctgcgaaatggtccccctcctttccaaattaagaataatgtggaggacgccatgggcaactacatgttgaataaattttctcctagttctcctgagagcgccaatgaatgttcaaaggtactgtcagattcagcactcgaggcccccgaggccacggagaggatgacaaatgtgaaatccagtggctctacttcagtaaggaaaggtccactgccctttttaataaacagggcgatgtcttgcccctctggagaaccccatgcctcaactggcagggaagggagaaagaagcctctgacatctggaatggatgcctctgaactgaccccccgcgcatgggagcgcatcattagccccgtcgaatctgactcgagcgtacgggactgctctctgacaaagagacaacatcagaaggagaattttcaggaatacacagaaaaggaggggaagatggctgcaagtcgccgcagtgtcttcgccctcagtaatgaagaccccttgcccttttgttcagacttgagcggaaaagagagaggtaaaaccctccacaaagttaagacgacgagcaccttctccgtatctggcgatgaggacaatgttaagtgcctcgaggtggtatcgatctattatacactgccacggaaaccttccaaaaaattttgcaacctgctgcaacagtatactcaaaataccaatctgctcatcgaatcgcctcaagtggagaccgagactttccccaatgctctcgaaaaagataagcagaactactctaccagggagcagagcgggacccccagctgtgaaaacttaaaaatgagtgtgaatagcgatcaaaccttgacaactgagaacatgactgcctttagactgtccaatagaggcccactagctccaactctgcaggagatggcttctgtcgaagctgccgtgtcattacctgaggaggaaagcaaagctcgggagatcttttccgacaatttggccaagacaccgctgggcgattctgagaacaaaaaggagcgcggcaaaaaactacagagtgagacactgcatacatcgttgatgttacagagaaagaatgtaagcgaggagaagtctgaaaattgccagcaaagcatcaacagctctaatagcggccctagctcactgcccgccctgagcgaggtaaatatcggcaattctcaaaccaggcgaagctcctgggagtgcacaggaagcggcagggctatcccattcactggaagcggaaaatgcccacaaaaggatcatactagtacagctgtgggagacggctctagcggctcccagcctagagagggacgtggagacattgggacgaactgccagaaaatgacaaacaagacattgagccactcagagtcacaagtcttcgctctcactcctgcgcttcacaaattacaattgggcgaggaaactcagtccgacgagcctaacttggagagtttgcagtcagaaccacgagaactcccacaacgctcacaggaagctaatatgacagaatcaagaaaggccgaagacgagatgcagaaatctgcgtgggaccagccctctttgcctgagggtaacaagaacaagacgaatcttgacgacctggtaaaaggggaaaatcgctcgagcgtgaagcatcgtctggcagcaatgtccaaggcttctcggaagttccctgccaaggacgtgtcaccccggagacatgttgccaccattttcccccaatccgggtctaggagtgggttcgatcatctatcgctcggcacagtcgagtgtaatcccttgtttcccgagccaacacccaagagtgcagaaagcatcggagagtcacgcctgtctgagaatggcaagcacgtgaagaaatctgaaaacctgctgcctatcacagtcctccctaaccgcgagccgtcgacccatgtgagtaaccaaaaaagcaactccatctcgcagcgtcaccagaacgagttcaaaaacgtcagcgagtccccatcaaagcacgaaaactcgaaggacgtgacagctgcccagaatctggtccgggaaagcggggcccctagtccgattacgttcactagcctccgggaagctgaattctctgataaccagcggagactgtcccctccattccccctggagcccgcccagaagtcacgcgtaagctcaccactcgcaagcttcttgcagcagcagaggtccgcgagttctctagaatgggaaccggagccgcacctctaccgctcaaaatccctcaaatcgataaacgtccacggtgatctgttgcgcaagagtcatcctcctaaagtcagagaaagacacttttctgagtcaactagcatcgataatgccctgtctagactgactcttggtaacgagttctcagtgaacaacggatacagtcggcgcttccgctccttctccgagctgccctcctgtgatggcaacgagtcctgggcctaccgctcgggcaccaaaaccggacccaggagtgcaatctccatatacagaccaatcgattacgggatctttggaaaggaacagcagctggcctttctcgaaaatgtcaaaagatcactgacccagggaaggctctggaagccttctttcttaaagaatccgggctttctgaaggacgatctgcgcaacccgcccaacccttctgaatccttatcaagcaatagcccatctagtcaggtgccggaagacgggctcagcccatctgagccattgaacatctacgaagatgacccagtggattcgaactgcgatactgacaccactacagacgacgaatactacctggatgagaacgacaaggaaagtgagttgtag

SEQ ID NO: 116432 - DNA, 5949 bp, Artificial Sequence
  Description of Artificial Sequence: Synthetic coding sequence
atgtcattgtcatttctcaatgatgaagaggcaaggaagattctgcaggtgttggagaggaatgaggagctgcagcgggcggagaaagacagaatcagtaagctccagaaaactaaaagggacatacgatggttgcagggggtgactggcgaatggttcgaagaaattcagcgcaagaaattttgtaacgaaacagatgtcagtcaaatgctcaaacagcctttgacctacagactgtcaaaagaaatggccaaaaatgaccctattgaactgcctacctccaggtccaaaaacgtaacaaaccagaagaagccaaccccgttctcttccagaatgagttttcgcagtagctttgccagcctgttttcttttcgaaaatccgggaaagagacgtccaagcttcccagccttgggcagaaggggtgtgatggacacgcaggcccaccaatgcctgttaggggcgcggccgtacaggcgaaaatctacaacagcccgctggagaatcacttagtggacagcaccttcgtgcctaaacccgccgtgatgagggaagaatctggcatgcctccgccatgggatgccagtctgcttgaaaatgagttcttccaagtccttgatgatctggattctaagctcgcccaggagcagtcggcttccagcgtcaacacacgaaccccgctgaactatggatcccggactcagttcgggcacttctatagcagcggaaaccggcacggcaacattaccgagaggcataagaagcactataacgaaacttccaatatgtctatctatgatatcctgcgacctggcacaccaagggagggctttaagaccttctctccgcgcacctccaccatctatgacatgtaccgcacaagagaaccccgcgtgtttaaagaggactacgtgcagaagaacacatttggctccacctccctctgcttcgactcaagacagaggtcagcgctgcctgcgacgggccactttactgccaggagtctgcattttcctgccactacccaatctaagagcgggtttattccgccgagacaccagcagtctcctaagcgcactcctctctcatccatcatctggaatcgatcagactcctcacgggaccgagagaatcaggaagaattcctgcgggcccccagccccatggaaattgaccctgctgacaagtacgtttatccgcgcggcttccaggagaataaacgctatgagtcctatcattcccagaatgtgtaccaacgggtatcccttaatgcacctatggagaacgccatgtcccccgacacatttgaaaattccgagaacatgcccttctaccaccagtccaacacctttaccagatcctttttctccaatacctttggacggtccggagaacagaggcggttcggccagggacccttttggggacaggaaaaaggccattcgttttggtctgattttcataggtccagaaaatccttttcctcctctgatcgcgatttcgagatgatcagcatggaggccaatagtgtctctgccattcacgggcacaacgtgagttccgagcattgggagagcttttccagcggatacggtaccgacgtgagccgaggacaagaggagccacacccctggcagttcgattttcagcgctccaccctagacagtatggtggtctcccatgggaacgaaacccagctcactccgcattttggaactccaaatgtgtgcagcatgacgggcagcagttaccatgtgaaatcttccgaattagtaagtcaacaggatagctcccccgtggaggtgcacatcaacaaagaggccagcagtttcggaatcgcccagaccctagcatccagctttaagacaagtttctcacagatttccgatgacagaagaaatccccagagcccaaacctgcagaaccccaccgttacactgcagaagatcttccccaacaagccagcttcccaccctatgcgttctcatactgaggtgactgtcacttctagcaacagcgtggattcccttccactcgccaagtcccagccaaatattctcgtaaccgaggtgaataacgaaaaggatctcaacgagtcaatatcagaggaagacaagcagttatcaaagatggaccaaacgaacaaagcaggcgagatcccccagccggtaagccagacaggcatatccaacagcctgcccgatttccaaaaccctctgtcccaggattctgctaagtcaaatggctttggattcaacgcatctacaataatatcatctaagaagagtcctcgagtcttcagcagaaaggacacctccaaaatgtacatcccccataccgataagtccaatgacatcaagcaggataaacggttcaccgagaaccgcaagctcggatcaactgcaagcctgccctttatccaggagcaccggacacccccgtcttttccccgaacagaccagggctgtcatcaggaactcactgtcaacaacgaggacatatcaaggatcatcacgaataaccactggtcatctgccctgactgacactcagaacgctcagtacagtaagtgtaaacttactcctgggcacaaaacctcatgcgactcgctcgatctatctagcgctgccttgcccgactcatccccctcaaaaaactctagtctggatgctcctgttgtgccttcaacaaccgtcttctccaggagatcgccttcagataaggacccatctctgggagaaagggaagaaaaagacaacgccggaaagaaccagaaaaaccagtttattgtgtcccattcagaaaaccaggagcggaacgattccccagtgccaacacatgacgaggtagttgacgtgaaatgccatagccactcccctttccgaaacgagaggggaaaaggtaaaattagacaccacatttcctgcatcgagaagctgtctaagaccgaaagcatttctgtgcctactagcgatcacaggtctctgatcgaagccaatcagagtaactcaaaggtatctgagttagacaccatctactgtactctcccaaggaaatcctcctcttttctgattcacggtaggcagagtggaagtaagattatggccgcctctttgaggaatggtcctccgcctttccagatcaaaaacaatgtggaagacgccatgggcaactacatgcttaataagttcagccccagtagcccagaaagtgccaacgagtgtagcaaggtcctgtcggactcagcactagaagctccggaagctacagaacggatgactaatgtgaaaagctccggaagtaccagtgttcggaaggggccactcccttttttgataaacagagcaatgagctgccccagtggagagccccacgcaagcaccggacgcgaaggccggaagaagcccctcacttcaggcatggacgctagcgagctgacaccgagggcttgggagagaattatcagccccgtggagtccgacagttcagtgcgcgactgcagcctgacgaagcgccagcatcaaaaggaaaactttcaggaatacactgaaaaggagggcaagatggccgcgagtagaagatcagtttttgccctgtctaatgaagacccgctacccttctgcagcgaccttagcggcaaggagagggggaaaaccctgcacaaagtcaagacgacatccacattctctgtcagtggggatgaagacaatgtgaagtgtctggaggtggtttccatatattacacgctgccccggaagcccagcaagaaattttgcaacttattgcaacagtatacacaaaacaccaacctcctgatagagagccctcaggtggaaaccgagactttcccaaatgcattagaaaaggataaacagaactattctacacgggaacagtccggaacaccttcttgtgagaacctaaagatgagtgtgaacagtgaccagaccctcactacagaaaatatgaccgcttttcggctgagcaatagaggaccacttgcccccacgctgcaggaaatggcctctgtggaagctgccgtcagccttcccgaggaggagtctaaggctcgtgaaatatttagtgataacctcgctaaaacacctctgggagactccgagaacaagaaggagaggggaaagaagctgcagtctgaaacactgcacactagtctcatgcttcaacggaaaaacgtttccgaggaaaagagcgaaaactgccaacagtcaattaactcaagcaactcggggccgtcttctctgcccgcacttagtgaggttaacattgggaacagtcagactcggcgaagtagttgggaatgcacgggttccggtagagcaattccatttacaggcagcgggaagtgtccacagaaggatcacacctcgacagcagtaggagacggatcaagtgggtctcaacctcgggagggccgcggagatattgggactaattgccagaagatgactaataaaacattgtcacacagcgaaagccaggtgtttgccctgactcccgcactccacaagctgcagcttggagaagagacccagagcgacgaacctaatttagaatctctccagtcagagcctcgcgagttacctcaacggtcccaggaagcaaacatgaccgaatcgcgtaaagcagaggatgagatgcagaagagcgcctgggatcagccaagcttgcccgaaggcaataagaacaaaaccaatctggatgacctggtcaagggggaaaatcgcagtagcgtcaagcatcgcctagctgccatgtctaaagcttccagaaagttccctgctaaggatgtatccccgcgcaggcacgtcgcgaccatcttccctcagagcggatcccgcagtggattcgatcatctttctctgggcacggtcgagtgtaaccctttgttccccgagcccactcctaaaagtgctgaaagtattggcgaatcccgactgagtgagaacggcaagcatgtgaaaaaatccgaaaatctgctgcccatcactgtgctaccaaatcgagagccctccacgcacgtgagcaaccagaagtctaattctattagccagcgccaccaaaacgagttcaagaacgtatccgaaagcccctctaaacacgaaaatagcaaagacgtgactgccgcccaaaacctagtgagggagtctggggctcccagccccattacctttaccagcctgcgagaggcggaattctctgacaaccagcgtagactgtctcccccattcccactggagcccgcccaaaagagtagggtaagtagcccactggcgtcctttctacagcagcagaggtccgcaagttctctggaatgggagccagaaccgcatctgtaccggagcaaaagcttaaaatccatcaatgtacatggtgacttgctgagaaaaagtcacccccccaaagtgagagaaagacactttagcgaaagcacctcgattgacaacgcccttagccgactcacattgggtaacgagttctctgtcaacaacggctatagtcggcggtttcggtcgttttccgagcttccctcctgtgatggcaacgaatcttgggcctacaggagcggaaccaaaaccggcccccggagcgcaatttctatttataggccaatcgactacggaatctttgggaaggaacagcaactggccttcctggaaaacgtgaaaaggtccttaacccagggtcgtctgtggaagccgtcattcctcaagaatccgggctttttaaaagatgacctgcgtaaccccccaaacccctcagagtccttatcatctaattcccctagctctcaggtgcccgaagacgggctttccccttcggagccactgaatatttatgaggacgatccagtggatagtaactgcgatactgacacgactactgacgacgagtattacttggacgagaacgacaaagagagcgaattatag

SEQ ID NO: 116433 - DNA, 2583 bp, Artificial Sequence
  Description of Artificial Sequence: Synthetic coding sequence
atggcccctccttccacaagagaacctagagttctgtctgctactagcgctacaaaatccgacggtgagatggtgctgccgggttttcccgacgcggactccttcgtcaagttcgcgctgggctcagttgtagcggtgaccaaggcttcaggcggacttcctcagttcggcgatgaatacgatttctatcggtcattcccaggatttcaggccttttgtgaaacgcagggcgacagattgttgcagtgtatgagtagagttatgcagtaccacggttgtcgttctaatattaaagatcggtctaaagtcactgaattggaagacaagttcgatctcctggtggacgccaacgatgtgattctggagagggtgggaattctcttggacgaagccagcggcgtgaataagaatcagcaacccgtactccccgctggcttgcaggtgcctaaaactgtggtgagttcctggaaccgtaaggccgcagagtatggaaagaaggccaaaagcgagacttttcgactcctgcacgcaaagaacatcatccggccacagctgaaatttagagaaaagattgacaacagtaacaccccatttttgcctaaaatctttatcaagcctaacgcccagaagccactgccacaggccctgagcaaagaacgacgggagagaccccaggatcgcccagaagatctggacgttccaccagctctcgccgattttatccaccagcaaaggacacagcaggtcgagcaagatatgtttgcccatccatatcagtacgaattaaaccactttacacctgcggatgccgtgctccagaagccgcagcctcagctttaccggccaatagaagagaccccctgccacttcatatcctcactggatgagctggtggagctcaacgaaaagctgttaaactgtcaggagttcgctgtggacctggagcaccactcctaccgttcattcctcggattgacttgcctaatgcagatcagtactagaacagaagactttattattgacacccttgagcttaggagcgacatgtacatattgaacgagagcctgacagatccggcaatcgtgaaagtgttccacggcgcagattctgacatcgaatggctacagaaggactttggcctctatgtggtcaacatgttcgacacacatcaggcggcacggctcctcaacttgggacgccactccctggatcatctcctgaaactgtactgcaacgtcgattctaacaagcagtaccagctcgccgactggcgcatcagaccgctgccagaggagatgctgtcttatgcgcgagacgacactcattacttgctgtatatttatgacaagatgcgcctagaaatgtgggagcgcggtaacggacagccggtgcagttgcaggtggtgtggcagaggagtagagatatctgcctgaaaaagttcattaagccaattttcaccgacgagtcctacttagaattgtatcgaaagcagaaaaagcatttgaacacccagcagctgactgcgttccagttattgttcgcatggcgagataaaacagccaggagagaagatgagagctatggatacgtcctccccaaccatatgatgcttaagatagctgaagagctgcctaaagagccccagggaataatcgcctgctgtaatccagtgccaccccttgtacgccagcagatcaacgaaatgcatcttttgattcagcaagccagggaaatgccacttttaaagtctgaagtggccgccggggtgaaaaagagcggacccttaccgagcgccgagcgattggagaacgtgctgtttggtccacacgattgcagccacgcgccaccagacgggtaccccataatccccacatcaggctccgttccagtgcagaaacaggcaagcctcttccctgatgagaaagaggataatctgctgggtacgacctgccttatcgcgaccgccgtgattactcttttcaacgagccgagcgctgaagatagcaagaagggcccactaacagtggctcagaagaaggcccagaatattatggaaagcttcgagaacccatttagaatgatttcaaacaggtggaagctggctcaggtccaggtgcaaaaggattccaaagaggcggtgaaaaagaaggcggcagagcaaacggccgcacgtgaacaggctaaggaggcttgtaaagctgctgccgagcaagccatcagcgtgcggcagcaggtggttttagagaatgccgccaaaaagagggaaagagccaccagtgaccccagaactacagagcagaagcaggaaaaaaaaagactcaaaatctcaaagaagccaaaggaccctgagcccccagagaaagagttcaccccttacgactactctcaatctgacttcaaggcatttgccggcaattccaaaagtaaagtgtccagtcagttcgaccctaacaaacaaaccccctccggaaaaaaatgcattgctgctaaaaagatcaaacagtcggtgggaaacaaaagtatgtccttcccaactggcaagtccgataggggctttcgttacaactggcctcaacggtag

SEQ ID NO: 116434 - DNA, 2658 bp, Artificial Sequence
  Description of Artificial Sequence: Synthetic coding sequence
atggctcccccaagtactcgggagccacgcgtcctaagcgctactagcgctacaaagtccgatggggaaatggtgctccccgggttccccgatgctgattcgttcgtgaagttcgccctcggttccgttgtagctgtgaccaaagctagtggcggactgccccagtttggtgacgagtatgacttctaccggtccttccccgggtttcaggctttctgcgagacccagggtgaccgcctactgcagtgtatgtccagagtgatgcaataccatggctgccgttctaatatcaaggacaggtctaaagttacagaattagaggataagtttgacctattggtggatgcaaacgacgtgatcctcgagcgggtagggattctcctggatgaagcctctggtgtcaataagaatcaacagcctgtgctgccagcagggttgcaggtgcccaaaaccgtggtgtctagctggaacagaaaagcggcggaatacggaaagaaggcaaagtcagaaacatttcgcctgcttcatgcgaagaatatcattcgaccacagctcaaatttcgagaaaagatcgacaacagcaacacccccttcttgcccaaaatcttcatcaagccgaacgcacagaagcctctccctcaggccctgtctaaggagcgccgagaacgaccacaggacagacctgaagacctggatgttccgccggccctggccgacttcatacatcaacagcgaactcaacaagttgagcaagacatgtttgctcatccttaccaatacgaactgaatcatttcacacccgcggatgcagtcctgcagaagcctcagccccagctctacagacccatagaagaaacaccatgccactttatttccagcctggacgaactcgtggagctgaatgaaaagctgttaaattgccaggaatttgcagtggatctagagcatcattcataccggtctttcctagggctcacctgtctcatgcagattagtacccgaaccgaagactttattatcgatactctggagctcagatccgatatgtacatactgaacgagagtctgaccgatcctgcaattgtcaaagtgttccatggggccgattcggatatcgagtggttgcaaaaggactttggcctgtacgttgtaaatatgttcgacactcaccaggccgccaggcttctgaacctgggacggcactcacttgaccatttgctgaaactgtactgtaatgtggacagtaataaacaatatcaactggctgattggagaattcgaccccttccggaggagatgctgtcctatgcaagggacgacacccattatctcctctatatatatgataagatgcgtcttgaaatgtgggagcgcggtaacggccaaccagtgcagcttcaggtggtgtggcaaaggtcgcgcgacatttgtctgaaaaaattcattaaacccatcttcacagatgaaagttacttggagctttacagaaagcagaagaagcacctcaacacccaacagctcacagcttttcagctgcttttcgcctggagagacaagacggctaggcgggaggatgagtcatatggctatgtcttacccaatcacatgatgctgaagatagccgaagagctacccaaagagcctcaagggataattgcctgctgtaacccagtcccacccctcgttcgtcaacaaataaacgagatgcatctcctgattcagcaggcacgtgaaatgccgctcctcaaatcagaagtggccgccggtgtgaaaaaatctgggcccctgccgagtgcagaacgactggagaacgtactctttggacctcacgattgctcacacgcccctcctgacggctaccctattatccccacctcagggagtgtgcctgttcagaagcaggctagcctctttcccgatgagaaggaggataatttactggggacaacatgcctgatcgcgacagcagtcatcaccttgttcaacgagcccagcgcagaggattcaaaaaaaggcccccttacagtcgcacagaaaaaggcgcagaatataatggagtcctttgagaaccccttccgcatgtttttaccctccctcggccacagggctcctgtctcccaagcagcgaagtttgacccatccaccaagatctacgaaatctccaatcgatggaaactcgcgcaggtgcaagtccagaaagacagcaaagaagccgtgaaaaaaaaagctgccgagcagaccgccgcaagagagcaggctaaggaggcttgcaaagctgcggccgagcaagctatttccgtaaggcagcaggtcgtcttagaaaatgccgccaagaagcgcgagagagccacttctgatcccaggacgactgaacagaagcaagagaagaagaggctgaaaatatcgaagaagcctaaagaccccgagcctcccgaaaaggaatttacgccgtatgactattcgcaatccgattttaaggcttttgccggcaatagcaagagcaaagtttcatcacagttcgaccctaataaacagacacccagcgggaaaaaatgcattgcggctaaaaaaatcaaacagagcgtggggaacaagtctatgtcattccctactgggaagtctgacaggggattcagatacaactggcctcaacgctag

SEQ ID NO: 116435 - DNA, 2040 bp, Artificial Sequence
  Description of Artificial Sequence: Synthetic coding sequence
atggcgcccccaagtacccgggaaccccgcgtactcagtgccacaagcgctaccaagtccgacggagaaatggttctgcctggattccccgacgctgacagttttgtcaagttcgccctgggttccgtagtcgccgtgacaaaagcaagcggaggcctaccacaatttggagatgagtatgatttttatcggtccttcccgggcttccaggccttctgtgaaacccagggagaccgtctgttgcagtgcatgtctagagtcatgcaataccacggttgcagatcaaacataaaggaccgtagtaaagtaacagagttggaagacaaatttgacctactagttgatgcaaatgatgttatcctcgaacgggtaggtatcctgctggacgaggcatctggcgtgaataaaaatcagcagccagtgctgcctgcaggcctgcaggtgccaaagactgtggtttcttcttggaaccgcaaagccgccgaatatggaaaaaaggccaaatcggagacttttcggttactacacgctaagaatatcatccggccgcagctgaagttcagagagaagatcgacaactccaacacccctttcttgcccaagattttcattaaacctaatgcacaaaagcccctgccccaagcgttatcgaaagagagacgggagaggccacaggatcggcctgaggacttggatgtcccacccgccctggctgatttcatccatcagcagcggacgcagcaggtggagcaagacatgttcgcgcacccttaccagtacgagcttaaccactttaccccagctgacgccgtattgcagaagcctcagcctcagctctaccgccctatcgaagagaccccctgtcacttcattagttcgttagacgagctcgtggagctgaacgagaagctcttgaattgccaggaattcgccgtggatttggagcatcactcatatcgcagctttctggggttgacctgtctaatgcagatctcaactcggaccgaagacttcattattgacactctcgagctgcgcagcgatatgtatattttaaatgaatccttgacagaccctgcaatcgtgaaggtgttccacggggccgattccgatatcgagtggcttcagaaggatttcggtctatatgtggtcaacatgttcgacacccaccaagctgcgcgcctactgaatcttggcagacatagccttgaccatcttcttaagctatactgcaatgtggattcgaataagcaatatcagttggccgattggcgcattcgaccactccccgaggaaatgctgtcatacgctcgggacgatactcactacctgctttacatctacgacaaaatgcgcttggagatgtgggaaagaggcaacggacagcctgtgcagctccaagtggtgtggcaacgctccagagacatttgccttaaaaaatttattaaaccaatttttacagacgagagctatctggagctttaccggaagcaaaaaaagcaccttaatacccagcagctgacagctttccaactactattcgcatggcgagacaaaaccgcccgcagggaagacgaaagttacgggtacgtcctcccaaaccacatgatgctgaaaatagctgaggagctgcctaaggaacctcaggggattatcgcctgctgtaaccccgtgccacccctggttcgacagcaaataaatgagatgcatctgttgatacaacaagcaagagagatgccactcctaaaatccgaagtagcagcaggtgtgaagaaatcaggccctttgcctagcgcggaagtggagtgcagaatatgcttcctgcctcaggagggaaagagacaggttaccgccagtgcatctacccctctgacggaagcctgtgctgattcttggcagaaggccacagccggcctgcacgtgctgcatgcatccctcttggtttccttcaacgccgagatcggtgagtgctccctgtggacctcaagactgctcccttgcccaagtgggtggctctcaaaccacccgaatcagtggtag

SEQ ID NO: 116436 - DNA, 747 bp, Artificial Sequence
  Description of Artificial Sequence: Synthetic coding sequence
atggctgctggctttaaaaccgtggagccactcgaatattacaggaggttcttgaaagagaactgccgtcccgatggtcgagagcttggggagtttagaaccaccacggtgaacattggctccatttccacagcagatggctccgccctggtgaagttggggaatacaactgttatatgtggggtgaaagcattcaggtcagggcctcccggcgaagaggcacaggtggcttctcaattcattgctgatgttatagaaaatagccaaattatacaaaaggaagatctctgtatcagtcctggcaaattggtgtgggtgctctattgcgacttaatctgccttgattacgacggcaatatcctagacgcctgtaccttcgccctgctggctgctttgaagaacgtacagctacctgaggtgacaatcaatgaagagacagctctggccgaggtgaatctcaagaagaaatcttacctaaatatccggactcacccagtggcgacatcattcgcagtgttcgatgacacactgttgatcgtggaccctactggtgaggaggaacacctggccaccggcacactgacaatcgtgatggatgaggagggtaaattatgctgcctgcacaaacctggtggatctggccttaccggcgccaagctgcaggattgtatgtcgcgagcagttacgagacataaagaagtgaaaaagcttatggatgaagtgataaagtccatgaaacctaagtag

SEQ ID NO: 116437 - DNA, 831 bp, Artificial Sequence
  Description of Artificial Sequence: Synthetic coding sequence
atggcagccggctttaagacggtagagcccttagagtattaccgccgtttcttgaaggagaactgtagacccgacggtcgcgaacttggggagtttcgaaccaccaccgttaacattgggagcatctctaccgccgacggctccgccctagtgaagctcggtaataccaccgttatatgcggcgttaaagctgagtttgctgcaccctccactgacgcgccagacaagggatatgtggtccccaatgtggatctccctccactctgttcctcccggtttaggtccggaccacctggggaagaggcgcaggtggcaagtcagttcatagcagatgtcatcgaaaactcccagatcatccagaaagaggacctgtgtattagcccaggtaaactggtgtgggtgctctattgcgacctgatctgcttagattatgatgggaatatcctggacgcatgcacatttgcattattagccgccctgaagaacgtgcaattacctgaagtgacaataaatgaggaaacggccctggccgaagtcaaccttaagaaaaagagctacctgaatatccggacccatcccgtggcgaccagctttgccgtttttgacgacacgttactgatagttgaccccaccggagaggaagagcatttggccactgggacattgaccatcgtaatggacgaggaaggcaaattgtgctgcctgcacaagccgggcggttctggcttgactggggctaagctgcaggattgcatgtcacgggcagtgacaagacacaaagaggttaagaagctgatggacgaggtaatcaaaagcatgaaacctaagtag

SEQ ID NO: 116438 - DNA, 1320 bp, Artificial Sequence
  Description of Artificial Sequence: Synthetic coding sequence
atgaaggagacgccacttagcaattgcgagaggcgctttctgcttcgagccatcgaggagaagaaacgacttgatgggcgccaaacctacgactaccgaaatatacgaatcagtttcggcaccgactatgggtgctgtatcgtggagctaggcaagacaagggttctcggtcaggtctcctgtgagctggtgagtccaaagctgaacagagccacggaaggcatcctattcttcaacctggagctgtcccagatggccgcccccgccttcgagcccggccggcaatctgatctgctagtcaaactgaataggctcatggaacgctgtctaagaaactcaaagtgcatcgacaccgagtccctgtgcgttgtcgcaggggagaaggtctggcaaatcagagtggatctccacctgcttaatcacgacggaaacatcatcgatgcggcatctattgccgccatcgttgctctttgccacttccggcgcccagatgtgagcgtgcagggcgatgaagttaccctctacacccccgaggaacgagatccagtgcctttatccattcatcacatgcctatttgtgtctcatttgctttcttccagcaggggacctatttgctggttgatcccaatgagagagaggagagggttatggacggccttctggtcatagccatgaataagcaccgcgagatttgtacaatacagtcctccggagggattatgctgcttaaagatcaggtgctgaggtgctctaagattgccggcgtcaaggtcgctgagataactgaactgatacttaaggcattggagaacgatcaaaaagtcagaaaagaaggaggcaaattcggcttcgcagaatcaatagcaaaccagagaatcaccgcattcaagatggaaaaggcgccaatcgataccagcgatgtcgaagagaaggcagaggagattatcgccgaagctgaacctccttctgaggtggtgtcaacacccgttctatggacgccaggaaccgctcagatcggcgaaggagtggagaattcctggggcgatttagaggattcagagaaggaagacgacgaaggcggcggggaccaggctatcattttggatggaatcaagatggataccggtgtggaagtcagcgatatcggctcccaagacgcacccatcatattatccgacagcgaggaagaggaaatgatcattctcgaacctgacaagaatcctaaaaagattcgcactcaaaccacatctgccaagcaggaaaaggcaccttctaaaaagcccgttaaaaggcgtaaaaagaaacgggctgcaaactag

SEQ ID NO: 116439 - DNA, 1371 bp, Artificial Sequence
  Description of Artificial Sequence: Synthetic coding sequence
atgaaagagacccccctgtcaaactgcgagagaaggttcttactgcgcgccatcgaagaaaaaaagaggctcgatggcagacagacctatgactatcggaacatacgaatctccttcgggacagactatgggtgctgcatcgtcgaacttggcaaaacgcgtgtgttgggacaggtgtcctgtgagttggtgagccccaaactaaaccgggcaaccgaaggtatactgttttttaatctggagctgtcacaaatggcagctcccgcctttgaacccggaaggcagtctgaccttctggtgaaactgaacagactgatggagaggtgcctcagaaattccaaatgcatagacaccgaaagtctgtgcgttgtcgccggagaaaaggtgtggcaaatacgagttgacctacacctgctgaatcatgatgggaacataattgatgcagcttccattgcagcaatcgttgccctctgccacttccgccgcccggatgtgtctgtccaaggagacgaggtcaccctctatactcccgaggagagggacccagttccactcagcatccaccacatgcccatttgtgtgtcctttgccttcttccagcaggggacctatcttctggtggacccaaatgagagagaagagagggtgatggacgggttactggttatcgctatgaacaaacatcgtgagatctgcacaatacaaagctctgggggtataatgctcttgaaggatcaagtcctcaggtgctctaagattgccggggtgaaggtcgcagagatcactgagctcatattaaaagctttggaaaacgatcagaaggtgcgcaaggaggggggcaagttcggtttcgcggagtctatcgctaaccaacgaataacagcctttaaaatggaaaaggctcccatcgatacgagcgatgtggaggaaaaggctgaagagatcatcgctgaagccgagccgccatccgaagtcgtcagcacaccagtcctgtggacacctggcacagctcaaatcggtgaaggtgtggagaactcatggggggatctagaggactccgagaaagaagacgacgaaggcgggggagatcaggccatcatcctggatggcatcaagatggacacgggagttgaggtctccgatatagggtcacaagaactcggcttccaccacgtcggccagactggactggaattcctgacgtccgatgcaccgattatcctaagcgactctgaggaagaggaaatgatcatcctcgagcccgataagaaccctaagaaaataaggacacagaccaccagtgcaaaacaggaaaaagccccaagcaagaagcccgtaaaaaggcgcaagaagaagcgggcagccaattag

SEQ ID NO: 116440 - DNA, 2031 bp, Artificial Sequence
  Description of Artificial Sequence: Synthetic coding sequence
atgcagtcctggcgtagacggaagagcctttggctcgccctctctgcctcatggttgctgctggtacttttaggcggtttttccctcctgcggctcgctctgccacctaggcccagaccgggggcatcccaaggttggccccggtggctggatgccgaactcctgcagtcatttagccaacctggcgaactgccggaggacgccgtcagcccacctcaggccccccatggtggaagctgcaactgggaaagctgtttcgacacctcaaaatgtagaggcgacggacttaaggtgttcgtttatccagccgtggggaccatcagtgaaacacataggcggatcttggcctcgatcgaagggtcacggttctacacattctcacctgcaggggcctgccttctgctgctactgagcctagacgcccagaccggcgagtgtagttccatgcctctgcagtggaataggggccgcaatcatctggtgctccgcctgcacccagcgccttgtccacggacttttcagctaggacaggctatggtcgccgaggcctcgcctaccgtggacagcttccgaccggggtttgacgtggccctgccttttttaccagaggctcatcctttgcgtggcggagcccccggacagttaagacaacactccccccagccgggtgttgctctcctggctctagaagaggaacgcggcggctggcggacagccgataccggcagtagtgcttgcccatgggatggcaggtgcgaacaagaccctggcccggggcagacacagagacaagaaacactgccaaacgcgaccttttgtctgattagcgggcatcgccccgaggctgcctctagattcctccaggcactgcaggcgggttgcattcctgtgcttctgtcacctagatgggaattgccatttagtgaagtaatcgactggaccaaagcagccatcgttgccgatgagcgtctgccacttcaggtgctggccgcactgcaagagatgtctccggcacgggtgctggcgttgcgacagcagacccaatttctttgggacgcatatttttcttctgtcgagaaggtgatccacaccactctggaagtaatacaggaccgtatattcggcacaagcgctcaccctagcctcctctggaacagtccaccaggggccctgctcgccctatcaacctttagcacttctccacaggacttcccattctactatctgcagcagggctcacggcccgagggaagattctctgcgctgatctgggtgggaccccctggtcagcctcctctcaaacttatccaggctgtggctggctcccagcactgtgctcagatcctcgttctgtggtcaaatgaaaggcctctcccatcacgctggcccgaaaccgctgtcccactcaccgtcatcgatggacacagaaaggtgtctgaccggttctacccttactcgacaattagaaccgacgctattctttctctggacgccagatcaagcctgagcacctcagaggtggatttcgcttttctcgtttggcagtcttttcctgaaaggatggtgggctttctcacttcgtctcacttttgggacgaggcccatggaggatggggctacactgctgagcggacaaatgagttctccatggtccttaccaccgccgccttctatcaccggtattaccatactctgttcacccattctctgcccaaggcactaaggactttggccgatgaagcccccacctgtgtagacgtgctcatgaactttattgtggccgccgtaaccaaattgccaccgatcaaggtcccatacgggaagcagcggcaagaagctgctcccttggctccaggagggccaggaccacgccccaagccccccgccccggctccggattgtattaatcagatcgcggcagcatttggtcacatgcctcttctcagctcacgactgcggctcgatccggtgttatttaaggaccccgtgagcgttcaacgcaaaaagtaccggagtttagaaaagccttag

SEQ ID NO: 116441 - DNA, 993 bp, Artificial Sequence
  Description of Artificial Sequence: Synthetic coding sequence
atgaggtgctgccacatatgcaaacttccgggccgggtgatgggaatccgcgttcttcggctcagcctggtcgtcattctggtcttgctgcttgtagcgggcgccttgaccgccctcctcccaagtgtgaaggaagataagatgctgatgctcaggagggaaatcaagagtcaaggcaagagcaccatggattccttcactctcataatgcagacatacaataggaccgacctgctgctgaagttgctgaaccactaccaggccgtccccaacttacacaaagttatcgtggtctggaataacatcggtgaaaaggcccctgatgagctctggaacagcctcggcccgcacccaatcccagtaatcttcaagcagcaaacagcaaacagaatgcgaaatagacttcaggtgttcccggagctcgagaccaacgccgtgttgatggtggacgatgatactcttattagtaccccagacttggtctttgcgttctctgtctggcagcagttcccagatcagatcgtcggatttgtgcctaggaagcacgtgagcacctctagcggaatctatagctatgggtcattcgaaatgcaggcccccggatctggaaacggcgaccagtacagcatggtcctgatcggagcgagcttcttcaatagtaaatacctggagctctttcagcgacagccagccgcagtccatgccttgatcgatgacacccagaattgcgatgatattgcaatgaacttcataattgctaagcacattggaaagacctctggcattttcgtgaagcctgtgaacatggataacctcgaaaaggagaccaattccggctacagtggaatgtggcacagagctgagcacgcactgcagaggtcttactgcatcaacaagttggttaatatttacgactcgatgcctctcagatactctaatattatgatctctcagttcggttttccttatgcgaactataagagaaaaatctag

SEQ ID NO: 116442 - DNA, 993 bp, Artificial Sequence
  Description of Artificial Sequence: Synthetic coding sequence
atgagatgctgtcacatttgtaagctgcccggacgggtgatgggaattcgagtgctcaggctttctttggttgtcattttggttctgctgctggtggctggagcccttacggcccttcttccttcagtgaaagaggataaaatgctgatgcttagaagggaaatcaagtctcagggtaagtccaccatggattcattcacgctcatcatgcaaacctacaaccggaccgacctgctgttgaagctgctcaatcattatcaagcagtgccgaatctccataaggtcatcgtggtttggaataatattggtgagaaagcacccgatgaactctggaactccttgggcccccaccctatcccggttattttcaagcagcaaaccgccaaccggatgcggaatcgactgcaggtgttccccgagttggagacgaatgccgtgctgatggtggatgacgataccctaatatccactccagatctggtgttcgccttctccgtatggcagcagtttcccgaccagatagtgggattcgtgccacggaagcacgtgtccacctcatcaggaatttactcctacggatccttcgaaatgcaggcccccggttctgggaatggcgaccaatatagcatggtcttaatcggggctagtttctttaactcaaaatacttggaattgttccaacggcagcccgcagccgtgcacgctctgatcgacgatacccagaattgtgacgatattgcgatgaatttcattatcgccaaacacattggcaagacatcaggtatctttgtgaagccagtgaatatggacaatttagaaaaagagactaatagcggctattctggtatgtggcaccgagccgaacacgccctccaacgaagttactgcataaacaagctggtaaatatctacgattcaatgcctctcaggtactccaacatcatgatctcacagttcggttttccttacgcaaactacaagagaaagatctag

SEQ ID NO: 116443 - DNA, 354 bp, Artificial Sequence
  Description of Artificial Sequence: Synthetic coding sequence
atggggatccgggtgcttagactgagtctggtggtgatattggtactgctgcttgtggcaggagccctgaccgccttattaccgtccgtgaaagaagacaagatgctcatgctccgccgagagatcaaatcccagggcaaaagtaccatggattctttcaccctcattatgcagacctataaccggaccgatctgctgctcaaattattaaaccactatcaggcagttcccaacctgcacaaagtgattgtggtatggaacaatataggggagaaggcacctgacgaattgtggaacagtcttgggccccaccccattccagtaatttttaagcaacagaccgccaaccggtag

SEQ ID NO: 116444 - DNA, 801 bp, Artificial Sequence
  Description of Artificial Sequence: Synthetic coding sequence
atgcggacatggaattccggtggaactaagtgctgccacatttgcaagctgcctggaagggtgatgggtattcgcgtgctccgcctgtctctggtggtgattttagtgctcttactcgttgccggtgctctgaccgccttactcccgtcagtgaaagaggacaaaatgctgatgttgaggagagagatcaagtctcagggcaagtcaacgatggattccttcacactcatcatgcagacatataaccgtacagacttactgctgaagctgctgaatcattaccaggctgtgcctaatctgcataaggtcatcgtggtgtggaataatattggagagaaggctccagacgaactatggaactcactcggtccccatccaatccccgtgatctttaaacaacaaacggccaacaggatgagaaacaggctgcaagtgtttccggaattagaaacgaatgccgtcctaatggtggatgacgatactctcattagcacccccgatctggtttttgccttcagcgtgtggcaacagttccccgaccagatcgtcggctttgtgcctcgcaagcacgtctctacatcttctggcatatacagctacggttcatttgagatgcaggctcctggtagcggaaatggggaccaatatagcatggtgctgatcggggcttcattctttaacagcaaatacctcgaattgttccagcgacagcccgccgctgtccatgccctgatcgacgatactcagaattgcgacgatatagctatgaatttcatcatcgccaaacacatcgggaaatag

SEQ ID NO: 116445 - DNA, 954 bp, Artificial Sequence
  Description of Artificial Sequence: Synthetic coding sequence
atgggaatacgtgtcctgcggttgtcactcgtagtgattctcgttttgctccttgtagccggcgctctgacagcactgctaccttctgtcaaggaagataagatgctcatgctgcgccgcgagattaaatcacaaggcaaaagcaccatggacagctttacgctgataatgcagacatataaccgtaccgatctgttgttaaagcttcttaatcattaccaggctgtgcccaacctgcataaggtgattgttgtgtggaataatatcggtgagaaggcgccagacgaactctggaactccctcggacctcatcccattcctgtcatctttaaacagcagacagccaaccggatgaggaaccgtcttcaagtttttcctgaactggaaacaaacgctgtgttgatggtcgacgacgacacactgatctctactccagacctagttttcgctttcagcgtttggcaacagtttcctgaccagatagtgggctttgtgccacgtaagcacgtgtccacatcttccggcatctattcgtatggtagcttcgagatgcaggcgcctggctctggaaacggagatcaatactccatggtgttaatcggagcttcatttttcaattccaaatacttggaactgttccagaggcagcccgctgccgtgcatgcccttatcgatgatacccagaactgtgatgatatcgcgatgaacttcataattgctaaacacatcggcaaaacctcaggcatcttcgtgaaaccagttaatatggataatcttgagaaggagactaatagtggctattcaggtatgtggcatagagctgagcacgctttacagcgaagttactgcatcaacaaattggtgaatatttacgattctatgcctcttcggtactcaaacattatgatctctcagttcggctttccatatgcaaactataaaaggaagatttag

SEQ ID NO: 116446 - DNA, 519 bp, Artificial Sequence
  Description of Artificial Sequence: Synthetic coding sequence
atgagcgtgcccggtccttcaagcccggatggagccctcacccgtccaccatattgcctcgaggccggcgaacccaccccagggctgagtgacaccagcccagatgaggggctgattgaagacctgacgatcgaggacaaggcagtagagcagctcgccgaggggctcctctctcattatctaccagatctgcagcgcagcaagcaggccctgcaggagcttacgcagaaccaggtggtgctgctagataccttggagcaggagatcagcaagttcaaagagtgccactcgatgctggatatcaatgccttgttcgcagaggctaaacattatcatgccaagcttgtcaatatccgcaaagagatgctcatgctccatgagaaaacatcaaaactaaaaaaacgggcattaaaactccaacagaagaggcagaaagaagagttggagcgcgaacagcagagggagaaagagttcgagagggaaaaacaactgactgctcgccccgccaagaggatgtag

SEQ ID NO: 116447 - DNA, 1608 bp, Artificial Sequence
  Description of Artificial Sequence: Synthetic coding sequence
atgctccacaagtccgaagaaggacgggttctcgttgaattcacatgtaagaatcagcctaaacctagcctgccaacagaatgggccctgtgtggcgaacgtgaggacagactggagttgctgaagctcagtacattcgccttgataataacacccggtgacccacgccttgtcatatccagcgggtgtgctacaaggctctttgaggccctcgaggtgggcgcagtgcctgtggttctgggggaacaggtgcagcttccttaccaggacatgcttcagtggaatgaggcggcacttgtcgtgcccaagcctagggtgactgaggtccacttcctcttaagaagcctgagcgattcagatctgctggccatgcggaggcagggcaggttcctctgggagacatatttttctaccgccgacagtatcttcaacacagtgttagctatgattcgaaccagaatccagatccctgcagccccaatccgagaagaagcagccgccgaaatcccacatagatctggtaaggccgcaggaacagatcctaacatggccgataacggggatctcgaccttggaccggtggagacggaacccccctatgctagccccaggtacctcaggaatttcactctcacagtgaccgacttttaccgttcatggaactgcgcccctggcccgttccacctcttccctcacactccttttgatccagtgctgccttctgaagcaaagtttttaggaagcgggacaggcttccgccctattggcggcggcgcagggggatctggtaaagagttccaggcagctctagggggtaacgtgccccgcgagcaatttactgtggtcatgctgacttacgagagagaagaagtccttatgaattcacttgagcgcctcaatggactcccatacctcaataaagttgtggtcgtgtggaacagcccgaagctcccaagtgaggacctgctctggccagacatcggtgttcccataatggtcgtgagaaccgagaagaactcccttaataaccgtttcctcccctggaacgagatcgaaactgaagccatactgtctattgacgacgacgcccacttgaggcatgacgagattatgttcggttttcgagtgtggcgagaagcaagggatcgcatcgtcggttttcctggcagataccatgcttgggacatcccccaccagagttggctttacaatagtaattacagctgcgagctgagcatggtgcttaccggagcagccttttttcacaaatactatgcctacctttactcatatgtaatgcctcaggctatccgcgatatggtcgatgaatatataaactgtgaagatatcgccatgaactttctggtgagccacatcaccagaaaacctcctatcaaagtaacatcacgctggacctttaggtgcccaggctgcccgcaggcattaagtcatgacgactcccatttccatgaaagacacaaatgcataaacttctttgtcaaggtgtatggttacatgcctctcctctatacccagttccgggtggacagcgtgcttttcaagaccagactgccgcacgacaagaccaagtgtttcaaattcatctag

SEQ ID NO: 116448 - DNA, 3216 bp, Artificial Sequence
  Description of Artificial Sequence: Synthetic coding sequence
atgcctgctatcatgaccatgctggcggaccacgctgctcgacagttgcttgatttttcgcagaaactggatataaacctcttggataatgttgtgaactgtctgtatcacggagagggggctcaacagaggatggcccaggaggtgttaactcatctgaaggaacaccccgacgcctggactcgcgtggacactattttagagttctcccagaacatgaatactaaatactatggtttgcagatcctcgagaatgtaatcaagacacgatggaaaatcctacctcgcaatcagtgtgagggcatcaagaaatacgtcgttggtctgatcataaaaacctcttccgacccaacgtgcgtggaaaaagagaaagtgtatatcggcaagctgaatatgattctggtccagattctaaaacaggagtggccgaaacattggcctacctttatcagtgatattgtcggcgcctctaggacatctgaatcactctgtcaaaacaacatggtcatccttaaactgctctccgaagaagtgtttgactttagttcgggacagatcacacaggtcaagagcaagcatttaaaggactcaatgtgcaacgaattcagccaaattttccagttatgccagttcgtgatggaaaattcacagaacgctccgttagttcacgccactctagaaactcttctgagatttctcaattggatccctctggggtatatattcgaaaccaaactgatttccacactgatttacaaatttctcaatgtacccatgtttcgcaatgtgtctctcaagtgcctaaccgaaatcgcaggcgtaagcgtgagtcagtacgaagaacagttcgtcacactgttcaccctgaccatgatgcagctgaagcaaatgctgccgctgaacactaatataagattagcttatagtaatgggaaagatgacgagcagaactttattcagaatctgtccttgtttctgtgtacatttctcaaggaacacgatcagctgatcgaaaaaaggctgaatcttcgcgagacactgatggaagccctgcattacatgctattggtttccgaagtggaggagactgagatttttaagatctgtttggaatactggaatcatcttgccgctgagttgtatcgcgaatccccattctcgacaagcgcatcgcctctactttcagggagccagcatttcgatgtacctcctcgccgtcagctgtacttacccatgttgtttaaagtgaggttactgatggttagccgcatggcaaagcctgaggaggttctggtcgttgagaacgatcagggagaagtggttagagagtttatgaaagacacagatagcataaatctatataagaacatgcgcgaaaccctggtctacctgacacacttggactacgtagataccgagagaattatgacggaaaagcttcataaccaggtgaatggcaccgaatggtcctggaagaacctcaacacgttatgttgggccatcggctcaatctcgggcgctatgcatgaagaagatgagaagaggtttttagtcacagtcattaaggacctgctgggcctgtgtgaacagaagcgaggcaaagacaacaaggctatcattgcctctaatataatgtatatagtcggccagtacccccgctttcttcgggcccactggaagttcctaaagaccgtggtcaacaagttgttcgaatttatgcacgaaacccacgacggagtccaagacatggcatgtgatacattcataaagatcgcccagaaatgccgccggcacttcgtccaggttcaggttggggaggtgatgcctttcatcgatgagatcttaaataatattaatactattatttgcgacctgcagccacagcaggtgcatacgttttacgaagccgtcggctatatgataggcgcccaaactgaccagacagttcaggagcacctcattgaaaagtacatgctgttgccaaaccaggtttgggactctatcatacagcaggcaactaagaatgtggacattctgaaggaccctgaaactgttaagcagctgggaagtatcctcaagacgaatgtacgagcgtgtaaagcggtggggcatcctttcgtgatccaactaggtcgaatttacctagatatgctgaacgtgtacaagtgtctgagtgaaaacatttctgcagccattcaagcaaatggagaaatggtgacgaagcagccgctcatcagatctatgagaacggtcaagcgagaaactctgaagctgatttccggctgggtttcacgctctaatgatccacagatggtcgccgagaactttgtgccgccactcctggacgctgtgttaatcgattaccaacggaacgttcccgccgcccgtgaacctgaagtcctgagcacgatggctatcatcgttaataaactgggaggccacatcactgcggagatcccacagattttcgacgccgtgttcgaatgtacgttaaacatgataaacaaagatttcgaagagtatcccgagcatcggaccaatttcttcctcctcctgcaggcagtgaattcgcattgcttcccagcattcttggcgatcccaccaacacaatttaagctggttctagatagcataatttgggccttcaagcacacaatgcgaaacgtagccgacactggactgcagatcctgtttacactactgcagaacgtggcacaggaggaggccgctgcccagagcttctatcagacttacttctgcgacatcctgcaacacatatttagtgtcgtaacagacacttctcacacagcaggactgaccatgcacgcaagcatccttgcctatatgttcaatctggtagaagagggcaagattagcacatcgctcaacccagggaatcccgtgaataaccagatctttttgcaggaatacgtggcaaacttgcttaagtctgctttcccgcacctgcaagacgcccaagtgaaactctttgtcaccgggctgttctctctgaaccaggacattcctgcttttaaggagcatctgcgtgacttccttgtacagatcaaggagtttgcaggggaggacactagcgatctgtttctagaggagcgggagatagccctgcggcaggcagatgaggagaaacataaacggcagatgtccgtgcccggaatttttaaccctcacgaaattccagaggaaatgtgtgattag

SEQ ID NO: 116449 - DNA, 3216 bp, Artificial Sequence
  Description of Artificial Sequence: Synthetic coding sequence
atgcccgccataatgactatgcttgctgaccatgctgcgcgccagctgctcgatttcagtcagaagttggatattaatctccttgacaatgtggtcaactgcctgtatcatggagagggcgcccagcagcggatggcccaagaggtccttacacacctgaaagagcacccggatgcatggactcgtgtcgacacaatcctcgaattcagtcagaatatgaacacaaagtactatggacttcaaatactggagaatgttatcaaaaccaggtggaaaattcttccccggaatcagtgcgagggaatcaaaaaatatgtcgtcggattgattatcaagacctcttcggaccccacctgcgtggaaaaagagaaagtatacatcggcaaactgaatatgatcctggtccagatcctgaagcaggagtggcctaaacattggcctacttttattagcgacatcgtcggggcgtctagaacaagtgagagtctgtgccaaaacaatatggttatactcaaactcctgtctgaggaagtttttgattttagttctgggcagatcacgcaggtgaagagcaagcatttgaaggacagcatgtgtaacgaatttagtcagatttttcaactgtgccagttcgtaatggagaactcccaaaatgctcccctcgtacacgccacccttgagacgcttctgcggttcctaaattggatcccccttgggtatattttcgaaactaagctgatatctacactaatttacaagttcctcaacgttccgatgttccgaaatgtgtccctgaagtgcttaaccgaaatcgctggggttagtgtaagccagtacgaagagcagtttgtgacgctgttcaccctgacaatgatgcagctaaagcagatgctgccactgaacactaacatcaggttggcatattctaatggcaaagacgacgaacagaatttcattcagaacctatctctgttcctgtgcactttcctgaaagagcatgatcaactgattgaaaaaagactgaacctgcgggagaccctgatggaagcgttacactatatgctactcgtgagtgaagtcgaagagacagagattttcaaaatttgcttggaatactggaatcacctggctgccgagctctatagagaaagtccattcagcaccagcgccagccctctgttgtccgggtctcagcactttgacgtgcctccgcgcagacagctttacctgcctatgctctttaaggtccggctgttaatggtaagccggatggcaaagccagaggaggttctggttgtggaaaacgaccagggcgaggttgtccgcgagttcatgaaagacactgacagtattaacctgtataaaaatatgagagagaccctggtatatctgacccacctcgattacgtcgataccgagaggatcatgacggagaagctgcacaaccaggtcaatggaacagaatggtcttggaagaacctaaatactctatgttgggccattggcagcatcagtggggccatgcacgaagaggacgagaaaagatttctagtgacagtgattaaggacctgctgggattgtgcgaacagaaacggggcaaggataacaaggccatcatcgcatctaacatcatgtatatagtgggccagtatcccagatttctgagggctcattggaagttcttgaaaacagtggtcaataagctgtttgaatttatgcacgaaacacacgatggtgtgcaggacatggcctgtgacacattcattaaaatagcccagaagtgtagaagacacttcgtacaggtccaggtgggcgaagttatgcctttcatcgacgaaattctcaacaatatcaacaccataatttgcgatctgcaaccgcagcaagtccacaccttctacgaagccgttgggtatatgatcggagcccagacagatcagactgtgcaggaacatttaattgagaaatacatgcttctgccaaatcaggtgtgggattcaataatccagcaggcaactaagaatgtagacatcctgaaggatcctgagactgtgaaacaactcggatcaatcctcaaaaccaacgtcagagcgtgcaaagccgtcggtcacccttttgtgatacagcttggcagaatttatctggacatgcttaacgtgtacaagtgtctgagtgagaacattagcgctgccatccaggctaatggagagatggtaaccaaacaaccgctgattaggagcatgcggaccgtcaagagagagaccttaaagttgataagcggttgggtgtcacggagcaatgatccacagatggtggccgagaatttcgtcccgcctctgttagatgcggtgctgatcgactatcagaggaacgttccagctgcccgcgagcccgaggtcctgtccacgatggctatcatagtcaacaaacttggcgggcacatcaccgctgagattccacagatttttgatgcagtcttcgaatgcaccctgaatatgattaacaaggactttgaggagtaccctgagcaccggacaaacttctttctgctgttgcaagctgtgaacagccactgctttccggcattcctggctattccgccgactcagtttaagctggtgcttgattcaattatttgggccttcaagcacaccatgcggaacgtcgctgatacaggactgcaaatcctgttcacactgcttcagaatgtggcacaagaggaggccgccgctcagtctttctatcaaacctacttctgtgatatcctgcagcatattttctccgtggtgaccgatacctctcacaccgcaggactgacaatgcacgcatcaatcctggcctacatgtttaacttagtggaagagggaaagatctctacaagccttaaccccggaaaccctgtaaataatcagatcttcctgcaggagtatgttgcaaacctacttaaaagtgctttcccacacctccaggacgcccaagtgaagttgtttgtgacaggtcttttctccctcaaccaggatattcccgccttcaaagagcaccttcgcgattttctcgttcagattaaagagttcgcgggagaggacacatcagacttgttcctggaggaaagagagatcgcactacggcaggccgatgaagaaaagcacaagagacagatgtctgtacctggcatattcaaccctcatgaaatcccagaagagatgtgtgactag

SEQ ID NO: 116450 - DNA, 3216 bp, Artificial Sequence
  Description of Artificial Sequence: Synthetic coding sequence
atgcctgcgattatgacaatgctcgccgatcacgcagcccgccaactgttggatttctctcagaaactggacatcaacttgttagacaacgtcgtgaactgcctgtaccacggtgagggggcacagcagcggatggcccaggaggttctaacgcacttgaaagagcatccggacgcctggaccagggtcgacaccatcctggaattttcacagaatatgaacaccaagtattacgggctccaaattctggagaatgtgattaaaactcgctggaaaattttacccaggaaccagtgtgaaggaatcaaaaagtatgtcgttggcctcattatcaaaaccagctccgatcccacttgtgtcgagaaagaaaaagtgtatataggcaaacttaacatgatcttggtccaaatcttaaaacaggagtggcctaagcactggccaacctttatcagtgacatcgttggcgcctcccgtactagtgagtccttatgccagaataacatggtgatcctgaaattgctgagcgaagaagtattcgattttagttcaggccagattactcaggttaagtccaagcatctaaaggactcgatgtgcaatgagtttagccaaattttccagctttgtcagttcgttatggagaacagccagaatgcgcccctcgtccatgctactcttgaaactctgctgaggttcctgaactggatcccccttggttacattttcgagacaaagctgataagtacactgatatacaagtttctgaatgttcccatgttcaggaatgtttcactaaagtgtctgacggaaattgccggcgtttcagtgtctcaatacgaggagcagtttgttacattgtttactttgactatgatgcaactgaagcagatgctgccactaaatacaaatatccggctggcttacagcaacggtaaagacgatgaacaaaactttattcagaatctgagcctatttttatgtactttcctcaaggagcacgaccaactgatcgagaagcgcctaaacctgcgggaaactttgatggaagctctgcattatatgctgctcgtgagcgaggtcgaagaaacagagatctttaaaatttgcctggagtactggaatcacctcgcggcggagctgtacagagaaagtccattttcaacaagtgcgagccctcttctctctgggagccagcacttcgatgtgcctccaaggcgccagctgtacctccccatgctgtttaaggtacgactactgatggtctccagaatggccaaaccagaagaggtgctggtcgtggagaacgatcagggcgaggtcgtgagagagttcatgaaggataccgacagcatcaacttgtataagaatatgcgggaaacactcgtatatctgacacatttggactacgtggacactgaacgaatcatgactgaaaagcttcacaaccaggtgaatgggaccgaatggtcttggaagaatcttaatacactctgttgggcaattggatcgatatcgggagctatgcacgaggaggatgagaagcggtttctggtcacagttattaaagatctgttaggtctgtgtgagcagaaaaggggcaaggacaataaggccattatcgcctccaacataatgtatattgtgggacagtacccccgattcctgagagcccattggaagttcctgaagaccgtggtaaacaaattgttcgaattcatgcatgaaacacacgatggggtgcaggacatggcttgtgacacattcattaaaatcgcgcagaagtgcaggaggcacttcgtgcaggtgcaggtaggagaggtgatgccattcattgacgagattctgaataacataaacacaattatttgtgacttgcagcctcagcaggttcacacattttacgaggccgtcggttatatgatcggagcccagacagaccagacagtgcaggagcatctgattgaaaagtacatgctgctcccaaatcaggtatgggattctattattcagcaggctactaagaacgtcgatatcctgaaggaccctgagacggtcaagcagctgggaagtattttaaagaccaatgtccgtgcctgcaaagctgttgggcaccccttcgtgatacagttagggcgcatctatttggatatgctgaatgtttacaagtgcctttccgagaatatatcggccgcaatccaggccaatggggagatggttacaaaacagccgttaatcaggtctatgcggactgttaagagggaaactctgaagctgatatccggctgggtttctagatccaacgacccgcagatggtggccgagaattttgtacctccactgctggacgccgtcctcatagattaccagcggaacgtgcccgccgctcgggagcccgaagtactgtccaccatggccatcatcgtgaataagctaggagggcatatcaccgcagaaatccctcagatcttcgacgctgtgttcgagtgtaccctgaacatgatcaacaaagacttcgaagagtacccagagcacagaacgaattttttcctgctcctccaggccgtcaactcacactgcttcccagcgttcctggcaatcccccccacccaatttaaacttgttcttgattctattatctgggctttcaagcacacaatgaggaatgtggctgacacaggattacagatcctctttacgctgctgcagaacgttgcacaggaagaagctgccgcccagtcattctaccagacttacttctgcgatattctccaacatatatttagcgtggtgactgacacttctcacacagcagggcttaccatgcacgcatctattcttgcctatatgttcaatctcgtggaagaggggaaaatcagcacgagtctgaatccagggaatccagtaaataaccagatctttctgcaggaatacgtagccaatcttcttaaatccgcattcccccacctgcaggatgcccaagtcaagttattcgtgacaggcctttttagtttaaaccaggatatcccagcctttaaggagcacctacgcgatttccttgtacagattaaagagttcgcgggtgaggatacgagtgatctgttcctggaggagcgcgagatagcgcttcggcaggctgacgaagagaaacacaaacggcaaatgagtgtgcctgggatcttcaatcctcacgagataccggaggagatgtgtgattag

SEQ ID NO: 116451 - DNA, 303 bp, Artificial Sequence
  Description of Artificial Sequence: Synthetic coding sequence
atgccagcgattatgaccatgttggccgatcacgcagcccgtcagctattagatttctcgcagaagctcgatattaacctgcttgataacgtcgtcaattgcctctatcacggcgaaggcgcccagcagcgcatggcccaagaagtactgacacatctgaaagaacaccctgatgcatggaccagagtcgacaccatcctggagtttagccagaacatgaacaccaagtactacggcctccagatcttggaaaacgtgataaagactcgatggaagatcctgcctcgtaaccagtgcgagtag

SEQ ID NO: 116452 - DNA, 288 bp, Artificial Sequence
  Description of Artificial Sequence: Synthetic coding sequence
atgcccgccatcatgactatgctggctgatcacgcggccagacagctactggatttttcgcagaagctggacataaacctgttagacaatgttgtaaactgcttgtatcatggggaaggggctcagcagcggatggcccaggaggttctcacccatttaaaagagcaccccgacgcatggacgcgcgtggacaccatcttggaattcagccagaatatgaatactaaatattatggattgcaaatactggagaatgtaattaagaccagatggaaaatcctgccatag

SEQ ID NO: 116453 - DNA, 180 bp, Artificial Sequence
  Description of Artificial Sequence: Synthetic coding sequence
atgcctgcaattatgacgatgctagctgatcacgccgcccgacagttgctagacttctctcagaaactggacattaatctcttagacaacgtcgttaattgtctctaccacggtgaaggcgcacagcaacggatggcgcaagaggtgctcacacatctaaaagagcaccctgatgcttag

SEQ ID NO: 116454 - DNA, 399 bp, Artificial Sequence
  Description of Artificial Sequence: Synthetic coding sequence
atgccagctatcatgactatgcttgctgatcacgctgcccggcaattgttagatttcagtcagaaactcgacattaacctcctagataacgtggtcaactgcctgtaccatggtgagggggctcagcagagaatggcccaggaggtcttaacacacttaaaggagcacccagatgcctggactcgagtggataccatcctggaattctcccagaacatgaacacgaagtactacggcctgcagatcctggagaacgtgatcaaaacccgctggaaaattcttcccaggaaccaatgcgagggtattaaaaaatatgtcgtgggactcatcataaagacatcatctgaccctacttgcgtggaaaaagaaaaagtctacatcggaaagcttaacatgtag

SEQ ID NO: 116455 - DNA, 189 bp, Artificial Sequence
  Description of Artificial Sequence: Synthetic coding sequence
atgcctgccataatgaccatgttggccgatcacgcagctcgccagctgttggacttctctcagaagctcgatatcaatctgttagataacgttgttaattgcctgtatcacggagaaggggctcaacaacgaatggctcaggaggtcctaactcatttgaaagaacacccggacgcctggacccgatag

SEQ ID NO: 116456 - DNA, 540 bp, Artificial Sequence
  Description of Artificial Sequence: Synthetic coding sequence
atgccagcaatcatgactatgctggctgaccatgcggccagacagcttctggacttcagccaaaaacttgacataaatttactcgacaatgtggttaactgcctataccacggagaaggagcccagcagcggatggctcaggaagtgttgacacacctgaaggaacaccctgatgcatggaccagggtggacactatcctcgagtttagccagaacatgaatacaaagtattacggcctgcagatcttagagaacgtaattaagactagatggaagattcttcctcgtaatcagtgcgagggaatcaagaaatatgttgtgggattaattataaaaacctctagcgacccaacgtgtgtcgagaaagagaaagtgtacatcggcaagctaaatatgatcctcgttcaaattttaaagcaggagtggccaaagcattggcctacctttatcagcgatatcgtgggcgctagtcggacgagtgaatcattgtgtcagaataacatggtgattcttaagttactaagtgaggaggtgttctag

SEQ ID NO: 116457 - DNA, 285 bp, Artificial Sequence
  Description of Artificial Sequence: Synthetic coding sequence
atgcccgcaatcatgacaatgttggcagaccatgccgctcggcaacttttagatttcagtcagaaattagacattaacctgctggacaacgtagtgaactgtctttatcatggggaaggtgcccagcaaaggatggcccaggaggtgctgacccatttgaaggaacaccctgatgcttggactcgtgtggatacaatcctggagttcagccagaacatgaatacaaagtactatggactgcagatcctggagaatgtgattaaaaccaggtggaagattctgtag

SEQ ID NO: 116458 - DNA, 3615 bp, Artificial Sequence
  Description of Artificial Sequence: Synthetic coding sequence
atggctatggatcaagtcaatgctctttgtgaacagctagtgaaggccgttacagttatgatggacccgaatagcacccagcgctaccgactggaagccttgaagttctgtgaggagtttaaggaaaaatgtcccatctgcgtgccctgtgggctgaggcttgccgaaaaaacacaagtggcgattgtgcggcacttcgggctgcagattctagaacatgtagtcaagttcaggtggaacggaatgtcgcgcctagaaaaggtgtacttgaaaaactctgttatggagctgatcgcaaatggcactttgaatatcctagaagaagagaaccacattaaagatgctctctctagaatcgtggttgaaatgataaagagagaatggccccagcattggccggacatgctgattgaactcgatacattgagcaagcagggagagacgcagaccgaactggtaatgtttattctgttgcgcctagccgaagatgtcgtgactttccaaaccttgcctcctcagcggcggagggacattcagcaaaccctcacccagaacatggagcggatcttttcatttttgcttaatactttacaggagaatgtaaataagtatcagcaggtgaagacagatactagtcaggagagcaaggctcaggctaattgcagggttggagtggccgcattgaatacactggccggctacatcgactgggtgagcatgagccacattacagcagagaactgtaagttactagagatcttatgtctcctcctaaacgagcaggagctgcagctgggcgctgccgaatgtctgctaatcgcagtgtctcgcaaaggtaagctggaggaccgaaaaccgctcatggtgctgttcggcgacgtggccatgcattacatcctgagtgcagcccagacagctgatggaggcggactggtggagaaacattatgtttttttgaaacggttatgccaggttctgtgcgctctggggaatcagctctgtgctctgctgggagccgattccgacgtggagacacccagcaatttcggaaagtatctcgagtcctttctggccttcacgacgcacccctcgcagttcctgcggtcttcgacacagatgacttggggcgccctgtttaggcatgagatcctgagccgagaccctctgctgttggccatcatccctaagtacctccgcgcaagcatgaccaacctggtgaagatgggcttcccttcaaagaccgattcacctagttgtgaatacagccggttcgacttcgacagtgacgaagatttcaatgctttctttaactcctccagagctcagcagggagaagtaatgaggctggcctgccgacttgaccccaagacttcatttcagatggctggtgagtggctgaagtatcaactctctacatttctggacgcaggtagtgtaaattcttgctctgctgttggcaccggtgagggtagtctgtgtagtgtgttctctccctcctttgttcaatgggaggcaatgacactgttcctcgagagcgttattacccaaatgttccgcactctcaaccgcgaagagattccagtcaatgatggcatcgaactcctccaaatggtgttgaatttcgataccaaagacccactgatactgtcttgtgtccttacaaacgtaagcgcacttttccccttcgttacatatcgacccgagttcctgccacaggtcttcagcaaactctttagcagtgtgacatttgaaacggtggaggaatcaaaggcaccccgcactcgcgccgttagaaacgtgagaaggcacgcctgctctagcataattaaaatgtgtagggactacccccagctcgtgttgccaaattttgacatgctctacaaccacgtgaagcagctcctgtcgaatgaactgttgctgacccagatggagaagtgcgccttaatggaagctttagtgcttatctccaaccagtttaagaactacgaaagacagaaggtcttcttagaggagctgatggctcccgtggccagcatctggctgagccaagacatgcatcgcgtcctaagtgacgttgacgcatttattgcttacgttggtacagatcagaaatcatgcgatcctgggctggaggatccttgtgggctcaacagagcccgcatgtctttttgtgtatactcaatcctgggcgtggtaaagagaacctgctggcccactgatctcgaagaagccaaagcaggcgggtttgttgtgggctatacctcatcaggtaaccccatctttagaaacccctgtacagagcagattctgaagctgttggacaacctactggctctaattagaacacataacacactgtacgctcccgagatgctcgccaagatggcggaaccttttaccaaagcactggacatgctggatgccgaaaagtcagccattctgggcctgccccagcctttgcttgaactgaatgactcacctgtattcaagaccgtgcttgaaaggatgcagcgcttcttcagtactttatatgagaactgttttcacatcctggggaaggcaggccctagtatgcagcaggatttttacactgtggaagacctagccacacaactgctgagctcggcatttgtcaaccttaacaatatccctgattatagactgcgccctatgcttcgtgtgtttgtgaaacccctagtccttttctgcccaccggaacactacgaagcactggtctcccctattctcgggcctctcttcacctacctgcacatgcggctctctcagaagtggcaggttatcaaccagcgctctttgctttgtggtgaggatgaggccgccgatgagaacccagagtctcaggagatgctcgaggaacagctggtccgcatgctgactcgagaggttatggacttgatcactgtctgttgcgttagcaaaaaaggcgctgaccattccagcgcgccacccgctgatggagatgacgaggaaatgatggccaccgaagtgacaccatccgctatggccgaactgactgacttgggcaagtgtcttatgaagcatgaggacgtctgtacggcactgctgataaccgcgttcaatagtctggcgtggaaagacaccttaagctgccagcgtactacctcccagctgtgttggcccctgctcaagcaagtgctatcaggaactctgcttgccgatgcagttacatggctgtttacttcggtgttgaagggtctgcagatgcatggccagcacgatggctgcatggcaagccttgtgcacctagcctttcagatctacgaggcactaaggccaaggtatcttgaaatcagggctgtcatggaacaaattcccgaaattcagaaggactccctcgaccaattcgattgcaagttgcttaacccctccctgcagaaggtggccgacaaacgacgcaaggaccaattcaaacgcctcattgcagggtgtataggaaaacctctgggcgaacagtttcgaaaagaggttcacattaagaacctgccttcccttttcaagaagaccaagcctatgctagagacggaagtactggacaacgacggcggaggactcgcaaccattttcgaaccctag

SEQ ID NO: 116459 - DNA, 513 bp, Artificial Sequence
  Description of Artificial Sequence: Synthetic coding sequence
atggccggggagtggttaaaatatcagctgagtacatttctggatgccggctctgtcaacagctgttcggctgtgggaactggtgaggggtcgctctgcagcgtgttcagccctagtttcgtgcagtgggaagccatgactttattcttagagtctgtaatcacacagatgttccgcacactgaacagagaagagataccagtaaacgacggaatcgagttgttacagatggtcctgaatttcgacactaaggacccacttattttgagttgcgttttgaccaatgttagcgccctattccctttcgtgacctaccgccctgaatttttaccccaagttttctctaagctgttcagctcagtgacattcgagactgttgaagagtctaagcccccacacttcccacctctgtctgcgtggaaagagatccaggtctggtcttggagagagcaggcgctatgtcggacaaggtccaattacaccaaggtaagccgcaaaggcgtgagagcgtag

SEQ ID NO: 116460 - DNA, 2166 bp, Artificial Sequence
  Description of Artificial Sequence: Synthetic coding sequence
atggcaggggagtggctgaagtaccaactgtcaacctttctggatgccgggagcgtgaactcctgcagtgcagtcgggacaggcgagggaagcttatgcagcgttttctccccctccttcgttcagtgggaggcaatgaccctatttctggagtcagtaatcacccagatgttccggaccttaaatcgagaggagatcccggtgaatgacgggatcgaactactgcagatggtgctcaacttcgatactaaggatccattaatattatcttgcgtccttactaacgtttccgctctgttcccctttgttacctaccgccctgagtttttacctcaggtcttctctaagctgttttctagcgtgaccttcgaaactgttgaggaaagcaaggcccccaggacacgggcagtgcgaaacgttcgtcgacacgcctgctctagtatcattaagatgtgtcgtgattatccacagctcgtcctacccaattttgacatgctttacaaccacgtgaagcagcttctcagcaacgaactcctgctcacccagatggagaaatgtgctctaatggaagccctggtgctaatctctaaccagtttaaaaactacgaaaggcaaaaggttttcctggaggagctgatggcccccgtcgctagcatctggttaagtcaagatatgcatcgcgtcctctctgacgtggatgcttttattgcttacgtggggactgaccagaagagttgcgatcctggactcgaggacccgtgtgggctgaatcgcgcaagaatgagcttttgcgtatacagcattcttggcgtggtcaagcgcacctgttggcccactgacctggaagaagccaaagcaggaggtttcgtagtgggctacacatcaagtggcaaccctattttcaggaatccttgcacggagcagattttaaagcttttagataacctgctcgcgctgattaggacccataacaccctctacgcccctgagatgttagccaaaatggctgaacccttcaccaaggccttggatatgctcgatgccgagaaaagcgcgatccttggtttgcctcaacccctgctggagctaaacgactctccagtgtttaaaaccgtgctagagcggatgcagcggttcttctcaacactctacgagaattgtttccatatacttggtaaagccggtccatccatgcagcaggacttctataccgtggaagaccttgccactcaactgctgtcctctgccttcgtcaatcttaataatatcccagactacaggttgagaccaatgctgcacatcttgagcaagcccctggtcctgttttgtcctcctgaacattatgaagcactcgtatcccccattctcggccccctctttacatacctccacatgaggctttcacagaagtggcaggtgatcaatcagcgaagcctgctttgtggcgaggacgaggcagctgacgagaaccccgagagtcaggagatgctggaggaacaactggtaagaatgctcacacgcgaggtgatggacctgattacagtgtgctgcgtttcaaagaagggcgccgatcatagcagtgctcccccagctgatggagacgacgaggaaatgatggctaccgaggtaaccccaagcgccatggccgaactgaccgacctgggaaaatgcctcatgaaacatgaggatgtgtgtacagccctattgataaccgctttcaactccctagcctggaaggacacattgtcttgccagcgcactacttctcagttgtgctggccattgctgaagcaagtgctctctggcaccctgcttgcagatgccgtgacatggttattcacaagtgtcctgaaggggctccagatgcatggtcagcacgacggctgcatggcctcactcgtgcacctggccttccagatctacgaagctctccggccgcgatatttagagattagggcagttatggaacagatacctgaaatccagaaagactcgttggaccagttcgactgcaaactcctgaacccatccttacagaaggtcgcggataaacggagaaaggatcagttcaaacgcctcatagccggatgcataggtaagccacttggggaacagtttcgtaaagaggtgcacattaaaaatctcccctttgtggctgacctctag

SEQ ID NO: 116461 - DNA, 2211 bp, Artificial Sequence
  Description of Artificial Sequence: Synthetic coding sequence
atgcattacatcctctccgccgctcaaacagcggatggcggcggtctggtggagaagcactatgtctttctcaaaaggctatgtcaggtgctgtgcgcccttggcaaccagctgtgcgctctgttgggcgccgattccgatgtggagactccctcgaatttcggcaaatatctggagtcattcttggcgtttactacgcatccttctcagtttctgagaagttccacacagatgacttggggtgccctgttcaggcatgagattctgtcaagggaccctcttctgctagcaataattccgaagtacctgagggcctccatgactaatctggtgaaaatggggttcccctcgaagacggattctccctcctgcgagtattcacggttcgacttcgattcagacgaagacttcaatgccttctttaactcaagcagggcgcaacagggggaagttatgcgccttgcctgccgactggaccctaaaacatccttccagatggcaggggaatggctgaagtatcagctctcaaccttcctggatgctggctcagttaattcctgttcagccgtagggacaggggagggatccctatgtagcgtgttcagtccatccttcgtccaatgggaggccatgacattgtttttggagagtgtaatcacacagatgttccggacactgaaccgagaagagatccccgttaacgacggaatcgagttattgcagatggtactgaacttcgacaccaaggatcccctgatcctttcatgtgtcctaactaatgtttccgctttgtttccatttgtaacttatcgccccgaattccttccacaagtgttctctaaactctttagctccgtgactttcgaaacagtggaagagtctaaagcaccgcgcacgcgagccgtgaggaacgtgagaagacatgcgtgtagttctataatcaagatgtgtagagactatccgcaactggtgctgccaaatttcgacatgctgtataatcacgtgaaacagctgctgagcaatgagcttttgttgactcaaatggaaaaatgtgctctgatggaagccctagttctaatctctaatcaattcaaaaactatgaaaggcaaaaggtttttctggaagagctgatggctcctgtagccagtatatggctgtcccaggatatgcatcgggtgctttccgatgtggacgctttcattgcttatgtggggacagatcagaagtcttgcgatcctggtcttgaagatccttgcggcttgaatcgcgcccgtatgtcattttgcgtgtactcgatcctgggcgtggtcaagcgtacatgttggcccacagatttggaagaagcaaaggccggaggattcgtggtgggttatacctcaagcggaaatccaatcttcagaaatccatgcacagagcaaatcttaaaactgttggacaacttgctggccctaattcgaacacacaataccttgtacgctcccgaaatgctggctaagatggctgaacctttcaccaaggcactggacatgttggacgccgaaaagagcgcaattctgggtctgccccagcctctcctggagctgaacgattcccccgtgttcaagactgtattagaacgcatgcagaggttcttcagtacgctatatgagaactgttttcacatcctgggaaaggctggcccctcaatgcagcaggacttctataccgtcgaggatttggctacccagttactctcctcagcatttgtgaatttgaataacattcctgactatcgcttgagacccatgctgcacatcctttccaagccactggtgctcttctgcccccctgagcactatgaggctttggtctcacccatattggggccccttttcacctaccttcatatgagactgagccaaaaatggcaggtgatcaaccagagaagcctcttgtgcggcgaggacgaggcagccgacgagaaccctgaatcccaggagatgttagaagaacaactggtgagaatgcttacaagggaggtcatggatctcattaccgtatgttgcgtgagcaagaaaggcgcagaccatagtagcgcaccacccgctgatggagatgatgaagaaatgatggccaccgaagtgacccccagcgcaatggccgaactaactgacctggtgtcaatccaatctactgacaaaagggtgagccctcgcgcagaggtggattag

SEQ ID NO: 116462 - DNA, 2499 bp, Artificial Sequence
  Description of Artificial Sequence: Synthetic coding sequence
atgacatggggggccctgttcaggcatgagattctttctcgagatccacttctgctggctatcattccgaaatatttgcgggcatccatgaccaacttggttaaaatggggttcccctcaaaaactgattcccctagctgcgaatactcgaggtttgatttcgactctgatgaagactttaatgcgttctttaattccagcagagcgcaacagggtgaagttatgcgcctggcctgcaggctggaccccaagacttcctttcaaatggctggcgagtggctaaaatatcagctgagcacctttcttgatgccggatcagtcaactcatgttctgccgtggggacgggcgaggggagtttgtgttccgtcttcagcccctcttttgtccagtgggaggcaatgaccctgtttctcgagagtgttatcacacaaatgtttcgaaccctgaaccgtgaggaaattcccgtgaacgacggtatcgagctcctgcagatggtgctcaactttgataccaaggatccactgattctctcatgcgtgctgactaatgtctcagccctgttcccgtttgtgacctaccggcccgaatttctgccacaagttttctccaagttgttcagcagtgtcacattcgaaacagttgaggaaagcaaagctccacgtacccgtgccgtccgcaacgtaagacgtcacgcatgttccagtattataaagatgtgcagagactacccacagctggtgctacctaattttgatatgctttataatcatgttaagcagcttctgagcaacgaacttcttctgacccaaatggagaaatgtgcattgatggaggcgctggtattaataagcaatcagttcaaaaactatgagcgacagaaggtgttcctggaggaactcatggcccccgtggccagtatatggcttagccaagacatgcacagggtgctatccgatgtcgacgctttcattgcctacgttggtaccgaccaaaagagttgtgaccctggcctggaggatccctgtgggctcaatagggctagaatgagcttttgtgtttattctattttaggcgtggtgaaacggacctgctggcccaccgatcttgaggaggcaaaggcaggcggtttcgttgttggatacacaagcagtgggaatcccatatttagaaatccctgcaccgagcagatcctgaagttgctcgataacctgctcgctctgattcgcacccacaataccctctacgccccggaaatgctggcaaaaatggccgagcccttcacaaaggcactcgacatgctggatgcagagaagtccgctattctgggcctgcctcagcccctgctagagctcaatgacagcccagtgttcaaaaccgtgctggagcggatgcagaggttcttttcaacactctacgagaattgcttccacatcctgggcaaggctggcccatctatgcagcaggatttctatacggtggaagacttggccactcagctcctgagctccgccttcgtcaatcttaacaacatcccagactaccggctcagacctatgttacgggtgttcgtcaagcctttggtgcttttttgcccacccgagcactacgaagctttagtttcgccaattcttgggcctctttttacttacttacatatgaggctgagccagaagtggcaggtaatcaatcagaggtccttactttgcggcgaagacgaagcggctgatgagaaccctgagtcacaggagatgctggaagaacagctggtaagaatgcttactcgcgaggtgatggatctgatcacagtatgttgcgtctcaaagaaaggagccgatcactccagtgccccacccgccgatggggacgacgaagagatgatggccacagaggtcaccccctctgctatggcggaattaaccgatctgggaaaatgccttatgaagcacgaggatgtttgcactgctctactgataaccgccttcaactctctggcttggaaagacacgctttcatgtcagcgcaccacctcccagctgtgttggcctctgctcaaacaagtgctgtctggcaccctccttgcagacgccgttacatggctctttacgtctgtgttaaaaggacttcagatgcacggccagcacgacggatgcatggcatctctggtccacctggcctttcagatctacgaggcgctgcgaccccgatacctggaaatcagagccgtaatggagcaaatacctgaaatacaaaaggactccttagaccagttcgattgcaagctgctgaatccaagcttgcaaaaagtggccgataaacgacggaaggatcaatttaaaaggttaattgcagggtgtatcgggaagcccctgggcgagcagtttcggaaggaggtccatatcaaaaacctgcccagcttgttcaagaagaccaagcctatgctcgagacagaagtgctcgacaatgacggcggcggactcgcgaccattttcgagccctag

SEQ ID NO: 116463 - DNA, 3378 bp, Artificial Sequence
  Description of Artificial Sequence: Synthetic coding sequence
atggctagtgaagaggctagtctcagagcccttgaatcgcttatgactgaatttttccacgactgcactacaaatgagaggaagcgcgagatagaggagctgctcaacaattttgctcagcagattggcgcatggcgtttttgtctatactttctaagctcgacaaggaatgactacgtcatgatgtacagcctgaccgtatttgaaaaccttataaacaagatgtggctgggagtaccttcccaagataagatggagatccgctcctgcctccccaaactgttactggctcatcacaaaacattaccgtacttcattcgtaacaagctgtgcaaagttatcgttgacatcgggcgccaggattggcctatgttctaccatgactttttcaccaacatacttcagctcatacaaagcccagtgactactcccctgggtctgatcatgctgaagaccacatcagaggagctcgcatgcccaagggaggaccttagtgtggctagaaaggaggagctaagaaagctgttgctggaccaggtccagactgttctaggtctgctgacaggaatcctggaaaccgtctgggataagcacagtgtgacagcagcgaccccccctcccagtcctacatccggcgagagcggggatctcctctcaaacctgctccagtctccaagcagcgccaagctgttgaaccagccaatcccgatcctggacgtggaatccgagtacatctgtagcttagctttggagtgtttggcccacttgtttagctggatacctctgtccgccagcatcacaccaagtctgcttacaactatttttcatttcgcgaggttcggttgcgatattagggccagaaaaatggcgtctgtcaatggctcgagtcagaactgcgtgagcggccaggagagggggaggctgggcgtcttggctatgagctgcatcaatgaattaatgtctaaaaactgcgtccctatggaatttgaagagtatctgttgcggatgtttcagcagacattctatctacttcagaagataacgaaggacaataacgctcataccgtgaagtcccgattggaagaactcgatgaatcatacatagagaagtttaccgactttttgcgcctgttcgtgtccgtgcacttgcggagaatcgagtcgtatagccagttcccggtggtggaattcctcacattactgttcaagtacacgtttcatcagcccacgcacgagggctacttctcctgccttgatatttggacattgttccttgactacctgacctctaaaattaagagtaggctgggcgataaggaggccgtactgaaccgatacgaagatgcattagtgttactgcttacagaggtcctgaatcgcatccagttcaggtacaatcaagcgcagctggaagagcttgatgatgagacactggatgacgaccaacagaccgagtggcagcggtacctaagacagtccctggaggtggttgctaaagtcatggaattgctacctacccatgctttcagtaccctattccccgttttacaggacaacctcgaggtgtatttaggtttgcagcagtttattgtcacatccgggtccgggcatagactaaacataacagcagagaacgactgtagacggctccactgttctctgcgcgatctttcttccctgttgcaagctgtaggccgcctggctgaatatttcattggtgatgtatttgccgccagattcaatgacgcactcaccgttgtggagcgactggtgaaggtgaccctctatggaagccagatcaaattgtacaacatcgaaacagccgttccgagcgtcctcaagccagaccttatcgatgtgcatgcacagtccctggctgctctccaggcctattctcactggttggcccaatactgcagtgaggtgcatcggcagaatactcagcagttcgtgaccctgatttcaacgactatggacgccatcacacccttaatctctacaaaagtgcaagacaagctcctgttaagcgcttgccatctgttagtaagtcttgccacgacagtgcggccagtgttccttatctctataccagccgtccagaaagtgttcaaccggatcacagatgctagtgcgctaagactcgtggataaagctcaggtgctggtgtgccgagccctgtccaatatccttctcttgccatggcccaacctcccagagaacgaacagcagtggcccgttagatcaatcaaccatgctagcctgatatctgcactgtctagagactacaggaatctcaagccctctgcagttgccccccagaggaagatgcctctggacgacaccaaactgattatacaccagaccctgtcagtcctcgaggacattgtcgaaaacatttccggagagtctacaaaaagcaggcagatctgttaccagtccctgcaagagtccgtgcaagtcagcttggccctgtttcccgcatttatacatcagtctgacgtgactgacgaaatgttatccttcttcttgacactcttcaggggcttgagggtgcagatgggcgtcccttttactgagcaaattattcagaccttcctgaacatgtttacaagagaacagctggccgagtccattttgcacgaaggctccactggctgtagagtagtggagaaattcctcaaaattctccaggttgtggtgcaagagccagggcaggtattcaagcccttcctgccttctataattgcgttgtgtatggagcaggtgtatcctattatcgcggagcgcccaagtcccgacgtgaaagctgagcttttcgagttgctgtttaggacactgcatcataattggaggtattttttcaaatcaactgtcctcgcatctgtgcagcgagggattgctgaggagcagatggagaacgagccacagttttctgccataatgcaagctttcggtcagagcttcctgcaacctgacatacacctgttcaagcagaatcttttttatttagagaccttgaacacaaagcagaaattatatcacaagaaaatcttccggacagcaatgctgtttcagttcgttaacgtcctgcttcaggtcttggtccacaagagtcacgacctcctccaagaggaaattggcattgctatctacaacatggcctctgttgactttgatgggttctttgccgcatttttgcccgaatttctaacttcgtgcgatggcgtcgacgccaatcagaaaagcgttctaggaagaaacttcaagatggacagggacctgccatcattcacacagaatgtgcaccgattggtgaatgatctaagatactaccgcctgtgcaacgacagcctgccacccggaacagtcaagctttag

SEQ ID NO: 116464 - DNA, 3336 bp, Artificial Sequence
  Description of Artificial Sequence: Synthetic coding sequence
atgacggagttttttcatgactgtacaaccaatgagagaaagcgcgagatcgaggaacttctcaacaactttgcacagcaaattggggcatggaggttctgcctgtactttctgtcgagtaccagaaacgactatgttatgatgtatagcttaaccgtgttcgagaacctcatcaataaaatgtggctgggtgtgccatcccaagacaagatggagataagatcctgtctgccaaagcttctgctcgcccaccacaagactttgccatacttcatccgcaacaagctctgtaaagtgatcgtggacattgggagacaggattggcccatgttctatcacgacttcttcaccaatatcttacagttaatccaaagccccgtgactacacccctcggactgatcatgcttaagaccacgtctgaggagctggcttgcccacgcgaggatcttagtgtggcccgcaaggaagagctcagaaagctcctcctcgaccaagtacagaccgtgctgggtctgctgacaggaattttagaaacagtttgggacaagcattccgtaactgctgctacacctcccccttcgcccacgtccggtgagtctggggaccttctctctaacctgctgcagtcgccatcctccgcaaaacttctgaaccaaccgatccctattttggatgtggagtccgagtacatatgtagcctcgctttagaatgcttggctcatttgtttagctggatcccactgagtgcctccatcacaccttccctgctaactaccatcttccacttcgctagatttggatgcgacatccgggcgcgtaagatggcttccgtgaatggctcatctcagaactgcgtcagcggccaagaacgcggaagactgggtgtcctggccatgagctgtatcaatgaattaatgtcgaaaaactgcgtgcccatggaatttgaagaataccttttgcggatgttccagcagaccttttacctcctccaaaagatcacaaaggataacaacgcacacactgtcaagtctcgcctcgaggaactggacgagtcctacattgagaaattcaccgatttcctgaggctgtttgtgtcagtgcacttgagacgaattgaaagttatagtcagtttcccgtggtggagttcctgactctgctgttcaaatatacttttcaccagcctacacacgaaggttacttcagctgcctcgacatatggacactcttcttggattacttgacttctaaaatcaagtccaggctgggcgacaaggaggctgtactaaataggtacgaagacgcgctcgtgctgctgctgactgaggtactgaataggatacaattccggtataaccaagcacagctggaggagctggacgacgagacccttgatgacgaccagcagacggaatggcaaagatatctccgccaatcattggaagttgtggctaaggtgatggagcttctcccgactcacgccttcagtaccttattccctgttcttcaggacaatttggaggtgtacctcggtctccagcaattcatagtgacctcagggtcgggccataggttgaacatcaccgcagagaacgactgcagaagactacactgctctcttagagacctctcttcacttctgcaggcagtgggcaggctggcagagtactttatcggcgatgtttttgctgctcgcttcaatgatgctctgaccgtggtggagagactggtgaaagttacattgtacgggagccagatcaaactgtataatatcgagacggcagtcccgtctgtcctgaaacccgatttgatcgacgtgcatgcccagagccttgccgcactgcaggcctatagccactggttagcacagtactgctccgaggtgcaccggcagaacacccagcaattcgtcacactgatctccactaccatggacgcaatcactcctttaataagtacaaaggttcaggataagctgctgctatcagcatgtcacctgttagtgagcctggctaccacggtgcgccctgtcttcctgatcagtatcccggccgtgcagaaggtttttaataggatcacagatgcgagcgccctgcgactcgtggataaagcacaggtgctggtctgcagagctctttccaacatcctgttgctgccttggccgaacttaccagaaaacgaacagcaatggcccgtacgtagcatcaaccacgcgtccttaatttctgcattgtccagggattaccgcaatcttaaaccgtcagccgtggctccacaacggaagatgcctttggatgacacaaagcttattatccaccagacccttagtgtactggaagacatagttgagaacattagcggagaatctacaaaatcacgtcagatatgttatcagagcctccaggagagcgttcaagtaagcctcgccctttttcctgcatttattcatcaaagcgacgtaactgatgagatgctctcgttctttcttactttgttccgggggctgcgggtgcaaatgggagtacctttcactgaacagatcatccaaactttccttaatatgtttacacgcgagcagctcgccgaatctattttgcatgagggcagcaccggctgcagggtggtggagaagtttctaaagatcctgcaggtcgtagtgcaagaaccaggccaggtcttcaagccgttcctgccaagtatcatcgcactttgcatggagcaggtctacccaattattgccgagagaccaagccccgacgtgaaagcagaattgttcgagttgctgtttcgaactttgcaccacaactggaggtacttctttaagagcacagtgctcgcgtccgtccagaggggaatcgcagaggagcagatggaaaatgaacctcagttttccgccatcatgcaggcattcggacaatcatttctgcagcctgacatccatctctttaaacagaacctgttttatctcgagactttgaataccaagcaaaagctgtaccacaagaaaatctttcgcacggccatgttgttccagttcgtcaacgtgctgctgcaggtgctagttcataaaagccacgacctgctacaagaagaaatcggtatagctatttataacatggcttcggtggactttgacgggttttttgccgccttcctgcctgaatttctgacatcctgtgacggcgttgatgcgaatcagaaatctgtgctcggcagaaactttaagatggatagggacttgccctcctttacccagaatgtgcaccgtctcgttaacgacctgaggtattacagattgtgcaatgacagcctccctccagggactgtcaagctctag

SEQ ID NO: 116465 - DNA, 3264 bp, Artificial Sequence
  Description of Artificial Sequence: Synthetic coding sequence
atggcagaccatgtccaatcgcttgcccaactggaaaacttatgtaagcagctatacgagacaaccgatacgacaactcgtctgcaagctgagaaagcgctggtggaattcaccaactctcctgactgcctgagcaaatgccaattgctgttggagcgcgggtcttctagctactctcagctgttggccgctacttgcctgactaagcttgtttcgagaactaacaacccactgccacttgagcaaaggatcgatattcggaattacgtgctgaactacttggccactagaccgaaactggccacattcgtgactcaagccctgatacagctgtacgcccggatcacaaaacttggatggttcgattgccagaaagacgactatgtgttcaggaatgctattaccgatgttacgagattcctgcaggactcagtggagtactgtatcattggcgtgacaatattaagtcaactcacgaacgagataaaccaggcagacacaactcatcctctgactaaacatcgtaaaatcgctagtagctttagggactcctccctattcgacattttcacactgtcttgtaacttgctcaaacaagccagtggcaagaacctaaacctgaacgatgagagtcagcacggccttctgatgcagcttcttaagctaacccacaactgtctgaactttgactttatcgggacaagtacagatgaaagctctgatgacctctgcaccgtgcagatcccaacatcatggaggagtgctttcctcgactctagcacactgcaactgtttttcgatctctatcatagcataccgcccagcttctcccctctcgttcttagctgcctggtccagattgcatccgttcgccgttctctattcaacaatgccgaacgcgcaaaattcctgtcacacctggtggacggtgtgaagagaatacttgagaatccacagtccctctcagaccccaataattaccacgagttctgtcgtctcctggctcgccttaagtctaactatcaactgggcgaactggtgaaagtcgaaaactaccctgaagtcatccggctgatcgccaactttacagtgaccagcctgcagcactgggaatttgcccccaattcagttcattatctgcttagcctttggcaaaggctcgccgcctcagtgccttatgtcaaggctacagaacctcatatgctggagacctacacaccagaggttaccaaagcctacatcacatccagactagaaagcgttcacatcattctccgcgacggccttgaagatccactggaagacacagggctagtgcaacagcagctggatcaactttccacaatcgggaggtgtgaatacgagaaaacctgcgctctcctggtgcagttgttcgatcagtctgcacaatcctatcaagagctcttacagagcgcaagcgcgtcaccaatggatatcgccgtgcaggaaggacgtcttacgtggttggtgtacataatcggggctgtcatcggtgggagagtttctttcgctagcaccgacgagcaagacgcaatggacggggagctcgtttgtagagtcctacaactgatgaaccttacagacagtcgccttgcccaggccggaaatgaaaagctcgagctagctatgctgtccttttttgaacagttccggaagatctacatcggcgatcaggtgcaaaagagcagtaaactataccgtcgtctcagcgaagttctgggattaaacgatgagacaatggtgctgtcggtcttcatcgggaagatcatcacaaatctgaaatactggggtagatgcgagccgattacctcaaagactttgcaacttcttaatgatctcagcattggttatagcagtgtgcgcaagctggtgaagctctcagccgtgcaattcatgcttaataatcacacatctgaacatttttcctttctggggatcaacaaccagtcaaaccttacagacatgcgatgccgcaccactttttacactgctctggggcgcctcctgatggtggatctaggagaggacgaggaccagtatgagcagtttatgttacctttgacagccgcctttgaggctgtggctcagatgttttccaccaactcgtttaacgaacaggaggcaaaacggaccctcgtcgggctcgttcgtgacttgcgcgggattgctttcgccttcaacgccaaaacctcctttatgatgctgtttgagtggatttaccctagctacatgcctatcctgcagcgcgctatagagctatggtatcacgatcctgcttgtacaacccccgttctgaagctgatggccgaactggttcataaccggtcccaacgattacagttcgacgtgagctcaccaaatggtattctcttgtttcgcgagacctccaagatgatcacaatgtatggcaaccggatcctgaccctcggggaggtgccgaaggatcaggtgtacgcgctaaaactaaagggaattagtatctgttttagcatgctgaaagccgccctttctgggtcttacgtcaattttggtgtcttcaggctctacggcgatgacgccctcgacaatgccctgcagacctttattaaactgctactgtccatcccacactccgacctgcttgattatcccaagctgagccagtcctattacagccttttggaggtgctcacacaagatcacatgaactttatcgcctccttggaaccgcacgtcatcatgtacattctgtctagcatcagcgaggggctcacagcgttagatacgatggtctgcaccggctgttgcagctgcttggatcacattgtcacttatctgttcaaacaacttagcagaagtacaaaaaagcgcacaactcctctcaaccaagagtcggacaggtttctccacatcatgcaacagcatcctgagatgatccagcagatgctgtccaccgtgctgaacattattattttcgaagactgcagaaaccaatggagtatgtccagacctctactgggcctgatcctcctgaacgagaaatattttagcgacttaaggaattcaatcgtgaactcacaaccaccagaaaaacagcaggcaatgcacttatgttttgagaatctcatggagggaatcgaacgtaatcttctcacaaaaaatagagaccgcttcacccagaacctctccgctttccggcgcgaagttaatgacagcatgaagaacagcacctatggagttaatagcaacgatatgatgtcctag

SEQ ID NO: 116466 - DNA, 3267 bp, Artificial Sequence
  Description of Artificial Sequence: Synthetic coding sequence
atgagagatcctggaagaaagtcattagctcagcttgaaaacttatgcaaacagttgtatgaaacaaccgacactacaacccgtctgcaggctgagaaggctctggtcgagttcacaaactccccagattgcctgtcaaagtgtcagctcctgttagagaggggctccagctcatactcgcagcttctggctgctacatgcctgaccaaattggtgagcaggaccaataatcctttgcccctggagcagaggatcgatattcgcaactacgtgctgaattacctcgccactcgacccaagctggcaaccttcgtgacgcaggccctcatacagttgtacgcgcgcattacaaaactcgggtggtttgactgtcagaaagatgattacgtgtttaggaacgcaattacagatgtcaccagattcctgcaggactcggttgaatattgcatcatcggcgtgacaatactttcacaactgaccaatgagatcaaccaggctgacacaactcacccgcttactaagcaccggaagattgcctctagctttcgggactcctccttgttcgatattttcactctgagctgtaacctgctgaagcaggctagcggcaagaatctgaatctgaatgacgagagtcaacacggcctcctcatgcaactcctcaagctgacacataattgcctgaattttgatttcattgggacatcgacagacgagtcatccgatgatctctgtacagttcagatcccaacctcctggcgtagtgccttcttagactccagtactttgcagttgttttttgatctgtaccactccatcccaccatcctttagcccccttgttctgtcatgtctggtacagatcgcaagcgtccggagatcccttttcaacaatgccgagcgcgctaagttcctttctcacctggttgatggggttaaacggatcttggagaacccccaatcactcagcgacccaaataattaccatgaattttgccgcttgctagctagactcaaaagcaattaccagttgggagagcttgtgaaagtcgagaactaccctgaggtcatccggcttatcgcaaattttacggttactagcctccagcactgggagttcgcccccaattctgtgcactatcttctgagcctgtggcagcggctcgccgcgtcggtaccctacgtcaaggccaccgaaccccacatgttagaaacttacacccccgaagtaactaaagcctatatcacttctcggctggagagcgtgcatatcatccttcgggacggcctggaagaccctttagaagacacgggactagtgcagcagcaactggaccagctgagcactattgggaggtgcgagtatgaaaagacttgcgccctgctcgtacagttatttgatcaatcagcgcagtcgtaccaggaactgctgcagagtgcgtctgcctctccaatggatattgccgtgcaggaggggagacttacgtggctcgtttacattattggggctgttattggcggaagagtctcatttgcttccactgatgagcaggacgccatggatggggagttggtgtgtagggtgcttcagctgatgaacttgacagacagtagactagcccaagctggaaacgaaaaattggaactggctatgctgtctttcttcgaacagtttagaaagatctatatcggggatcaagtacagaagagttcaaagctgtatcggaggctgtctgaagtgttgggactgaatgacgaaacaatggtgctaagtgtattcataggtaagatcataactaatctgaagtactggggccggtgcgaacccattacctctaaaacgctgcagctcctaaatgacctctccatcggatacagtagcgtgcgtaaactggttaagctttcagcagtccagtttatgctgaacaatcatacatctgagcacttcagcttcctaggcatcaacaaccaatctaatctgactgacatgcggtgcagaacaaccttctacaccgccctcggccgactattgatggtggatcttggagaagacgaagaccaatatgagcagtttatgttgccactaaccgctgcttttgaggcagtggctcagatgtttagtaccaacagctttaatgaacaggaagccaagcgcacactcgtcggactggtccgcgacttgagaggcattgcattcgcattcaatgccaaaacatcttttatgatgctcttcgaatggatctatccatcgtacatgcccatcttgcagagggccatcgagctatggtaccatgatccagcctgtacaaccccggtcctgaagctcatggccgaactcgtacataataggagccagaggttacagttcgatgttagcagtccgaatggcatccttctgttccgcgaaacaagtaagatgatcaccatgtacggtaacaggatcctgactctaggcgaggtccccaaagaccaggtgtatgcactcaagctaaagggaataagtatatgtttttccatgttgaaggccgccttaagcggcagctacgtgaattttggcgtattcagactctatggagatgatgctcttgacaacgccctccagactttcatcaaactcctcctaagcatcccacacagcgacctgctggattatcctaaactcagtcagtcctactactcactcttagaggtgcttacacaggaccatatgaattttattgcctctttagaaccccacgtcattatgtacattttgtcctccatctccgaaggcttaaccgccctggataccatggtctgcaccggttgttgttcgtgcctagatcacatcgtgacctatctattcaagcagctgagcagatcgacaaagaaacgcactacccctttgaatcaggaaagtgatagattcctccacataatgcagcagcatcctgagatgatccagcagatgcttagcacagtattaaacatcatcattttcgaggactgccggaatcagtggagcatgtcaagacccctcctcggactcatcctgctaaacgaaaaatacttctctgacctgcgaaattcgatagtgaattcccaaccccctgagaagcaacaggctatgcacctgtgtttcgaaaatttaatggagggtatcgagcgaaacctgctgaccaaaaacagagaccgatttacccagaacttgtcagcattcagaagagaggtaaatgatagtatgaaaaattctacctatggtgtgaactccaacgatatgatgtcatag

SEQ ID NO: 116467 - DNA, 3291 bp, Artificial Sequence
  Description of Artificial Sequence: Synthetic coding sequence
atggctgaccacgtgcagagcttggctcaacttgaaaatctctgtaaacaactgtatgagacaacggacactactacacggctccaggcagaaaaagctctagtggaattcacaaatagtccagattgtttgagcaagtgccagctgttgttggaaagggggtctagctcatacagccaactactggccgccacctgtctcacaaaactggtgagcaggaccaataacccattgcccctggaacagagaatcgatatccgaaattacgttctgaattacctcgccaccaggcctaaactggcaactttcgtgacgcaggcactgatccagctctacgcacgcattacgaagttgggttggttcgattgccagaaagacgactatgtttttcggaacgcaatcacagatgttacgcggttcctgcaggatagcgtggagtattgtattataggggtaaccatcctgtcgcagctgaccaatgagatcaatcaggtcagcgctactgcattcctgatagaggccgatactactcacccactgacaaaacatagaaagatagcttcatcattcagggactcaagtctgtttgacatcttcacattgtcatgtaacttgctcaaacaagcaagcggaaagaacctcaatcttaatgatgaatcccaacacgggcttctgatgcagctgcttaaactgacacacaattgtctcaatttcgactttatcggaacatctactgacgaatcatctgatgatctctgcaccgtgcaaattccaacaagctggcgaagcgcttttttggatagctctaccttgcagctcttctttgacctctaccactctattcctccttcttttagtccccttgtgctgtcgtgcctggtacagatcgcctctgtgaggaggtccctcttcaataacgcagagagagccaagttccttagccacttggtcgacggggtgaaacgaatactggaaaacccacagagcctgtccgatccaaacaactatcatgagttctgccggcttcttgcacgattaaagtctaactatcaactcggggaactggtgaaagtggagaactatccagaagttatacggctgatagccaattttaccgtgactagcctgcaacactgggagttcgcccctaactcagttcactatctcttgtcactctggcagagattagcggcgagcgttccctacgtgaaggctaccgaaccccacatgctcgagacatacacccccgaagttacaaaggcctacattacaagcaggcttgagagcgtccacattatactgagggatgggttggaagaccctctagaagacaccgggctggtccaacagcaactggaccagctctccacaataggaaggtgcgaatacgagaaaacatgcgccctcctcgtgcagctgttcgatcaatctgcccagagttatcaggaactcttgcaatcagctagcgccagtcccatggacatagccgtgcaggaaggaaggctgacatggttggtgtatatcataggcgcagttatcggggggcgggtcagcttcgcttccactgacgaacaggacgcaatggatggagaactggtctgtcgggtgcttcagttaatgaacctcacggactccaggctggctcaggccgggaatgaaaaacttgaactagccatgttgtctttctttgagcaattccgtaaaatctacatcggcgaccaagtgcagaaatcttcaaagctctatcgtcgcctgagtgaggtgctgggactgaatgacgagacaatggtgctgtccgtattcattgggaagatcattaccaatctcaagtactggggccggtgcgaaccgatcacttcaaagaccttgcagctgctgaatgacctttccatcggatatagtagcgtacgcaagctggtaaagctcagtgcagtgcaatttatgttgaacaatcacacgtccgagcatttttccttcctcgggattaacaatcagagcaacctgactgatatgaggtgcaggacaacattctacaccgcgctcgggcgcctgctaatggttgacttgggggaagatgaggaccagtacgagcaatttatgctaccactcacagctgctttcgaagctgtggcccagatgttttccactaactcatttaacgaacaagaagcgaagcggaccctggtcggtctggtgcgggatctccgcggcatcgcatttgcattcaatgctaagacctcttttatgatgctgtttgaatggatctacccctcctacatgccaattctgcagcgagcaatcgagttatggtatcacgatcctgcctgcaccactcctgtactcaaactcatggctgaactcgtgcacaatcggtctcaacgactgcagttcgacgtatcgtcaccaaacggtatcctgctgttccgagaaacttctaaaatgataactatgtacggaaacaggatccttaccctcggagaagtgcctaaagaccaggtctatgccctgaaattaaaagggatcagcatctgctttagcatgctgaaggcagctctcagcggcagttatgtgaacttcggggttttcagactgtacggggacgacgccctggacaacgccctgcagaccttcattaagctgctgctctccattccacactcagacctgctggactatcctaagctgagccaatcgtattattccctgctggaggttctgactcaggatcacatgaattttatcgcttcactcgagcctcatgtaattatgtacattctgtcctctatctcagagggacttacggccctggacactatggtgtgtacaggatgctgttcctgcctggatcacatcgtaacctacctgtttaaacagttgtcccggtccaccaagaagcggactacgcccctgaaccaggagtcagaccggtttcttcacatcatgcagcagcacccagagatgatccaacagatgctgagtaccgttctcaacatcattatatttgaagactgtcgcaatcaatggtctatgtcccggcccttgcttggactgattctgcttaacgaaaaatactttagcgatctccgaaacagcattgtcaacagccaaccaccggagaaacagcaggctatgcatctgtgctttgagaaccttatggagggtatcgaacgcaacctcctgactaaaaaccgcgatcggttcacacagaacctgtctgccttcagaagggaggtgaacgatagtatgaaaaattctacatatggggtgaattcaaacgatatgatgagctag

SEQ ID NO: 116468 - DNA, 6363 bp, Artificial Sequence
  Description of Artificial Sequence: Synthetic coding sequence
atgcggtcttttaaaagagtgaatttcgggactctactgtctagtcaaaaggaggcggaagaactactgcccgccctgaaggaattcctttctaatcctcctgcaggatttccctctagccgatctgatgccgaacgaagacaggcttgcgacgctattctgagggcatgcaatcaacagctcaccgcaaaactagcatgtcctaggcatctgggtagcctgctcgagttggctgagctcgcctgcgacggctatctcgtatccactccacaaaggcctcccctttacctggagaggatcttgttcgtgctattgcgaaacgccgctgcacaaggctcccccgaagcgacccttcggttggcgcagccactccacgcatgcttagtacagtgttcacgcgaggcagccccacaggattacgaagctgtggctaggggttccttctcccttttgtggaaaggcgccgaggctctgctagaacgacgcgcagccttcgccgctcggctcaaagcgctgtcctttctcgtcctgctggaagacgagagcacaccatgtgaagtcccgcactttgcatcacccaccgcttgccgagccgttgctgcccatcagctcttcgacgcaagcgggcacggtctgaatgaggctgacgcagactttctcgacgacctcttgagtcggcacgtgattagggcactcgtgggcgagcgcggcagttcctcaggactgctatctccacaacgggctttgtgtctcctggagctgaccttggaacattgcaggagattctgttggtctaggcaccatgataaggccatctccgccgtggagaaggcacattcttatctgaggaatactaatctggctccatctcttcagttgtgccaacttggagttaaactgttgcaggtgggagaggaaggtccccaagccgttgccaagctattaatcaaagcttccgctgttctatccaagagtatggaagccccgagccctccactgagggcattatacgaaagttgccagtttttcctgtctggcctggagaggggcacaaagcgtagatacagactggatgccatcctctctctgtttgccttccttggaggctactgctcactactccagcaactcagggacgacggagtctacggaggctcgagcaagcagcaacagtcattcctccagatgtacttccaggggctacacttatacacagtcgtagtgtacgatttcgcgcaaggatgccagatcgtagatctggcggatctcacacaactggttgactcctgcaagtcaactgttgtctggatgcttgaagccctggagggactttctggccaggaacttacagatcacatgggaatgacagccagttacaccagcaatctggcctactcgttctattcacacaaactgtacgctgaagcttgcgcaatcagcgagccgctctgccagcatttgggactggtgaagccaggtacatatcccgaagtgcctcccgaaaagttgcaccgatgcttccggctgcaagtcgaaagcctgaagaagctgggaaaacaggcacaaggatgcaaaatggtcattctgtggctcgccgccctccagccctgctcccccgagcatatggccgaaccagtgactttctgggtcagggtcaaaatggatgccgccagggccggtgacaaagagttgcagctcaaaacattaagggactcactctctgggtgggaccccgagacactcgctctgctgctccgagaagagctccaagcctacaaagcagtgcgggcggacacaggccaggagcggtttaatattatttgtgatttgctggagctcagtcctgaggaaacccccgccggggcatgggcgagagctactcacctcgtcgagttggcccaggtgctctgttatcacgatttcacacagcagaccaactgttctgcactcgatgccatccgcgaggccctgcagcttctggactcagtgaggcctgaggctcaggcgagagatcagctgctggatgacaaggcccaggctttgttgtggctgtatatttgcacactcgaagctaagatgcaagagggtattgaacgtgaccgtagagctcaggcgccaggcaacctggaagaatttgaagtaaatgatctgaactacgaggacaaattacaagaggatcgctttttatacagtaacattgcatttaacctggcagccgatgcagcacaaagcaagtgtcttgaccaggccctagcgttgtggaaggaactgcttactaagggtcaggcgccagctgtgcggtgccttcagcagactgcagctagtctccagattctggcggctctttaccagctagtggccaaacctatgcaggccctcgaggttctgttgttactacggatagtatcagagcgattgaaagaccactcaaaagcagcgggtagctcatgccacataacccagctgcttctcacacttggttgtccctcctatgctcagcttcacttggaagaagctgccagctccctcaagcacctcgaccagaccacagacacttacctgctgctgagcttgacatgcgaccttttgcggagtcaactgtattggactcaccaaaaggtgacaaagggagtttctctactgttatccgtgctgagggatcctgcactgcagaagtcaagtaaggcctggtatttgctcagggtccaggttctgcagctggttgcagcctatttgtccctgccgagcaacaacttaagccatagtctatgggagcaattgtgtgcccagggctggcagacccctgagatcgccctgattgatagtcacaagctcctgcgatcaataattctgctgctgatgggtagcgatattctctcaacacagaaggccgccgttgagacctcttttctggactacggcgagaaccttgtgcagaaatggcaggtcctcagcgaagtgctaagttgtagtgaaaagctcgtgtgtcatctgggccgcctggggtcagtctctgaggcaaaggccttctgcctggaagcactgaagttaacaaccaagctgcagatccctcggcagtgcgcactgttcctcgtgttgaaaggggagctggaactggctaggaacgatattgacctttgccagtctgatctgcagcaggtcctgttcttactggagtcatgtactgaatttggcggcgtcacacagcacttagatagcgtgaaaaaggtgcacctgcagaagggcaaacaacaggcacaggtcccatgcccaccacaactgccggaagaagagctatttctgcgcggtcccgccctcgagttagtcgctacagtagcaaaggagcccggcccaatcgcacccagcacgaatagtagccctgtcctgaaaacaaagcctcagcccatcccaaactttctctcccactccccaacttgtgactgctcactgtgcgcttcgcccgtacttaccgccgtttgccttcgctgggtgctggttacagctggcgtaagacttgcaatgggacaccaggcacaaggcctggatctattacaggtagtccttaaaggctgccccgaagccgcggagcgcctaactcaggccttgcaggcaagtctgaatcacaaaacccccccaagcctcgtgccaagtcttttggatgaaatcctcgctcaggcctacacattgctagcattggaggggctgaaccaaccaagcaacgaatctctccaaaaagtgctgcagagcggactaaagttcgttgccgcaagaatcccacacttagagccttggagagccagccttctgctgatttgggccttgaccaagctggggggcctgtcttgctgtactactcagcttttcgcatcttcctggggttggcagccccctcttataaagtccgtgccgggttctgaaccctcaaagacacagggacagaagcggagcgggagaggcagacagaagctggcttccgccccccttcggctgaataacacatctcaaaaaggcctcgaaggtagaggcctgccgtgtacaccgaaaccccccgacagaattaggcaggcagggcctcacgtgccattcacagtgttcgaagaggtgtgccctaccgagtccaaacccgaggtcccacaagcccctagagtgcagcagagagtgcagactaggcttaaagtaaatttttcagatgatagcgatctggaggatcctgtttcggctgaggcctggctggccgaagaacctaagagaagaggaacagcctctcggggccgcgggagagcacgaaagggactgtccctgaaaacagatgccgtcgtagcacccgggtctgccccgggcaatcccggactaaacgggaggagtaggcgcgccaagaaagttgcgtcgagacactgcgaggaacgccgcccacagagagcctcagatcaggcccggccgggccctgaaattatgcgcacaatccccgaagaagagctgactgacaattggagaaaaatgagctttgagatccttcgtggctccgacggggaggatagtgcgtccggcgggaagactccagcccctggtccagaagcagcttctggcgagtgggagctactgaggttagattcttccaaaaaaaaactcccttcaccttgccccgataaggaatccgataaggacctgggcccgcgcttaagactacctagcgctcccgtggcaacaggcctaagcacactggattctatctgcgactcactctcagttgctttcaggggcatttcccattgcccccctagcggactgtatgctcatctgtgccgcttcctcgccctctgtctgggccacagggatccctatgccacagcatttctcgtgacagagagtgttagcatcacttgccgtcatcaactgctcacacacttacaccgtcaactgtcaaaggcccagaaacatcgtggctctctcgaaatcgccgatcagctgcagggactttccttacaggagatgcccggggatgtgcctttggctagaatccagcggctgtttagttttagagctcttgagtctggccacttccctcagcccgaaaaggagtccttccaggagagacttgctttgatcccctctggcgtcactgtgtgtgttctcgcactggcaacgttgcagcccgggaccgttggcaataccttgctgctgacacgccttgagaaggacagtccaccagtgtccgtgcagatccccactggccaaaacaagttgcaccttcgatctgtcctcaatgagtttgacgccattcagaaagctcagaaggaaaactcaagttgtaccgataagcgtgaatggtggaccgggcggttggccttagaccacaggatggaggttctcatcgcatccctggagaagtctgtgctcggctgctggaagggtctgctgctgcctagctccgaggaacctgggccagcccaggaggcatcaaggctgcaagagctgctccaggattgtggttggaagtacccagatcgcactctgcttaagatcatgctgtctggcgcaggcgctctgaccccacaggacatacaggctcttgcctacggcctttgtcccactcagcccgagagggctcaggagcttctgaatgaagctgtcggaaggctccaggggttgaccgtgccctcgaactctcacctagtgttagttttagacaaagatcttcagaaactgccgtgggagagcatgcccagcctgcaggcccttccagtaaccaggctgccatcctttcgcttcctgctgagttatagtatcattaaggaatatggcgcttcaccggttctttcacagggtgttgacccacgttctacgttctacgtgctgaaccctcacaacaatctgtcgagcacagaggagcaattcagggccaactttagttctgaagcaggttggcggggggttgttggcgaggtaccacgacccgaacaggttcaggaggccctgacgaagcacgatctctacatctatgcaggccacggcgccggcgcccggtttttggacggtcaggcagtgcttcggttgtcttgcagggctgtggccctcttattcgggtgtagctctgccgcccttgctgtcaggggcaaccttgaaggagcaggcatcgttcttaagtacataatggccggctgtccactattcctggggaacctttgggacgttactgatcgcgacattgataggtatacagaagcactgcttcaaggatggctgggggccgggcctggcgctcctcttttgtattatgtgaatcaggcacgacaggccccccgcctcaaatatctaatcggcgcagctcccattgcttatgggcttcccgtgtctctgcggtag

SEQ ID NO: 116469 - DNA, 6363 bp, Artificial Sequence
  Description of Artificial Sequence: Synthetic coding sequence
atgaggagtttcaaacgggtgaactttggtaccctactgtcaagtcagaaagaagctgaggagctgcttccagccctgaaggagtttctgagcaacccgcctgccggatttcccagctctaggagtgacgccgaacggcgtcaggcatgtgacgcgatactgagagcttgcaaccagcagctaaccgccaagcttgcctgtcctcgccatcttggctcactcctggaactcgcggagctcgcctgtgacggttatctagtcagtacgccccagcgcccacccctctatttggaacgcatcctctttgtacttctcagaaatgcagctgcccagggatctcccgaagctacacttagactggctcagcctttgcatgcttgccttgtgcaatgctctcgggaagcagcgccccaagattacgaagctgtagctcggggaagcttttctctcctgtggaagggggctgaggccctcctcgaacgcagagcagccttcgcagcccgcctaaaggccctgagtttcctcgtattgctggaggatgaaagcacgccatgtgaggtgccccattttgctagtcctaccgcctgccgggccgtcgcagctcaccaactgttcgatgcctccgggcacggacttaacgaggcagacgctgattttcttgatgacctcctgagccgacatgtgattcgggccttggtgggagagcgtgggtcaagttcaggactgctcagcccccagcgcgccttgtgtttacttgaactgacactcgagcattgccgtagattctgttggtcaagacatcacgacaaagctatctccgccgttgaaaaggcccacagctaccttcgtaataccaatctggctcccagcctccagctgtgccagctaggcgtcaaactgctgcaggtgggggaggaaggaccgcaggctgttgccaagctgctcatcaaggcatccgccgtcctctccaaatctatggaagccccctccccgccgctgagagctctgtatgagagctgccagttcttcttaagtgggctggagcgcggcaccaaacgccgatatcggctggatgccatcttgtcacttttcgcattcctcggcggatactgctctctccttcagcagcttcgtgacgatggagtctacggcggcagttccaaacagcaacaatcttttctgcagatgtactttcaggggttacacctttacacggtggttgtctatgacttcgctcagggatgtcagattgtggacttggccgatttaacgcaactggtggactcatgtaagtctaccgtggtgtggatgctggaggccctggaggggcttagcgggcaagagcttactgatcatatgggaatgaccgcaagctacacaagcaatcttgcatacagtttctatagtcataaactctatgcagaagcatgcgccatctctgaaccactttgtcaacacctgggcctggtcaagcccggaacatatcctgaagtaccacctgaaaaactacatcgttgctttaggctccaagtcgaaagcttgaagaagctcgggaaacaggctcagggttgtaaaatggtgattctctggctggccgcattgcagccctgctccccagagcacatggcggaaccagtgaccttctgggtgcgggtgaaaatggatgccgcccgagccggggataaggagctacagctgaagacactccgcgattcactgtccgggtgggatcccgagaccctcgcactcctgctcagagaggagcttcaagcctataaagcagtgcgtgctgatactggacaggaacgcttcaatataatttgcgacctcttagaactttcgcccgaagagaccccggccggcgcctgggccagggcaacccacctagtggagctcgcacaggtgctgtgttaccacgatttcacgcagcagacaaattgctcagcactggacgcgattcgagaggccttgcagctgctcgactcggtcaggcccgaagcacaagctcgggatcagctgctggacgacaaggcccaggcactgctgtggctgtacatttgtaccctggaggccaaaatgcaggaaggaattgaacgtgacaggcgggcccaagccccaggcaacctggaggaatttgaggttaatgacctaaactatgaagacaaactccaggaggatagatttctgtattccaacattgcattcaacctggccgctgacgccgctcaaagcaagtgtttagatcaggcattagcactgtggaaggaactgctgactaagggtcaagctcccgcagtgagatgcttgcaacagacagccgcctcattgcaaatccttgctgcactctatcagctggtcgccaagcctatgcaagctcttgaagtactgctgctcctcaggatcgtcagcgagcgtctcaaagaccacagcaaagccgctgggtcaagctgccacatcactcagttacttctaacgctggggtgtccatcttacgcacagctccacctggaggaggcagccagttctctgaagcacctcgatcagacaaccgatacttacctgttgcttagcctgacatgcgacctgttgcggtcccaactgtactggactcaccagaaagtaacgaagggtgtttctctgcttctctccgtattgcgtgaccctgcattacagaagagctctaaggcttggtacctgttgagggtacaagtgctgcagctagtcgccgcctaccttagtttgcctagtaataacctcagtcattccctgtgggagcagctctgtgctcaagggtggcagacccctgaaatcgctctcattgacagccataaactccttcggtccattatcttgctgttgatggggagcgacatcctcagtacacaaaaggcggctgtggagacaagctttttagactatggggagaacctggtgcagaaatggcaggtgctgagcgaggtccttagctgttccgagaagctagtttgtcacctcggccgactagggagtgttagcgaggctaaggcgttctgtttggaggctcttaagcttacaaccaagctccaaattcccagacagtgtgcgttatttttggtgctaaaaggggaactcgagttggcacgcaacgatatagacttgtgtcaaagcgacctgcagcaagtgttatttctgctagaaagttgtacggaatttggaggggttactcaacatcttgattccgtgaagaaggttcatttgcaaaaaggaaaacagcaggctcaagtgccatgcccgcctcagcttccagaagaggagctgttccttagagggccagcactggagctcgtggccaccgtagccaaggagcccgggcccattgcgcctagcacaaattcttcaccagtgctgaaaacgaagccacagcccatccctaactttctgtcacatagtccaacttgtgattgtagtctttgtgccagccctgtgctcacagcagtgtgcctccgttgggttctagtgactgcaggggtccggctggccatgggacatcaggctcaggggctcgacctgttgcaagtagtcctgaagggatgtcctgaggcagctgagaggctcacacaagctctccaggccagccttaatcacaagactccacccagcctcgttcctagtctcctggatgaaattctggctcaagcctacaccctgttagccctggagggtctgaaccagcccagtaatgagtctcttcaaaaagtgctgcagagcgggctgaagtttgtcgccgccagaatccctcacctcgagccttggcgggcctctcttctgctcatctgggctctcaccaagctgggagggctcagttgctgcactacccagctgtttgcctcttcctggggctggcagcccccattaattaaatccgtgcccggttcagagccctcgaaaacacagggacaaaagaggtctggcagaggccgccaaaaactggcgagcgctccacttcgattaaacaatacaagccagaaaggcctggaaggaagaggtctcccgtgtacacctaaaccacccgataggatcagacaagctggcccccacgtgccttttacagtctttgaagaggtttgtcctacagaatccaagccagaggtgcctcaggcccccagggttcagcagagagttcagaccaggctgaaggtcaattttagcgacgactcagacttggaggatccggtgagcgcagaagcttggctggcggaagaaccaaaacggcgggggaccgcgtctaggggacggggcagggcgcgaaagggtctcagtctcaagaccgatgccgttgtggctccagggagtgcgcccgggaatcctggcctgaacgggcgcagcaggcgggcaaagaaggtggcctcacggcattgcgaggagaggcgtccacaacgtgcgagtgaccaggcccggcctggccctgaaattatgcgtacaatccctgaggaagaactgactgataactggagaaaaatgtcattcgagatcctacggggttccgacggagaagacagcgccagcggtggcaaaactcccgcgcccggccccgaagctgcttcaggtgaatgggagttgctgaggctggattcaagcaaaaagaagctgccctccccttgcccagacaaagagagcgacaaggatctgggaccaagactccggcttccatcggccccagtcgccactgggctgagtacacttgattcaatttgtgactctttgtcagtggcgtttcgtgggatatcacattgccccccttccgggctgtacgctcacctgtgcagattcttagccctgtgcttaggacaccgcgacccgtatgcaactgccttcctggtgactgagagcgtgtccatcacctgccggcaccagctactcacacatctgcacaggcagctttcgaaggcacagaagcaccgcggcagcctggagattgctgatcagctgcagggcctgagcctgcaggagatgccaggggacgtgcctctggctcgcatccagcggcttttttcattcagagctctggaaagtgggcactttccccaacctgagaaggagagttttcaggagcgcctggctctaatcccgtccggcgtaacagtctgcgttctggcactggctaccctgcaaccgggaaccgtaggcaacacccttttgttgacgcgcctcgaaaaagatagtccgccagtgagtgttcagattcctaccggtcagaataaattacatctccgcagcgttcttaacgaatttgatgctattcaaaaagcccagaaggagaactcttcctgtaccgataaaagagaatggtggactggacgtcttgctctggaccatcggatggaggtgctgatagccagcctagaaaagtcggttctggggtgctggaaaggcctattactgcccagcagtgaagagccagggcctgcccaggaagcaagcagactgcaggagctgcttcaggactgcgggtggaagtacccagatcgcaccctgctcaagattatgttgagtggtgcaggtgctctgactcctcaggacatacaagctctggcatatggactgtgccctacacagccggagagggcccaggagctgctaaatgaggccgtggggaggttacaggggctaacggttccatcaaattcccacttggtgctcgtccttgataaagacctccagaagttaccatgggaaagcatgccgagcctacaagcactgcctgtcacacgacttccctctttcaggtttttactgtcgtacagcattatcaaggaatatggcgcatctccagtcctgtcccaaggagtggaccccagatcaacattttatgtcctgaatcctcataacaatttgagttccacagaagagcagttcagggccaactttagcagcgaggccggctggcggggggtggttggcgaggtgcctagaccagaacaggtccaagaagcactgacaaagcacgacttgtatatatacgctgggcatggcgctggcgcaagatttcttgatggacaggccgtgctgcgcctgtcttgtcgcgctgtagcgcttctgtttgggtgttctagcgctgcactggctgtcaggggaaacctggagggcgcaggcattgttctaaagtatatcatggctgggtgcccactgttcctggggaacctatgggacgtcaccgaccgcgatatcgataggtatacagaggccctcttacagggatggctgggggccggtcctggtgctccccttctttactatgtgaatcaggctcgacaagctccacgcctgaaatacctgatcggagccgcaccaatcgcatacgggctgcctgtcagtcttcgttag

SEQ ID NO: 116470 - DNA, 5388 bp, Artificial Sequence
  Description of Artificial Sequence: Synthetic coding sequence
atggaagctcctagcccccccctacgtgccctctacgaaagctgccaattcttcctctcggggctggagcgagggaccaaacgccgttacaggctcgacgctattctatctttgttcgccttcctaggaggatactgcagcttgctgcagcaattgagggacgatggcgtctatgggggttccagcaaacaacagcaatcatttctgcagatgtatttccagggtttgcacctgtacacggttgtggtctacgattttgcgcaggggtgtcagatagttgatctggccgacttaactcaactggtcgacagttgcaaatcaaccgtcgtgtggatgttagaagccttagaaggcctgagtggacaggagctcactgatcatatgggaatgacagcctcctatacaagcaacctcgcctacagcttctacagccacaaactgtatgccgaagcgtgcgctatcagcgagcccctatgccagcacttgggattggtgaagccaggtacctaccccgaggtgcctccagaaaaactccaccgctgtttccgtctgcaggtggagtccctgaagaaactggggaaacaggcacagggctgcaagatggttatactgtggctcgcagctctgcagccttgcagtcctgaacacatggctgaacccgttactttctgggtacgagtgaagatggacgccgcacgggctggggacaaggagctgcagctgaagaccttgcgggacagtctatccgggtgggatcctgagaccttggctcttctgctgagagaggagttgcaggcctacaaggctgtgagggcagataccggtcaggagcgttttaacatcatttgtgacttactggagttatcgcccgaggaaactccagcaggagcctgggctcgcgccacccacctggttgagctcgcacaggttctctgttaccacgattttacacagcaaacaaattgttctgcccttgatgcgatcagggaagccctgcagcttttagattcagtcagacccgaagctcaagctagggaccagctcctggacgacaaagcccaagctttgctctggctgtacatctgcaccttagaggccaagatgcaggagggaattgaacgcgatcgacgtgcccaggctcctgggaatctggaggagttcgaagttaatgacctcaactacgaggacaagctgcaagaagaccgattcctgtactccaacatcgcatttaacctggctgcggatgcagcccagtcaaagtgtctggaccaggctctagccctgtggaaggaactcctcacgaaggggcaggcccctgccgtgcgatgtctgcagcagacagccgctagtctgcaaattctagctgcactttaccagctggtcgcaaaacccatgcaagctctggaagtgctcctgctgctccgtatcgtgtccgagaggctgaaggaccactccaaagcggcaggcagctcttgtcatattacccagctgttgctcacactcggatgtccatcatacgcgcagttgcatctcgaggaggcggcaagtagcctcaaacacctggatcaaactacggacacttacctcctgctgagcttgacctgtgatctccttaggtctcagctgtactggacacaccagaaggtgactaagggggtaagcctcttgctgagtgtgctgagagaccccgctctgcagaaaagcagtaaggcctggtatctgttgcgtgtacaagtactccagctcgtggctgcgtacttgtcacttccctccaacaatctgtcacacagcctgtgggaacagctttgtgcccagggctggcagacgcccgagattgcgctgatagactcacataagctgttgcgcagcataatcctcctgttgatgggctctgacatcctttctacccagaaggcagcggtggaaacatcattccttgactatggtgagaatttggtgcagaaatggcaggtcctcagtgaagtgctctcgtgttccgaaaaactagtatgccacctgggaaggctgggctcggtgtcagaggctaaggcattctgtttggaggccctgaagctgaccaccaaactacaaattccccggcagtgtgcattattcctcgtgctgaagggcgaactggagctggctcggaacgatatcgacctatgtcagtcagatcttcaacaggttctgtttctgctggagagctgtaccgagtttggcggcgttacccagcatttggactccgttaagaaggtgcatctgcagaagggcaagcagcaggcccaggtcccttgcccgccacagcttcctgaggaggagctcttcctccgcgggccagctctggagctcgttgccaccgtcgccaaagagcccggcccaattgctccatctacaaactcttccccggttctcaaaacaaaacctcaacccattcctaacttccttagtcattcccctacatgtgactgctccctctgcgcctcgcctgtattgaccgccgtctgcctacggtgggtgctggttactgccggtgtgcggttagctatgggtcatcaggcacagggtctcgacctcctccaggtggtgctcaaaggttgtccagaggcagccgagcggctcacacaggcactgcaggcatctctcaatcataagacgccccctagtcttgtgccttctttgctagacgagatacttgcccaggcatacactctgctggcattggagggcctcaatcagccttccaatgagagtcttcagaaagtcctacagagcggacttaagtttgtggccgcccgaatccctcacctcgagccgtggcgagcaagtcttctgctaatttgggctcttacaaagctggggggactgtcatgttgcactacccagcttttcgcttcttcttggggctggcagcctcctctgataaaatcagtgccagggtccgaaccatctaagacccaagggcaaaaaagatccggcaggggacgtcagaagctagcctccgcccctcttaggctgaataatacctctcagaaaggactggagggacggggcctgccgtgtactccaaaaccacccgatagaattcggcaggccggccctcacgtgcccttcaccgtgtttgaggaggtgtgccctacagagtcaaagccagaagtgcctcaggccccccgtgtgcagcagagggttcagacacggcttaaggtcaatttttctgacgactctgacttggaggatcctgttagcgccgaggcctggttagcagaggaacctaaacgccggggaacagccagccggggaagaggacgggcccgtaaaggtttgtcactaaaaaccgacgcagtagtcgccccaggttccgcgccagggaacccggggctgaacggtcgcagtcgtcgtgctaagaaggtggcatcccgacactgcgaagagagaaggcctcaacgggctagcgatcaagcgcgacccgggcctgaaattatgagaacgattccggaagaagagctgaccgacaactggcgcaaaatgtctttcgagatactgagagggtccgacggcgaagacagcgccagcggaggaaagacaccagcccctggtcctgaagcggcttcaggtgaatgggaactactgcgtctggactcatcaaagaagaaactaccatcaccctgccccgataaggaaagtgacaaagatctgggcccacgtcttcgactcccctcagcgcccgtggcaacaggactttccactctggatagcatttgcgattctctgtccgtcgcgtttagaggcattagtcactgtccccctagtgggttgtacgcccacctgtgtcggtttctcgccctctgtctgggacatcgtgatccgtacgccacagcattcttagtgacggagtctgtgagcattacctgtcggcatcagttactgacccacctgcaccggcagctgtccaaagcccagaaacacagaggaagcctggaaatcgcagaccagctgcaggggctcagcttgcaggagatgcccggagatgttccgctagcaagaatccagcgtcttttttccttcagagccctggagtccggccactttccccagcccgagaaggagtcgtttcaggaacgtctggccctcataccttccggggtcactgtgtgtgttctcgccctggccactctccagcccggcactgtgggaaataccctgctgttgaccaggctggaaaaagactctccccctgtctccgttcagatccctacaggtcagaacaaactgcaccttcgtagcgtcctcaatgagtttgacgctattcagaaagcccagaaggagaattctagctgtacagataagagagagtggtggactgggcgcctcgccctggaccatcggatggaggtgcttattgctagtctggagaagtcggtgctgggatgttggaagggtttgctcttgccaagtagtgaagaacccgggcccgcccaagaagcctcgagactacaggagctgttacaggactgcggctggaagtacccggatcgaactctactcaagatcatgttgtcaggcgcaggcgctctgactcctcaggatatccaggccttggcctacggcttgtgcccaacccagccagaacgcgcccaggagctgctcaacgaggccgtgggacgtctgcagggcctgaccgtgccatctaattcccacttggtattggtgctcgataaagatctgcaaaaactgccttgggaatcaatgcccagtctccaggccctgcccgtcaccagattaccctccttcagattcctgttgtcctactccatcatcaaggagtatggagctagcccagtgctgagccagggtgtcgacccgcggtctaccttttacgtacttaacccgcacaacaatctctcctccacagaagagcaattcagggcgaacttctcttccgaagccggatggaggggcgttgtgggcgaggtacctagacctgagcaggttcaggaagctctcacaaaacacgatctgtacatctacgccgggcacggagccggcgcccggtttctggatggacaggcagtactgcggctttcctgtcgggcagtggccctcctcttcggctgcagttcggcagcccttgccgttcgggggaatctggagggggccggcattgttctgaagtacattatggcaggatgccccctgttcctcggaaatctttgggatgtcacagaccgtgacattgaccggtatactgaagctctactgcagggttggctcggggctggtccaggggcacccctgctgtactacgtgaaccaagcgcgccaagctccacgcctaaagtatcttatcggggcagcccccattgcatatgggctacctgtgtcccttagatag

SEQ ID NO: 116471 - DNA, 1248 bp, Artificial Sequence
  Description of Artificial Sequence: Synthetic coding sequence
atggggaccaccgcgcgcgcagctctggttctaacataccttgccgtggcaagtgcagcaagtgagggcggcttcactgccacaggacagaggcagctgcgccctgagcattttcaggaggttgggtacgctgccccccccagtccaccactgtcacgcagcctgcccatggaccaccccgattcttctcagcacgggccacctttcgaggggcagagccaggtgcagcccccgccatcccaggaagcgacaccattgcagcaagagaaactgctacccgctcagctcccagcagagaaggaggtggggccccctctgccacaggaagccgtccccctgcagaaggaattgccctctctgcaacatcctaatgagcaaaaggagggaactcccgcaccctttggagaccagagccacccggagcctgagtcttggaacgcagcacagcactgccagcaagaccggagtcagggaggctggggacatcggctggatgggttcccacctggacggccatctcctgataacctgaatcaaatctgcctgcctaatcggcagcatgttgtctacggaccatggaacctcccccagtcatcttactcccatctcacacgtcaaggcgaaaccctaaatttcctggaaataggttacagccgctgctgccactgtcggagccacacaaataggttagagtgtgctaagctcgtctgggaggacacactggacaagtattgtgatcgcgagtatgccgtaaagacacaccaccacctatgctgtcggcacccaccctcaccaacaagagacgagtgttttgcccgtagggcaccttatccaaactatgatcgcgacatcttaacgatcgatatcggtcgagtgactccaaacctgatgggccacctttgtggcaatcagcgcgtcctgaccaagcataaacacattcccgggctaattcataacatgaccgccaggtgctgcgacctaccctttccagagcaggcctgttgtgctgaagaggagaaactcactttcattaacgatctttgcggcccccgaaggaacatatggcgcgatcctgccctgtgttgttatttatcccctggggacgagcaggtgaattgcttcaacatcaattacctacggaacgtagctctggtgtccggcgacacagaaaacgctaagggccagggcgagcagggatcgaccggaggcaccaatatctctagcaccagcgagccaaaggaggagtag

SEQ ID NO: 116472 - DNA, 1623 bp, Artificial Sequence
  Description of Artificial Sequence: Synthetic coding sequence
atgggcacaacagcccgggcagcattagtcctaacctacttggcagtggcttctgcggcctccgagggtggcttcacagccacaggccagcgacagctccgtccggagcatttccaggaagtcgggtatgccgctcctccaagcccccccttaagcagatccctgcctatggaccatcctgactcttcccagcacggcccacctttcgaaggccagagccaggtgcagcctcctccctcgcaggaagccactcctctgcagcaagaaaaactgctgcccgcccagctcccagccgaaaaggaagtcggcccgcccttaccccaagaagccgtccccctgcagaaggagcttccctccctacaacacccaaatgagcagaaggaggggactccagcaccatttggcgatcagtcgcatcctgagcccgagagttggaacgccgctcagcactgccagcaggaccgtagtcagggaggatggggtcatagattagatggcttcccacctggacggccttctccagacaacctgaaccaaatctgcctgcctaacagacagcatgtggtgtatggaccttggaatctgcctcagagtagttactcgcacttgaccagacagggcgagactcttaacttcctggaaattggatattctcggtgctgtcactgtcggtctcacaccaacagactcgaatgtgctaagcttgtgtgggaggaggcaatgagccgtttctgtgaagccgagtttagtgtaaaaacacgcccccactggtgttgcaccagacagggcgaagcaagattctcatgcttccaggaggaggccccccagccccattatcagctacgtgcctgtccgtcccatcagccggatatttcctctggcctagaactgccatttccccccggagttccaacgctggacaatatcaagaacatatgtcatttacgtaggtttaggtctgtgcctcggaacttaccagctacagatccactccagagggagctactggccttgatccagcttgagagggaatttcagcgttgttgccgccagggtaacaatcatacatgtacttggaaggcatgggaagatacactggacaagtattgtgaccgcgaatacgccgtgaagacccaccaccacttatgttgcaggcatccgccttcccctacccgtgacgagtgtttcgcaaggagggccccctacccgaattatgatagagatattctgactattgatattggaagggtgaccccaaacttgatgggacacctgtgcggcaatcagcgggtgttgactaagcataagcatattcccggcttaattcacaacatgactgcacggtgttgcgatctaccattccctgagcaggcatgctgcgctgaggaagagaagctgacctttataaatgatctatgtgggcctcgacgaaacatttggagagacccggccctgtgttgttacctgagtcctggagacgagcaggtgaattgtttcaacattaattacctgcgcaatgtggctttggtgtcaggtgatactgagaatgccaaaggccaaggagaacaaggctccaccggagggacgaatatatcctccacttctgagccaaaagaagaatag

SEQ ID NO: 116473 - DNA, 1704 bp, Artificial Sequence
  Description of Artificial Sequence: Synthetic coding sequence
atgggaaccaccgctcgcgctgccctggtcctcacataccttgcagttgcttccgccgcttcagagggcggattcaccgcgacgggacagagacagctgcgccctgagcacttccaagaagtcggatacgccgcccctccctccccccctctgagtcgtagtctgccaatggaccatcccgactctagtcagcatggaccacctttcgagggtcaatcggggaaggagggacgtggcccacgaccccattcacagccatggctaggcgaacgagtgggatgcagccacatcccacctagtatagtacagcccccccccagtcaggaggcaacaccgctccaacaggaaaagctgctgcctgcccaattgcccgcagagaaggaggtcggccctccgctgccccaggaagctgtaccgctccagaaggaactgccttccttgcagcatcctaatgagcaaaaggagggcactcccgcacccttcggagaccagagtcatccagagcccgaatcctggaacgccgcccaacactgccagcaggacagatcacagggcggctggggacatcgtctggacggttttcccccagggaggccctcacctgataatttgaaccagatttgcctacctaaccggcagcacgttgtgtatggcccttggaaccttccgcagagtagctacagccatttgaccaggcagggcgagactctgaattttttggagattggctattcaagatgttgtcactgtcgctcccatactaatcgcctcgaatgcgccaaacttgtatgggaagaggccatgagccgattctgcgaggctgagttttctgttaaaactcggccccactggtgttgcaccagacaaggagaggcaagattttcttgctttcaggaagaggctccccaaccgcactatcaactaagagcatgcccatcacaccaaccagacataagctcaggactcgagctcccatttccacctggggtacctaccttggataatataaagaatatatgtcatctacgtaggtttagaagtgtcccgagaaatctcccggctacagacccccttcagcgtgagctgctggcattaatccagttagagagagagttccagcggtgctgtcggcagggcaataatcacacctgcacctggaaggcttgggaggacactctggacaagtactgcgaccgtgagtatgccgtgaagacacaccaccatttatgctgtcgacatcccccgtcccccactagagacgagtgcttcgcccggcgggccccctacccaaattatgatcgcgacatcctgacaattgacattggccgagttacccctaacttgatggggcacctgtgcgggaatcagagagtcctgacaaagcacaagcacatccctggccttatccataacatgactgctcgctgttgtgacctcccatttcccgaacaagcgtgctgtgccgaggaagagaagttgacttttatcaatgacctctgtgggccacgccgtaatatatggcgcgacccagcgctgtgctgttacctgtctcccggagatgagcaggtcaactgttttaacatcaactacctgagaaacgtagcacttgtttcaggggacactgagaatgcaaagggccagggagaacaaggcagcactggaggcaccaacataagtagtacatctgaaccaaaagaagagtag

SEQ ID NO: 116474 - DNA, 2100 bp, Artificial Sequence
  Description of Artificial Sequence: Synthetic coding sequence
atgaagatcgctgttctgttttgttttttccttctcatcatcttccagacggatttcggtaagaatgaagaaattcccagaaagcaacggagaaaaatctatcatcggcggctgagaaagtcctcaaccagtcacaagcatagaagcaaccggcagttaggcattcagcagactaccgtcttcacacccgtggcaagattgcccattgtcaattttgattatagtatggaagagaagtttgagtcattttcgtcctttcctggagtagaatcttcctacaatgtattaccaggaaagaaggggcactgcttggtcaaggggatcactatgtacaataaggccgtatggagccccgaaccgtgtaccacgtgtctatgttctgacggtcgggtactatgtgatgagaccatgtgccacccgcagaggtgcccccagacagtaattcccgaaggggagtgctgtcctgtgtgttccgcaaccgtttcttattccctcttgtccggtattgccctaaatgatcgtaacgagttctctggcgactccagcgaacaaagggaacccacaaatctgctgcataagcagctccctcctccacaggtggggatggaccggatagtcagaaaagaggccctgcaatcagaagaagacgaggaggtgaaggaggaagacacagagcagaaacgagaaaccccagagagtaggaatcaaggtcagctttattccgaaggagattcaagagggggcgatagaaaacaacgcccaggggaagaaaggcggctggcccatcagcaacaacgccaaggccgggaggaggaggaagacgaggaagaagaaggagaagagggcgaagaggatgaggaagatgaggaggatcctgtacggggcgacatgtttagaatgccctcacgcagccccttgcccgccccaccaaggggaaccctgcgactgccctctggctgctccttgagttaccgaactatttcctgcattaacgccatgctcactcagatccctcctctcactgctcctcagatcacaagccttgaactgacggggaactctatcgctagcatcccagacgaggcatttaacgggcttcctaatctggaaaggctggatctctccaagaataacatcaccagcagcgggatagggccaaaagccttcaaactgctgaaaaagctgatgaggttgaacatggacggaaacaacctgatccagatcccaagtcaactcccctccaccctggaagaactgaaggtaaacgagaataatttgcaggctatcgatgaagagagccttagcgacctgaaccagctcgtgaccctagaactcgagggcaataacctttccgaagccaacgtcaatcctctcgcattcaaacccctaaagagccttgcctacctgcgactaggtaaaaacaaatttcgaatcatccctcagggtttacccggtagtatagaggaactttacctagagaacaatcaaatcgaagagattactgaaatttgttttaaccacactcggaagatcaatgtgatcgtgctccgctacaacaagatcgaggagaatagaattgcccccctggcctggattaatcaggagaacctagagtccattgatttgagttacaataaactgtaccatgtccctagttatctcccaaagtccctccttcaccttgtgcttctgggcaaccaaatagagcggatcccaggatatgttttcggccacatggagcctggattggagtacctctacctatctttcaacaagctggccgacgacggaatggacagagtgagcttctatggggcctatcactcgcttcgcgagctctttctagaccataatgatctgaagtctattccgcccggaattcaggagatgaaggcccttcattttcttagactcaacaacaataagatccggaatattctaccggaagagatttgtaatgctgaagaagatgacgatagcaacttagagcacctgcacctggagaataattacatcaagatcagagaaatcccatcctacacttttagttgtatccgctcgtacagcagtatcgtactcaaacctcaaaatatcaagtag

SEQ ID NO: 116475 - DNA, 495 bp, Artificial Sequence
  Description of Artificial Sequence: Synthetic coding sequence
atgaagattgcagtgctgttctgcttctttctcctcattatttttcagactgattttggaaagaacgaggagattcctcgcaagcagagaagaaaaatttatcatcgccgcctgcgaaagtcttccacctcccacaagcatcgcagcaacaggcagctcggcatccagcagaccactgtattcacccctgtggcacgtctgcccatagtgaacttcgactatagtatggaagagaagtttgagtctttctctagcttccctggtgttgaaagttcatataacgtgttgccaggaaaaaagggccactgcttggttaagggcatcacaatgtataataaagcggtctggagcccagagccatgtaccacctgtctctgtagcgacggacgagtcctgtgcgatgagacaatgtgccacccgcaaaggtgtccacagaccgtgattcctgagggcgaatgctgccctgtctgctccgccactggcacggagatttag

SEQ ID NO: 116476 - DNA, 483 bp, Artificial Sequence
  Description of Artificial Sequence: Synthetic coding sequence
atgaaaatcgctgtgcttttctgcttcttcctccttattatcttccagactgatttcgggaaaaatgaggaaatacccagaaagcagaggagaaagatctaccatcgccgcctacggaaatcatccacctcccataagcacagaagcaaccgtcagctaggcattcagcaaacgacggtttttacgcccgttgccagactaccaatcgtcaacttcgactattcaatggaggaaaagtttgagtcctttagcagcttccctggagttgaaagttcctataatgtcttgccaggtaagaaaggtcattgcctggttaagggaatcactatgtacaacaaagcggtttggagccccgaaccatgcaccacctgtctgtgctctgacggcagagtgttgtgcgacgagaccatgtgtcatccacaacggtgcccccaaacagtgatccccgaaggtgagtgctgtcctgtgtgtagtgcaacatag

SEQ ID NO: 116477 - DNA, 1932 bp, Artificial Sequence
  Description of Artificial Sequence: Synthetic coding sequence
atgaaaatagccgtgcttttttgtttcttcctgttgatcatttttcaaacagattttggaaagaatgaggagatcccgcgcaagcaacggaggaagatataccaccggcgtctgcggaaatcctcgacctcccacaaacaccgctctaatcgccagctgggcattcagcagaccactgtctttaccccggttgcacggctgcccatagtgaactttgactatagcatggaagagaaattcgaaagcttctcgagctttcccggcgtggagagttcctacaacgtactgccaggcaagaagggtcattgcctcgttaaagggatcaccatgtataacaaggccgtttggtctccagaaccttgcacaacatgtctttgtagcgatggaagagtactgtgcgacgaaaccatgtgccaccctcagaggtgccctcagacagtgatcccggagggagagtgttgcccagtttgctctgccaccgagcagcgcgaaccaaccaaccttctccataaacagctgccacctccacaagtgggcatggatcggatcgtgagaaaagaagccctgcagagcgaagaggacgaggaggttaaggaagaggataccgagcagaaaagggaaacaccagagagtcgtaaccaaggccagctatactcagaaggggacagtagaggcggagaccgtaaacagcggcctggagaggagagaaggctggcccaccagcagcagaggcagggccgtgaggaagaggaggacgaggaggaagaaggcgaagagggagaagaggacgaggaagacgaggaagacccggtgcgcggggacatgttccgtatgccgtctcgctccccgctgcccgcccctccaaggggtacgttgcgattaccaagcggctgctctctgtcttacagaaccatatcgtgcatcaatgcaatgctgacacaaatccccccccttacggctcctcaaattacatctttggagctgacgggtaatagcattgcctcaatccccgacgaggcttttaatggcctgccaaacctggaacggctcgacctttccaagaataatatcacctcctcaggaataggcccaaaggcctttaagctgcttaagaaactgatgaggcttaatatggatgggaataacctcattcagatcccttcccagctgccatccacactagaagagctcaaagtgaatgagaacaatctccaagccatcgacgaagaatccctgtctgatttaaaccagctggtgactctggagctcgaaggaaacaatctgagcgaagccaatgttaaccctctggctttcaagccattgaaatctttagcatatctccgccttggcaagaataagttcaggattatccctcagggccttccggggagtatcgaggagctgtatctggaaaacaaccagattgaggagattacagagatctgtttcaatcacaccaggaaaattaatgtgattgtccttagatacaataagatcgaagaaaacagaatcgccccattggcctggattaaccaggagaatctggaatctattgaccttagctacaacaagttgtatcacgtccctagctacctccccaagtctctccttcacctagtgttactcggcaatcagatcgaacgtatcccggggtacgtgttcggacacatggagcccggcctggaatatctttatcttagcttcaacaagcttgcggatgacgggatggaccgagtatccttttatggcgcatatcattctctgagagagctgttcctggaccacaatgacctgaaatcaattccccccgggatacaggagatgaaggcgctacacttcttacggctaaacaacaataagatacgttgcgtgagtgatgccgtacttgagaccgtgactaatagaagcgatgtggcctttcccctgtggtag

SEQ ID NO: 116478 - DNA, 1779 bp, Artificial Sequence
  Description of Artificial Sequence: Synthetic coding sequence
atggagatgcaggacctgaccagtccccactccagactgtctggtagctccgagagcccatccggccctaagctcggcaattctcatattaactcaaactctatgaccccaaacggaaccgaggtgaaaacggagccaatgagctcctccgaaactgcaagcacaactgccgacggtagcctgaataacttctcgggaagtgcaatcggctcaagctcgttctctcccagacccacccaccaattctctcccccacagatctacccttcaaacaggccttacccgcatatattgccgacgccttctagccagactatggcagcctatggccagacgcagttcaccacaggaatgcaacaagccacagcatacgctacctacccacagcccggacagccctatgggatcagttcttatggtgcgctctgggctggaatcaagactgagggggggctatctcaaagccagtcaccaggacagaccgggtttctgtcatatggcacttccttcagcacccctcagcctggacaggctccctactcttatcagatgcagggctcttccttcacgacaagtagcggcatctacactggcaacaatagcctcactaactcatccggcttcaatagctctcaacaggactaccccagctacccttcattcggtcagggtcaatatgcccagtactacaactcttccccttatcccgctcattacatgacatcatcgaacacctcaccaaccacacctagtaccaacgccacgtaccaactccaggagccaccatccggcattacgagtcaagcggttacagaccctactgctgaatattccaccattcattcaccttcaacccctatcaaggatagcgatagtgatcggttacgtcgcggctccgatggcaaaagtagaggccgcggccgtcggaacaataatccttcccccccaccagattcagacctggaaagagtgtttatttgggatcttgacgaaaccataatagtgttccacagcttgttaaccggatcctacgccaaccgatatggtcgggatccacccacctctgtgagcctggggctgcgcatggaagaaatgatatttaatttagccgacacccatcttttttttaacgacctggaagagtgcgaccaggtgcacattgatgacgtgagctctgacgataacggtcaggacctcagcacatataactttggtaccgatggattccctgccgcagctacatctgccaatctctgtctggctactggagtgcggggtggcgtagattggatgaggaagctcgcttttcgatacagacgggtaaaagaaatttataacacttataaaaataatgtgggcggcctcctaggacccgcaaagcgggaggcgtggttacaactgagggcagaaattgaggccttgacagattcctggctaactctcgccttgaaggcactgtctctcatacacagtagaacaaattgcgtgaacattctcgtcaccaccacccagctgataccagccctggcaaaggtactgctttacggactgggcatcgtcttccctattgaaaacatttacagcgctactaaaatcgggaaagaatcgtgcttcgagcgaatcattcaacggtttggacgcaaggtggtctatgtggttattggagatggagttgaagaagaacaaggtgccaaaaagcacgccatgccgttctggcgcatttccagccacagcgatctgatggctctgcaccacgctttagagctcgagtacctctag

SEQ ID NO: 116479 - DNA, 1680 bp, Artificial Sequence
  Description of Artificial Sequence: Synthetic coding sequence
atgctcctgtttccccaggtggccgttaagacagagcctatgtccagttccgagacagcaagtactacagccgacggtagtctaaacaatttctcaggtagcgccatcggatcatcaagcttttcgcctcggccaactcaccagtttagtcctccgcagatttaccccagcaacaggccatatccacacattctgcctaccccctcctctcagaccatggccgcatacggtcaaacccagttcacgacagggatgcaacaggcaactgcttacgccacttaccctcagcccggacagccatatgggatttccagctatggagctctctgggccggcattaaaacagaaggtggcctgagccagtcccagagccctggccagacagggttcttatcttacggaacttcattctctacccctcaacccggccaggccccttatagctaccagatgcaaggatcctcctttaccacttctagcggtatctatacaggcaataattctctgaccaactcctccggcttcaactcaagccagcaggattacccgtcttaccccagttttggtcagggtcagtatgcacagtattacaacagttccccctatcctgcccactacatgaccagctccaatacaagccctacaacccctagtactaacgccacataccagttgcaagagcccccatcaggcataacgagtcaagccgttaccgaccccaccgctgaatattctactatccattcaccatcaacgcccatcaaagactcagactccgatagactacgacgaggtagcgatggcaaatctaggggccgtgggagacgaaacaataacccttcaccacctccagattccgacctcgagagggtattcatttgggacctggacgagactatcatagtctttcactctttacttacaggcagctacgcaaatcggtatggaagggacccacctacatccgtctccctgggtctgcgaatggaggaaatgatatttaatctcgctgacacacacctcttcttcaacgatttggaagagtgcgatcaggtgcatatagatgacgtcagtagcgatgataacgggcaggatctgtcgacctacaattttggcacagatggcttcccagccgctgccacttcggcaaacctctgcctcgcgaccggggtccgggggggtgtagactggatgagaaagctggcatttcggtatcgaagggttaaagagatatacaacacgtataagaataacgtggggggtttactgggaccagctaagagggaagcctggctccagttgagggcagagatcgaggctttaaccgatagttggttgaccctcgcacttaaagccctgtcactaatccatagcagaactaactgtgtcaacattctggtcaccacaacccagttaatacctgcattggccaaggtgttattgtatgggctgggtatcgtgttccctatcgaaaatatttactcggccaccaagatcgggaaagaaagctgttttgagcgtatcatccaaaggttcggcagaaaagttgtctatgtagtgataggcgatggcgtcgaagaagagcagggggccaaaaaacatgctatgcctttctggcgcatttcttctcatagcgacctgatggctcttcaccacgccctcgagctggaatacctctag

SEQ ID NO: 116480 - DNA, 1779 bp, Artificial Sequence
  Description of Artificial Sequence: Synthetic coding sequence
atggaaatgcaggatctaacctcacctcatagtcgcttatcgggttccagcgagtccccctccggaccaaaactggggaatagccacataaactctaattctatgacacctaacggaactgaagtgaagaccgaacccatgtcttccagcgaaaccgcctctacaaccgcggatggcagtctgaacaacttcagcggaagtgccattgggtccagctccttttcaccacgaccaacccatcagttttctccccctcagatctatccaagcaataggccgtatccacatattctgccaacccccagctcccagaccatggccgcctacggacaaactcagtttaccaccggcatgcagcaagccacagcatatgccacttacccacagccaggccagccctacgggataagcagttatggagccctctgggccggcattaaaactgagggaggactctcacagagtcagagtcctggccagacggggtttctgtcatatggcacctcttttagcacaccccagcctggccaagccccttactcataccagatgcaaggatcatcgttcaccacatcgtccggaatctacacaggaaataacagtctgaccaattccagcggtttcaattcatctcagcaagattaccctagttaccccagtttcggacagggccaatatgctcagtactataatagcagcccctatccagcccactatatgactagttccaatacaagtcccacaactccgtccaccaatgcaacataccagctgcaggagcccccctctgggattacctcacaggccgtgaccgaccccacagcagagtacagtaccattcacagcccctctacacccattaaggacagtgattcagaccggctccggagggggtctgacggcaagtcccgcggaagaggaagaagaaacaacaatccgtctccaccgccagacagcgacctcgaaagggtcttcatttgggatctggacgagactatcattgttttccatagtcttctcactggatcctacgcgaacagatacgggcgggatccacccacaagcgttagcctcggactccggatggaagagatgatctttaacctggccgacacacacctcttcttcaacgatctagaggagtgtgaccaggtccacattgacgatgtgagctccgacgacaacgggcaggatctgtccacctataacttcggcacggatggcttcccggcagctgcaacctctgctaacctgtgcctcgccacaggcgttcggggtggcgtggactggatgcggaaactggcctttaggtaccgccgggtgaaggaaatctataacacatacaaaaacaatgtgggcggcctgttgggtcccgccaaaagagaggcctggcttcagctgagagctgaaatagaggctctcactgatagctggctcactctggccctgaaggcactgtctctgatccatagccgcacaaattgtgtgaatatcctggtcaccaccacccaactcattccggcactcgcgaaggtgctgttgtatggcttgggcattgttttcccgatcgaaaatatctatagcgccacaaagataggaaaagaatcttgttttgaacggattatccagcgctttggaagaaaggtcgtgtacgtagtcataggcgatggagttgaagaggagcagggggccaagaagcacgccatgcccttttggcggataagcagtcattctgatctgatggcgttgcaccatgctttggaactggagtacctctag

SEQ ID NO: 116481 - DNA, 1683 bp, Artificial Sequence
  Description of Artificial Sequence: Synthetic coding sequence
atgctgatgatctacgtgcagttagtggtgaagaccgaacctatgtcttcttcagagacagccagcaccacagccgatgggtctcttaataacttctctggctccgcaatcggaagctcatcattcagcccccggcctactcaccaattttcacctccccagatatacccttccaaccgcccatatccccacatcctgccgaccccgtctagccagacgatggcagcctacggccagacccagttcaccaccggtatgcagcaagctacagcctatgcaacatatcctcagccaggccagccgtatgggattagtagctatggcgccctgtgggcagggatcaagaccgagggaggactctcccagtctcaaagccccgggcagacaggcttcttgagctatgggacctccttcagcaccccacagcccggccaggccccttactcataccaaatgcaaggatcctccttcactacttccagtgggatctatacagggaacaactctctcactaatagttctgggtttaattcatcccagcaggattatccaagttatccaagcttcggccaggggcaatatgcgcagtactacaacagttctccttatcctgcccattacatgacctccagcaatacatcacctactacaccatccactaatgcaacttatcagttgcaggaacctccctccgggattacaagccaagcggtgacagaccctactgccgagtattctacaatccatagtccatcaacccctataaaggattccgactcagatagactgcggcgggggagcgatggcaaatccaggggcagaggccgcaggaataacaatccttctccccccccagactctgaccttgagcgcgtgttcatttgggacctggatgagaccattatcgtctttcacagtctgctgacgggctcatacgctaaccgctatggtcgggacccgccaacctctgtctcgctcggtctgagaatggaagagatgatatttaatttggccgacactcacctcttcttcaatgaccttgaggagtgtgaccaggtccacattgacgacgtgagttcggatgacaatggacaagacctcagcacatataatttcggcacagatggattccccgctgccgccacatccgctaatctgtgtctggcgaccggagttcggggcggcgttgactggatgagaaaactggccttcaggtacaggagagtgaaggagatttataacacttacaagaacaatgttggtggactgctgggtcccgcaaaacgcgaagcctggctgcagctgagggccgagattgaggcgctgactgatagttggttgacccttgctctgaaggctctgtccttaattcattcacggacaaattgtgtcaacatcctggtgacgacgacccaactcatccccgccttggccaaggtgttattgtatgggctcggcatcgtgttccccatcgaaaacatctactctgccactaaaatcgggaaagagagttgcttcgagcgtatcatccagaggtttgggcggaaggtcgtgtacgtggtcataggagacggtgtcgaagaagagcaaggcgccaagaaacatgccatgccattctggcggatatcatctcattccgacctaatggcactgcatcatgcccttgaactggaatatctctag

SEQ ID NO: 116482 - DNA, 1674 bp, Artificial Sequence
  Description of Artificial Sequence: Synthetic coding sequence
atggagatgcaagacctgacaagcccacatagccggctgtcaggcagcagtgagtccccgtctgggcccaaacttggaaattctcatattaattctaattctatgacaccaaacggaaccgaggtaaagacagaacccatgtcctcctccgagacagcaagtactaccgccgatggctctttgaataacttctctggctctgcaataggaagctcatcattctcaccaaggcctacacaccagttctctcccccacagatttacccgtccaaccggccttacccacatatcctccccaccccatcatcgcagacaatggcagcctatggtcagacccagtttaccaccggtatgcagcaggccacagcttacgcaacgtaccctcagcctggacagccatacggtatcagctcttacggcatcaagacagagggggggctttcccagtcacagtcaccaggccaaaccggattcttatcgtacgggaccagtttctccacaccacaacccggacaggccccctattcttatcaaatgcaaggcagcagtttcaccactagctccggcatatatactgggaataactctttgacgaatagttccgggttcaacagttctcagcaagattatccctcttatccttctttcggacaggggcagtatgctcagtattataactccagtccctaccccgcccactatatgaccagttctaatacatcacctaccacgccctcgactaatgcaacctaccagttacaggaacccccttccggcatcactagtcaggcagtgaccgacccaactgccgaatattcgacgattcactccccctctactccaataaaggactcagattccgataggctgagacgtggttccgacggaaagagcagaggacgcggcagaagaaacaataatccctcgcccccgcccgactccgatttggagcgggttttcatctgggaccttgacgagactatcatcgtctttcactcgttactcaccggcagctatgcgaacagatatgggagggaatgtgaccaagtgcatattgacgacgtgtcatctgacgacaatggccaggacctgtcgacatataattttgggactgatggcttccctgctgcggctacgtccgccaacctgtgcttagcaacaggcgttcgggggggggtggactggatgcggaagctggcttttcggtataggcgcgtgaaggagatctacaacacatataaaaacaacgttgggggtttacttggccctgccaagcgcgaggcctggctgcagctgcgcgccgaaatcgaagcattgacagactcctggctgacactggcccttaaggcgctcagtctgatccactcaagaacgaattgtgttaatatactcgtcaccaccacacagctgatacctgctctggcaaaagttttgttatacggactcgggatagtttttcctatagagaacatttattctgccacaaagattgggaaagaatcatgttttgaacgaatcatccagcgttttggtcggaaggtggtgtacgtagtcattggagacggggttgaggaagagcagggggccaaaaagcatgccatgcccttttggagaattagctcccacagtgacttgatggctctccaccacgctctcgagctagagtacctatag

SEQ ID NO: 116483 - DNA, 1527 bp, Artificial Sequence
  Description of Artificial Sequence: Synthetic coding sequence
atggtcgaactggtaatctccccctcactgaccgtgaactccgattgcctggacaagctgaaattcaatcgcgccgatgcggccgtgtggactctctccgatagacaggggattactaagtctgctccattgagggtgagtcagctgtttagccgatcctgtcccagggtcctcccccgccagccctccaccgcaatggcagcatacgggcagacccagtacagtgccgggattcagcaggccaccccctataccgcttacccacctccggcacaagcctacggtatcccctcgtatagtataaaaaccgaggatagtctgaaccattccccaggtcaaagcggctttctttcctacggctcgagcttctccacatcacctacaggccaatcgccctatacctatcagatgcacggtaccacaggcttttatcagggtggcaacggtctcggaaacgctgctggattcggatccgttcatcaagactacccaagctatcccgggtttcctcagagccagtacccacaatactatggctcttcttataatcccccatatgtccctgcatcttccatctgcccctcccccctgtccacaagcacttatgttttgcaggaggccagtcataacgtgccaaaccagtcttctgagtccctcgctggcgaatacaacacccacaacgggccgagtactcccgcaaaagaaggtgacacagaccggcctcaccgggcctctgacgggaaactgaggggccgctccaagcggtctagcgaccctagccccgccggcgacaatgaaattgaacgcgtcttcgtctgggaccttgacgaaactatcatcatctttcactctctgctgacggggacttttgcctcccgttatggtaaagactgcgaccaaattcatgtggacgacgtgagcagcgatgataatggccaggatttgtctacttataatttcagtgctgatggattccacagttctgcgccaggagcgaatctttgtctggggagcggtgtgcatggaggcgttgactggatgagaaagctcgcattcaggtatcgccgggtcaaggagatgtacaacacctataagaacaatgtgggcggtctgattggaactcctaagcgcgagacctggttacagctccgtgcggagctggaagcactcaccgacctatggcttacccactccctgaaagctctgaatctgatcaattctcgtccaaattgtgtaaacgtcttagttactacaactcagctgatacctgctctcgctaaagtcctgctttacgggctcggttcagtattccctatagaaaatatatatagcgcgaccaaaacagggaaggagagttgtttcgagcggattatgcagcgcttcggaaggaaggccgtgtatgtcgtgatcggtgatggagtggaagaggaacaaggggccaagaagcataacatgcccttctggcggatatcttgccatgcagacctcgaagccctgcgacatgccctggagctggaatatctttag

SEQ ID NO: 116484 - DNA, 1617 bp, Artificial Sequence
  Description of Artificial Sequence: Synthetic coding sequence
atggtggagctggtgatctcacccagccttaccgtgaactcggactgtttggataaactgaaattcaaccgtgcagatgctgccgtgtggacactgtcagatcgacagggcatcacaaagagcgccccattgcgagtctcccaattgttctcccgaagttgccctagagttttaccgcgccaaccatccacagctatggcagcttacggccagacccagtactccgcgggcatccaacaggcgactccctacactgcttatccaccacctgctcaggcatatgggatccctagttacagcattaagaccgaagatagcctgaaccacagccctggccagtcagggttcctgagttatggaagttctttttccacaagcccaactggacagtccccatacacataccagatgcacggtactacaggattctatcagggtggtaacgggctaggcaatgctgctggtttcggatccgttcaccaggactacccttcttatcctgggtttcctcagagccagtatccacagtactacgggtcatcctacaacccaccctacgtgcccgcttctagtatttgtccaagcccactgagtacgagcacgtatgtcctgcaggaagcttcccacaacgttccgaatcagtctagtgagtcacttgcgggggagtacaatacacacaatggacctagcacaccggcgaaggagggggacacggataggccacaccgtgcgtccgatggcaagctacgggggcggtccaagagatcttcagatccatctcccgccggtgataatgaaattgagagggtcttcgtttgggacctggacgagactattatcatttttcacagcctgctgactgggactttcgcatcaaggtatggcaaagacacgacaacaagtgttcggattggtctaatgatggaggagatgatatttaacctcgccgacactcacctgttctttaacgacctcgaggattgtgaccagatccatgtagatgatgtaagctccgacgataacggacaggatctgagcacttacaatttttctgcagatgggttccatagtagcgctccgggggctaatctttgcttggggagcggcgtgcatgggggtgttgattggatgcgtaagttggcattccgctatcgacgcgtaaaagaaatgtacaatacctacaaaaacaatgtggggggtctgattggcaccccaaagagagagacttggctccaactgagagcggagttggaggctctcacagacctgtggctgacacatagtctcaaggctctcaacctgatcaactctcggcccaattgcgtcaacgtccttgtcacaacgacccagttaattcctgctcttgccaaggtactgctatacggactcggtagcgtttttcctattgagaacatatattcagcaaccaagacaggaaaggagagctgtttcgaaaggataatgcagaggtttggtcgaaaggctgtgtacgttgtgattggagacggggttgaagaagaacagggcgccaagaagcacaacatgcccttctggagaatatcctgccacgctgacctcgaagctctcaggcacgccctagagttagaatacctctag

SEQ ID NO: 116485 - DNA, 1380 bp, Artificial Sequence
  Description of Artificial Sequence: Synthetic coding sequence
atggtcgagctcgtgatatcccctagtctgaccgtgaactcggactgtctggataaattgaagttcaacagagcagacgcggccgtctggacactatcagacaggcagggtatcactaagagcgccccactgagggtttcacagttgttctctagatcctgtcctcgcgtgctcccgaggcagccttctaccgccatggccgcatacggacagacacaatacagtgccggcatccagcaagcaacaccctacactgcctacccacccccagcgcaggcctacggaatcccctcttattccattaaaacagaggactccctgaaccactcaccagggcagagtggcttcctgagctacgggagctcattttctacttctccgacaggtcagagtccctatacctatcagatgcatggaactacaggattttaccagggagggaatggcctgggtaatgccgcagggttcggttcagtccatcaggactaccctagttatccaggctttccacagagtcaatatccccagtactacggctcctcctataaccctccttacgtgcccgctagttcaatttgtccctctcctttgtcaacatcaacttatgtactacaagaggcaagccataacgtgcccaaccagagttctgaatcgcttgccggggaatacaacacacacaacgggccctctactcccgcaaaggaaggcgataccgaccggccccatcgcgcttccgatggaaaactccggggcaggagcaaacgttcaagcgatccatcacctgctggagataatgaaattgaacgggtgttcgtgtgggacttggatgaaacaataatcatctttcattcgttactgaccggaactttcgcaagcaggtatggaaaggacacaactacaagcgtacgcatcggcctcatgatggaggaaatgattttcaacttggccgatacacacttgttcttcaatgacttggaagattgtgatcaaatccacgtagatgacgtgagctcagatgataacggccaggatctctctacttataacttctcagccgacgggttccatagcagtgctcccggcgctaacttgtgcttgggctctggcgtccacggtggagtcgattggatgcgaaagctggcctttagatatcgtagggtcaaagagatgtacaatacctataaaaacaacgtggggggcaaagagagctgcttcgagaggattatgcagcggtttggaagaaaggcagtttatgtggtgatcggcgacggggtcgaggaggaacagggggctaaaaaacataatatgcctttctggaggatcagctgccatgccgatctggaggccctcaggcatgcactagaattggaatacctgtag

SEQ ID NO: 116486 - DNA, 1527 bp, Artificial Sequence
  Description of Artificial Sequence: Synthetic coding sequence
atggtggaactggtcatcagcccctccctcacagtgaactccgactgcttagacaagttgaaatttaatagggctgatgccgccgtatggacactctccgacaggcaaggaataaccaagtccgccccgctaagagttagccagctgttcagtcgcagttgccctcgagtactgccaaggcagccgagcacagcgatggctgcctacgggcagactcagtactctgctggaatacagcaggcaacaccatacacagcatatccaccccccgcgcaagcctacgggattccctcctattccattaaaacggaagactcactcaatcactcgcccggccagtccggatttctctcatacgggtcatccttcagtactagccctacaggccagagtccatacacctatcagatgcatggcaccacaggattttatcaaggagggaacggcctggggaatgctgccggattcgggagtgttcatcaagattatccatcttaccccggcttcccccagtcacagtatccacagtactacgggagcagttataatcctccatacgtgcctgccagttctatctgtccttcccccctctccacctctacttatgtgctgcaggaggcttcccacaatgttcctaatcagtccagcgagtctctggctggagagtacaacacccataatggaccgtccacacccgccaaagagggagatacagatcgcccgcatagggcctcagacggaaagctgcggggccgcagtaaaaggtcttctgatcccagcccagctggggataatgagatcgagagagtttttgtgtgggatctggatgagacgattataatctttcacagcttgttgaccggcacgttcgcttcgcggtatgggaaagactgtgaccagatccatgttgatgacgttagtagtgatgacaacggccaagatcttagtacttataactttagcgccgacggtttccatagttcggcacccggagccaatctgtgcctggggtctggagtgcacgggggagtcgactggatgagaaagctcgcgtttcggtaccgccgcgtcaaggagatgtacaacacatacaaaaacaacgtgggcggactgataggaacacctaagcgggaaacttggttacagctccgcgccgaattggaagcgctcaccgatctgtggctgacacattccctcaaggccctaaacctgatcaattctcgtcagaattgtgtcaacgtactggttactactactcaactcatccctgccctcgccaaggttctgctgtatggccttgggtcggtgtttccgattgagaacatttactccgccactaagacaggcaaggagagctgcttcgaaaggatcatgcaacgatttggtagaaaagcagtttacgtcgtgattggcgacggtgttgaggaagagcagggagctaaaaagcataatatgcccttttggcggatctcgtgccatgcagacttggaagctctgcgtcacgcactggagttggagtatctgtag

SEQ ID NO: 116487 - DNA, 1611 bp, Artificial Sequence
  Description of Artificial Sequence: Synthetic coding sequence
atggaggaagagcaagatctgccggagcaacctgtgaagaaggccaagatgcaggaatccggagagcagacaatttcccaggtttccaacccagatgtctctgatcagaagcctgaaacaagcagtctggcctcaaaccttcccatgtctgaagaaatcatgacatgcaccgattatatcccaagaagtagcaacgattacacctctcagatgtactctgcgaaaccatacgcccacatcctgtccgttcctgtgtccgagacagcctatccaggacagactcaatatcagactcttcagcagacacagccctacgctgtttaccctcaggctactcaaacctacgggctgcccccctttgcaagttctactaatgctagcctcatatcaacatctagcaccatagccaatattccagccgccgccgttgcaagtatcagcaaccaggactatcccacatatactatcctagggcagaatcaatatcaggcctgttatccaagctccagcttcggcgtgaccggccaaactaactcggacgcggaaagtacaacactggctgcaaccacatatcagtccgagaagcccagtgtcatggcccctgcacccgccgcgcagcgcctgtcaagcggtgatcccagtacctcccccagcctcagccagacaactccgagcaaggatacagatgaccagtcacgaaaaaacatgacaagtaagaatagagggaaaaggaaggcagacgccacctcctctcaggacagcgagctggagcgcgtgtttctgtgggacctagacgagacgatcattatattccattccctcctgactggatcttacgcacagaaatatgggaaagaccctactgttgtgataggctctgggcttaccatggaagagatgatcttcgaggtggcagacacacacctcttcttcaacgatctcgaggagtgcgatcaggtccacgtggaagacgtcgctagcgatgataatggacaggacctcagcaactatagcttctctactgacggtttttccggctccgggggaagcggtagtcacggatcctcggtcggagttcaggggggtgtggattggatgcggaaactagccttccgctatcgtaaggttagggagatctacgacaaacacaaatccaacgtcgggggattgctgagtccccagcgcaaggaagctctgcagcgtttgagggcagaaatcgaggtccttacggacagttggctaggaaccgccttgaaaagtctactcctcatccagtctagaaagaattgtgtcaacgtactcatcaccactactcagctggtcccagccctcgctaaggtactgctgtacgggttgggagaaatttttcccatcgaaaacatctactccgcgactaagataggcaaggagagttgtttcgagcgcatcgtttcacggttcggcaagaaagtgacctatgtggtgatcggggacggacgcgacgaagagattgccgcgaagcagcagctgtatttcctggacatggaggcactgggctgccagcttgagcctactgctctgattctgtttatccagctgtctggaaatctgtccaactacaataagctttag

SEQ ID NO: 116488 - DNA, 1251 bp, Artificial Sequence
  Description of Artificial Sequence: Synthetic coding sequence
atgataattcctcataagtgtatactccagactagttccaccaatgcctccctcatctctactagtagcaccatcgcaaatatcccagccgccgccgtggccagcatttcgaatcaggattaccccacttacaccatccttggacagaatcaatatcaggcctgttacccttcctcttccttcggcgtgaccggtcagactaatagcgacgctgagagtaccacgctggcggctaccacataccaaagtgaaaagccttcagtcatggcaccagctcccgcagcacaacgtctgagctctgacccatcgacaagtccaagtctgtcacagaccaccccatccaaagatacagatgatcagagccggaaaaacatgacttcaaagaatagaggcaagagaaaagccgacgccacatcttctcaggatagcgagctcgagcgagtgtttttgtgggacctagacgagacaattattatttttcactcactgctgaccggcagctacgctcaaaagtatgggaaagaccccaccgtggtaattggttctggtcttacaatggaggagatgatcttcgaagtcgctgacacgcacctcttcttcaacgatctagaagaatgtgaccaagtccacgtggaggatgtcgcaagtgacgacaatggccaggatttatcgaattatagctttagtactgacggattctctgggtctgggggatcaggatcacacggcagctctgtcggagttcaggggggagtggattggatgaggaagctcgccttccgctacaggaaggtgcgggaaatctacgacaagcataagagcaacgtgggcggcttgttgtcaccacagcggaaggaagcactccagcgcttaagagcagagattgaggttctcactgatagctggctgggcacagctctgaagtccttgctgctcattcagtctcggaaaaactgcgtaaatgttttgatcactaccactcagcttgtaccagccttagcaaaggtcctgctctatggactgggcgaaatttttccaattgagaacatatactccgccactaagattggaaaagaatcctgcttcgagcggatagtttcacggttcgggaagaaagtgacatatgtagtgatcggtgacggacgtgatgaggagatcgctgctaaacaacacaatatgcctttttggaggattaccaatcatggcgaccttgtatcattgcaccaggccctagagttggacttcctttag

SEQ ID NO: 116489 - DNA, 1722 bp, Artificial Sequence
  Description of Artificial Sequence: Synthetic coding sequence
atggaagaggagcaggaccttccagaacagcccgtcaagaaagccaagatgcaggaaagcggagagcagaccatttcccaggttagcaaccccgacgtgtctgatcaaaagcccgagacatcctccctggcttcaaatcttccaatgtctgaggaaattatgacttgcactgattatatacctcggtcgagcaacgattatacctctcagatgtacagcgctaagccttatgcccatattctgagcgtccccgtttccgagaccgcataccccggacagacccagtatcagacacttcagcaaacacaaccttacgcagtgtaccctcaggcaacccagacttacggtctgcctcccttcggagcgctctggcccggcatgaaaccagaaagtggcctaattcagacaccttctccgtctcagcactcagtgctgacctgcacaaccggtctgactacctcccaaccatcacccgctcactattcttacccaatccaggccagttcaaccaatgcatctttaatcagcacatccagtaccatcgccaacatcccagctgctgccgttgcatctatctccaatcaggattatccaacatataccatcctgggacagaaccagtatcaggcctgttacccctccagcagctttggggtgacagggcagactaattctgacgccgagtctaccaccctggccgccacaacctatcagagcgagaagccatccgtgatggcccctgctcctgctgcgcagaggctcagctcaggagacccatccacatctccttctctgagccagaccacaccatcaaaagatactgacgaccaatctaggaagaatatgaccagcaaaaatcgggggaagcgcaaagcagatgcaaccagctcccaggattcagagctggagcgagtcttcctttgggacctggacgagaccataatcatttttcactcattacttacgggctcttacgctcaaaagtacggcaaggaccctaccgtggtaattggttccgggctcaccatggaggagatgatttttgaggtggctgatacccacctcttttttaacgacctggaagagtgcgatcaggtccacgtggaggatgtcgctagcgacgacaatggccaggatctctcaaattatagcttctccaccgatgggttctccgggagtgggggcagcggcagtcatggttcttctgtcggtgtacaaggcggcgttgattggatgcgcaaactcgcatttcggtatcgtaaagtgcgagagatttatgataaacacaagtccaacgttgggggtcttctcagcccacagaggaaggaagccctgcagaggttacgggcagaaattgaggtgcttacagactcttggttggggacagcactgaagtccctgttacttatccagtctcgcaaaaattgcgtcaatgtgctcattacaactacacagctggtgcctgccttggcaaaagttctcctttacggtctcggggagattttccccatcgagaacatctactcagcgacgaaaatcggtaaggagagctgctttgagaggattgtgagccgctttggtaaaaaggtcacctacgttgtcatcggtgatggaagggacgaagagatcgccgcaaagcagcataacatgcccttctggcgaattacgaatcatggtgatctcgtcagtctgcaccaagctctggagcttgacttcctgtag

SEQ ID NO: 116490 - DNA, 1344 bp, Artificial Sequence
  Description of Artificial Sequence: Synthetic coding sequence
atgaagccagagtccggattgatccagaccccatctccttctcaacactccgtgctgacctgcactactgggctgaccacgtcgcaacctagcccagcccattactcttacccaatccaagccagctccacgaacgcaagcctgatctccacctccagcacaatagctaacatccctgcggcagccgtcgcatcaattagcaatcaagactatcccacatacaccatcctcgggcagaatcaataccaagcctgctacccttcatcttcatttggggtcaccggccaaacaaactccgacgcggagagtactactctggcagcgaccacctaccagagcgaaaagccctctgtaatggcaccagcaccagccgcacaacgtctgtcgtctggagatccctccactagccctagcctttctcaaacgaccccctcaaaggataccgacgaccagtctaggaagaatatgaccagcaaaaacagaggaaaaaggaaggccgatgcgaccagtagccaggacagtgaattggagagggtgttcctgtgggacctcgatgaaacaattatcatcttccatagccttttaacaggctcctatgcccaaaaatacggcaaggatcccacggtcgtgatagggagcggactgaccatggaagagatgatctttgaagtggccgatacccacttgttttttaacgatttagaagaatgcgaccaagtacacgtggaggatgtggcctcagacgataacggacaagacttgtcaaactattcatttagtacggatggcttctctggcagtgggggctctggctcacatggctcaagcgtgggtgttcaaggaggcgttgattggatgagaaagctcgcctttcgctaccggaaggtcagagagatatatgataagcataaaagcaacgtgggcggtttactgtccccccagcggaaggaggcgctgcaacgccttcgagccgagatcgaggtgctcaccgattcgtggctgggtaccgctttaaagtccctgctactcatccaaagcagaaaaaattgcgttaatgtgctgattactaccactcaacttgtacctgctctagctaaagtgctgctttacggcctcggtgagatattcccaattgaaaatatttacagcgcaactaagattggcaaggagagttgctttgaaaggatagtcagccgcttcgggaagaaggtaacatatgtggtcattggcgacggcagggacgaagagatagcagcgaaacagcataacatgcccttttggaggatcaccaatcatggcgatctcgtttcactgcaccaggctttggaattagacttcctgtag

SEQ ID NO: 116491 - DNA, 1584 bp, Artificial Sequence
  Description of Artificial Sequence: Synthetic coding sequence
atggaagaagaacaggatctgcctgagcaacccgtaaagaaagcaaagatgcaggagagtggtgagcaaaccatttcccaggttagcaaccccgatgtcagcgaccaaaaacctgaaacttcctcgctggcgtcaaacttacccatgtccgaagaaattatgacttgcaccgattatattccccgaagtagcaacgattacacatctcagatgtatagtgccaagccctacgcgcatatattatccgttcctgtcagcgagactgcctacccaggacagacacaataccaaacgctgcagcaaacccagccatatgcggtctatccacaggccacccaaacctacggcctgcctccctttgcttccagcacaaacgctagtttgatatctacttcctctacgatcgcgaatatcccagcagcagctgtggcttcgatcagcaaccaagactatcctacctatacaatcctgggccagaaccaatatcaggcttgttatccctccagttctttcggcgtgactggacagacaaattcagacgccgaatccaccaccttggctgccacaacgtaccagtccgagaagccatccgtcatggctccggcgcccgccgcccaacggctctcgagtggtgacccgtccacttctccttccctttcacagacgactccaagcaaggacacggacgatcagagccgcaagaacatgacatcaaaaaatcgaggaaagcggaaagcagacgccacctcatcccaagattcagaactggagagggtattcctatgggatttggacgaaacaataataatattccattctctcctcacagggagctacgctcagaaatatggaaaagatccaactgtcgtgatcggctcagggctgacaatggaggagatgatctttgaagtggccgatactcacttatttttcaatgacctggaggagtgcgaccaggtgcacgtggaggatgttgcatcagatgacaatggccaggatcttagtaactactccttcagcaccgacggcttctccgggtcaggtgggagcggatcacacggctcctcagtaggagtacaagggggtgtcgattggatgaggaagctggcttttaggtaccgcaaggtgagagagatctatgacaagcacaagtcaaatgtgggaggcctgttaagtccccagaggaaggaggctctgcagaggctgagagcggagattgaagttctgaccgatagttggttagggaccgctttgaaaagcctgctgttgatccagagccgcaaaaactgcgtcaacgtgctaatcaccacgacccagcttgtgcctgcactcgccaaagtcctgctatatgggctgggtgagattttccctatcgagaacatttattccgccaccaaaatagggaaggagagctgtttcgagagaatcgtgtcccgattcggcaagaaggtgacgtatgtggtcataggtgacggacgcgatgaagagatagcagctaaacagcataacatgccattttggcgtattaccaaccacggggacctggtctcgctgcaccaggctttagagctagactttctctag

SEQ ID NO: 116492 - DNA, 1563 bp, Artificial Sequence
  Description of Artificial Sequence: Synthetic coding sequence
atgacatgcactgattatatcccccggagcagtaacgattacacatcacaaatgtatagtgccaagccgtacgctcacatcctcagcgtccctgtctccgaaacagcctatccaggacaaacccagtatcagacccttcagcaaacacagccttacgcggtttatccccaggcaactcagacatacggactgccccccttcggcgccttgtggcccggaatgaagccggagagtgggcttattcagactcctagtccctctcagcactctgtactgacgtgcactaccggcctaacaacatcccaaccgagccctgctcattactcctatccaatccaggcctccagtactaacgccagcctgatatctaccagctctacaattgcaaatattccggctgctgcggtggcaagtatatcgaaccaagactatcccacctatactattctgggtcaaaatcagtaccaggcttgttacccatccagctcctttggagtgacaggtcagaccaactcagatgctgagtcaacaaccttggcggctacgacttatcagtcagagaagcccagcgtaatggctcccgcacccgctgcacagcgtctctctagtggggaccccagtactagtccctccctatcccagacaacacctagtaaggacactgacgaccagtcccgaaaaaatatgacaagcaagaataggggtaaacggaaggcggacgctacatcaagtcaagacagcgaattagagagagtgttcctctgggatctggatgagacaatcattatcttccatagtttgctcaccggatcctacgcccagaagtacgggaaagatcccactgtcgtgattgggagtggcctgaccatggaggaaatgattttcgaggtggcagacacgcatctgttctttaatgatctggaggagtgtgatcaggtacacgtcgaggacgtggcaagcgatgataacgggcaggacctgtctaattattcattctcaactgacggttttagtgggagcggaggctcggggtcccacggctctagtgtgggggtccagggcggcgtggattggatgcggaaactcgccttccgctatcgcaaggtgagggaaatatacgataagcataagtccaacgttggcggccttctctcccctcagcgcaaagaagctctgcaaagactgcgagccgagatcgaagtgttgaccgactcttggctgggtacggcccttaagagtttgcttttgatccaatcccgaaaaaattgtgtgaatgtcctgatcacaacaacacagctcgtgcctgccctggccaaggtgcttctctacggattaggagagattttcccgattgagaatatctactcagctactaaaataggaaaagaaagttgctttgagcgaattgtctccaggtttgggaaaaaggtcacttacgtggtgataggcgacggaagggacgaggaaatcgccgccaagcaacacaatatgccattttggcggatcacaaaccatggagacctggtgtcattgcatcaggccctggagctggactttctttag

SEQ ID NO: 116493 - DNA, 1920 bp, Artificial Sequence
  Description of Artificial Sequence: Synthetic coding sequence
atggaagattcccaggacctcaacgaacagagcgtcaagaagacttgtactgaatctgatgtgtcacagagccagaatagcaggtctatggaaatgcaggatcttgcctcaccacatacgctggttggagggggcgatacccccggttcctcaaaactggaaaaaagtaacctgtcttcgacctccgtaaccactaatggaaccggtggggagaacatgactgttctgaacactgctgactggctcctaagctgtaatactccatcttccgccaccatgtccttactggctgtaaagaccgaacccctgaatagctccgaaacaaccgcaaccactggcgacggcgccctggatacctttaccggcagcgtcattaccagcagcgggtactccccacggagcgcccaccagtactcaccccagctgtacccttccaagccgtaccctcatatcctcagcacaccagcagcccaaactatgtcggcctacgccggtcagacccagtacagcggaatgcaacagcccgcggtgtacactgcttacagccaaaccggtcaaccttactccctccctacctacgacttgggggtaatgctccccgctataaagacagagtctggcctgtcgcagacacagagtcccctccagtcaggctgcctgagctattccccaggtttttctaccccacagccaggacaaaccccttactcttatcaaatgcctggatcctccttcgcccccagttccactatttacgccaataactccgtcagtaactctactaacttctctgggtcccagcaggattacccaagctacactgccttcggccagaaccagtatgcacagtattattccgcctccacatatggcgcctatatgacttcaaacaacactgccgatggaaccccatctagcacctcgacatatcagctgcaggaatcgctgccaggtctcactaaccagcctggagaatttgataccatgcagagtcccagcacacccattaaggatctcgacgagcgtacttgcaggtcatccggatctaagagcaggggcagagggaggaaaaacaatccaagtcctccccccgacagtgacctcgagagagtattcgtgtgggatctcgacgaaacaataatagtcttccacagcctcctgactgggagctacgctcagaaatatggtaaagatccccctatggcagtaacattaggactcagaatggaggagatgatatttaatctggcagatacccacttgttttttaatgacttagaggagtgtgaccaggtacatatcgacgacgtatcttccgatgacaatggccaggacctgagtacgtactccttcgctacagacggatttcacgcagcagcgtcttcagccaatctatgtctgcccaccggggttagggggggagttgattggatgagaaagcttgccttccggtaccgtcgggtgaaggaactgtataacacttacaaaaataatgtgggggggctcctcgggcctgccaaaagagacgcctggttgcagctccgggcagaaatcgagggtttgacagactcatggttgactaatgccctgaagagcttatctatcatatccacacgcagcaactgcattaatgtgctggtcactacaactcagctgatacccgctctggcgaaggtcctgctctacagcctcggcggggcatttcccattgagaatatttacagcgccacaaaaattggcaaagagtcctgttttgagagaatcgtgagccgctttggtaccaatatcacatatgtcgtcattggagacggtagagacgaggagcatgccgcaaatcagcataacatgcccttttggcgcatctccagccatagcgacctgctagccctgcatcaagcattagagctggagtacttatag

SEQ ID NO: 116494 - DNA, 1851 bp, Artificial Sequence
  Description of Artificial Sequence: Synthetic coding sequence
atggaagacagtcaggatctcaacgagcagagtgtcaagaaaacatgtactgaaagtgacgtatcacaatctcagaactctaggtctatggagatgcaagatctggcaagtccgcacactttggtgggtggcggcgacacaccagggagctctaagctggagaaatccaacctctctagtacaagcgtgactaccaatggaaccggcgtgtcgctcctggctgtgaaaacagagcctctgaactcttcagaaactaccgctacaactggcgatggcgcgcttgacaccttcactgggtcagtgataacctcctcagggtacagtcctcgttctgcccatcagtactcacctcaattataccctagcaaaccatacccccacatcctaagcacacccgccgcccagactatgagcgcttatgcaggtcagactcagtactcaggaatgcagcagcctgccgtgtatactgcttactcccaaactggacaaccctattcactgcctacatatgacttgggtgtgatgcttcctgctatcaagaccgaaagtggactgtcacagacacaatcaccactccagtctggctgcttatcttatagtcctgggtttagcacaccccagccaggacagacaccttatagctaccagatgcctgggagtagtttcgccccttcttcaactatctacgcaaataactctgtgtccaattctacaaatttttccgggtcacagcaagactatccttcttacacagcctttggccagaaccagtacgcacagtactactccgcatctacatacggggcgtatatgacatcaaacaacaccgctgatggcactccgagctctacctctacctaccagctgcaggaaagtctgccgggcctgacaaatcaacctggggagttcgacacgatgcagtcaccaagcactccaattaaagacctggatgagcgcacttgccggtccagcggtagcaagtctcgaggaagagggcggaagaataatcccagcccacccccagatagcgatctggagcgagtgttcgtttgggacctggacgaaaccatcatcgtttttcactcactcctgaccggaagctatgcccagaaatacgggaaagacccacccatggctgtaaccctgggacttcggatggaggagatgatttttaacctcgcagatacgcacctcttctttaacgatttggaagagtgtgaccaggtacatatcgacgacgtttcaagcgatgacaacgggcaggacctgagcacgtatagttttgccaccgatgggttccacgccgccgcgagttccgcaaacctatgtctaccaaccggcgtgaggggtggagtcgattggatgcggaagctggcattccgctacaggcgcgtcaaagaactttacaacacttataaaaataacgtgggcggcctgctcgggccggcgaagagagacgcctggctgcagttgagagccgagatcgaagggctgactgattcgtggctgacaaatgcgctgaagagcctctcaatcatctcaacccgaagtaattgcataaacgtcctcgtgaccactacacagctgattcccgcacttgccaaggtgttgctttactcgctggggggcgcttttccaatcgagaacatctattcggcaaccaagattggtaaggaatcttgctttgagcgtattatgcagcgatttgggcgcaaggtcgtgtatgtggtaatcggagacggggttgaggaggagcaggctgcaaagaagcacaatatgcctttttggcggatatcctctcattcagacttgcttgctttgcaccaggcccttgagctggagtacctgtag

SEQ ID NO: 116495 - DNA, 1920 bp, Artificial Sequence
  Description of Artificial Sequence: Synthetic coding sequence
atggaggactctcaggacctcaacgagcagtccgtgaagaagacatgcactgagagtgatgtatctcagtcacaaaacagtagaagtatggagatgcaggatttagcaagtccacacaccctggttggagggggcgataccccaggaagctcaaagctggaaaagagtaatctgtctagtacctctgtaacaaccaacgggactggaggtgagaacatgaccgtgctgaataccgccgactggctgctgtcatgtaacacaccctccagcgcaacaatgagccttttggccgtgaagactgagccacttaactcaagcgaaactacagctaccaccggagacggagctcttgacaccttcacgggctctgtgataacgagctccgggtacagccctcgcagcgctcatcagtactctccccagctctacccgtctaagccgtacccacacattctgagcactccagccgcacagacgatgtcagcatacgccggacagacccagtacagcggaatgcagcagcccgccgtgtatactgcttacagtcaaactggacagccctactcattacctacttatgatctaggggtgatgctgccagccatcaaaactgaaagcgggcttagtcagacccagtcgcctctgcagtctggttgcctctcctatagccctggctttagcacaccccaacccggtcagacaccttacagttaccagatgcccgggtctagtttcgcacctagttcgactatatatgctaataactccgttagcaacagtactaacttctcaggaagtcaacaagattaccctagctacacagcgtttggtcagaatcaatacgcccagtattattctgcttcgacatatggcgcatacatgacatccaacaatacagcagatggtactccttcttccacatctacctaccaactgcaggaatcgctgcccgggctcaccaaccagcctggtgagtttgataccatgcagtctccatcaacgccaataaaagatctagacgaacgcacatgcagatcctccggctcgaagtcccggggccgaggtcgcaaaaacaacccgtctcctccacccgatagcgatttggaaagggtttttgtttgggacctggacgagacgatcattgtgtttcactctttgctgaccggcagctatgcacagaagtatgggaaggacccccccatggctgtaactttgggactgagaatggaggaaatgatattcaacttggcagacacgcatctattcttcaatgacctggaggagtgtgaccaggtccacatcgatgacgtgagtagtgatgacaatggtcaggatctgtctacctacagcttcgctactgatggatttcacgctgcagccagttcagctaatctgtgtctgcccaccggggtgagaggtggagtggactggatgcgcaaactagcatttcggtatcgaagagtcaaggagctctataatacctacaagaacaacgtgggcggcctgctgggcccagctaagagagacgcctggctccagttacgcgcagaaattgagggactaacagactcctggctaaccaacgcgctcaagtctttgtctatcatatctacccgctcgaattgtatcaatgtgctggtaaccacaacccagcttattcccgccctggctaaagttctattgtattctctcggtggtgcttttccaatcgaaaatatctatagtgccacgaaaatcgggaaggagtcctgctttgaacggattatgcaaagatttggccgaaaagtcgtatacgtggtaattggcgacggtgttgaagaggagcaggcggctaagaaacacaatatgcctttctggcgtatttcctctcacagtgacctgctcgccctgcatcaggcgttggagcttgagtatctgtag

SEQ ID NO: 116496 - DNA, 9498 bp, Artificial Sequence
  Description of Artificial Sequence: Synthetic coding sequence
atgactgataagtccatcgttattctttctcttatggtgtttcatagtagcttcatcaatggaaagacctgtaggcgccagctggtggaggaatggcacccacaaccgtctagttacgtggtgaattggacattgaccgaaaatatctgcctcgacttctatcgcgattgctggtttctgggggtcaatactaagatagatactagcggtaatcaggcagttccgcagatatgcccccttcaaattcagctgggagatatcctggttatctcctcggagccttccttacaatttcccgaaattaatctaatgaacgtgagcgagacgagttttgtcggatgtgtgcagaacacaaccacagaggaccaactcctgtttggctgtcggttgaaagggatgcacacagtcaattcaaagtggttatcagtgggcacccattatttcattaccgtgatggctagtgggccctctccctgtccactgggtttacgcctcaacgtaacggtgaaacagcagttctgccaagaatccttaagctccgaattctgcagcggccacgggaagtgcctgtcagaggcctggtccaaaacctattcctgtcactgtcagcctcctttcagtggtaagtactgtcaggagctggacgcctgttcctttaaaccatgtaaaaataacggatcgtgcattaataaacgggagaactgggatgagcaggcctatgagtgcgtatgtcaccccccattcactggcaagaattgtagcgagatcataggccagtgtcagccacacgtctgtttccatgggaactgcagcaatattacgagcaactctttcatttgcgaatgtgacgaacagttttccggccctttttgcgaagtatctgctaaaccctgcgtcagcctgcttttctggaagcgaggcatatgcccaaacagctcaagcgcttacacctatgaatgtccaaaaggttcatcgtcgcagaacggggagacagatgtatccgagttcagccttgtcccttgccaaaacggcaccgactgtattaaaatttcaaatgacgttatgtgcatctgttcgccgatattcactgacttgttgtgcaagtctatccaaacatcctgtgaaagttttcctctccgtaacaatgccacctgcaaaaagtgcgagaaggactatccctgctcttgcattagtggctttactgagaagaattgcgaaaaggccatcgatcactgcaagctgttgagcataaactgcctgaacgaagagtggtgctttaatattatcggccgtttcaaatatgtgtgtattcccgggtgcaccaaaaacccctgctggttcctcaaaaacgtctatctcattcatcagcacctgtgctactgcggagtcacctttcatggcatttgccaggacaaggggccagctcagtttgagtacgtttggcaactcgggttcgcaggtagcgagggcgaaaaatgccagggagtcatcgatgcctattttttcctcgcagcgaactgcaccgaggatgccacttatgttaacgacccggaagataacaacagctcctgctggttccctcacgagggtaccaaagagatctgtgccaacgggtgtagctgcctatccgaggaagatagccaggagtacagatacctatgttttctcaggtgggcaggtaacatgtatctggaaaacaccaccgatgaccaagagaatgaatgccagcacgaggctgtatgtaaggacgagatcaatcggcctaggtgttcttgcagcctgagctatataggcagattgtgtgtcgttaacgtcgattattgcctcgggaatcactccatatcggtgcatggactctgtctggccctgagtcacaattgtaactgttctggattgcagcgctacgagcgtaatatctgtgagattgacactgaagattgcaaaagtgcatcctgtaagaatggcacaacatccacccatttgcgtgggtacttctttcgtaagtgtgtccccggatttaagggcactcagtgcgaaatcgatattgatgagtgcgctagccatccatgtaagaatggtgcaacgtgcattgaccagccaggcaattacttctgtcaatgcgtgcccccattcaaggtcgtcgatggcttcagctgcttatgcaaccccggatatgtcggaatccgttgtgagcaggatatcgatgactgcattttgaatgcttgtgaacacaacagtacttgcaaggatctgcacctaagctaccagtgcgtgtgcctgtcagactgggagggaaatttctgcgagcaggagtctaatgagtgcaagatgaatccttgcaagaacaactctacatgcacagacctgtataagtcttaccgttgtgagtgtactagtggatggacaggtcagaactgttctgaggagatcaacgagtgcgactcagatccctgcatgaacgggggactctgccacgaatctaccataccaggccagtttgtgtgcctctgtcccccgctctacaccgggcagttctgtcaccagcgctataacctgtgtgacttgctccacaacccctgtagaaataacagtacctgtctcgcactggtggatgctaaccagcactgtatctgtagggaggagttcgaggggaagaattgtgaaatagatgttaaggactgcctgtttctgtcttgtcaagattacggggactgcgaggacatggtgaacaacttcaggtgcatctgtcgcccgggtttcagtgggagtctatgtgaaatagagatcaacgagtgcagtagcgagccctgcaagaataatgggacttgcgtggacctgaccaacagattcttctgcaactgtgagccagagtatcacggcccattctgcgaattggacgttaacaagtgtaaaatctccccatgcctggatgaggagaactgcgtttaccgtaccgacggttataattgtctgtgcgcacccggctacactggaattaattgcgaaataaatctggatgaatgtctctctgaaccgtgcctccacgatggtgtctgtatcgatgggatcaaccactacacatgtgactgtaagtcggggttttttggcacccattgcgagactaacgcaaacgattgccttagcaatccttgcctccatgggagatgtaccgaattaataaatgagtacccttgctcttgtgacgctgacggcacttctacccagtgcaagattaagatcaatgactgcaccagtataccctgcatgaatgagggattctgccagaagtcggcgcacggatttacgtgcatttgccctcgcgggtatactggcgcttattgcgagaagagcatagacaattgtgctgagccagaattgaattccgtcatatgtcttaatggtggtatttgtgtggacggtcccggacatactttcgattgtaggtgcctcccagggttttctgggcagttctgtgagatcaacataaacgagtgctcctcatcaccttgcttgcatggtgctgactgcgaagatcacattaatggttatgtctgtaaatgtcagcccgggtggagcggacaccactgcgagaatgagctcgaatgcatacctaactcatgtgtacacgagttatgcatggaaaacgagcctggaagtacttgtctgtgtaccccagggtttatgacctgtagcataggtctgctgtgcggggatgagatccgacgaataacatgcttaacacctatctttcagagaacagatcctattagtactcagacatacactattccaccgagcgagactctcgtctcgtcattcccttcaattaaagccaccaggattccagcaattatggatacatacccagtggatcaaggcccaaaacagaccgggatcgttaaacacgatattctgccaacgacaggactggcaacactccgcattagcaccccactggagagttacctactgcaagagctgattgtaacacgggaactttcagccaaacattcactcctatcttccgccgacgtgagcagttcccgcttccttaactttggcatcagggaccctgcccaaatcgtccaagacaaaacctcagtgtcacacatgccaattaggacttctgcggctaccctgggttttttctttcccgatcgacgggcccgcacgccatttataatgtctagcttaatgagcgactttattttccccacacagtccctgttgttcgaaaattgtcagaccgtcgctttatcggctacaccaacgacaagtgtgatccgtagcatcccaggcgcagatatcgagctgaacagacagagtctgctttccagagggttcttgctgatagccgcctccatttcagccactcctgttgtgtcgagaggcgctcaggaggatattgaggaatactcagccgacagcttaatctctcggagggagcattggagactgctcagtccatcaatgtccccaatttttccagcaaaggttattattagtaagcaagtgaccattctgaactcatcagccctgcaccgctttagcaccaaggcatttaacccatccgaatatcaggcaattacagaggcgtcatctaatcagagacttactaatatcaagtcccaagctgcagattctctgcgagagctgtcccagacatgcgccacttgctcgatgaccgagattaagagtagccgggagtttagtgatcaagtcctccatagcaagcagtctcacttttacgaaacattctggatgaactccgcaattctagcttcctggtatgctctgatgggagctcagactattacttccggtcatagcttcagtagcgccactgagatcactccttctgtcgcatttactgaagtgccctccctgttcccctccaagaaaagcgctaagcgcacaatacttagttctagccttgaagagtctataacactgtctagcaatcttgatgttaacctctgccttgataagacctgtttgtctatcgtgccaagtcagacaatctctagcgatctgatgaactcagatctgacatcaaaaatgaccactgacgagctgtcagtctccgaaaatattctcaagctgctgaaaattcgtcagtatggcattacaatgggtcctactgaggtcttgaaccaggagagtctgctggatatggaaaagtctaagggctcgcacactctgttcaagcttcacccttcagactcctcgcttgatttcgaactgaacttacagatttatccggatgtgaccctgaagacctacagtgaaatcacccacgccaacgacttcaaaaataacctcccccccctgacaggttcagttcccgactttagtgaagtgacaacgaacgtggccttttacacagtctccgccaccccggctttgtccatacagacaagcagcagtatgtctgtgatcaggccagactggccgtacttcactgactatatgactagccttaagaaggaggtgaagacctcgtccgaatggtctaaatgggagttacagccatctgtccagtaccaggaattccccacggcttctaggcatctgcctttcactcgaagcctcacattgtcaagcctcgaatctatcttggcacctcagcgactgatgatctccgactttagttgcgtgcggtattatggcgatagctatttagaatttcagaatgtggcactaaacccccagaacaacatctctttagaattccagacgtttagcagctacgggctcctcctgtatgttaagcaggacagcaacctggttgacggcttttttatccagctgttcatcgaaaatgggacactcaagtaccatttctattgccccggagaagctaagttcaagagcataaatacaactgtgagggtcgacaatggacagaagtacaccttgcttattaggcaggagctcgacccatgcaatgccgaactcacaatactcggacggaatacacaaatatgtgagtctattaaccacgtactggggaagccactgccaaagagcggttcagttttcattgggggatttcctgatttacatggcaagattcaaatgcccgttcccgtcaagaacttcaccgggtgtattgaggtaattgagattaacaactggcggtctttcatcccctcaaaagcagtgaaaaattatcacattaacaactgccgaagtcagggcttcatgctgtcacccaccgctagctttgttgacgcgtccgatgttacacagggtgtggataccatgtggacttctgtctcgcccagtgtcgccgccccctcggtgtgccagcaggatgtatgccacaatggaggcacctgtcacgccatctttcttagtagtggtatagtcagcttccaatgtgactgcccactgcatttcacagggcggttctgcgagaaggatgctgggctgttttttcctagcttcaacgggaattcatacctggagcttcccttcctgaagttcgtgctggaaaaggagcacaatcggaccgtgacgatatacctgacgatcaagaccaactctctcaatggcaccattctgtacagcaatggtaacaattgcggcaaacagttcctacacctgttcctggtggaaggcagaccgagtgtgaaatacgggtgcggaaactcacagaacatcctcactgtatcagctaactacagcattaatactaacgcctttacacctatcaccatccgttatactacacccgtgggaagtccaggggtagtgtgtatgatcgaaatgacagccgacggaaagcctcctgtccagaagaaggatacggagatttcgcacgcgagtcaggcatatttcgaatccatgttccttgggcatatcccagccaacgtgcagatccacaagaaagctgggccggtctacgggtttcggggctgcattttggaccttcaggtcaacaacaaagaattttttattatcgacgaggctcgacacggaaaaaacatagaaaattgtcatgttccttggtgcgcccatcatctctgtaggaacaatgggacctgtattagcgacaatgaaaatctcttttgcgaatgtcctcgactgtactctggaaagctctgccagtttgcgagctgcgagaacaatccttgtggtaatggcgccacctgtgtccccaagagcggaacagatatcgtgtgtctgtgtccctatggaaggtcagggcctctctgtacagacgccataaatatcacccaacccaggttcagcggtacggatgcctttggttacacgtcattccttgcctattctcggatctccgacattagttttcattacgagttccacctgaaattccagctcgcaaataaccactctgctctgcaaaacaatctaatatttttcactggtcagaagggtcacggcctgaatggcgatgatttcctggcagttgggttactgaacggctccgtggtctatagctacaacctaggatcaggtatcgcatcgattcgctctgagcccttgaatctgtcactgggagtccataccgtgcacctgggaaaatttttccaggagggatggttgaaggtggatgatcataagaataaatccattatcgcacccggaagacttgtgggcctgaacgtgttttcccagttttacgtgggaggctatagcgaatatacccccgacctgctgccaaatggggcagatttcaaaaacggctttcagggatgcattttcaccttgcaggtgaggaccgaaaaagacggacattttcggggactcggtaatcccgaggggcaccccaacgcaggaaggtccgtcggccagtgtcatgcctccccctgcagcttgatgaagtgcggtaacggtggcacctgtattgagtctggaacaagtgtttactgcaactgcacgacaggctggaagggatccttctgtaccgagacagtctctacatgcgaccctgaacacgatccaccacatcattgcagtagaggggcgacctgtatcagtctgccacacgggtacacctgcttttgcccactcggtacaactggcatttattgcgaacaagctctgattctcattgtgattttggagaaacctaaacctgctgagaggaaagtaaaaaaagaggccctgagtattagcgatccctctttccgatctaacgagctcagctggatgtcgtttgcatctttccacgtcagaaagaagactcatatacagctgcagttccagccgctagcagccgacggcattcttttttatgccgcccagcatctcaaggcacaatccggagactttttgtgcattagcctcgtcaattcttctgtgcagttacgatacaacctcggcgaccgcacgataatcctggaaacactacagaaggtgaccatcaacggcagtacctggcacattatcaaagccggccgcgtgggtgccgagggctatctcgatttggacggaatcaacgttaccgagaaagcttcaacgaagatgtctagtctggacaccaacacggacttctacattggtggcgtcagttctctgaatctggtgaaccccatggctatcgagaacgagccagtaggatttcagggctgcattagacaggtgatcatcaacaatcaggagctgcaactgactgaatttggcgccaagggcggcagtaatgtaggggattgtgacggcacggcctgtggttacaacacatgcaggaatggcggggagtgtaccgtgaatggaacgaccttctcgtgccgctgtctgccagattgggctggcaacacctgcaaccagagcgtcagttgtttgaacaacctctgcttgcatcagtcattgtgtatcccggatcaaagtttttcttactcttgcctgtgcacgttgggatgggtgggtcgatactgtgaaaacaaaacctctttctccactgctaaatttatgggcaactcttatattaagtatattgacccgaactatcgcatgcgcaacctccagttcaccacgatatcattgaacttctccactaccaagactgagggattgatcgtttggatgggaatcgctcagaacgaggagaacgacttccttgctattggtctccataaccagacactcaaaattgctgtgaaccttggggagcggatcagtgtgccgatgtcctataacaatggtactttctgttgcaacaagtggcaccacgttgtggtgatacaaaatcagactctgattaaagcctacattaataactcacttatcctaagcgaggatattgatccccataagaattttgtggctctgaactatgacgggatatgctacctaggtggcttcgaatacggacggaaggtgaacatagtcacacaggaaattttcaaaacaaattttgtgggcaaaattaaagatgtggtcttcttccaagagcccaaaaatatcgagctgataaagctggaggggtacaacgtctatgacggagatgaacagaatgaggtgacctag

SEQ ID NO: 116497 - DNA, 1785 bp, Artificial Sequence
  Description of Artificial Sequence: Synthetic coding sequence
atgactgacaaatctatcgttattctttcgttgatggttttccattcatcctttataaatggtaagacatgcaggcggcagctggtcgaggaatggcaccctcagccttcatcttatgtggtgaactggactttgaccgagaacatttgcctcgacttttacagggactgctggttcctgggggttaacacaaagatagatacttctggcaatcaggctgtgcctcaaatctgccctcttcagatccagttgggcgacatcctcgttatcagctccgagcccagtttgcaatttccagagatcaacctcatgaatgtgagcgagacgtcctttgtaggctgcgtgcagaatactactactgaggaccagctgttatttgggtgccgcctcaagggaatgcatactgttaatagcaaatggctcagtgttggaacacactactttattactgtcatggcctcaggaccttccccatgccctctgggcctgagacttaacgtgacggtgaagcagcagttctgtcaagagagcctgtcatctgagttttgtagcggacacggaaagtgcttatcagaggcatggtccaagacttacagttgtcactgccagcctcctttttcagggaaatactgtcaggagctggatgcttgctccttcaagccttgtaaaaacaatgggtcctgcatcaacaaaagagagaactgggatgaacaagcctacgagtgcgtgtgtcaccctccctttacaggcaaaaattgctcagaaatcatcgggcagtgtcaacctcatgtttgctttcacggaaactgcagcaatatcacatcgaacagttttatttgtgaatgtgatgaacagttctcaggtccattttgtgaagtgagtgccaaaccctgtgtttccctgctcttttggaaacgcggtatctgccccaatagtagttccgcttatacttacgagtgtccgaagggtagttcctctcagaacggagagaccgacgtttcagagttttccctagtaccctgccaaaatggcactgattgcattaagatttccaatgacgtcatgtgcatatgctctcccatatttactgacctgttgtgcaaaagcattcagacttcttgtgagagttttcccctgaggaataatgctacctgtaagaaatgcgagaaggattatccatgtagttgtatttccggcttcacagagaaaaattgcgagaaggcaattgaccactgcaagctgctgagtatcaattgtctcaatgaggagtggtgctttaatataattggtcggtttaagtatgtctgcattccaggttgcaccaaaaatccctgttggttcctaaagaacgtttacctgatacaccagcatttatgctattgcggcgtgacatttcatggcatctgccaggacaaggggccagcccagttcgaatatgtgtggcaattgggattcgccggcagcgagggtgaaaagtgtcagggagtcattgatgcatatttttttttggccgcaaactgtacagaagatgccacctacgttaacgatcccgaagacaataacagctcctgctggtttcctcatgagggaacaaaagaaatatgcgcaaatggctgctcctgtctttcagaggaagactcgcaggaatataggtatctgtgcttcctgaggtgggctgggaatatgtacctggagaatacaactgatgaccaggaaaatgagtgtcagcatgaagccgtgtgcaaagacgaaataaaccggccacggtatctgtgcattatttag

SEQ ID NO: 116498 - DNA, 9498 bp, Artificial Sequence
  Description of Artificial Sequence: Synthetic coding sequence
atgacggacaagagtatcgtgatccttagcctaatggtttttcattcatcctttataaacggcaagacttgtagacgtcagctagtggaagaatggcaccctcagccttcgagctatgtggtcaactggaccctgacggagaacatctgcctggacttttatagagactgctggtttttgggagtgaatacaaagatcgatacttccgggaatcaggccgtgccacagatttgccccttgcagatccagctcggcgacattctggtgattagtagtgaaccaagcctgcagttccccgaaattaatctgatgaatgtctccgagacctccttcgttggatgtgtacagaatactaccaccgaagaccagctgttgtttggatgccggctgaaagggatgcacacagtcaattcaaagtggcttagtgtggggactcactacttcattaccgtgatggcaagtgggccgtccccctgccctcttgggctgaggctgaacgtaaccgtcaaacagcaattctgtcaagaaagtcttagctcagaattctgcagcggtcacggcaaatgcctctccgaggcatggtcaaagacgtactcctgccattgtcagcccccatttagtggaaagtattgccaggagctggatgcatgttcatttaaaccatgtaaaaacaatgggtcctgcattaataaacgggagaactgggacgagcaagcctacgagtgcgtgtgtcatccaccatttaccggcaagaactgtagcgagatcatcggacagtgccagcctcacgtgtgcttccacggcaattgctccaatatcacaagcaactccttcatttgtgagtgtgatgaacaattttccggacctttctgtgaagtaagcgctaagccctgcgtctctctccttttttggaagcgtggcatctgtcccaattccagcagtgcctacacctatgagtgccccaaaggcagctcgtctcaaaatggggagacggacgttagcgaattttctttagtgccttgccagaatggcacagactgcatcaagatttccaatgatgtcatgtgtatttgttctccgatctttactgatttgctctgcaaaagcatccaaacgtcttgcgaaagctttcctctgcgcaacaacgccacatgcaagaaatgcgagaaagattatccatgttcttgtatatcaggctttacggaaaagaattgcgaaaaggcaattgatcactgcaaactgctgtcaatcaattgccttaacgaggagtggtgttttaacatcatcgggcgcttcaagtacgtgtgcattcccggttgcacaaaaaatccttgctggtttctgaagaacgtctacctgatacatcagcacctttgctattgcggggtaacatttcacgggatatgccaggacaagggtcctgcccagtttgagtatgtgtggcagctgggattcgcaggatctgaaggcgagaagtgtcagggtgtgatagacgcatacttcttcctcgccgcaaattgtacagaggacgcgacgtatgtgaacgaccctgaagataataatagcagctgttggtttccacacgaaggaaccaaggaaatttgtgccaacggctgcagctgtttatcggaggaagatagtcaagaatatcgttacctttgtttcctccgctgggccggaaatatgtatctggaaaataccactgacgaccaggaaaacgaatgccagcatgaggctgtttgtaaggacgaaatcaataggcctcgatgctcctgctctctgtcatacatcggcaggctctgcgtggtcaatgtggactactgtctggggaatcatagcatcagcgtccatggcttgtgcctcgccctcagtcacaactgcaactgcagcgggcttcaacgctatgagagaaacatttgcgagattgacacagaggattgtaaatcagccagctgcaaaaatggaacaacatctacacatctgcgcggatatttctttcgcaaatgcgtgcctggatttaaaggcactcagtgtgagatcgatattgacgagtgcgcctctcacccctgtaaaaacggggctacctgtatagaccagcccggcaattacttttgccaatgtgttcctccttttaaggtagtcgacggttttagttgtctctgtaatccgggctatgtgggaatccggtgcgaacaggatatagacgactgtatcctaaacgcctgcgaacataattctacatgtaaggatttgcacctctcgtatcaatgcgtctgtttaagcgactgggagggcaacttttgtgaacaggagagtaatgagtgcaaaatgaacccatgcaagaataattccacctgtacagatttgtataagagttatcggtgtgagtgcactagtgggtggacaggacagaactgctctgaggagataaatgaatgtgactccgacccatgcatgaacggtgggctttgccatgagtccaccattcctggacagtttgtatgcctctgtccccccctttacaccgggcagttctgtcatcagaggtacaacctttgcgacctgctccacaacccttgtcggaataattctacatgcctcgctttagttgacgcaaatcaacattgcatttgcagagaagaatttgaaggcaagaactgcgagatcgacgtgaaagattgccttttcctgtcatgtcaagactatggggactgcgaagacatggtgaacaattttaggtgtatttgccgccctggcttctctgggtctctctgtgagatagaaataaatgaatgcagctctgagccctgtaagaacaatgggacctgtgtagacctgacaaaccggtttttttgtaattgcgagcctgagtatcacggccccttttgtgagctggatgttaataagtgcaaaatttcaccgtgcctcgatgaggaaaactgtgtctaccgcactgatggctataattgcctgtgcgctcctgggtatacggggatcaactgtgaaatcaacctagacgagtgtttatctgaaccctgtctgcacgacggtgtctgcatcgatggcattaaccattacacttgtgactgcaagtctggcttcttcggtacacactgcgaaaccaatgccaacgactgtctatccaatccctgcctgcatggtcggtgcaccgagttaatcaacgagtatccctgcagttgtgacgccgacggcacaagcactcagtgcaagatcaagatcaatgattgtacctccatcccatgcatgaacgagggcttctgccagaagtctgcacacggctttacatgcatttgcccaagaggatataccggagcctactgcgagaaaagcatcgataattgtgctgaacccgaactcaactcagtcatctgtcttaacggggggatctgcgtggacgggcctgggcatacatttgactgcagatgtctgcccggctttagcggccagttctgtgagattaacattaatgagtgcagctccagcccttgcctacatggtgccgactgtgaggaccacatcaatgggtacgtttgcaaatgccagcccggctggagcggccaccactgcgagaacgagcttgaatgcatacctaactcatgcgtacacgagctatgtatggaaaacgagccaggatccacttgcctctgcactcctgggtttatgacttgctccataggcttgctatgtggagatgagattagacgaatcacttgcctcaccccaattttccagaggactgatcccatcagtacacagacctatacaatacctccatccgagaccctggtgtcatcattcccaagcattaaagctacccggattcctgcaatcatggatacatatcccgtcgatcaggggcccaaacagaccggcatagtgaagcacgacattttaccaacaacgggacttgcgacactgcgaatctcaaccccgctggagtcctacctgctgcaggagctcatcgttacgcgcgagctctcagccaaacattcccttctctcctcagcagatgtgtctagttccaggtttttaaacttcggaatacgagaccccgcccaaattgttcaggataagacctctgtttcacatatgcccattagaacgtccgccgctacactgggctttttctttccagacagaagggcccggacccccttcattatgtcctccctcatgagcgactttatctttcccacccagagcctgctcttcgagaactgtcagacagtggcactgagtgccacgcccactacatccgtgatacgatctatccccggagccgacattgaactaaataggcaatcactgctttctagaggcttcctattgatcgccgcctcaattagcgccactcctgttgtctctcggggggcccaagaggacatcgaggaatattcggcagatagtctgatctcgcggcgagagcattggaggctgctaagtccgagtatgtctccaatatttccagccaaagtcataataagcaagcaagtcaccattcttaactcatccgccctacaccgttttagcaccaaggcgtttaaccctagcgagtaccaggcaattacggaagcctcaagcaatcagcggctgaccaatataaagtcacaggcagccgactcactcagagagctgtcgcagacttgcgctacgtgttccatgacagaaatcaagtcaagcagggagttcagcgaccaggtccttcatagtaagcaatctcatttttatgagaccttttggatgaactctgccattctcgcctcctggtacgccctgatgggggctcaaacaatcacaagcggtcactctttctcaagcgccacagagattactccgagcgttgcgttcactgaagttccaagtctttttccaagcaaaaagagcgcaaaacgcaccattctaagctcttcactagaggaatcaatcacactctccagcaaccttgacgtgaatctgtgcctggataaaacttgcttgtcaatcgtcccctcgcagacaatcagctcagacctgatgaactctgatcttacatccaagatgacgaccgatgaactctccgtgtctgagaatatactgaagcttctcaagataagacagtacgggatcacaatgggacccaccgaggtgctgaaccaggagtcactgctagacatggaaaagagtaaaggatcacacaccctttttaaacttcatcccagcgacagctccttagacttcgaattgaatctgcagatttatccagacgtgactttaaaaacatactcggaaatcactcacgctaatgacttcaaaaataacctgcctccactcactggctccgtacccgacttttcagaggtcactactaatgtagccttttacaccgtgtctgccacaccagccttgtcaatccaaacatcaagttccatgtccgtgatccgccccgactggccatacttcacggactacatgacgtccctgaagaaagaggtcaagacaagcagtgagtggagtaaatgggagcttcagccgagcgttcaatatcaagagttccctacggcctcgagacacctgccgttcacccggagcctgaccctgagtagcctggagtcaatcctggcacctcagaggctgatgatcagcgacttcagctgcgtgagatattatggagattcttacctggaatttcagaacgtagccctcaatcctcagaacaatatatccctggaattccagacatttagcagctacggacttctgctttatgttaagcaggatagcaatcttgttgatggcttctttattcaattatttatagagaacggtactttgaaataccatttctattgtcctggggaagccaaatttaagagcatcaatactaccgtcagggtggataatggtcagaaatacacccttttgattcgtcaggaattggacccttgcaatgccgagctgacaatactcggacgcaacacccagatttgtgaatcaataaatcacgttctggggaaacctttgccgaaaagcggaagtgtctttattggaggatttccggacttgcatggcaaaatccagatgcctgtgcctgtgaaaaattttaccggatgcatcgaagtaatagaaatcaacaattggaggtcttttataccctctaaggccgtcaagaactaccatattaacaattgccggagccaggggttcatgctgtcacccaccgctagcttcgtggatgcaagtgatgtgacccagggtgtggacacgatgtggacttccgtgtctccttccgttgccgcaccttcagtctgccaacaggatgtttgtcacaatggcggaacatgccacgctatctttctatcaagcgggatagtctcattccagtgtgactgccctttacacttcactggaagattctgcgagaaggatgctggcttgtttttcccatccttcaacggaaatagttatcttgagttgccattcttgaaattcgtgcttgaaaaggaacacaaccggacggtgactatttacctgaccataaaaacgaacagtttgaacggcactatactgtactcaaatggcaacaactgtggtaaacagtttctgcacctgttcctggtggagggccgcccctcagtgaaatacgggtgtgggaacagtcagaacattctgacagtctctgccaattactctatcaacactaatgcgttcacccccataaccatccgttacaccacgcccgtgggtagtccgggagtggtttgcatgatagaaatgaccgcagacggaaagcctcctgtgcagaagaaggacactgagatctctcacgcaagtcaggcgtattttgagtctatgtttctgggccacatcccagccaacgtccagattcacaagaaagcaggccccgtatacgggtttagggggtgcattctggatctgcaggtcaataacaaggaatttttcataattgatgaggctcgccatggaaagaatattgaaaactgccacgtgccttggtgtgcccatcacttgtgcagaaacaacggcacctgcattagtgacaacgaaaatctgttttgtgagtgtccccgactctactcggggaagctgtgccagtttgctagctgtgagaataacccatgtggcaacggagcaacgtgtgtgcctaagtccggtactgatatcgtctgtctttgcccatacgggcgctccggccccctgtgcacagatgcaattaacatcacccagcctcgattctctgggactgacgccttcggctatacgagtttccttgcatacagccgaatctccgacatatcttttcattatgagtttcacctcaaattccagctcgccaacaatcactcagccctccagaacaatctgatcttcttcacaggccagaaggggcacggtctgaatggagatgatttcctcgcagtggggctgttaaacggctctgtggtttactcctacaatcttggcagtggaattgcctctatccgtagcgagcctctgaacctgtcactgggggtccacaccgtgcacctggggaagttctttcaggaaggctggcttaaggtggacgaccataagaataaatctatcattgccccgggcaggctcgtcggtctcaacgtcttctcacagttctatgttggtggatactctgagtatacacctgacttattgccaaacggggcagacttcaagaacgggtttcaggggtgtatttttacattacaggttcggacagaaaaagacggccattttcgaggcctgggaaaccctgagggacatcctaatgccggacggtccgtaggtcagtgccacgcctccccatgttccctcatgaagtgtggtaacggaggaacatgcatcgagtccggtacctccgtctactgcaactgtactaccggatggaaagggtcattttgcaccgagacggtgtctacatgcgaccccgagcatgatcctccacaccactgctcacgaggggccacttgtatttctcttccccacggctatacttgcttttgcccactgggaaccactgggatctattgcgagcaggccctgatactgattgtcatactggagaaacctaaaccagcagagcggaaagtgaagaaagaggccctgtccatttctgatccgtcatttcgctctaatgagctcagctggatgtcttttgccagttttcatgtcagaaaaaagacacatatccagctacaatttcagccactggctgccgatggaatattattttatgctgcacagcacctgaaggcccagtccggggacttcctgtgtataagtctggtgaattcctcagtccagctgaggtacaaccttggggatagaaccattattctcgaaaccttacagaaggtgactattaacggaagcacgtggcatatcatcaaggcaggtagagtcggagccgaaggatatctggacttagacggcatcaacgtcactgaaaaggccagtacaaagatgagtagcttagatacaaatacagatttttacataggtggtgtaagcagcttgaatctagttaacccaatggctattgagaatgagcctgtgggtttccagggatgtattagacaggttatcatcaataatcaggagttgcagctcaccgaatttggagctaaaggaggctccaacgtgggggattgcgacggtacggcttgtgggtataacacgtgtcgtaatggcggagagtgtaccgtgaacggcactacgttctcctgccgctgcctgcccgattgggcggggaatacctgcaatcagtcagtctcttgtttgaataacttgtgtttacatcagagcctttgcattcccgaccaatctttcagctacagctgcctctgtactctaggatgggtgggacggtattgcgaaaacaagacgtcatttagtactgccaaattcatgggcaatagctacattaaatatatcgaccccaattacagaatgaggaacctccagtttacaaccatctccctgaacttctcgacaaccaagactgagggcttgattgtgtggatgggaatcgcccagaatgaggaaaatgattttctggcgataggcctgcacaaccagacccttaagattgccgtgaatttaggggagagaatcagcgtcccaatgagttacaacaatggcaccttttgttgcaacaagtggcaccacgtagtcgtgatccagaaccagactcttatcaaggcctacatcaacaattctcttatactcagcgaggacattgatcctcataaaaattttgtagctctcaattatgatggtatatgctatttggggggattcgagtacggacgcaaggtcaacattgtaacccaggaaatcttcaagaccaacttcgtgggtaaaatcaaagacgtcgttttctttcaggagccaaagaatatcgagctgatcaagttggaggggtataacgtgtacgacggcgacgaacagaacgaggtgacatag

SEQ ID NO: 116499 - DNA, 9435 bp, Artificial Sequence
  Description of Artificial Sequence: Synthetic coding sequence
atgaccgataagtccattgttattctttctctaatggtgtttcattcatcctttataaacgggaaaacatgtaggcggcagctggtggaggagtggcatccacagcccagctcctacgtagtgaattggacgctgaccgagaatatctgccttgatttttatcgcgactgctggttcttaggtgttaacaccaagattgacaccagcggaaaccaggccgtgccccagatatgtccgctgcagattcaattaggagatatcctcgtgatcagcagcgaaccaagtctgcagttccccgagatcaatttgatgaacgtgtccgaaacaagcttcgttggctgcgtgcaaaacactaccaccgaagaccagcttcttttcggttgtagattaaaaggcatgcacacagtgaactctaagtggctgagtgtcggtacacactactttataaccgtgatggcttcaggaccatccccttgtccattgggcctccgcctgaacgttaccgtaaaacaacaattttgccaggaatccctgtcatctgaattttgcagcggacatggcaagtgcctgagtgaggcttggtcaaagacctacagttgccactgtcagccccccttttccgggaaatactgtcaggagctcgatgcgtgctcatttaagccttgcaagaacaatgggtcatgcattaacaaacgtgagaactgggacgaacaggcctacgaatgtgtgtgccacccgccttttactggaaagaattgtagcgagattatcgggcaatgccagccacacgtatgcttccatggtaattgttctaatatcacctcaaatagcttcatctgcgagtgcgacgagcagttctcaggaccattctgtgaggtctctgctaaaccctgtgtgtcactgctattctggaaaagggggatctgccccaactcgtctagcgcctatacctatgaatgcccaaaaggatcaagttcacaaaatggcgagactgacgtatctgagttcagcctcgtgccatgccagaatggcacggattgcattaaaatttcaaacgacgtgatgtgcatctgcagtcccatttttaccgacctgctgtgcaagtctatccaaacttcttgcgaatcctttcccctccggaacaacgctacctgcaagaagtgcgaaaaagactatccatgttcttgcatctctgggtttaccgagaaaaattgcgaaaaggccatagaccattgcaagctactttcgattaactgcctcaatgaagagtggtgtttcaacattattggtagattcaagtacgtatgtattccagggtgtactaaaaacccatgttggttcctgaagaatgtgtacctgatccaccagcatctctgttattgtggtgttacctttcacggtatatgtcaggataaggggcccgcacaatttgagtacgtttggcaactaggcttcgcgggtagtgagggtgagaagtgccagggggtcattgacgcttatttctttctagcagctaactgcacagaggacgccacgtacgtgaatgaccctgaggataacaatagttcttgttggttcccccatgaggggactaaagagatttgcgcaaatggttgctcctgccttagtgaagaagactcccaagagtacagatatctctgcttccttcggtgggctggcaatatgtacttggaaaatactactgatgaccaggagaatgagtgccagcacgaggccgtgtgcaaggacgagatcaatagacccaggtgtagttgctctctctcttacataggacgtctctgcgtcgtgaatgtagactactgcctgggcaatcatagtatatccgtgcatggcttatgcctggctttgtcacataactgtaattgtagtggcctccagcggtacgagcggaacatctgcgagatcgatacagaggattgtaagagcgctagctgcaaaaatggcacgacctcaacccatctccgcggctatttctttcggaagtgtgtccctggattcaaaggcactcagtgtgaaattgatatcgatgaatgcgcaagccatccatgcaaaaatggcgccacctgtatcgaccagcccggcaattatttttgccagtgtgttcccccattcaaagtggtggacggatttagctgcctctgcaacccaggatacgtcggcatcaggtgtgagcaggacattgatgactgtatcctgaacgcctgcgagcacaattccacctgcaaagacttgcatttgtcttaccagtgcgtgtgcctgtctgactgggaaggcaacttttgcgagcaagaatccaatgaatgcaaaatgaatccctgtaagaacaactcgacttgcaccgatctgtataagtcatacagatgtgaatgcaccagcggatggacgggccaaaattgctcagaagagatcaacgaatgcgatagcgacccttgtatgaacgggggcctctgccatgaatcaaccatccccggacagttcgtttgtctttgcccacccctgtatacaggacaattttgccatcaaaggtataacctctgtgatttattacataacccttgccggaataactccacgtgcctggctctcgtggacgccaaccagcactgcatctgcagagaagaatttgaggggaagaattgcgaaattgatgtgaaggattgcctctttcttagttgccaggattacggcgattgcgaggatatggtgaataatttccggtgcatttgccgcccaggcttctccgggagcctttgcgaaatcgagatcaacgaatgtagcagcgaaccatgcaagaataacgggacttgcgtcgatctgacaaatcgcttcttctgtaactgcgaacccgaataccacggaccgttctgtgagctagacgtgaataaatgtaagatatccccatgcctcgatgaagaaaattgtgtctatcgaacagacggttataattgtctttgtgccccagggtatacgggcatcaactgtgagatcaacttagacgagtgcttgtcagaaccatgtttacacgatggcgtctgcattgacggtataaaccactacacttgtgactgtaagtccggtttctttggtacccattgcgaaaccaatgccaatgattgcctaagcaacccctgcttacatgggcgctgcacagagcttatcaacgaatacccttgcagctgtgacgctgacggcacctcaactcagtgtaagattaagatcaacgattgtactagtataccttgtatgaacgagggtttttgtcagaaatctgctcatggcttcacttgcatatgcccacggggctacacaggggcctactgcgaaaagtctattgacaactgcgctgaacccgaactgaacagtgtcatctgtttaaacgggggcatttgtgtggatggccccggtcatactttcgattgtagatgcctgcccggattttccggccagttttgtgaaatcaatattaacgaatgcagttcatcgccatgcctgcatggggcagactgcgaggatcacatcaatggttatgtgtgtaagtgtcaaccaggttggagcggccatcattgtgagaatgagctggagtgcattcctaattcttgtgtccatgaactttgcatggagaacgagcccggatccacctgcctgtgtaccccggggttcatgacttgctcaatcggcctcctctgtggagatgagatccggaggattacatgtcttacgcccatttttcagcgaacagatcctatctccactcaaacctacactattccccctagcgaaacacttgtcagctcattccccagtatcaaagcaacgaggatcccagctattatggacacctatcctgttgaccagggtccgaagcagactggtatcgtaaagcacgatattctacccacaaccggcctggccacccttagaatttccacaccgctcgaaagctacttactccaagagctgatagtgacaagagaactttctgcaaaacacagcctcctctcttccgccgatgtctcaagctcaaggttcctgaactttggtatacgtgacccagcccaaatagtacaggacaaaacaagcgtgtcccatatgccgatccgaacctcagcagccacactgggttttttcttccctgacagaagagccaggaccccttttataatgagtagcctcatgtcggactttatttttcctacgcagagcctgctattcgagaactgccagaccgtggcgctgtctgctacccctaccacaagcgttattaggtccataccaggcgccgatatcgaactgaatcgacagtccctgctcagtcgaggctttctcctcatcgctgcatctatcagcgcgactcctgtggtgagcagaggcgcccaggaagacatcgaggagtactcagcagatagcttgattagcaggagagaacattggagattactgtccccttctatgtcccccatcttccctgctaaggtcattatatctaagcaggtgactatacttaattcttccgctctgcacaggttttcaactaaggcatttaacccgagtgagtatcaagctattaccgaagcttcgtctaaccagagactgaccaacatcaagtcacaagccgccgattcccttagggaactatctcagacgtgcgcaacctgctcgatgactgagatcaaatcatcccgagagtttagtgaccaagtgctgcactcaaagcagtcccacttctacgaaaccttctggatgaactctgccattcttgcctcctggtatgccttgatgggggctcagaccattacttcaggccattccttctcctccgctaccgaaataaccccaagcgtggctttcaccgaagtgcctagcctgtttccttctaagaagtccgctaagcggaccatccttagctcctccctagaggagagcataacactgtcttcgaatcttgatgtgaacttgtgtctcgacaaaacctgcctctccattgtgcccagtcagactatctctagtgatcttatgaactcagacctgacatcgaaaatgaccaccgacgagctctcggtgagcgaaaacatactcaaactcctgaagatccgccagtacggtattacaatgggccccacagaggtgcttaaccaagaaagcctccttgatatggagaagtcaaagggctcccacacgctgtttaagcttcaccctagcgactccagcctggactttgagctcaatctgcagatctaccccgacgtaactctcaaaacttactctgaaatcacacacgccaacgacttcaaaaataacctgcctcctttgaccggatctgtgcccgacttcagcgaagttactacaaatgtcgcgttctacactgttagcgcaacgcctgccctatccattcaaaccagcagcagcatgagcgtcattagacccgattggccatattttaccgactatatgacgtccctcaagaaggaggtgaagacctcctcagaatggagcaaatgggagctgcagccttctgtacagtaccaggagtttccgacggcgagcagacatctcccatttacacggtccttaaccttatcgagcctggaatcaatcctcgctccacagcgtctcatgattagcgattttagctgtgtccgctactatggcgacagctatctcgagttccagaacgttgccctgaaccctcagaacaacatttccctggagtttcagacattttcctcatacggattgctgttgtatgttaagcaggatagcaatctggtggatggattttttatacagctgtttatcgagaacggaactcttaagtaccacttttattgccccggggaggctaaatttaaatccattaacaccaccgtgcgagtggataatggccagaagtacaccctgctgattagacaagagctggatccctgtaatgccgagttgacaatcctgggacggaacacacagatctgcgaatcaatcaatcacgtgctggggaagccacttcccaagagcggatcagttttcattgggggtttccctgacctgcacggcaaaattcaaatgcccgtgcccgtcaagaactttacaggatgcattgaggttatcgagattaacaactggcggagcttcattccttctaaggctgtcaaaaactatcatatcaataattgtaggtcacaggggttcatgctcagtccaacagcaagtttcgtcgacgctagtgatgtgacccagggcgtagacacaatgtggacatccgtgagccccagtgttgctgcaccctccgtgtgccaacaagatgtctgccataacggaggcacctgccatgcgatctttctgtcaagcggcatcgtgtcattccagtgcgattgtccactccactttaccggtcgattttgtgaaaaggacgccggtctgttctttcccagctttaatgggaactcatatctggagctccctttcctgaagtttgtgctcgaaaaggaacataaccgaactgtcacgatctacttaaccataaagaccaacagcctcaacggaacaatcctgtacagcaacggcaataattgcggcaagcaattccttcacctgttcctagtggaaggtagaccctctgtcaagtacggatgcggaaatagtcagaatatcttaaccgtgagtgcaaattactccataaataccaatgctttcacccccatcactatccggtacaccacccctgtcggcagcccaggcgtcgtatgtatgattgaaatgacggctgacggcaaacccccagtgcaaaagaaagacactgagatttcccacgcgagccaggcgtatttcgaatctatgttcctggggcatatcccagcaaacgtgcaaatccataagaaagcagggcccgtgtatggattccgaggttgcatccttgatctgcaggtgaataataaagagttctttatcatcgacgaagcacgccatggtaaaaatattgagaattgccatgtcccttggtgtgctcaccatctgtgtcggaataacggtacctgtatcagcgacaatgagaacctgttctgcgaatgtcccagactgtactcaggcaaactgtgtcagttcgcctcctgcgaaaacaatccgtgtggcaatggagctacgtgcgtgcctaagagcggcaccgatattgtctgtctgtgtccctacggccggagcggtcccctctgcactgacgctataaatataacgcagcccagattctccggtacagatgctttcggctatactagcttccttgcttattccaggatttcggatatctcctttcactacgagttccacttaaaattccaactagcaaacaaccattcagccttgcagaataatctgatctttttcaccggacagaaagggcacggcctgaacggtgacgactttttggccgttggattactcaacggctccgtggtgtactcatacaatcttggaagcggtattgccagcatccgcagtgaaccactgaacctgagtctcggcgtccacactgttcatctgggaaagtttttccaggaaggctggttgaaggtcgatgatcataaaaataaatccattatagcaccgggcagactcgtggggttgaacgttttttcccaattctacgtcggcggctactcggagtatacgcccgatttgctgccaaacggggcagactttaagaatgggttccagggttgcatctttacattacaggtgagaaccgagaaagacggacatttccggggtctgggaaaccccgaaggacatccaaatgctgggcgtagcgtcggtcagtgtcatgcctccccctgttctctgatgaagtgcgggaatgggggcacctgtatagaaagcggaactagcgtgtattgtaactgcacgactggatggaaaggttccttttgtacagaaacggtatccacctgcgaccccgaacatgaccctccacaccactgctctagaggcgcgacatgcatctctctcccccatggttatacctgtttctgtccgctggggacgactggcatatattgtgaacaggccctcagcatcagcgacccctctttcagatccaacgaactcagttggatgagtttcgcctcctttcacgtccgtaaaaagacccacatccaattacagttccaacccctagcagccgatgggatcctgttttacgccgcccagcatctaaaggcgcagagcggggacttcctctgtattagcctcgttaactcgtccgtgcaattgcggtacaatttaggcgaccggactatcattctcgaaacccttcagaaagttaccattaacggctctacctggcacattattaaagcaggaagagttggcgcagagggctacctggatctggatggtatcaacgtgactgaaaaagcgtctaccaaaatgtcctccctggacaccaatacggacttttacattggcggagtgagtagtctcaacctagtcaatccaatggccatcgaaaacgagccggtgggctttcaaggttgcatcaggcaggtcatcataaataatcaagaactgcagttgacggaatttggggctaagggaggctccaatgtgggtgattgcgacggcacagcgtgtgggtataacacgtgccgcaacggaggagaatgtactgttaacgggactacattctcttgcagatgcctgcccgactgggctggaaacacctgcaatcagtctgtttcttgtctgaacaatctgtgcttgcaccagtctctttgtatccctgatcagtctttcagctattcgtgtctgtgcactcttgggtgggtgggccgctattgtgagaacaagacctcatttagcacagccaaatttatgggcaacagctacatcaaatacattgaccctaattatcgcatgaggaacttacagtttaccactatctcgcttaattttagcaccaccaaaactgagggtctaatcgtctggatgggcatcgcccagaacgaggaaaatgattttctcgctattggactgcataatcaaacgctgaagatcgcggtgaaccttggagagaggatctcagtgcctatgtcatataataacggaacattctgttgcaataaatggcaccacgtggtagtgattcaaaaccagacactcatcaaagcttatataaataattcgctgattctgtctgaggacattgatccccacaaaaattttgtcgcccttaactacgatgggatctgctatctggggggattcgagtatgggcggaaagtgaacattgttacacaggagatttttaaaactaattttgtcggtaaaattaaagatgtggtgttctttcaggagccaaagaatatcgaactgataaagctagaaggctataatgtatacgacggggatgaacagaatgaggtgacctag

SEQ ID NO: 116500 - DNA, 1785 bp, Artificial Sequence
  Description of Artificial Sequence: Synthetic coding sequence
atgaccgataagagtatagtgatcctgagcttaatggtgtttcacagctccttcatcaatgggaagacctgtagacgccagctggtcgaggagtggcacccccagcccagctcatacgttgtgaactggaccctaacggagaacatctgcctggacttttatcgcgactgctggtttttgggtgtgaatacaaaaatcgacacgtcaggcaaccaagccgtcccccaaatttgcccacttcaaatccagttgggagacattctggtgattagctccgagccctccctccaattccccgagatcaatttaatgaatgtgtccgaaacatcttttgtaggctgtgtgcaaaatacgacaaccgaggaccagctcttgtttggatgtaggcttaaaggcatgcataccgtaaactctaaatggctgtccgtggggacacactacttcatcactgtgatggcttcgggacctagtccatgcccattaggcctcaggctgaatgtgaccgtcaaacagcagttctgccaagagagcttatcatccgaattttgcagtggccacggtaagtgcctttccgaagcatggagcaagacctactcctgccactgccagccaccattctctggaaaatactgccaagagctggatgcttgtagcttcaagccatgcaaaaataatggctcttgcatcaataagagggagaattgggacgaacaggcttatgagtgcgtttgccatcctccttttacagggaagaattgctctgaaatcattggccaatgtcagccacacgtgtgtttccacgggaactgctcaaacatcacctctaactcttttatttgtgagtgcgatgagcagttctcagggccattttgcgaggtctccgcaaaaccatgcgttagcctgctgttctggaagcgcggcatatgccccaatagcagttctgcttatacatacgaatgccccaaagggagcagttctcagaatggtgagactgacgtcagcgagtttagcctcgtcccttgccaaaatggtactgactgcatcaaaatctccaacgatgtgatgtgtatctgcagtccaatatttaccgacctgctctgcaagtcaatacaaacaagctgcgaatcttttcctcttaggaacaatgcaacctgcaagaaatgcgaaaaggactacccctgctcctgcatttccgggtttacagagaagaactgcgagaaggccattgaccactgcaagttgctgagcatcaactgcttgaatgaagaatggtgttttaatatcatcggaaggtttaagtacgtgtgcataccgggctgtacaaagaacccgtgctggtttctcaaaaatgtctacctgatacatcagcatctttgttattgtggcgtcaccttccacggcatttgccaggataaggggccagcacagtttgaatacgtttggcagctgggattcgcaggttcagaaggggagaaatgtcagggtgtcatagatgcctacttctttttagccgctaactgcacggaggacgctacgtatgttaatgacccggaagataataacagcagctgctggttccctcatgaaggcactaaagagatctgtgccaacggctgctcttgcttgtcagaggaggattcccaagagtatcggtacttatgctttctccgctgggctggcaatatgtacctcgaaaacaccactgacgatcaggaaaacgagtgtcaacacgaagccgtgtgcaaggatgagattaacagacccaggtatctttgcatcatttag

SEQ ID NO: 116501 - DNA, 1860 bp, Artificial Sequence
  Description of Artificial Sequence: Synthetic coding sequence
atgaccgataaatctatcgttattctgagtcttatggtgtttcacagtagcttcatcaatggcaaaacctgtcgaagacagctggtcgaagaatggcatccacagcccagtagttacgtggtgaattggacattaaccgagaacatctgtctggacttttaccgagactgctggtttcttggagtgaataccaaaatagacaccagtggcaatcaagctgtgcctcagatctgccccctgcaaattcaactaggcgacattttggtgatatcatcagaaccatcacttcagttcccggagatcaacttgatgaacgtgtccgaaactagctttgttgggtgtgtccagaacactacaacagaggaccagttactgtttggttgtagactgaaaggtatgcacacggtcaattctaagtggctctcagtgggcacacactactttataacagtaatggcctctggaccatccccttgtccactggggttgcggctaaatgttactgtgaagcaacagttctgtcaggaatccctgagctctgagttttgtagtggacatggcaagtgcctgtcggaagcttggtcgaagacatacagctgccactgccagcccccgttttccggaaagtactgtcaggagttggacgcctgttcattcaagccttgtaaaaataatggctcatgtatcaataaacgagagaactgggacgaacaggcctatgagtgcgtatgccatccccctttcaccggcaaaaattgttctgagatcataggacagtgtcaaccgcatgtttgctttcatggcaactgttccaatattacatcaaactcttttatatgtgagtgtgacgaacagtttagtggacccttttgcgaagtatcagcaaagccttgtgtgagcctactgttttggaagcggggtatttgccctaacagctcaagcgcctacacctatgaatgccccaaaggctctagttcgcaaaacggcgagacagacgtgagcgaattcagcctagtgccttgtcagaatggcaccgactgcataaaaatctctaatgatgtaatgtgtatttgctctcctatattcaccgatctgctgtgcaagtccattcagacttcttgcgagtcatttccactgcggaacaacgctacatgcaaaaaatgtgagaaggactacccctgttcctgcatctcggggtttaccgaaaagaactgtgagaaagcaattgatcactgcaagctcctatctatcaactgcctcaatgaagaatggtgcttcaacattattggacggttcaagtatgtttgtatccccggatgtaccaaaaacccttgttggttcctgaagaacgtgtacctgatacaccagcatctttgctactgcggagtcactttccatggtatttgccaagacaagggaccggcccaattcgagtacgtgtggcagcttggtttcgcaggcagcgagggcgagaagtgtcagggagtcattgatgcctatttctttctcgccgcaaactgcactgaagacgccacctatgtgaatgatccagaggacaacaatagcagctgctggtttccccatgaaggcaccaaagagatatgtgcaaatggatgttcttgcctctctgaagaggatagccaagaatatagatacttatgtttcctgaggtgggctggcaatatgtatctcgagaacacgacagacgaccaagagaacgagtgccagcacgaggctgtgtgtaaggatgagatcaataggccccggcgaattctgaatacagtgatccctcatcaaattcagcagcatatagaaagatttattcagcatgaccaagtgggctttatagtccgcatttag

SEQ ID NO: 116502 - DNA, 1764 bp, Artificial Sequence
  Description of Artificial Sequence: Synthetic coding sequence
atgggctgggatctgggaactcgcctgtttcagcgccaggaacagagatcacgactgagccgcatatggctcgagaagacccgggtctttttggaggggagtacacgaacgccagcattgccacactgcttgttctggcttctgcaagtgccttctacacaggatcctctgttccctggttacggtccacaatgtcctgtggatctggcggggcctccctgtctgagacctctcttcggcggactgggaggatactggagagcgctgcagagaggacgtgaaggtcgaacaatgacatctcgtgcaagcgaattaagccctggacggtctgtaactgccggaatcataatcgtgggcgacgagattctcaagggtcatacccaagacacaaacacatttttcctatgtcgaactctgcggagcctgggcgtgcaggtgtgtcgggtgtctgttgtgccggacgaagtggctacaatcgccgcagaagtaaccagcttctccaatagattcacgcacgtgcttaccgcaggcgggattggtcctactcatgacgatgtgacctttgaagccgtggcacaggcattcggggacgaacttaagccccatccaaaattggaggcagccaccaaggcactggggggagaagggtgggagaaactttccctcgtcccttcgagcgctagattgcactacggaaccgatccctgcacaggccagcctttccggttccctctggtttccgtgagaaacgtgtacctgtttccaggtatccctgaacttctcagacgggtgctggaaggcatgaagggcttattccagaaccctgctgtgcagttccactccaaggagctgtacgtcgctgccgacgaggccagcattgcacctatactggccgaagctcaagcacacttcggacgtaggctaggactgggaagttacccagactgggggtccaactattaccaggtcaaactgaccttggatagcgaggaggagggtccgctcgaggagtgcctagcctacctcactgctcgcctcccacaagggagtctcgtgccttatatgccgaacgctgtggagcaagcatctgaggccgtgtataaacttgcggaatctgggtccagcctaggcaagaaggtggctggtgctttgcagacgattgagacaagtcttgcgcagtactctttaactcagctgtgcgtgggcttcaatgggggcaaggactgcaccgccttgctccacctcttccatgccgccgttcaaagaaagctgccagatgtgcctaatccactacagatattatacatccggagtatcagcccctttcccgagcttgagcaatttctccaggatactatcaagcggtacaacctacagatgctggaagcagagggaagcatgaagcaggcactgggggagctgcaggccagacacccccagctggaagctgttctcatgggtactcgtcggaccgatccatacagctgctctctctgcccgtttagtcctaccgacccaggctggcccgccttcatgaggattaatcctctactggattggacgtaccgagatatctgggattttttgaggcagttgttcgtgccatactgtattctctacgaccgaggatacacatccttgggctccagagaaaacactgtgaggaatcctgccttaaagtgcctctcacctggcggtcaccccacctatagacccgcctacctgctggaaaacgaagaggaggagcgtaattcccggacctag

SEQ ID NO: 116503 - DNA, 513 bp, Artificial Sequence
  Description of Artificial Sequence: Synthetic coding sequence
atgaagggtctgtttcagaatccagccgtgcaatttcattccaaggagttatatgtggctgcggacgaggccagtatagcccctatccttgccgaagcacaggcccacttcggacggcggctagggctaggctcatatcccgactggggatccaactattaccaggtgaagctcacgctcgatagtgaggaagaagggcccctggaggagtgtctggcctacctgactgcaagactaccccagggctcactcgtgccgtatatgccaaatgccgtggaacaggcctccgaggcagtgtacaagctggccgaatcagggaattacttgatgttccagacgccttcccgaagttgcatcagtgctgcttcaccactcagcctcagctggaacagcttctaccgaactctatctcgcgaacaggctattcctgaaaaccagatcgcctccccacccagtgaggctaaaggcgcagaagagccctggatgggcccttttccaggccaacaagggtag

SEQ ID NO: 116504 - DNA, 1473 bp, Artificial Sequence
  Description of Artificial Sequence: Synthetic coding sequence
atgacttcacgagcgtcggaactttcccccggcaggtccgtgaccgccggtataattattgtgggggacgagatacttaagggtcatacccaagacactaatactttctttctgtgcaggaccctccggtcgttgggggtgcaggtgtgtcgggtatctgttgtgccagacgaagttgctacaattgcagctgaggtaacctcattcagcaatcgtttcacccatgtgcttaccgccggtgggatcggcccaacacacgacgatgttacttttgaggccgtggctcaggcctttggggacgaactcaagccccacccaaagttggaggccgctactaaagctctgggaggcgagggatgggagaaactgtccctggtaccttcatccgcgagactacactatggaacagacccctgcaccggccagccctttagattcccattggtgtctgtcaggaatgtttacctgttcccaggcattcccgaactacttcggagggtgcttgagggcatgaagggtttgttccagaaccctgccgtgcagtttcactcaaaggaactgtacgtagctgctgacgaggccagtatcgccccgattctcgcagaagctcaagcccatttcgggcggagactgggattgggcagttatccagattgggggagcaattactatcaggtgaagctgaccctggactccgaagaagaaggaccactcgaggagtgcttagcgtacctgacagcacgcttaccccaggggtcacttgtcccttacatgccaaatgctgtggagcaggcatccgaagcggtttacaagttagcggagagtggttccagcctcggaaaaaaagtagctggggcactgcagaccatcgagacttctctggcccagtacagtcttacccagctatgcgtggggtttaatggaggcaaggactgtacagcccttctccacttattccatgctgccgtgcagaggaagctgccagacgttcccaatccgcttcagatactgtatataagatcaatttctccttttcccgaactggaacaatttctccaggataccattaaaaggtacaaccttcagatgctggaagccgagggttccatgaaacaggctctcggtgaactacaggctcgacatccacagctggaggcagtgctaatgggcactaggcgcacagacccctactcttgcagcttatgcccattttcacctacagatccagggtggcctgcattcatgaggatcaatccactgctggattggacctatagagatatctgggacttcttacgacagctgtttgtaccttattgcattctttacgaccgtgggtatacctccctcggctcccgagagaataccgtgcggaatccagcactcaagtgcctgtcaccgggggggcaccccacttacagaccagcctacctgttggagaacgaagaagaggaacggaactcacggacgtag

SEQ ID NO: 116505 - DNA, 387 bp, Artificial Sequence
  Description of Artificial Sequence: Synthetic coding sequence
atgctggaagctgagggctccatgaagcaagcgttgggggagcttcaagccagacatccccagctagaggctgttttaatgggcacacggcgcaccgacccatattcgtgcagcctgtgccccttttcccccacagaccccggctggcccgctttcatgaggattaatccccttctggattggacctaccgagacatttgggacttcctgaggcagttattcgtgccgtattgcattctttatgacagagggtacacatccctgggttcacgagaaaacactgtgcgcaaccctgccttgaaatgcctcagcccaggggggcatccgacttacaggcctgcctatctgctcgagaacgaggaagaagagcgaaattctcgtacctag

SEQ ID NO: 116506 - DNA, 885 bp, Artificial Sequence
  Description of Artificial Sequence: Synthetic coding sequence
atgcaacctagctcctccactcccccactccacccttacagcacagacggactcatctttcccttcaatcctcaaggtcacactcaagacactaatacgttcttcctttgtaggaccctcagatcgttaggtgtacaggtctgcagagttagtgtggtcccagatgaggtggccaccatcgccgccgaggtaacaagtttttcgaatagatttactcacgtactgacagctggcgggattggacccacccacgatgacgtgactttcgaggcagtggcccaggcctttggcgatgagttgaagccacatcccaaactggaggccgcgacaaaagctcttggaggggaaggctgggaaaaactatccttggtacccagctcggctaggctgcactacgggaccgacccatgtactggccagcctttcaggttccctctggtttccgtccgcaacgtctacctgtttcctggcatccccgaactgctgagaagggtgttagagggcatgaaaggattgttccaaaaccctgccgtccagttccattctaaggagctgtatgtggccgccgacgaagccagtatcgcacctattctggcagaagctcaagcccactttggtaggagacttgggctcggctcctaccccgactggggtagcaactactatcaagtcaaactaactctggactccgaggaagagggtccccttgaagagtgcctggcttatctgactgctcgcctgccgcagggcagtctggtcccgtatatgccaaatgctgtggaacaagcctctgaggctgtatataagctggctgagtctggacgcgatctgatggaggaaggacattatgcccaaagccattggtggcaccctcggagccagtag

SEQ ID NO: 116507 - DNA, 1341 bp, Artificial Sequence
  Description of Artificial Sequence: Synthetic coding sequence
atgacctccagggctagcgaattgtcccctggccggtccgtgactgccgggataatcattgtaggggacgagatcctgaaggggcacacacaggatacgaacacctttttcctatgtcggacactgcggtccctgggtgtccaggtgtgccgcgtgagcgtagtgccagacgaagtcgccaccatcgctgccgaagtcaccagcttttccaacaggttcacacacgtgctgactgctggtggcatcggccccacccacgacgatgtgacttttgaagccgtggcccaggcatttggcgatgagctcaagcctcacccaaaattggaagccgctacgaaagccttaggcggagagggatgggaaaagctgagcctggtgccttcgagcgcgcggctccattacggaaccgatccgtgcacgggccagcctttccgctttcctctggtgtctgtcagaaatgtatacctcttccctggaattcctgaactcttgagaagggtgctagaaggcatgaaaggtctttttcaaaatcctgccgtgcagttccactccaaagagttgtacgtggcagctgatgaggcttctatcgcccctattcttgccgaggcccaggcccacttcgggcgtaggctgggcctagggagttacccagactgggggagcaactattaccaggtcaagctgaccctggacagcgaggaggaaggccctttggaggaatgccttgcttatttaactgctcgtctgccacaaggtagcttagtgccctatatgccgaatgctgttgaacaggcctctgaggcggtgtacaagctggcagaatctggttctagccttggcaaaaaagtggctggagctttgcaaaccatagagaccagcctagcccagtatagcctaacgcagctttgcgtcgggtttaatggcgggaaggattgcacagccctactgcacctgtttcatgccgcggtccagcggaaactccccgatgtacccaatccattgcaaattctgtacattcggtcaatctccccgtttcctgagctggaacagttcctccaggacacgattaaacggtacaatctgcagatgctggaagccgagggtagcatgaagcaagctcttggggaactgcaggcaagacatccacaattggaagccgtcctaatggggaccagaagaactgatccttatagttgctctctgtgcccattctctcctacagaccctggctggccagctttcatgcggattaatccactgctggactggacctacagagatatttgggattttctccgtcagctatttgttccttactgcatcttgtacgacagggggtag

SEQ ID NO: 116508 - DNA, 1371 bp, Artificial Sequence
  Description of Artificial Sequence: Synthetic coding sequence
atgggttgggaccttggtaccagactctttcagaggcaggagcagcggagccgactgtctcgaatctggctcgaaaagacgagagtgtttttggaaggatccacccgtacccctgcactgccacactgtctcttttggttgctgcaggtgccctccacacaggaccctcttttcccgggctatggccctcagtgtcccgtggatcttgctggcccaccctgcctgaggccactgtttggcgggttaggcggctattggcgggcgctgcaacgaggtcgcgaaggacgcacaatgacaagccgggctagcgaattatccccaggaagatccgtcaccgccgggatcatcatcgtaggcgacgagatacttaaggggcacacccaagataccaacacatttttcctatgcagaaccctccggtccctgggggttcaggtatgtagagtgagcgtagtacctgatgaagtcgcaacgattgccgcagaggtgactagcttctctaacaggtttactcacgtattgaccgctggtggcattggaccgacacacgatgacgttacttttgaggccgtcgcacaggcctttggtgatgagctcaagccccaccccaagctcgaggcagctacaaaggcgctgggaggcgaggggtgggaaaagctcagcctcgtcccatctagcgcaaggctgcactacggaacagacccgtgcacaggacagccgttcagattcccgctggtaagcgtacgcaatgtttatctctttccaggtatccccgagcttctcagacgggtgctggagggcatgaaagggttgttccagaatcctgccgttcaattccacagtaaagaactctatgtcgccgccgatgaggcatccatcgctcctattctagccgaagcccaggctcactttggcagacgactcggccttggttcatatcctgattggggctcaaactattatcaggtgaaactgaccctggatagcgaggaggagggaccgctggaagaatgtctcgcatatctgactgccaggctgcctcaagggtctctggtgccttatatgccaaatgctgtggagcaagcctcagaagccgtgtataaactcgccgagagcggatcctcactcggcaaaaaggtggctggagcgctccagaccattgagacgagcctcgcacagtactccctgacacagttgtgtgtgggcttcaatggcggcaaggactgcaccgccctgctacatctttttcacgccgctgtacagagaaaactccccgatgtgcccaacccattgcagattctgtacatccggtcaatcagtcctttccctgaattagagcagttcctccaggataccataaagcggtactag

SEQ ID NO: 116509 - DNA, 1017 bp, Artificial Sequence
  Description of Artificial Sequence: Synthetic coding sequence
atgcaacccagctcttcaaccccaccactccacccatatagtacagatggactcattttcccatttaacccccagggccatacacaggacacaaataccttcttcctgtgtcgtactcttaggtcactgggcgttcaggtatgcagagtctccgtcgtgccagacgaggttgcgactatcgcagcagaggttacttcgttttcgaataggtttacccacgtgctcaccgctgggggaataggccccacccacgacgacgttacgtttgaggcagtggcccaggcattcggcgacgagctgaagccacaccccaagctggaggcagccaccaaggcactcggtggcgaaggttgggagaagctcagtctagtcccaagcagcgccagactccattatggtaccgacccgtgtaccggccagccctttagatttcccctcgtctccgtgcgcaacgtgtacctctttcccggcatccccgaactcctgaggagggtgttagaaggcatgaagggtttatttcagaaccctgctgttcaatttcacagcaaggagctgtacgttgctgcagacgaggcctcaattgctcctatacttgctgaagcacaggcccatttcggccgacgcttaggtctgggttcctatccagactggggatcaaattattaccaggtgaagcttacactcgacagcgaagaagagggccctctggaggagtgcttagcctacttgacagcccggctgccccaaggcagtctggtgccctatatgccgaacgccgtggagcaggccagtgaggctgtatacaagctggccgagtccgggaattacctgatgtttcagactccatctagaagttgcatctccgccgcctctcccctgtcgctgtcctggaattcattctatcgcaccttgtcgcgcgaacaagcaattccagagaaccagatagcaagcccgcccagtgaggccaagggggcagaagaaccgtggatggggccattccccggacagcaggggtag

SEQ ID NO: 116510 - DNA, 1461 bp, Artificial Sequence
  Description of Artificial Sequence: Synthetic coding sequence
atgatacgtcgagtccttcctcacgggatggggagaggacttctcactaggagacctggaacacgccgcggcggctttagtctggactgggatggtaaagtctccgagattaagaagaaaatcaagtcaattctcccgggccggtcttgcgatctactgcaggacaccagccatctgcctccagagcactccgatgtcgtgatcgtcggggggggggtgttggggcttagtgtggcatattggctcaagaagctggagagtcggcggggcgctatcagggtcctcgtagtggagagagaccacacctactcacaggcctccactggcctctctgttggtggaatctgtcagcagttctctctaccggagaatattcagttaagcttgttctctgccagctttctgaggaacattaatgaatatctggcggtggttgatgctcctcctctcgacctgaggtttaatccatcaggataccttctattggcaagcgaaaaagatgctgctgcaatggagagtaacgtgaaagtgcagcgccaggagggcgctaaggtcagtctgatgtctcccgatcagctcaggaacaagtttccctggatcaatacagagggcgtagcactggcttcatacggtatggaggatgaggggtggtttgatccatggtgcctgctgcaggggctccgacgcaaggtccagtccctgggagtgcttttctgccagggtgaggtgactcggtttgtttctagctcacagaggatgcttacgactgacgacaaggcggtggttctaaaacgaatccatgaagtgcacgttaagatggaccgctctctggagtaccagccggttgagtgcgcgattgtgatcaacgcagccggcgcttggtccgcacagatagcagccctggccggggtgggggaaggacctccgggaacactgcagggcacaaaactgccagtggagcctcgcaaaagatatgtatacgtgtggcactgcccccaggggcctggactcgaaacacctttggtggcagataccagcggagcctactttcgccgcgaggggctgggcagtaactacctgggaggacgatctccgacagagcaagaggaacctgaccctgccaatctggaggtggaccacgacttcttccaggacaaggtctggccccacttggccctgcgggtgccagcctttgagactctcaaggtacagagcgcctgggctgggtattatgattataatacatttgatcagaatggggtcgtgggcccccatcctctcgtggtgaatatgtactttgctactggattttctggacatggtctccagcaggccccaggaatcggtagggctgtggccgaaatggtgctcaagggtagatttcaaacaattgacctgagcccgtttctcttcacccgcttctacttaggcgagaaaatacaagaaaataatatcatatag

SEQ ID NO: 116511 - DNA, 951 bp, Artificial Sequence
  Description of Artificial Sequence: Synthetic coding sequence
atggagagcaatgtgaaagtgcagagacaagagggagctaaagtgagcctgatgtctccagaccagcttagaaataagttcccttggatcaataccgaaggggttgcccttgcgagttacggaatggaagacgaaggctggtttgacccatggtgcctgctgcaggggctacgaaggaaggtccagtcattgggcgttctcttctgccaaggtgaggtaacacggtttgtgagctccagtcaaagaatgctgaccaccgatgacaaggccgtagtgctcaagcggattcacgaggtgcacgtgaagatggacagatccttggagtatcagcctgttgagtgcgcgatcgtaattaacgcagctggggcttggtccgcacaaatagccgccctggctggagtaggcgagggacccccagggaccctgcagggtaccaagctccctgtagagccccggaaaagatatgtgtatgtttggcactgcccacagggacccggtctcgagacaccactggttgctgacactagcggagcttatttcagacgggaaggcctcggatctaactacctgggcggccgcagccccacagagcaggaggaaccagacccagccaatttggaagtcgatcacgatttttttcaggataaggtgtggccccaccttgcgctgcgcgtccctgctttcgagactttaaaagtgcaatctgcctgggcaggctactacgattacaacacgttcgatcaaaatggcgtagttgggccacatcctcttgtcgtaaatatgtattttgctacaggcttctctggccatggtcttcagcaggccccgggtattgggagagctgttgcggagatggtgcttaagggccgcttccagacgatagacctgagtcctttcttgttcactcggttttatctcggggaaaagattcaggaaaataacatcatttag

SEQ ID NO: 116512 - DNA, 1419 bp, Artificial Sequence
  Description of Artificial Sequence: Synthetic coding sequence
atggctcataccgggagaactgtggggcggctgggagaaggtgactgggacggcaaagtgagcgagattaaaaaaaaaatcaagagcattttgccaggtcgtagctgcgatttgctgcaggacacaagccatctgcctcctgagcactccgacgtggtgatcgtgggcgggggtgtcctgggcctgagtgtggcgtattggctgaaaaagttggaatctaggcggggggctattcgggtgctagtcgtggaacgagaccacacatattcacaggcctcaacaggcctatctgtgggcgggatctgccagcagttttctctaccagagaacattcagctgagtctgtttagtgcctcatttctgcggaacatcaatgagtatcttgcagtcgtggacgctcctcccttggacctgagatttaatccgagcgggtacctgttgctggcttctgagaaggacgctgcagctatggagagtaacgtgaaggtgcagaggcaagagggtgccaaagtctccctgatgtcacccgaccaactgaggaataagtttccgtggatcaatacagaaggggtggcgttggcttcttatggcatggaggacgaagggtggttcgatccatggtgcctgttgcagggcctgcgacgtaaggtacagtctctaggcgtactcttttgccagggcgaggtcacacgcttcgtcagcagtagtcagcgtatgttgaccacagatgacaaggctgtcgtcctcaagcggatacatgaagtgcacgtgaagatggatcggagcttagaatatcagccagtcgagtgtgccattgttattaacgccgcgggtgcatggtccgcccaaatcgctgctctagccggggttggagagggccctccaggaacgctccagggcaccaagttgcctgtagagcctcgaaaacgctacgtgtacgtgtggcattgcccccagggtcctgggttggagacacctctggtcgcggacacatcaggagcatatttcaggagagagggacttggaagtaactacctaggcggacggtctccaactgaacaagaagaacccgatccagcaaacttagaggtggaccacgatttttttcaggacaaagtctggccccacttagcactcagggtgcccgcctttgaaacgctcaaggtgcaatctgcatgggccgggtattatgactataacacgttcgaccagaacggagtggttggcccccacccactcgttgtgaacatgtattttgcgactggcttctcgggccatgggctccagcaggctccaggcatcggacgtgccgtggctgagatggtgttaaagggacggttccagaccattgacctttctccgttcctgttcacacggttttatctaggtgaaaagatacaggagaacaacataatctag

SEQ ID NO: 116513 - DNA, 501 bp, Artificial Sequence
  Description of Artificial Sequence: Synthetic coding sequence
atggcccagcggctgctgttgagacggttcctagcatcagtaatctctagaaagccatcacagggccagtggccccctcttacgtccagagccttgcaaactccacagtgtagtcccggaggtctcactgtgacccccaacccggcccggaccatttacacaacccgcatcagtctgacaacattcaatattcaggatggccccgacttccaggaccgggttgtcaacagcgagactcccgttgtagtggacttccatgcacaatggtgtggaccgtgcaaaattctaggcccacggcttgagaaaatggtggctaaacaacatggaaaagtggttatggccaaggttgacatcgacgaccacaccgacttggctatcgaatatgaagtgtcagcagtccctactgtactggccatgaaaaatggagacgtggtggataagtttgtcggcatcaaggacgaggatcaactggaggcattcctgaaaaagctgatcggctag

SEQ ID NO: 116514 - DNA, 2055 bp, Artificial Sequence
  Description of Artificial Sequence: Synthetic coding sequence
atgggcctctcggcagctgctccactgtggggtccccctggcttactcttggccattgcgctccatccagccttatctgtgcccccccggagggattattgcgtgctgggtgccggcccagccggcctacagatggcttatttccttcagcgcgcaggtagagactatgcggtttttgaacgggccccaagacccggatctttcttcacccgttacccgagacataggaagctgatcagcatcaacaaacgatacactggaaaagccaatgcggaattcaaccttcggcatgattggaattccttactctcccatgaccctaggctgctctttagacattactcaagggcatacttcccggacgcccgtgatatggtgagatacctaggcgacttcgccgacactctgggactgagggtgcagtacaatacaaccattgctcatgttaccctcgacaaggaccggcaggcttggaatggtcattactttatactgaccgaccaaaaaggccaggttcaccaatgtagcgtactcttcgtcgccacggggctatctgttccaaatcaggtagacttcccagggtctgaatatgctgaggggtacgaatctgtatccgtggatccggaggattttgttgggcagaacgtgctcattttgggtaggggtaatagcgcttttgaaacagcggaaaatattctcggcgtgactaactttattcatatgctgtcaaggagcagagtgcgcttgtcttgggctacccattatgtgggcgaccttcgtgccatcaataatgggctactggatacataccagttaaaatcactggacggccttctggagtcagatctaactgacctggctatccttaaagactccaagggcaaattccatgtgactccaaaatttttccttgaggaagccaatactaaccagagcgctgatagtataaccctgccacaagacgataatgacaactttgctatgcgggtgccgtatgatcgcgtgatccgatgcctaggctggaatttcgatttctctatcttcaataaatctttgcgactaaacagcggaaacgccttcggaaagaaatatccccttatcagggctagttacgaatctaaagggtccagaggcttattcatcctggggacagcttcccactcagtcgattaccgaaagagcgccggtggatttatccatggtttcagatacaccgtccgtgccgtgcacaggttattggagcaccggcatcattccgtgacctggccagccacagagctgcctattacacagctcacctcaagcatcgtgagaagagtgaacgaagcttccggactataccagatgtttggggttcttgccgatgtaatcttgctgaaggagaactcaactgccttcgagtacctcgaagaatttccaattcagatgctggcacagctggaaaccttgacagggcgcaaggcgaagcatggtttgttcgttatcaacatggagtacgggcgcaacttcagcggcccagacaaagatgtgtttttcgacgatcgcagtgtgggtcacacagaggacgcatggcagtctaatttcttgcatcccgtcatttactattaccgctacttaccaactgaacaggaagtcaggtttcgacccgctcattggccacttccacggccaaccgcaatccaccacatcgtggaagatttcctgactgactggactgcacctatcggtcacattctcccattgcgccggttcctggagaattgtctggataccgatctgaggtctttttacgcggagtcctgtttcctcttcgcactgaccagacagaagttgccccctttctgccaacagggatacttacgcatgcagggcctcgtgtccactgaatccctctggcaacaccgcgtggaaagccgactgctccgagactacgctccaacgggccgccgactggaagactcttctcagcagctaggagatcaagagcctctgggcagtcccctagcccctggccctctggcacagtccgtggacagtaacaaggaggagctgtag

SEQ ID NO: 116515 - DNA, 2055 bp, Artificial Sequence
  Description of Artificial Sequence: Synthetic coding sequence
atgggcctgtctgctgctgcccccctctggggccctcccggactgctcctggcgatagctttacacccagctctgagcgtgcctcccagaagggactattgcgtgctgggcgcagggcctgcagggcttcagatggcttattttctccagcgcgccggccgggactatgcagtgttcgagcgggcgccccggccaggatcgtttttcactcggtaccccagacaccgtaaactgatttctattaacaagaggtatacagggaaggccaatgcagagttcaatttgaggcacgactggaactcactcttatcacacgatcccagacttctatttcgccattatagcagggcatattttcccgacgcccgcgacatggtgaggtatttgggcgactttgctgacacactcggattgagggtgcaatataacactacaatcgcccacgttacgttggacaaggatcgacaggcctggaacgggcactacttcatcctcacagaccagaagggtcaagttcaccaatgctctgtgctgtttgtagccacggggctgtcagtgccaaaccaggtcgactttcccgggtcggaatacgccgagggctacgaatctgttagtgtcgaccctgaggacttcgtgggccagaacgtcctaatattggggagagggaacagtgccttcgagaccgcagagaacattttgggtgttacaaactttatccacatgttgtcccggtctcgtgtgcggctgtcatgggctacgcactatgttggcgatctgcgggctattaacaacggcctccttgacacttatcagctgaagagtctggatggcttgctggagtcagacctgacagacctagctatactcaaggatagtaaaggaaaatttcacgtgacacccaaattcttcttagaagaggcaaacactaatcagtccgccgatagcattactttgcctcaggacgataacgacaattttgccatgagagtgccctatgatcgcgtgataagatgtctgggttggaattttgacttttccatcttcaataaatccttgcgcctgaatagcggcaacgctttcggcaaaaaatatccattaatacgggcctcctacgagtcaaaaggatcccgtggattatttatcctcggaactgccagccatagcgtagattataggaagtctgctgggggcttcatccacggttttcgttatacggtgagagcggtccatcgtctgcttgagcaccgccatcattccgtgacctggccagctaccgagttaccaatcacgcagctgaccagttccattgtgagacgtgtgaacgaggcatcgggtctataccaaatgttcggagttcttgcagatgtcatcctgctgaaggagaacagcacggcattcgagtatcttgaggaattccccatccaaatgctggcccagctcgagacgctgaccgggcggaaggctaagcatggcctcttcgtcatcaacatggaatacgggcgcaacttctctggaccagataaggatgtattctttgacgatcgcagtgtggggcacaccgaagacgcctggcaaagcaacttcctccatccggtcatctattattatcgctacttgcctaccgagcaagaggtcaggtttagacctgctcattggcctttacctcggcctacggcaatccaccatatcgtagaggacttccttactgattggacggccccaattggacacatcttacccttgcgccggtttctcgagaattgtctggacacagatctaaggtccttttacgccgaatcttgcttccttttcgctttgaccaggcagaaattgcctccattctgccaacaggggtacctgcggatgcagggattggtgtccaccgagtccctctggcaacatagggtagagagccgcttattgcgggattacgcgcccacagggcgccgcttggaggattcctcccagcagcttggcgaccaggaaccactggggtcccctttagcacctgggcctttagcacagtccgttgacagcaacaaggaggaactttag

SEQ ID NO: 116516 - DNA, 261 bp, Artificial Sequence
  Description of Artificial Sequence: Synthetic coding sequence
atggggctctcagctgccgctcccctgtggggccctcccggtcttctcctggccattgcactccatccagcgctgagtgtgccgccacggcgggactactgcgtacttggggcgggacccgctggcctgcagatggcatactttctgcaaagagctgggagggactatgcagtgtttgagagagccccaaggccagggtccttctttacgagatatccgaggcatcggaagttgatctccatcaacaagagatacacttag

SEQ ID NO: 116517 - DNA, 729 bp, Artificial Sequence
  Description of Artificial Sequence: Synthetic coding sequence
atgtttctgttgagtggggacccatgtttcaagacgccacccagcactgccaagagcattagcattcccgggcaggattcctcactccagctcacctgtaagggggggggaacctcgtccgggggcagcagcaccaattccctcacggggtcaagaccacccaaagccagacctaccatcctcagcagcggactgcccgaagaacctgaccagaatctctcctcccccgaggaagtgttccactccgggcacagccggaacagctcatacgcatcacagcagagcaagatctctggctatagtactgagcattccagatcttcgtcgctcagtgaccttacccatagaagaaacacttctactagctcatcagctagcggcggcctgggaatgacagtagaagggcctgagggctccgagcgcgagcatcgcccgcctgagaaacctcccagacctcctagacctctgcacctgtcagacagatcgtttagacgtaaaaaggactctgtcgaaagtcaccctacctgggtcgatgatacccgcatagacgcagatgcaatcgtggaaaagatcgtccagtcccaagattttaccgacggcagcaatacggaagacagtaatcttcgactgttcgtgagcagggacgggtccgccaccctgtctggcattcaacttgccactcgcgtatcgtctggagtctatgaaccggttgtgatcgaatcgcattag

SEQ ID NO: 116518 - DNA, 1155 bp, Artificial Sequence
  Description of Artificial Sequence: Synthetic coding sequence
atggcgtttctcatgaagaagaaaaagttcaagttccagaccacctttacactggaggagctgaccgcagtgccattcgttaacggggtgttattctgcaaagtacggctattggatggcggggattttgtgtcactctctagcagagaggaggttcaggaaaattgtgtgcgatggcgaaagaggtttacctttgtttgcaagatgtcagctaatcccgccaccgggttattggacccttgcgtttttagagttagtgtgcggaaggagctgaagggaggaaaagcgtacagcaaattgggtttcgctgatctgaatcttgccgagtttgccgggtcaggctctaccgtgcgctgctgcctgctggagggctatgacacaaaaaacacgagacaggataatagcattttgaaggtcactattgggatgtttcttctgagcggcgacccctgtttcaaaacaccaccttccacggctaagtctatttccatccctggccaagactcgtctttgcagcttacttgcaaaggagggggcacttccagcggaggatccagtaccaattctttgactggttcaaggcctcccaaagccagaccaacgatactgtcttcaggactgccagaagagcctgaccagaacttatcatcgccagaagaggtgtttcatagcggccactcacgaaattctagttacgcttcacagcagtccaaaattagcggctacagtaccgaacactcaagatcttctagcctgagtgacttaacacatagaagaaatacttctacaagctcctcagcctccggcggactgggaatgactgtggaaggcccagagggatctgagagagaacaccggcccccggagaagcccccacgccctcctcgccccttacatctgtctgacagatccttcaggcgaaagaaggacagtgtggaatcacaccctacatgggtggacgacacgagaatagacgcggatgcgatcgtggaaaaaatagtccagagccaagacttcaccgatgggagcaacactgaagattctaacctgaggttattcgtttctcgggacggtagcgccaccctcagtggtattcagctggcaacccgcgtctcatcgggcgtctacgaacccgtggtcatcgagtcacactag

SEQ ID NO: 116519 - DNA, 435 bp, Artificial Sequence
  Description of Artificial Sequence: Synthetic coding sequence
atgtactctgagattcaaagggagagggccgatatcggcggtctcatggcacggcccgagtatcgggaatggaatcctgagctcattaaacctaaaaaactgcttaatcccgtcaaggcatcgcgtagccaccaagaactacatcgagagctgctgatgaaccatagaagggggctgggcgtggatagtaagcctgagctacagcgagtgttggaacatcggcggcgaaatcaattgattaagaagaaaaaggaggagcttgaggcgaaacggctgcagtgtcctttcgagcaagagttactaaggcgacagcaacgattgaatcagcttgagaaaccccctgagaaggaggaggaccatgcacctgagttcatcaaagtgagagaaaacctgagacgtatcgcaaccctcacgtccgaggagcgagagttgtag

SEQ ID NO: 116520 - DNA, 435 bp, Artificial Sequence
  Description of Artificial Sequence: Synthetic coding sequence
atgtacagtgaaattcagagggaaagagctgatatcggtggccttatggctaggcctgaatacagagaatggaatcccgagctcatcaaacctaagaagctgctgaacccagttaaagcttcaagaagtcatcaggagctgcaccgagaactgctcatgaatcacaggagaggtttgggggtggactctaaacctgagctgcagcgagtgctggagcacaggagaagaaatcagcttatcaaaaagaaaaaagaagagctagaggccaagaggctgcagtgcccgttcgaacaggaattgctgcggcggcaacagcgcctgaatcagctcgagaagccacctgaaaaagaggaggaccatgcgcctgagttcatcaaagtccgcgagaacctaagaagaatagcaaccctgacaagtgaggaacgggaactctag

SEQ ID NO: 116521 - DNA, 519 bp, Artificial Sequence
  Description of Artificial Sequence: Synthetic coding sequence
atggcccagcgccttggggagtgggctcgcggaccctctgacgcaaccggcctttatagagcagtgctcctgcgctctgcggctatgtactccgagatccaacgtgagcgcgcagacataggagggttgatggcacgccctgagtaccgggagtggaacccggaactcataaaacctaagaagttgctgaatccggtgaaagcgtctcgatctcaccaggagctgcatagggagctgctcatgaatcaccgccgggggctgggagtcgattccaaacccgaactgcagcgcgtgctggaacatagaaggagaaatcagctgattaaaaagaagaaagaggagctggaggctaaaagactccagtgcccctttgaacaggagctcctgagaagacagcagagactgaatcagctggagaagccccctgagaaggaggaggaccacgcgcctgagttcattaaggtgcgggaaaatttgagacgcattgctacgctgaccagcgaggagcgcgaactctag

SEQ ID NO: 116522 - DNA, 408 bp, Artificial Sequence
  Description of Artificial Sequence: Synthetic coding sequence
atgtattctgagatacaacgcgagcgtgcggatatcggaggtctcatggccagacccgagtacagggagtggaatcccgaactgatcaagcctaaaaagttgctcaacccagtcaaagccagcaggagccatcaggagctgcatagagaacttctgatgaaccaccgtagaggtcttggagtagattctaagccagaattgcagcgcgtgctggaacaccgacgcagaaaccaattaatcaaaaagaaaaaggaggaacttgaggcaaagagactgcagtgtccatttgaacaggagctcttacgaagacaacaaagactgaatcaggtcggggatggccatccggcaggcacaactcacccaccagggctgagttccagagaggaactctgttgcggccatagttag

SEQ ID NO: 116523 - DNA, 318 bp, Artificial Sequence
  Description of Artificial Sequence: Synthetic coding sequence
atgtattccgagatccagcgggagagagcagatatcggagggttgatggctcgacctgaatatcgggagtggaatcccgagctgattaaaccaaagaaacttcttaatccggtgaaggctagccggtcccaccaggagctgcatagagaactgctgatgaaccatcgcagaggccttggggtcgactctaaacctgaacttcagcgagttctggagcacaggcggcgaaaccaattaataaaaaagaaaaaggaggagcttgaggccaagagactgcagtgtccctttgaacaggagttgttaagaaggcagcagtag

SEQ ID NO: 116524 - DNA, 528 bp, Artificial Sequence
  Description of Artificial Sequence: Synthetic coding sequence
atgggcgcagcccaggggaagaagaagacatatagccctcaagctcgattccactcagaaaacgaaaagcaaagaaggaacgggagtgccgctatgtattcggaaatccagagggagcgtgctgacataggaggattgatggcacggcctgaatacagggagtggaaccccgagctgatcaagccaaagaagctgttgaatcccgtgaaggcgtcccgttctcaccaggaacttcatagggaactgcttatgaatcataggcgaggtctgggcgttgatagcaaaccagagctccagagggtcctggaacataggagaaggaaccaactaatcaagaagaagaaagaggaactggaggccaagcggctccagtgccctttcgagcaggaactcctgcggcgacagcagcggctgaaccaactcgaaaaaccacccgaaaaggaggaggatcacgcaccggagttcatcaaggtaagagagaacctgcggaggatcgcaacactgactagtgaggaaagggagctgtag

SEQ ID NO: 116525 - DNA, 789 bp, Artificial Sequence
  Description of Artificial Sequence: Synthetic coding sequence
atggccccaggctccccacctggccccgccattgcgactatgaaactcaatgagcggtccttagctttctacgccacctgcgatgcacctgtggacaatgccggctttctgtataaaaagggtggccgacacgccgcctaccaccgcagatggttcgtgttgagagggaatatgctgttttacttcgaggatgccgcttcgcgcgagcccgtgggtgttattatcttagaagggtgtactgtggaacttgttgaggctgccgaagaattcgcctttgcagtgcgattcgcgggtactagggctaggacctacgtcctagctgctgaatcccaagacgcaatggaaggctgggtgaaagcactgtctagagcctcttttgattacctacgactcgtggtccgcgaacttgaacagcaactggcagccgtgcgcgggggcgggggaatggccctcccccagccacagccacaatcactacctctcccacctagtctgccatccgcgctggctcctgttcccagcttgccttcagcccctgcgccggtgccagccttgcccttgccgcggaggcccagtgcactgccacctaaagaaaacggctgtgccgtttggtcgacggaggccacgttccggccaggaccagagcctccccctcctcccccccgccgacgcgccagtgccccacatggccccctcgacatggcacctttcgcaagacttcatgaatgttacgggcaggagatccgggccctccggggacaatggctctcctcgcgcgtccaaccttag

SEQ ID NO: 116526 - DNA, 750 bp, Artificial Sequence
  Description of Artificial Sequence: Synthetic coding sequence
atgaaactgaacgagcggagcctcgctttttacgccacgtgcgacgcacccgtggataacgccggctttttgtataaaaagggaggcaggcatgctgcataccaccggcgatggtttgtgctgaggggaaatatgctgttttatttcgaagatgctgcctctcgcgaacccgtcggcgtgatcattctcgaggggtgcaccgtagagcttgttgaggccgccgaggagtttgcctttgccgtgagattcgccggaaccagggcacggacttacgttctggctgccgagtcacaggacgcgatggaggggtgggtcaaggctctcagcagagcaagcttcgactacctgcgcctcgtcgtgcgagagttagaacagcaattggctgcggttagaggcggtggcgggatggccctgcctcagccacagccacagtccctgcctctgcctccaagcctgcctagcgctttggccccagttccatcactcccctctgccccagcacccgtaccggctcttccccttccgagaaggccatccgccctgcctcccaaggagaatggctgtgccgtgtggagcactgaggctacttttcggcctggcccggagccacccccccccccgccacgacgccgggcatcggcccctcacggtccgcttgacatggccccttttgcccggctgcacgagtgttatgggcaggaaattagagctctccgtggccagtggctctctagtagggtccagccctag

SEQ ID NO: 116527 - DNA, 267 bp, Artificial Sequence
  Description of Artificial Sequence: Synthetic coding sequence
atgaagctgaacgaaaggtccctggctttctatgccacttgtgacgccccagtcgataacgccggcttcctttacaagaagggcggacgacatgcggcgtaccatcgccggtggttcgtcctgagaggcaatatgctcttctatttcgaggacgctgcctcgcgggaaccggttggagtaatcatattagtggccgtcgccttgtggccgcgggctctgtcagtgtctccgtggtggttatctcaagggagccctgacaccccttag

SEQ ID NO: 116528 - DNA, 849 bp, Artificial Sequence
  Description of Artificial Sequence: Synthetic coding sequence
atgcaggcatcctgtacgagacgtgtcggcggaactagacctactaccggagcaggcagctgctgtgccggcacgtgcagcagtacttcacgaaccctgcctgccgttagtccctgggcttcctctagctggcgcgccgccttgtggtcttggtggagacctccacgatcaagtcctagcctgtgcgctctgagggggcccgggcgtgcgcctacatgctggccccttcgcgttcggatgccctggcgcgccggatctagaccttgtagggtgcctgcctccacgacttgcggttggtggtgcgcctcctggagcagctcttggagactttatgtggcgggcgtagcttggccctgtcccagcccatcaccctcaccctgtccctgcccaagaccatgccctctgccatggccacagtctcacccatgcctgctgccccaacctcgatcccagccctgcccctgccccgccggccccgtacctagcaggccacgccgtatggccgcactgagcggggccttaaggccacctagcggtctcgacccaagcccgttgcatcataggcttgccgccgggcctcggcaccctacaggcccatggacctggccaccctcaccaggctgtacgtccgccatggcccgacggtctggtccctgtgtagcctctggaagcgctgctggaagtagtccagaggcaacccgcgcgccagtgcttgggggccataagctgtatgccctctgggaccgccctggtcctggcgagactgggggcgcggaccccgaggggaaccatgggcagggttggcctcctgggccagagtggccaggtttcggcggctgtcggctttag

SEQ ID NO: 116529 - DNA, 354 bp, Artificial Sequence
  Description of Artificial Sequence: Synthetic coding sequence
atgaagcttaatgagcgctcgctcgccttttatgctacgtgtgacgctccagtggataacgcaggctttctctacaaaaagggaggaaggcatgctgcctatcatagacggtggttcgtgctgagggggaacatgctgttttatttcgaggacgccgccagtagggagccagtgggcgttataattctggagggttgtaccgtcgagctggtggaggctgccgaggaatttgcttttgccgtaagatttgcagggacacgcgcccggacctatgttctggccgccgaaagccaggacgccatggagggatgggtcaaagcactttcccgggcttcttttgactatctgagatag

SEQ ID NO: 116530 - DNA, 750 bp, Artificial Sequence
  Description of Artificial Sequence: Synthetic coding sequence
atgaaattgaacgagaggagcctcgcgttttatgcgacttgtgacgcccctgtcgacaacgctggtttcctgtataagaaagggggccgacacgccgcttaccacaggcggtggttcgtgctcagaggcaacatgctgttttacttcgaagacgccgcttcgagagaacccgtgggcgtgatcatcttggagggctgcacagtcgaacttgtggaggctgcggaggaattcgcttttgctgttagattcgctgggaccagagcacgcacttatgtgctcgcagccgagagccaagatgccatggaagggtgggtaaaagccctgtccagagccagcttcgattacctaaggttagtagtcagggagttagaacagcaactcgccgctgtgcggggaggtggcggaatggccctccctcagcctcagccccagagcctacccctgccgccctctctcccctccgcattggcccccgtcccctcattaccatcggctcccgcccccgtgcccgcgttgcctttgcctagacggccgagcgccctccctccgaaggaaaacggctgcgcagtgtggtctacggaggccacgtttaggcctggacctgagcccccaccaccgccgccaagacgaagagcaagtgcacctcatggaccccttgatatggcgccctttgcgcgcctccatgaatgttatggtcaggagattcgagccctgaggggccagtggcttagcagcagagtacaaccctag

SEQ ID NO: 116531 - DNA, 750 bp, Artificial Sequence
  Description of Artificial Sequence: Synthetic coding sequence
atgaaactgaacgagcggagcctagccttttatgccacatgcgacgccccggtggataatgcgggcttcttgtacaaaaaaggagggaggcatgcagcgtatcataggcgttggtttgtgcttaggggcaatatgctgttctacttcgaggacgccgcctctagggagccggtgggcgtgatcattctggaaggctgcacagttgagcttgtggaggccgccgaggagtttgcatttgctgtaaggtttgctggtaccagagctagaacttacgtgctggctgccgaatcccaggacgctatggagggttgggttaaggctctgtcacgggcaagctttgactacctaagattggtggtgagagagctggaacagcaactagccgcggtgagaggaggaggaggtatggccctgccccagcctcagccccagagtctaccactgccccctagcctcccctccgccctggcaccggtgccaagtctgccttctgcacctgccccagttccggccctgccattgccccggcggccatcagctcttccacccaaggagaatggctgtgctgtgtggagtaccgaggcgacgtttaggcccggccctgagcctccccccccaccacctcgacgtcgggcctctgcccctcatggccctctggacatggctccttttgcccggctccatgaatgctacggacaggaaatcagagccttacggggccagtggctgtctagcagagtacagccctag

SEQ ID NO: 116532 - DNA, 225 bp, Artificial Sequence
  Description of Artificial Sequence: Synthetic coding sequence
atgaaactcaatgagcggtccttagctttctatgccacttgcgacgctccagtggataacgctgggtttctgtacaagaaaggggggcgacacgccgcctatcacaggcggtggttcgtcctgaggggtaacatgctgttctactttgaggatgccgcttcacgagagcccgtgggcgtgatcattctggaaggatgtactgtggagctggtggaggctgcctag

SEQ ID NO: 116533 - DNA, 243 bp, Artificial Sequence
  Description of Artificial Sequence: Synthetic coding sequence
atgaagctgaacgagaggagtctggccttttatgctacttgcgacgctccagttgataacgcaggattcctttacaaaaagggaggtcggcacgctgcttaccacaggcgatggttcgtgctgaggggcaacatgctgttttactttgaggatgccgcatcgcgcgaacctgtgggtgtcatcatcctagagggctgcaccgtagaattagttgaggccgccgaggagttcgcatttgcctag

SEQ ID NO: 116534 - DNA, 780 bp, Artificial Sequence
  Description of Artificial Sequence: Synthetic coding sequence
atgaagctaaatgagcggtcggtcgcccattatgctctgtcagactcacccgccgatcacatgggatttctgagaacctggggcgggcctgggaccccacctactcctagtggcaccgggagacgttgttggttcgttttaaaaggaaacttactgtttagtttcgagagtagagagggccgggccccactcagtctggtggttcttgaaggctgcaccgtggaactggccgaagccccggtacccgaggaattcgcatttgcaatctgttttgatgcccccggcgtacggccacatctgttggctgcggagggacccgcagcacaggaggcatgggtgaaagtgctttccagggctagctttgggtacatgcggctcgtagtgagagagctggagtctcagctgcaggatgctagacagagtctcgcactgcagcggagaagcagttggaaatccgtggccagcaggtgcaagccacaggctccaaaccatcgggccgccggactggagaatgggcactgcctgtcgaaggattcaagtccggtgggcctggtagaggaggcaggctccagatctgcgggctgggggctcgctgagtgggagctgcagggtccagcctctctgttactcggaaaaggacagtctcccgtttccccagagacctcatgcttctcaactctccatgactggtatggccaggaaatcgtggagctcagacagtgttggcagaaaagggcacagggctcccatagcaaatgcgaggaacaggataggccttag

SEQ ID NO: 116535 - DNA, 327 bp, Artificial Sequence
  Description of Artificial Sequence: Synthetic coding sequence
atgaaactgaacgagcgctctgttgcccattacgccctgtcagactctcccgctgaccacatgggcttcttacgaacatggggaggacccggaactcccccgacacccagcggaacagggcgcaggtgctggtttgtgctcaagggtaacctgcttttctcctttgaaagcagggagggcagggcacccctgtcattggtggtcctcgaaggttgcacagtggagcttgctgaagcccctgtgccagaagagttcgcatttgccatttgcttcgacgcacccggggtgcggccccacttgttagcggccgagggcccagctgcttag

SEQ ID NO: 116536 - DNA, 729 bp, Artificial Sequence
  Description of Artificial Sequence: Synthetic coding sequence
atgaccatcccaggcggcactccttccttgaaaatcctgtggctgaatcaagagccggagattcaggtacggcgtttggacactcttctagcttgtttcaatttgtcctctagcagggaggaactgcaggcggtggagtctccattccaagcactgtgctgcctcctgatttatttgttcgtgcaagtggacacactgtgcctggaggacttgcatgcatttatagcacaggcactgtgtctccaaggcaaatcaacttctcaattagtgaatttacagccagattacataaaccctcgcgccgtgcagcttggctcattgttggtgcgaggtctcaccaccctcgttctggtgaactcagcctgcggatttccctggaaaacatccgacttcatgccatggaacgtcttcgacggaaagctgtttcaccagaagtacctccagagcgaaaaagggtacgcggtggaagttctattggaacagaatagatcgcggctcaccaaattccacaacttgaaagctgttgtctgtaaggcatgtatgaaagagaaccggaggattactggtcgagctcactggggatcccaccatgctggcagatgggggcggcagggctcttcgtatcatcgcaccgggagcggttatagtaggagcagtcagggccagccttggcgtgaccaaggccccgggagcaggcaatacgagcatgaccagtggcgaagatactag

SEQ ID NO: 116537 - DNA, 2733 bp, Artificial Sequence
  Description of Artificial Sequence: Synthetic coding sequence
atgggagtgagggggttacaaggatttgtgggaagtacatgcccacacatctgtaccgtggtgaactttaaagagctggcagagcaccaccggtccaaataccccggctgtacaccaaccatagtggtagacgcgatgtgctgtctccggtattggtatacccccgaatcttggatttgtgggggacagtggcgagaatacttttccgccctccgcgacttcgtgaaaactttcacggccgccgggatcaaacttattttcttcttcgacggcatggtagagcaggataaaagagacgaatgggtgaaacggaggctcaaaaacaacagagaaatttctagaatttttcattatattaaatcacataaggagcagcccggcaggaatatgttcttcattcccagcggccttgccgtgtttactagatttgcgctgaaaactttgggacaggagactctctgctccctgcaagaggcagactacgaggttgcatcctacggactacagcacaactgcctgggaattctgggtgaggatacagattaccttatctatgatacatgcccttatttcagcataagcgaactgtgcttggagtcattagacaccgtcatgctctgtcgggagaagctttgtgagagcctgggactttgtgtcgccgatttgccactgctggcctgtctattaggcaacgatattatccctgaggggatgttcgaatcctttcgctataaatgcttgagcagctatacctcggtgaaagagaactttgataaaaaaggcaatattatcctcgcagtctctgaccacatctctaaggtgctgtacctataccagggggagaaaaagctggaagagattctacctctcggtccaaataaagctcttttttacaaggggatggccagctacctgctgccaggtcagaaatcaccctggttctttcagaaaccaaagggggtcatcacgctcgacaagcaagtgatttccacatccagtgatgcggagagcagggaggaagtccccatgtgctctgacgcagagagtaggcaggaggtgcccatgtgtaccgggcccgagagccgacgcgaagtgcccgtgtacacagactctgaaccccgtcaggaagttccaatgtgcagcgatccggagcccagacaagaagtcccaacctgtaccgggcctgagtctcgccgcgaagtgcccatgtgctccgatcccgagcctcggcaggaagtcccaatgtgcacaggacctgaagcacgtcaggaagtgccaatgtacaccgactccgagccaaggcaggaggttcctatgtatacagactctgaaccaaggcaggaggtgcctatgtataccggaagcgagccccgtcaagaggtccccatgtatacgggccctgagagccgtcaggaagtccccatgtataccggtccagaatctcggcaggaggtgttgattcggacggaccctgaatctcggcaggagattatgtgtactggacatgaatcaaagcaggaggttcccatctgcaccgaccccatctcgaaacaggaggattctatgtgtacacatgctgagattaaccagaagctgcctgtggccactgactttgaatttaagctcgaagctctgatgtgtacaaatcctgagataaaacaggaagatccaaccaacgtgggacccgaggttaaacagcaagtgaccatggtttctgacacagaaattctaaaggtggctaggactcaccacgtgcaagcagaaagttatcttgtgtacaacatcatgtcctcaggcgaaatagagtgctcaaatacgctggaggatgaactggatcaggcactcccaagccaggcatttatttataggcccattcgtcagcgcgtgtactccctactgctcgaagactgtcaggatgtaacttctacctgtctcgccgtcaaggagtggttcgtgtacccagggaatcccttacggcacccggacttagtccgcccactgcagatgaccatcccaggaggcactccgtccttgaaaatcctctggttaaaccaggaacccgagatccaagtcagacgtctcgataccctgttagcctgtttcaatcttagctctagcagagaagagctacaggccgtagagagccctttccaagctctgtgctgcctgctcatatacctgtttgtccaggttgacaccctatgtctcgaagacttgcacgcatttattgcccaggcactgtgcctgcagggtaagagcacctcccagctcgtcaacctgcaaccagattacatcaacccccgggccgtccagctggggagtctgcttgttcgcggtcttacaacccttgttctagtgaattctgcatgtggctttccttggaaaacttccgacttcatgccctggaacgtcttcgatggcaagctttttcatcagaagtatctgcaatcagagaaagggtacgccgtagaggtcctgctcgagcaaaatcgctcccgtctaaccaagttccacaacttgaaggccgtggtgtgtaaggcttgtatgaaggagaaccgtcgaataacaggtagggcgcattgggggtcacaccatgccggcagatggggtcgacaaggctcgtcttaccaccgaactggcagcggctactctaggagtagccagggccagccgtggcgggatcaaggccctgggtctcggcagtatgagcatgatcaatggaggcggtactag

SEQ ID NO: 116538 - DNA, 2802 bp, Artificial Sequence
  Description of Artificial Sequence: Synthetic coding sequence
atgtttgggccgcgcgggtctacgagtgcaggcgcaggccgaaaggagatcctgagccgttcttcagtgatgggcgtgagggggctccagggcttcgtgggatcaacttgcccacacatctgtaccgtggtcaactttaaggaactggccgagcaccataggagcaagtatccaggatgcacccccacaattgtggtggacgctatgtgttgcctgcgttattggtacactcccgagtcatggatctgcggagggcagtggagggagtatttttctgcactccgcgatttcgttaaaacatttacagccgctggaatcaagcttatctttttctttgatggaatggtggagcaggacaaacgagatgagtgggtgaagagacgactgaaaaacaatagggaaataagccggatctttcattatataaagagccataaggaacaacccggtcggaatatgttcttcatcccttccgggctcgccgtatttacacggttcgccctgaaaaccttgggccaggaaacattgtgttccctgcaggaagcagactacgaagttgcttcctacggattacagcacaattgtctcggaattttaggagaggacactgattatttgatctacgatacgtgcccgtattttagcatctctgagctgtgccttgaaagcctggacacagtcatgctatgcagagagaaattgtgcgagtcactgggactgtgtgtcgctgatctcccacttctggcgtgtctgcttggaaacgacatcattcctgaaggcatgtttgaatcattccgctacaagtgcctgagttcctacacaagcgtgaaggagaacttcgataaaaagggtaatataatcttagctgtgagcgatcatatctctaaagtgctgtacctttatcaaggcgagaagaaactggaggagatcctgcctttgggacccaacaaagccctattttacaaagggatggcaagttatcttctaccaggacaaaaatccccctggttttttcagaagcccaaaggagtgatcacactcgacaaacaggtgatctccacaagtagcgatgcagaaagcagggaggaagtgcccatgtgcagcgatgctgagtcccggcaagaagtcccaatgtgcactggtcccgagagccggagagaggtgcccgtatacacagattccgagccaaggcaggaggttccaatgtgcagtgacccagaacccaggcaagaggtacctacatgcactggcccagaatccagaagagaagtgcccatgtgctccgacccagagccacgtcaagaagtgcctatgtgcactgggcccgaagcgcggcaggaggtgcctatgtacaccgacagtgaaccccggcaggaggtaccaatgtacacagactccgagccaagacaggaggtgcctatgtacactggctccgagcctaggcaggaagtgcctatgtatactggaccggagtcccggcaggaggtgccgatgtataccgggccagagagccgccaggaagtgctgattcggactgaccctgaatctcgtcaggaaatcatgtgcacaggacatgaaagcaaacaagaggtcccaatctgtacagaccccatcagcaaacaagaggactccatgtgtacacatgcggagattaaccaaaaattgcctgtcgcaaccgacttcgaatttaagcttgaagctctaatgtgtactaatccagagatcaaacaagaggacccgacaaatgtgggacctgaagtgaagcagcaggtgactatggtttctgacacagagatattgaaggtggcaagaactcaccatgtacaggcagagtcataccttgtttacaatatcatgagctctggtgagatcgaatgctccaatacgctggaagatgaactggatcaggctttaccctctcaggcctttatctatagaccaatccggcagagagtgtattccctgctccttgaggactgtcaggacgttacctctacctgcctggcagtcaaagagtggtttgtctaccccggaaatccattgaggcaccctgacctggtgaggcctttgcagatgacaatccccggggggacgcctagcctcaagatcttgtggctgaaccaggagcctgaaatccaagtgcggcgcctcgatactctgcttgcctgcttcaatctgagttcatcccgggaagagctccaggctgtcgaatccccgtttcaggctttgtgttgtttactgatttacctttttgtccaggttgatactctttgcctggaggacctccacgccttcatcgctcaggcactttgcctgcagggaaagagtacgagtcagctcgttaatctacagcccgattacataaatcctcgagctgtgcaacttgggtctctcctggtgcggggcctgacaacccttgtcttggtcaacagtgcctgcggctttccatggaagacctcagactttatgccttggaatgtgttcgacggcaaactgtttcaccaaaagtaccttcaatccgaaaaagggtacgctgtggaggtgctgctggagcagaaccggagtaggctgacaaaatttcacaatttgaaggcagtggtgtgtaaagcctgtatgaaggagaatcgcagaattactggtagggcccactggggctcccaccatgccgggcgctggggccgccaggggagcagttaccaccgaaccggctctggctacagtagatcttcccagggacagccgtggcgcgaccagggccccgggtctcgtcagtacgagcacgaccagtggcggaggtactag

SEQ ID NO: 116539 - DNA, 2769 bp, Artificial Sequence
  Description of Artificial Sequence: Synthetic coding sequence
atggatcggcagatgatcctgagccgatcctctgtgatgggcgtccgtggcctgcaaggcttcgttggctcaacctgcccacacatatgcacagtggttaatttcaaagagctggctgaacatcatcgcagcaaatacccagggtgtactcccaccatagtagtggatgcaatgtgttgcctgaggtactggtatacaccggagtcatggatctgtgggggacagtggagagagtacttcagtgcgctccgcgatttcgtgaagaccttcacggcagctggcatcaaactgatctttttttttgacgggatggtggagcaggataagagagacgagtgggtcaaacgcaggcttaagaacaacagagagatctctcggatctttcactatatcaagtctcataaagaacagcccggccgaaacatgttttttatccctagcggccttgccgtttttacccggttcgccctgaaaaccttagggcaggaaacactctgtagcctgcaggaggcagattatgaagtggctagttacggactccaacataattgtctgggaattttaggggaagatacagattacctgatatacgacacatgtccatacttctccatctcagagctctgcctggaatccctcgacaccgtgatgctatgtcgtgaaaagctttgcgaaagtctgggcctctgtgttgccgacctgccgctgctcgcttgcctgctcggcaatgacatcatcccagaagggatgttcgagtcttttaggtacaaatgcctgtctagctataccagcgtcaaggaaaacttcgacaagaagggtaacattattctcgccgtgtcggaccacatttccaaggtcctctacctctatcagggcgaaaaaaagctggaggaaatcctgcccctcggacctaacaaagcactgttctacaaagggatggcttcttatttgctacccggccagaagtctccatggtttttccagaagccgaaaggagttataaccctggacaaacaggtaatcagtacttcgtcagacgctgaaagccgcgaagaggtgccaatgtgttctgacgctgaaagccgacaagaggtgcctatgtgtactgggccggagagtaggagagaagtgccggtctatacagatagcgaaccacgacaagaggtccctatgtgcagcgaccccgaaccccgacaggaagttcccacatgcaccggacccgaatctaggagggaggttccaatgtgctccgacccggagccgagacaggaggtccccatgtgtactggcccagaggcccgccaggaggtccctatgtacacagatagcgaacccaggcaggaagtgcccatgtacaccgacagtgagccaaggcaggaagtgcccatgtacaccggttccgaaccaaggcaggaggtgccaatgtatacaggtcctgagagtcgccaagaagtgcccatgtatactggacctgaatctcgccaagaggtcttgatacgcacagatcctgagtctaggcaggaaatcatgtgtacgggccacgagtctaaacaagaggtgcctatctgtacagatccaatcagcaagcaagaggacagcatgtgtacgcacgcagaaatcaatcaaaagctgccagtggccaccgacttcgaatttaagcttgaggcattaatgtgtaccaaccctgagatcaagcaagaggatcctaccaacgtgggtcctgaggtaaagcaacaagttacaatggtaagcgacaccgagatccttaaagttgcacgaacgcaccacgtccaggctgagagctacctggtttataacattatgtcctcgggagagatcgagtgtagcaatacattagaagacgagctcgaccaagccctgcccagtcaagcctttatctaccggccaatacggcagcgggtttacagcctcctgctggaagactgtcaggatgtaactagcacatgcctggccgtgaaggagtggtttgtttatcctggtaatccactgagacaccctgatctggttcgaccattgcaaatgaccatccccggtggcaccccctccttaaaaattttatggcttaatcaggagcccgagattcaggtacggagactcgatactctcttagcctgcttcaatttgtcatcttcgcgggaggaacttcaggctgtcgaatcccctttccaggctttgtgctgtctattgatctacctctttgttcaggtcgataccctgtgtctcgaagatctgcacgccttcattgcacaggccctgtgccttcaaggaaaatctaccagccaactggtgaaccttcagcctgactacattaatccccgcgcagtgcagctcgggtccctgctggttcggggtctgaccaccctcgtgttagtgaattctgcttgcgggttcccatggaaaacatctgatttcatgccatggaatgtcttcgatggcaagttattccaccagaaatacctgcagtctgaaaaagggtacgcggtggaagtcttgctggagcagaacaggtccaggctgaccaaattccacaacttgaaagccgtagtttgtaaggcctgcatgaaagaaaatagacggatcactggcagggcacactggggatcccatcacgccgggaggtgggggcgccaagggtcttcctaccaccggactggttctggctactcacggtccagccaaggacagccgtggcgggaccaggggcctggctctagacagtatgaacatgaccaatggcggcgttattag

SEQ ID NO: 116540 - DNA, 3291 bp, Artificial Sequence
  Description of Artificial Sequence: Synthetic coding sequence
atgggagttcagggctttcaggagtttttggagaagagatgccccggcgccgtggttcccgtggatttactgaaactcgcaagaaccgtttctcgacagcagcagcaacagcacctgcataggcagctccctcctaccgccgccctagctccaggagctccacgcgccgctagaggctcagtcccgctgcagccccccctcccacctgctgccctgggtgcctactcgggcggagctggaccgatccgccatcaccacccggcccatcattttcaccaccacggccaagcacagcccgggctgcatcctccactgccaccacctccgccccctcagctgcctggcgctagggttctggttgacgctggaagtgccctacctcggttatatggaggctaccaaactgactgggtgtgcgggggacaatggaatgccatgctgggctacctgtccgccctgtgtcaagcttgtgcgtaccccggaggagacggcctggaactggtagtcatgtttcccgggggtctaggaaaggaccggttggcagagtggggaagaaggtgtcaggccgaaaggcagaccgcgcagctaattgtcggacatgtgggcaacaaagggacgcccccgccccgcgcctggttcctgccacctgcgtgcctgagccactgcgtgagactcgcgctaatacgatttcgggttaaggtgtttcagagcctggaggaccaccatctggaggtcgtggctttctttagagagaacggatttcatggcctcctcgcccatgactcagagtacgccctatataacatcccttcctactactccagccacgcactgaagctttcatggaacggaaagaatctcactaccaatcaatttctaatgcaggaagttgctaagcagctcggcctcaaacgaatgaacttcccaatttttgccgcattgttaggcaatcatattctgcccgacgaagatctcgctgcattccactggtcactgctgggaccggaacatccccttgcatcccttaaagtccgcgcgcatcagctcgtgttacccccctgcgacgtggttatcaaggcagtctcagagtacgtctcgtcaattaaggatccttctaatctagatgtggtcgggaaggacgtttttaaacagtcccagagccgtacagaagataaaatcgaacgatttaagaaagctgtagagtattatagcgtcacaactaagctatcaagtctgcccgttggcccgtcatttctcggttttcggaacaatcggcttggcaatcctcctctgccaaggaaccaggttgggacgatctcagccgggaagccaatgtttagccaccaggtgcctcagaaggtgaagtatccacctcctttccctgtcggccccaacagctccctcctgttctcttctcacgccttgggcgaatcacacgccttctccgaagaccctatgcttcagaattccccattcgccaactgggcagtgtcttatgactcaagtgcgtcacagtttccaaattatcttccctccaaggcatccccccctttaggcccagattcatctcattcttctagtagcgacggcgacgaaccaaatggagcttcttctgatcacatcacagaggccttccaccatcaaccagaatggggaaacccaaatcgagaccgaggcagctgggctcagccagtggacacgggtgtgagtgaagctagtttaggggatggcgaaccccatattccatcgctactcagcatgagtacccgaaatcacatggatattactatcccacctttaccgcccgtagcccctgaggttttgcgcgtggccgaacaccggcacagacgcggtctgatgtacccatatatttatcatgtgctcaccaagggggagatcaagatcccagtctgcatcgaggacgagtgtaatatggaactcccccccgccgccctgttatttcggagcgccagacaatacgtttacggggtcctgttttcactggcggaaacccagcgcaaaatggagaggctcgcgatgcgaagaaggcttcctgtcgaggtcccctcagtaatcctcaaggagtggagtgcctataagggcaagagcccgcagacgcctgagctcgtaagtgcactgacattccgggaatggacctgccccaatctgaagaagctgtggcttggcaaagccgtcgaggataagaataggcgaatgagggcatttctggcctgtatgaaatccgacactccttctatgttgaaccccgccaacgtgcctacacaccttttgctaatgtgttgcgtcttgcggtacatggtgcagtggcccggcggacgaatcttgcaccgacacgagctcgacaccttcctagcacaggccgttagcacacagttgtatgaacccgataggctgcaggaactgaaaattgagaagctcgatgccagaggtatccagctcgccgcccttttcatgagcggggtggatactgctctgtttgccaacgatgcttgcggacaaccagttccctgggaacactgctgcccctggatatacttcgacggaaagttgttccagagtaagctaatcaaagccgggcgggagagagtgtctctggtggagttatgcgacggccaggcagacctcgcaactaaggtcgaaaagatgcgacaatccattctcgaaggggtcaatatgaaccatcctcctccatcagccctgctcccatctcctacgttcgtgccccctatggttccctcactatatcctgtatcattgtattcacgcgcgatgggaagcatgccgctgcctccacagggccgctcacggggctttgccggcttgcacccgatacccccacaggggggtaagcttgaaattgccgggatggtcgtcgggcagtgggcaggcagtcggtcatcaaggggacgcgggtccttcgggatgcaggtggtcagcgtcggaggaccaggaaagggccacgggaaagagcagaccgggagaggctctaagggtcacaaaaagggcaataagcagggaagttccgacggtgtcagtaaatcactagaactccatcagggacgatctcggtctcaggtgaatggaaactctggtgccctgatcaaggaagaaaaatccgatcatcggttgcccgctcctagtcaatgtgcgctgtctcgagactctaatgagtgtaataacggaaatcggtatctccctatgaataacagagaaaagaaccacctgcaggagcagaagctggagactgtggcccaacggaaagaggattag

SEQ ID NO: 116541 - DNA, 717 bp, Artificial Sequence
  Description of Artificial Sequence: Synthetic coding sequence
atgggggtgcagggctttcaggagtttctggagaagagatgtcccggagcagtggtgcccgtcgaccttctcaagttggctcgcacagtctcccggcagcagcagcagcagcatttgcacaggcagctgccacccacagcagcactagcaccaggcgctcctcgggctgcccgtgggagcgtacctctccagccgcctctgcccccagcagcccttggggcttattctggcggtgctggccccatccgccatcaccatcccgctcaccattttcatcaccacggacaagcccagcctgggctccaccctccactgcctccacccccccctccccagttgccaggagcacgtgtactagtggacgccggctctgccttgccccgcctgtacggaggataccaaacggactgggtgtgcggcggccagtggaatgccatgcttggttacctcagtgcactgtgccaggcttgcgcttaccctggaggcgatgggctcgagctggtcgttatgttccctggaggattggggaaagatcggttagctgagtgggggaggagatgtcaggccgaacgccagactgctcagcttatagtgggccacgtgggaaacaaaggcactccccctccaagagcgtggttcttgcctcctgcctgtctctcccattgtgtgaggctcgccttgattcgtttccgcgtgaaacaggcagccatgctgtag

SEQ ID NO: 116542 - DNA, 3408 bp, Artificial Sequence
  Description of Artificial Sequence: Synthetic coding sequence
atggagacccaaaaagatgaggccgcacaggccaaaggggcagcagcatcgggttcgacccgagaacagacagcagaaaagggtgctaagaacaaagccgctgaagccactgaagggccgacatccgagccatccagctccggtccaggcagactaaaaaagaccgctatgaagctctttgggggaaagaaagggatctgtacactgccatccttctttggagggggtaggagcaagggaagtgggaagggcagctctaagaaaggcctgagcaagtccaagacacatgatgggttgtctgaggccgcacacggacccgaggatgtcgtctctgagggaaccgggttcagcctgcctctgcctgaacttccatgccagttcccatcaagccagagtgcccatggcgctttggagaccggcagccgctgtaaaacttctgtcgcgggtgctaccgagaaagccgtcgcagaaaaattccctagcatgcccaaacccaaaaaaggtcttaaaggtttcttcagttccatccgccggcatagaaaatcaaaagtgacaggggccgagcagtccgagcccggcgccaagggccctgagcgggtccgcgcacgcccccatgagcatgtgagcagcgccccccaggtcccctgtttcgaagagacatttcaggccccacgtaaagagaatgctaatccccaggacgctcccggtccaaaggtgagtcccacaccagagccctcaccccccgcaactgaaaaaatggcatgcaaagacccggagaaacctatggaagcctgtgcctctgctcatgtccagcctaaaccagcccctgaagccagctctctggaggagcctcattcccctgagaccggtgagaaagtcgttgcgggggaggtaaacccacctaatggccccgtgggcgatcccttgtccctactctttggggacgttacaagtctgaaatccttcgattcactcaccgggtgtggcgatatcattgcagaacaagatatggacagcatgaccgactctatggcaagcggcgggcagagggcaaaccgtgacggcacaaaacgctcatcctgtctggtaacctatcagggcggaggagaggagatggccctccccgatgatgacgacgaggaggaagaagaggaagaagaggtggagctggaagaggaggaagaggaagtcaaggaggaggaggaggatgatgaccttgagtatttgtgggagaccgcacagatgtatccgagacccaacatgaacctgggataccaccccacaacgtccccagggcatcatggatacatgctgctggaccctgtgagatcttatcctggcttggcccccggggaactcctcaccccacagtctgaccagcaagaatctgccccaaatagtgacgagggatactatgacagtaccacccctggtttcgaggatgatagcggcgaggcactgggactggtgcgcagagactgcctccctagagactcttactccggcgatgctctgtatgagttttacgaacctgatgactctctcgagaatagtccaccaggagacgactgtctctatgatttgcacgggcgaagctctgaaatgtttgatccttttctgaatttcgaacccttcctctccagcaggcctcccggtgccatggagacagaagaggagaggctggttaccatccagaaacaactgttatactgggagctgcggagagaacagcttgaggcccaggaggcgagggctagggaggcccatgcgcgggaggcacacgcaagggaggcctacacaagagaggcttatggcagagaagcgtacgcccgcgaggctcatacttgggaggcacatgggagggaggcccgcaccagggaggctcaggctcgggaagtgaggtgcagggagacacaggtaagggaaacccaggctcggcaggagaagcctgttctcgagtaccagatgagacctctgggtcccagcgtgatgggcttagctgccggggtgtccggcacttcacagattagccataggggcatcacaagcgcctttccgacgactgccagcagtgagcccgattggcgcgactttcgaccgctggaaaaacggtacgagggtacttgttcaaagaaagatcagtcgacctgtctgatgcagcttttccagagcgacgcaatgttcgagccagatatgcaggaagccaacttcggcgggagccctaggagagcctaccctacctatagtcccccggaagatcctgaggaagaagaggtggagaaagaggggaatgctaccgtctccttttcacaggccttggtcgaatttacctccaatgggaacctcttttcttccatgtcttgcagctcagatagtgacagcagcttcacccagaatctcccagagttgcctccaatggttacatttgacatagcagacgttgagagggacggcgagggcaaatgcgaggaaaacccagaattccacaatgacgaagatctcgccgcttccctggaggctttcgaactggggtattaccataaacacgcatttaataattaccattcccgcttctaccaaggtttgccctggggtgtctcttcactcccaaggtatctgggtctgcctgggctgcatcccaggccacccccagccgcgatggctctgaataggagatcaagatctcttgacacagccgagactctcgagatggagctaagtaattcccatctcgtgcaaggttacttggaatcagatgaactgcaggcgcagcaggaggactctgatgaggaggacgaagaggaagaagagggcgaatggagtagagatagcccactaagtctgtacaccgaaccccccggcgcctatgattggcccgcttgggcaccctgccctcttcccgttggacccggccccgcatggatcagccccaatcaacttgacaggccctcctctcagagtccataccggcaggcaacctgctgtattcctcccatgaccatgtcaatctcgctgagtgtgcctgaaagtcgcgcgccaggggagagcggtccacagctggcacgcccgagccacctccaccttccaatggggccctgttacaatctgcagcctcaggcttctcagtctatgagagcgagacccagggacgttctgctgccagtggacgaaccaagttgttcctcatcaagtggtggcttctctccttcacccctgccacaagccaaaccggtcggcataacccatggcatcccgcagctcccaagagtaaggcccgagcatccccagccccagcccactcattacggaccgagcagcctggatctttcgaaagaacgggccgagcagggcgcctcactggccactagttatagctctacagccatgaatgggaacttggccaaatag

SEQ ID NO: 116543 - DNA, 2415 bp, Artificial Sequence
  Description of Artificial Sequence: Synthetic coding sequence
atggagacccagaaggacgaagcagctcaagccaaaggtgcagccgcgtccgggtctacacgggagcagaccgctgagaagggggcaaaaaataaagctgctgaagccactgaaggtcccacctccgaaccttcgtcaagcgggccagggcggctgaagaagacggcgatgaaactgtttggcggcaaaaaagggatctgcaccctgcctagcttctttggtggagggcgtagcaaaggatccgggaagggctcaagtaaaaagggactgtccaagtctaagacgcatgatggcctttctgaagccgcccacggcccagaagacgtagtgtctgagggaactgggttctcactccccctgcctgagctgccatgccagttccctagttcacagtccgcccatggcgcactggagacaggatctagatgtaagacatctgttgctggcgccactgaaaaggctgtcgccgaaaaatttccatctatgcctaagcctaaaaaaggcctcaagggatttttttcatctatccgcaggcacagaaaatccaaggtaacaggagctgagcagtccgagcccggagctaagggccccgaacgcgtgcgcgcgagaccccatgaacacgtcagttcagctccgcaggtgccatgtttcgaggagactttccaggctccaaggaaagagaacgcgaacccacaggacgcccctggacctaaagtttcaccaacacccgagcccagccccccagcaacggagaagatggcttgcaaagaccccgagaaaccaatggaagcttgtgcgagcgcccacgtgcaaccgaaacccgcacctgaagcatcctctctcgaagagcctcactcgcctgaaactggcgagaaggtcgtcgctggcgaggtgaatcccccgaatggtcctgtgggcgatcctctctcactgttgtttggggatgtgactagtctgaagagcttcgattcactaactggctgcggggatattattgcagagcaggatatggactctatgacggacagtatggccagcgggggacagcgtgccaatagggacggaaccaaacgatcgtcttgtctggtaacttaccagggtgggggggaagagatggcactgcctgacgatgacgacgaggaggaagaagaagaagaagaggtggaactcgaggaagaagaagaggaagtgaaggaagaggaggaagacgacgacctcgagtatctatgggagaccgcacagatgtacccgcgcccaaacatgaacttgggctaccatcctacaaccagcccggggcaccatggatacatgttgttagatcccgtgaggtcttacccaggtttggctcccggcgagcttcttacgccgcagtccgaccaacaggagagtgctccaaattccgatgagggttattatgattcaacgacccctggcttcgaggatgatagtggggaggcattgggcttggtcagaagagactgtctgccacgtgattcttatagtggcgatgccctctacgaattctatgagcctgacgactccctggagaactcacctcctggtgatgactgtttgtacgatctccacgggcgcagcagcgaaatgttcgaccccttcctgaatttcgagcccttcctatcgagccggcctcctggggcgatggaaaccgaggaggagcgtctcgtgacaatccagaagcaactgctgtattgggaacttcgaagggaacagctggaggctcaggaggcacgggcacgggaagcccatgccagggaagcccacgcccgggaggcttatacaagagaggcttatggccgagaagcatacgccagggaagcacacacttgggaggcccacggcagagaggctcggacccgggaagcccaagcgcgggaggttagatgccgcgagacgcaggtgagagagacgcaggcccgtcaggagaagcccgtgcttgaatatcagatgaggcccctgggaccaagcgtgatgggcttggcggctggcgttagcgggacgagtcagattagccatagggggataacctctgcgtttcctacaactgcaagctcagagccggattggcgggacttccggcccctggagaaaagatatgagggaacctgctcaaaaaaggatcaaagtacctgcctgatgcaactgttccagagcgatgcgatgtttgaacctgacatgcaagaagcgaattttgggggatcccccaggagggcttatcctacctactcccccccagaggaccctgaggaagaggaggtggaaaaggagggaaatgctacagtcagcttttcccaggccctggtggagttcacttctaacgggaatcttttctcatctattcggtgtccgggtactgaggataaacggcaggtgacccaggcttgtggcacctggtag

SEQ ID NO: 116544 - DNA, 1566 bp, Artificial Sequence
  Description of Artificial Sequence: Synthetic coding sequence
atgttcacatctgagaagggagtggtggaggaatggctgtcggaatttaaaaccctgccagagactagtctgcccaactacgcaaccaacctcaaggataagtcatctctcgtgagttcgttgtacaaggttattcaggagcctcagagtgaactccttgaacccgtgtgccaccagctcttcgagttctatagatctggagaagaacagttgctccagtttacgttgcagttccttcccgaacttatctggtgttacctggccgtgtcagcaagcaggaatgtgcattcctctggctgcatcgaagctctgctgctgggcgtgtacaacttggaaattgtcgacaaacaagggcatactaaagtcctgagcttcaccatcccatcactttctaagcctagcgtgtatcacgagccttcctctatcggatccatggccctgactgaatccgccctatcgcagcatgggctgtccaaggtggtgtactccggccctcatcctcagagagagatgctgaccgcccagaacaggttcgaggttctgacatttctactcctgtgttataatgcagctctgacctacatgccaagcgtgtcactgcagtcactgtgccaaatctgttctcgaatctgcgtgtgcgggtaccccagacagcacgtgcgtaaatacaaggggatttcttccagaatccccgtttcttctggtttcatggtccagatgctgacaggaatttactttgccttttataatggcgagtgggacctggcacaaaaagctctggacgacatcatataccgagcccagctcgaactctatccagagcctcttctggtcgccaatgccataaaggcttccctgccgcacggacctatgaaatcaaacaaagaaggtacccggtgcatccaagtggaaatcacccctacatcatccaggatctcccggaatgcagtgaccagcatgtcaattcgaggccatagatggaaaaggcatgggaacactgaacttactgggcaggaagaactcatggaaatcagcgaggttgacgagggcttttattcccgggccgctagcagcacttcacagagtggtttgagcaactcgtcacataactgctccaacaagccaagtatcggcaagaaccatagacgctccgggggaagcaagaccggaggcaaagagaaagaaactacaggggaaagctgcaaggaccattttgccaggaagcagacacagagagctcagagtgaaaacttggaattgcttagcctcaaacgactcactctgactacgtcccagtcactgcctaaacccagttcccacggacttgctaagactgccgcaacagtattcagcaagtcctttgaacaggtgtccggcgtgactgttccccacaacccctctagcgctgtcggctgcggcgccggcaccgatgcaaatcggttctcagcctgcagtctccaggaggaaaagctgatttacgtgtctgagcggacagagcttcctatgaaacaccagtccggccaacagcgcccacctagcatcagtattactctcagcaccgattag

SEQ ID NO: 116545 - DNA, 342 bp, Artificial Sequence
  Description of Artificial Sequence: Synthetic coding sequence
atggacggccgcgttcagctcataaaggctctcctggctcttcctattaggccagcgacccgccggtggaggaacccgattccattccctgagacatttgatggggataccgacaggctcccggagtttatcgtccagacagggtcctacatgtttgtcgacgagaatacattttcaagcgacgcccttaaagtaacattcctaattacccgtctgaccgggcccgcactgcagtgggtcattccctatattaagaaggaatcgcctctcctgaatgattataggggctttttggctgagatgaagagggtgtttggatgggaagaagacgaagacttttag

SEQ ID NO: 116546 - DNA, 2241 bp, Artificial Sequence
  Description of Artificial Sequence: Synthetic coding sequence
atgggtgacgtcctatcaacgcaccttgatgacgcccggcggcagcacatcgccgaaaagacaggcaagattctgacggagttcctgcagttctacgaagaccaatacggcgtggccttatttaacagtatgcgtcacgaaatagagggaacaggcctcccgcaggcccagctcctctggagaaaagtgccgctggacgagcgtattgtattttcaggtaacttgtttcagcatcaagaggactctaagaaatggcggaaccgtttcagcctggttccccacaactacggcttagtgctgtatgaaaacaaagcagcctacgagcggcaggtgccacctcgggctgtgatcaacagcgctggttataagatcctgacatcagttgaccagtacctggagctcatcgggaacagtcttccaggcacaactgctaagtcaggctccgcacctatcttgaagtgtcccacacagtttccgctgatactatggcacccatatgccagacattactatttttgtatgatgacagaggcagaacaggataagtggcaggctgtgctgcaagattgtatccgtcattgtaataatggaattccagaagattctaaagtggaagggccagcgttcaccgatgcaattcggatgtataggcagtcaaaggagctgtacggaacctgggaaatgctctgtgggaacgaagtgcaaatcctcagcaacctggtcatggaggagcttggccccgaactcaaagccgagctgggccctagactgaaggggaagccccaggaacgtcagagacagtggatccagataagtgacgccgtctatcacatggtctacgagcaggccaaagcccgcttcgaagaagtactttctaaggttcagcaagtgcagccagcgatgcaagccgttataagaactgatatggatcagattataacttcaaaagagcatttagcatctaaaatccgagcctttattctcccaaaggcagaggtttgcgtcagaaaccacgtacagccatacattcctagtattctggaagccttgatggtgcctacaagccagggctttaccgaagtcagggatgtgttttttaaagaagttaccgatatgaacctcaacgtgatcaatgagggaggaatagacaagctgggcgaatatatggagaagctttctcggctggcttaccatccactcaaaatgcagagttgttatgagaagatggaatccctgcgattagacgggctgcagcagaggtttgatgtgtccagcacctctgtgtttaaacaaagagctcaaatccacatgcgagagcagatggataatgccgtatatactttcgaaactcttctccaccaggaactgggtaagggccccacgaaggaagagctgtgcaaatcaatccagcgcgtcctagagagggtgcttaaaaagtacgactacgatagctcctctgtgagaaagcgattcttccgagaagctctccttcagatttccatccccttcctacttaagaaactggcaccgacctgcaagtccgaattacctcgtttccaagaactgatctttgaagactttgcccgtttcattctggtggaaaacacttacgaagaggtggtccttcagaccgtcatgaaagatattcttcaggccgttaaggaagcggcagtgcagcgcaagcataacctgtaccgtgattcaatggtcatgcacaactccgatccaaacctgcacctgctggctgaaggtgctcctatagattggggtgaggagtattcaaactccggtggaggcggttccccttcccctagtacacctgagtctgccacattatccgaaaagcggcgacgggcgaaacaggtggtgagcgttgtacaggatgaggaggtagggctgccatttgaagcctcaccagagtcgccaccgccagcttcacctgacggagtcacagagatccgcggattgctcgcccagggcctccgacctgaatcacctccgcccgcggggccccttctgaatggcgctccggctggcgagtcaccccagcccaaggctgcccccgaagcctctagccctccagcaagtccccttcaacatcttttaccaggaaaggccgtggatctagggccacccaagcctagtgatcaggagacaggagagcaggtgtcatccccctcgtcccacccggcgttacatactactacagaagatagcgccggtgtgcagactgagttttag

SEQ ID NO: 116547 - DNA, 2202 bp, Artificial Sequence
  Description of Artificial Sequence: Synthetic coding sequence
atgggttggatgggagagaagaccggaaagattctcactgaatttctccagttctatgaagaccaatacggagtggctctctttaactctatgaggcatgaaattgaaggcaccggactaccgcaggcgcaactgctgtggcgcaaagtaccacttgacgagcggatagtgttttcaggcaatctgttccagcatcaggaggacagcaaaaagtggagaaatcgcttctctctagtgccccacaactatgggctcgtcctctacgaaaacaaagctgcatatgaaagacaggttcctcctagagcggtgattaatagcgcaggctacaagatactgaccagtgtggatcagtatctggaattgatcgggaattcactgccgggaaccacggccaaatctggcagcgccccgatcctaaaatgtcccacccagttcccccttatcctttggcacccgtacgcccgccactactatttctgtatgatgactgaggctgaacaggataaatggcaggctgttttgcaagactgtatacgccattgcaataatggtatccctgaagatagcaaggtggagggaccggcattcaccgacgctatccgtatgtataggcagtcgaaagaactctacgggacctgggagatgctgtgcggcaacgaggtacagatactaagtaacctggtgatggaagagctcggtcccgaactcaaggccgaacttggtccccggctcaaaggcaaaccccaagagcggcagagacaatggatacaaatctcggatgccgtgtaccatatggtttacgaacaagccaaggctcggttcgaagaagttctgtcaaaagtccagcaggtgcagcccgccatgcaggcagtgatccgcacagacatggaccaaattataacatccaaagaacatctggccagcaagattcgcgccttcattctgcctaaggctgaagtgtgcgtgaggaaccacgtacagccatacatcccctcaatcttggaggccctaatggtaccaacttcacagggatttaccgaagtaagggacgtgttcttcaaggaagtgactgacatgaatttaaacgtgattaatgagggcgggatcgataaactgggtgagtatatggagaagttatccagattggcctaccaccctcttaaaatgcagagttgctacgaaaaaatggaaagcttgcggcttgacggcttgcagcagagattcgacgtatccagcactagtgtgttcaagcagcgcgctcagatccatatgcgagaacagatggacaacgccgtctatacctttgagaccctcctgcaccaggaactgggcaaaggccccactaaggaggagctctgcaagagtatccaaagagtactggaacgtgtgctaaagaagtacgattatgacagcagctctgtacgaaagcgctttttccgtgaagctcttctacaaatttcaatccccttcctcctgaagaaactggctcctacctgcaagtcagaacttcctcgattccaggaactgatatttgaggactttgccaggtttattctggtagagaacacctacgaggaggtggtgctgcagacagtcatgaaagatatattacaggcagtaaaggaagccgctgtgcagcgcaagcacaacttgtacagggacagcatggtaatgcacaatagcgaccccaatctgcatctgctagctgaaggcgcccctattgactggggggaggaatactccaactctgggggcggggggtccccttcgccctcaactcccgaatcagctacgctcagcgaaaagagacgcagagccaagcaagtagtctctgttgttcaggacgaagaggtgggacttcccttcgaagcatctccggagtccccccctccagcctcacctgacggagttacagagatccggggcctcctggcacagggcctacggcctgagagcccacccccggccggacctttgctaaacggagcaccggccggggagagcccccagcccaaggccgcacctgaagccagttcacctcccgccagccctttgcagcacctgctcccggggaaggccgtcgatctaggccctcctaaaccttctgatcaggaaacaggcgaacaggtctccagtcctagctctcatcccgcgctgcacacgaccaccgaagatagcgcaggggtccagaccgagttttag

SEQ ID NO: 116548 - DNA, 1191 bp, Artificial Sequence
  Description of Artificial Sequence: Synthetic coding sequence
atggtgcccactagtcagggttttaccgaggtccgggacgtctttttcaaagaggtgaccgatatgaatcttaacgttatcaacgagggcgggattgacaaactgggggagtatatggagaagctcagccggctcgcttatcatccccttaagatgcagtcttgctacgaaaagatggagtccttgcggctggacgggcttcaacagcgtttcgatgtgagttccaccagtgtgttcaagcaaagagcccagatccatatgagggaacaaatggacaatgccgtctacacattcgaaacactgctgcaccaggagctgggaaagggtccaacaaaagaggagttatgcaaatctatccaaagggtcctggagagggtgctgaagaagtatgattatgactcatcctccgtgcggaagagattttttagagaagcgttactccaaatctccattccattcctgttgaagaagttagcccctacatgcaagtcggagctaccaaggttccaggagctgatcttcgaggacttcgctcggtttatactggtagagaacacatatgaagaggtagtactgcaaacagtgatgaaggacatcttacaagccgtgaaggaggccgctgtccagcggaagcacaatttatatagggactctatggtgatgcataattctgacccaaacctccacctgctcgccgagggagccccaatcgattggggggaagagtactcaaacagcggggggggcggatctccaagtcccagcacccccgagagcgccactctgtcggaaaagcgcaggcgcgccaagcaagtggtctccgtagtgcaagatgaggaagtgggacttccctttgaggcctccccggagagtcccccgccagcaagcccagacggcgttactgaaattcggggcttgcttgcccagggactgcgtcccgaatccccacccccagccgggccactcctgaacggagctccagccggtgagagccctcagcccaaggccgcacccgaggcatcctcccctcccgcatctccactgcagcacttgctgcctgggaaggcagtcgatctgggtccacccaagccgagcgaccaggaaacaggcgagcaagtgtccagcccttcctcccaccccgcactgcacaccactaccgaagattcagcaggtgtccagacagagttctag

SEQ ID NO: 116549 - DNA, 3072 bp, Artificial Sequence
  Description of Artificial Sequence: Synthetic coding sequence
atgggggccggtgcactagcgatctgtcaatcaaaggccgctgtgagactaaaagaggatatgaaaaaaatcgtggcagtacctctcaacgaacagaaggactttacttaccaaaagctgttcggagtgtccttacaggagctggaaaggcagggtctgaccgaaaatggtattcccgccgtggtctggaatattgtcgaatatttgactcaacacgggctgacacaagaaggactcttcagagtcaacggcaacgttaaagtcgttgagcagcttagactgaagttcgagagtggcgtgcctgtggagctggggaaggatggtgacgtctgctcagccgctagcttgctgaagttatttcttagagaactgcccgattcattaatcaccagcgcactgcagcctagattcattcaacttttccaggacgggcgcaacgatgtccaggagagttcccttcgagatctcattaaggagctgcctgacacccattattgtctccttaagtatctgtgtcagttcctgacaaaggtggccaagcatcatgtgcagaaccgtatgaacgttcataatctggccactgtgtttggcccgaattgctttcatgtcccgccaggtttggagggcatgaaggagcaggacctgtgcaataagattatggctaaaattctggagaactataacaccctttttgaagtcgagtacaccgagaatgaccacctgcgctgcgagaatctggctagactgattatcgtgaaggaggtgtactataagaatagtctccctattctcctaactagaggcctcgaacgcgatatgccgaagccgccacccaagaccaagatccccaagtcaagaagcgagggctcaatacaggcccatagggttttacagcctgagctgtccgacgggatccctcagttatctcttcggctctcatacaggaaggcatgtctggaagacatgaactccgcagagggagctatttccgcaaagctcgtgcccagttctcaggaagatgagagaccattgtctcctttctatctgtcggctcacgttcctcaggtgagtaacgtttccgcaactggcgagctgctggagcgaacaatacgatcggcagtggagcagcacctgttcgacgttaataatagcgggggacagtccagcgaggactctgaatccgggactctgagcgcaagtagcgcgactagtgcccgtcagaggagaagacagagcaaagagcaggacgaggtgcggcacggcagagataagggcctaataaacaaggaaaacactcccagtgggttcaaccatttggacgattgtattctgaacacacaggaggttgaaaaagttcataagaacacctttggatgtgctggcgagaggtcgaaaccaaaacgtcaaaagtcctctacgaagctgagcgaactgcatgacaatcaagatggtcttgtgaacatggagagcttgaactccacacggtcccacgagcgcaccgggccagacgatttcgagtggatgagcgacgagcgcaaaggcaacgaaaaggacggggggcacacacaacactttgagagtcccactatgaagattcaggaacacccatcgctgtctgacacaaagcagcagcggaaccaggacgccggtgaccaggaggagagcttcgtttccgaagtccctcaatccgacctcactgccctttgcgatgagaaaaattgggaagaacctataccggccttcagttcatggcagcgcgaaaactccgatagtgacgaggctcacctatctccgcaggctggtcggttgataaggcagcttctggatgaggatagcgatcccatgttaagtccacgcttctatgcgtacggtcagtctcgacagtacctggatgacactgaggtgccgccctctcctcccaattctcactcattcatgcggcgccggagcagcagcttgggctcttacgatgacgagcaggaagacttgacccctgcccagctgacacggcgtatccaaagcctcaagaaaaaaattagaaaatttgaggataggtttgaggaggagaagaaataccgcccttcccactctgataaggcggccaatccagaagttctgaagtggaccaatgacctggcaaagttccgacgccaactaaaagaaagcaagctcaagatctccgaggaggatctgacgcccagaatgcgtcagcggagcaacactctccccaagtcctttggctcccaactggagaaagaagacgaaaagaagcaagagttggtcgacaaagcgattaaaccctctgttgaggcaacccttgaatccatccagcgtaagctccaagagaagcgtgccgagtcttctcgacctgaggacatcaaagatatgacaaaggatcaaattgccaatgagaaggtggctctgcagaaagcactgctgtactatgagagcatacatggcagacccgtgaccaaaaatgagcgccaggttatgaagcccctctacgatcggtaccggctcgtgaagcaaatcctctccagggctaacacaatacccataatcggctcgccatctagcaaaaggcggtcccccctactccagcccattatcgagggcgagacagctagctttttcaaggagatcaaggaagaagaggaagggtccgaggacgactcaaatgtcaaacctgatttcatggtcacactgaaaactgattttagcgcacgatgcttccttgaccaatttgaggacgacgctgatggcttcatctccccaatggatgacaaaataccatctaaatgctcccaggatacgggcctctctaacctgcatgctgcttcaatcccagaactccttgagcatttgcaggaaatgagagaagaaaagaaacgcatacgaaaaaaattgcgagatttcgaggataattttttccgacaaaacggcagaaacgtccaaaaagaagatcgaacgccaatggcagaagagtatagcgagtacaaacacataaaggccaaactcaggttgctcgaggtccttatcagtaaacgagatacagacagcaaaagtatgtag

SEQ ID NO: 116550 - DNA, 2010 bp, Artificial Sequence
  Description of Artificial Sequence: Synthetic coding sequence
atggcttgtgaaatcatgccactgcaaagctcccaggaagatgaacgccctctttccccattctacctgagtgcccacgttccccaggtgagcaatgttagcgccacaggggagttgctcgagagaacaattcgtagcgccgtggaacagcacctgtttgacgttaataatagtggcggacaatctagcgaggatagcgagtccggcacgctttcagcttcatcagccacctcagcgagacaacggcgcaggcagtccaaagaacaggatgaggtgaggcatggtagggataagggactcataaataaagagaacacgccctcaggtttcaatcacttggacgattgcatactgaacacccaggaggtggagaaagtccacaagaatacttttggctgtgccggtgagcgatccaaaccaaagaggcagaagtcctccactaaattgtccgaactgcatgacaatcaggacggattggtgaatatggaatccctgaatagcacgaggtcacacgagcggacaggtccggatgattttgaatggatgtctgatgaacggaaggggaacgaaaaagacgggggtcacacgcagcacttcgagtcaccaacaatgaaaatccaggaacatccaagtctttcggacactaagcaacaacgcaatcaagacgctggcgaccaggaagaatctttcgttagcgaggtccctcagagcgacctaactgcattgtgtgacgagaagaactgggaggaacctattcccgcattttcgagctggcagagggagaacagtgatagtgacgaggcccacctaagccctcaggccggccgactgatcaggcaactgttggatgaagatagcgatcccatgttgagccctcgcttctatgcatatgggcagtctagacagtatttggacgatacagaggtgccaccatctcctcccaatagtcattcattcatgcgcaggcgctcctcttcactgggctcctacgatgatgaacaggaggatctcacccctgctcagcttactagaaggattcaaagcctgaagaaaaagattagaaaattcgaagaccgatttgaggaagaaaaaaagtaccgcccgtcccactcagacaaggccgctaacccagaggtgctaaaatggaccaacgatctggctaagttccgccgacaattaaaagaatcgaaactcaagatctccgaggaagacctgacaccacggatgcgacagcggtccaacacactgcccaaatctttcggcagccagttggagaaggaggacgagaagaagcaagagcttgttgacaaggctatcaagccgagcgtcgaggcaaccctggagtctattcagcggaagttacaggagaagcgggcagagagcagcaggccagaagatattaaggatatgacaaaggatcagatagcaaatgagaaagttgcactacagaaagccctgctgtactatgaaagcatacatggtagaccagtgacgaagaatgagaggcaggtgatgaagcctctatatgatagatatcgactggtcaaacaaatcctgagtcgagccaatactattcccatcatcgaagaggaggaaggtagtgaggacgactctaacgtcaagcccgactttatggtaaccttgaaaacggacttctcagcccgctgttttcttgatcaatttgaggacgatgccgatggatttatatcacccatggacgataagatcccttccaaatgctcacaagacacaggcctgagcaatctgcatgctgcatcaatccccgagctgctggaacatctgcaggaaatgcgcgaagaaaaaaaacgcattcggaaaaagctgcgggactttgaggataacttctttcgccagaacgggcgcaacgtacagaaggaagaccgcactcctatggcagaggaatactcagaatataaacatatcaaggcaaagctcaggcttcttgaagtgctcataagcaaacgagataccgattccaagtctatgtag

SEQ ID NO: 116551 - DNA, 2094 bp, Artificial Sequence
  Description of Artificial Sequence: Synthetic coding sequence
atggcttgcgagataatgcctcttcagagctcacaggaggatgagcgccccctgagtccattttacctgtcagcccatgtccctcaggtcagcaacgttagcgctacgggggagctcctggagcgcacaattagaagtgctgtcgagcagcatctgtttgatgtgaacaattcagggggacagtccagcgaggactctgaatccggcaccctgagtgcaagcagtgctacttcagccagacagaggcggagacagtcaaaggagcaggacgaagtccgccacggccgggacaaaggcctgatcaacaaagagaacacaccctctggattcaaccacctggacgactgtatcctaaacacacaggaagtggagaaagtacataagaacacctttggatgtgcaggtgaacgctccaaaccgaagcggcagaagagcagcaccaagctctcagaactccacgacaaccaggatggcctcgtgaacatggagtctctgaattcgacaaggtcacacgagcgtacagggccagacgactttgagtggatgtccgacgagagaaagggcaatgaaaaggatggcggtcacacacagcatttcgaatccccaaccatgaagattcaggagcatccatccctgagtgacaccaaacagcagcggaaccaggacgccggcgaccaggaggaatctttcgtgtcagaagtcccccagtcagacctgacggccttgtgtgatgaaaaaaattgggaggaacctatacccgctttcagcagttggcagcgtgaaaatagcgacagtgacgaggcccatttgagtcctcaggcgggtcggcttatcagacagctcctagatgaagattcagaccctatgctttcaccaagattctacgcctatggacaatccagacagtacctggacgatacagaggtgccaccttctccacctaactcccattcctttatgcgtagacggtcaagctcactggggtcctacgacgacgagcaggaagacctgacccccgcccagcttactagaaggatccaatctctgaaaaagaagattaggaagtttgaggaccgtttcgaagaggaaaaaaagtaccgtccttcccactcagacaaagctgctaacccagaggtcctgaagtggaccaacgatctggccaaattcaggagacagctcaaggagtccaagctgaagatttccgaagaggatctgacccccagaatgagacaacgctccaacacactgcctaagtcatttggttctcagttggagaaggaggatgagaaaaaacaggaactggtggataaagcaatcaaaccaagcgtggaagcaaccttagagtccatccagagaaagctgcaggaaaagcgcgctgaatcctcaagaccagaagatatcaaggacatgacaaaagatcagatcgctaacgagaaggtcgccctacagaaagcactgctgtactacgagagtatccacggccgccccgtgactaaaaatgagagacaggtgatgaaaccactgtacgataggtatcgcctcgtgaaacagattctgagcagggctaacaccattcctatcatcggctcccctagctccaaaaggcggtctccgctactgcaaccaattatcgaaggcgagactgcttccttttttaaagagatcaaggaagaagaagaggggtcagaggacgactctaacgtaaaacccgattttatggttacccttaaaacggacttcagtgcccgttgcttcctggatcagtttgaggatgacgctgatggattcatttcccccatggacgacaagatcccgagtaagtgctctcaagataccggactctccaacttgcacgccgcctccataccagagttattggagcatctgcaggagatgagggaggagaagaaaaggatcaggaagaagctccgtgactttgaagacaactttttccgccaaaacggaagaaacgtccaaaaggaggaccgtactcctatggcagaggaatattcggaatacaaacacattaaggccaaactgcgccttctggaagtacttatctctaagcgtgacactgactctaaatctatgtag

SEQ ID NO: 116552 - DNA, 609 bp, Artificial Sequence
  Description of Artificial Sequence: Synthetic coding sequence
atgggagcgggcgcccttgccatctgccagtcgaaagccgccgtcagactgaaagaggatatgaaaaagattgtggctgtgccactgaatgaacaaaaggactttacctatcagaagctgttcggagtgagccttcaggagctggaacgccagggattgacagaaaatggaatcccagccgtcgtgtggaatatagtagaatacctgacacagcatggtttaactcaggagggacttttccgcgtgaatggcaatgttaaggtggtggagcaacttcgtcttaaattcgagtcaggagtacccgtagaattgggtaaagatggagatgtgtgtagcgcagcgtcactcttaaagcttttcttgagagagctgcccgattctctaatcaccagtgctcttcagccaaggtttatccagttatttcaagatggcagaaatgacgtgcaggagtctagcctccgcgatctgattaaagagctcccagacacacattactgcctgctgaagtatctttgtcagtttttgaccaaggtggcaaagcaccatgtccaaaatagaatgaatgtgcataatttggcgaccgtgttcgggccgaattgctttcagtag

SEQ ID NO: 116553 - DNA, 1494 bp, Artificial Sequence
  Description of Artificial Sequence: Synthetic coding sequence
atggcctcacccgcaccacccgaacacgcggaagagggctgtcccgcaccagccgcggaggaacaggccccgcctagcccacccccgcctcaggcaagtccagcggagcggcagcaacaggaagaagaagcgcaggaggccggcgcagcagagggggccggcctgcaggtcgaagaagccgccgggagggccgccgccgccgttacatggttacttggtgaacctgtactatggctgggctgtcgggccgacgaattgttaagctggaagagaccactccggagcctcctcgggtttgtggccgccaatctgctattctggtttcttgccctgaccccctggcgcgtttaccacctgatatccgtcatgattctggggcgcgtgatcatgcagattattaaggacatggtcttgagtagaacacgcggtgcccagctgtggcggagtctgtccgaaagctgggaagtcattaattcgaaacctgacgagcgtcctagactctcccactgcatcgcggagtcctggatgaacttctccatattcctccaggagatgtccctttttaagcaacagtctcctggaaagttctgtctccttgtgtgttctgtctgcacgttcttcactatcttagggtcatatatccctggtgtcatcttgtcttatttgcttctgctttgtgctttcctctgccccctgtttaagtgtaatgacatcgggcagaaaatttatagcaaaatcaaatcagttcttttgaaacttgatttcggaatcggtgaatatattaatcagaagaaacgggagaggagtgaggccgataaagaaaagtcgcataaggacgatagcgagctcgacttttcggcactctgccccaagatttcactgacagtcgccgccaaggaactcagcgtgtccgacacggatgtttccgaagtctcctggactgataacgggacgttcaatctcagtgagggctacaccccccagacagacacgagcgatgacctcgataggcctagcgaggaggtgttctccagggacctgtcagatttccctagcctggagaatggcatggggactaatgacgaggacgaacttagccttggattgccgacggagctgaaacgaaagaaggaacagctggattcgggacaccggcccagtaaagaaactcaatcagctgcggggctgaccttgcccttaaacagcgatcagacgtttcaccttatgagcaacctagcgggggatgtgattaccgctgccgtgacggccgcgatcaaggatcagttagaaggcgtgcagcaggccctctctcaagccgctccgattcccgaagaggacaccgatacagaggagggcgatgacttcgagctcctcgatcagagtgagcttgaccagattgaatctgagctaggtctcacgcaggaccaggaggccgaagctcagcagaacaagaagtcctccggtttcttgagcaatttgctgggcggccactag

SEQ ID NO: 116554 - DNA, 1071 bp, Artificial Sequence
  Description of Artificial Sequence: Synthetic coding sequence
atgcctgagggcgaggacttcgggcccggaaagagctgggaagtcattaacagcaagcctgatgagcgccctcggttgagtcattgcatagctgagtcatggatgaatttcagcattttcttgcaggagatgtccctctttaaacagcagagtcctggaaagttttgtcttctggtgtgctcagtgtgcacttttttcaccatactgggaagctacatccctggcgtgatcctaagttacctgctgctgctctgcgcgttcctgtgccctctcttcaagtgtaacgatataggtcagaagatttacagcaagattaaaagcgttctgctgaaactggacttcggtataggggagtatatcaaccagaaaaagcgcgagcgctcggaggctgataaggagaagtcgcataaggacgatagtgaacttgacttcagtgctctatgtccaaaaatctcattgactgtggccgctaaggagctaagtgtgagcgatactgatgtgagcgaggtgagttggaccgataacggaacattcaacctgtctgaagggtatacccctcaaacggacacatctgacgatctcgaccgccccagcgaggaagtgttcagtcgtgacctcagcgacttcccaagcctagagaatgggatgggcactaatgacgaggatgagctatcactgggccttcctactgagctcaagaggaagaaggaacagttagacagtgggcatagacctagcaaggagacccagagcgccgccggattgacattaccacttaactccgatcaaacatttcatcttatgtctaatctggccggggacgttattaccgcagccgtgacagccgctatcaaggatcaactagaaggcgtccagcaggctttgagccaggccgcacctatccccgaggaggatactgatacagaagaaggggacgattttgaactgctggatcaatcagaattggaccagatcgagtccgaattaggcttaacccaggaccaggaggcggaagcccaacagaacaaaaaatctagcggattcctgtctaatctgctgggcggccactag

SEQ ID NO: 116555 - DNA, 2151 bp, Artificial Sequence
  Description of Artificial Sequence: Synthetic coding sequence
atggctacgagccaccgagtagcgaagttggtggcttcttcactacagactcctgtgaacccaatcactggggcacgtgtggcccagtacgaaagggaggaccccctcaaggccctggcggccgccgaggcgatcctggaggacgaagaagaggaaaaagtggcccagcccgccggagcctccgcagatctcaacactagctttagtggggttgatgagcacgccccaatttcctatgaggactttgtgaacttccctgatattcaccattctaatgaagaatatttcaagaaggtcgaagagttaaaggcggcgcatattgaaaccatggctaagctcgaaaagatgtaccaggacaaactgcacctcaaggaggtgcaacctgtcgttatcagggaggactctctgtctgactctagcaggtctgtgtcagaaaagaactcttatcatcccgtatccctgatgacatccttctctgagcccgacctgggacagagttcctccttatatgtgagctcttccgaggaggaactgcctaatctagagaaggagtacccacggaagaaccgcatgatgacctacgctaaggagttaataaataacatgtggaccgatttctgcgtcgaggattacatccgctgcaaggatacaggtttccatgcagctgagaaacgccggaaaaagcgtaaagaatgggtgccaaccattactgtaccggaaccttttcaaatgatgatccgcgaacaaaagaagaaagaagaaagtatgaagagtaaatccgatattgagatggttcacaaggcactaaagaaacaggaggaagaccctgagtacaagaaaaaatttcgagccaacccagtcccagcttcagtgtttctccccttataccacgacctggtgaaacagaaggaagagcgaaggagatctctgaaagagaagtccaaagaggccttgctggcatcccagaaaccctttaagttcattgcaagggaggagcagaaaagagccgctcgggagaagcagctacgtgacttccttaagtacaagaagaagactaaccggtttaaggcccgacctatcccacgttcaacgtacgggtcgaccaccaatgataaactgaaagaagaggagctttatagaaatctgcgtacacagctgcgagcccaggaacacctccagaattcttctcctctgccatgtagaagcgcttgtggctgtcgcaatcctcggtgccccgagcaggctgtgaaactgaaatgcaaacacaaggtgagatgccctactccagactttgaagatctaccagaacggtaccagaagcacttgagcgagcataaatcacctaaactgcttacagtttgtaagccttttgacctccacgcgtctcctcacgcaagcatcaagcgggaaaagattctcgccgacatcgaagccgatgaggaaaacctgaaggaaacgcggtggccgtacctaagccccagacgcaaatcgcctgtacgatgtgctggtgtcaaccctgtgccgtgtaactgcaatccccccgtacccacagtatccagccggggaagggagcaggcggtcagaaggtcactcgaggaaaagaaaatgctggaagaggaaaggaaccgcatattgacaaagcagaagcaacggatgaaggagctacagaaactattgacaaccagagccaaggcctacgattcgcaccagtctctggcacagatttcgaagtccagggtaaaatgtcttagaaagagcgaaaaggagagaatgcgcgagtatcaacgcgagctggaggaacgcgaagagaaactgaagaaacgtccactgctttttgaacgcgttgctcagaaaaacgctaggatggctgccgaaaagcattactccaacacattgaaagctcttgggattagtgatgagtttgtatcaaaaaagggacaaagtggcaaagtacttgagtactttaataatcaggaaactaagagtgtaacagaggataaggaaagtttcaacgaggaagagaagatcgaggagcgtgaaaacggcgaggaaaattatttcattgacactaatagtcaggactcgtacaaagagaaggatgaagccaatgaggagagcgaagaagaaaaatccgtggaggagagccactag

SEQ ID NO: 116556 - DNA, 1983 bp, Artificial Sequence
  Description of Artificial Sequence: Synthetic coding sequence
atggcaacttcccaccgtgtagccaaacttgtggccagcagcttacagactccagtgaaccctatcaccggagcaagagtcgcacagtacgagagagaggaccctctaaaggcattggctgccgccgaggccatactggaagacgaagaggaggagaaggtggcccaacccgcaggcgctagcgccgacctgaatacctccttcagtggggtcgatgagcacgctcccatcagttatgaagacttcgtgaatttccccgacattcaccatagcaacgaggaatattttaagaaggtggaggaactcaaagctgcccatatcgaaacaatggccaaactggaaaagatgtaccaagacaagctgcatctgaaagaagtccaaccagttgtgatacgcgaagactccctgagcgacagttcccggtctgttagtgaaaagaactcctaccaccctgtcagccttatgacttccttcagcgagcccgacttggggcagagttcttccctctacgtgtcctcatccgaggaggaactccccaacttggaaaaggagtaccctcgcaagaatagaatgatgacatacgccaaagagttgatcaacaacatgtggactgacttttgcgtggaggactatatccggtgtaaagacactggattccacgcagctgagaaacggcgaaaaaaacggaaggaatgggtcccaactataaccgtgccggaaccatttcaaatgatgattcgcgaacaaaagaaaaaagaagaatcaatgaagtctaaatcagatattgaaatggttcataaagctctaaaaaagcaggaggaggatccggagtataagaagaagttcagggctaaccctgtccctgcatccgtgttcctgccactgtatcatgacctggtgaagcaaaaagaagagagacggcggagtctgaaagagaagagtaaggaagccctgctggctagccagaagccgtttaagttcatcgcacgggaagagcagaaacgggctgccagggagaagcagctgagagatttcttgaaatacaagaaaaagactaatagattcaaggcacgaccaataccgaggagcacttatgggtcgacaaccaacgataaattgaaggaagaggaattatacaggaacctgcggactcaactcagggcccaagagcatctgcagaacagttctcctctgccatgcaggagcgcttgcggttgtcgcaaccccagatgccccgagcaggcggtaaaactgaagtgtaagcacaaggtgcgctgccccactcccgatttcgaagatcttccggaaaggtatcagaagcacctgtctgaacataagtcacctaaactcctcacagtgtgcaaaccatttgacttgcatgccagccctcacgcctctatcaagagggaaaaaatcctggccgacatcgaagccgatgaggagaatctaaaggaaacaaggtggccatacctgtccccccggagaaagtcccccgtgcggtgcgcaggagtcaacccagtaccttgcaactgtaatccccccgtccccacagtgagctcaagaggtagagagcaagcagtgaggaaatccgagaaagaacgtatgagggagtatcagagagaactggaggagagagaagagaaactgaagaagcgcccgcttctttttgagagggtggcacagaaaaacgcccggatggcggcggaaaagcactatagcaataccctcaaagctttgggaatctctgacgagttcgtctctaaaaaaggccagtcaggaaaggtgttagagtattttaacaaccaggagaccaaaagcgtgactgaggacaaggagtcttttaatgaagaagaaaagattgaagaacgcgaaaacggagaggagaattacttcattgatacaaattcccaagacagttataaagagaaggacgaagccaatgaagaaagcgaagaagaaaaatcagtggaggagtcccattag

SEQ ID NO: 116557 - DNA, 645 bp, Artificial Sequence
  Description of Artificial Sequence: Synthetic coding sequence
atgtcagtgccacagatccatgttgaagaggtcggcgccgaggaaggggcaggggccgcagcccctccggacgaccatctgcgatcgctgaaggcactcacagaaaaactgagactggagactcggcgcccatcatacctggagtggcaggctagactggaggagcatacctggcctttcccccgaccagccgctgagcctcaagcctctctcgaagagggcgagaggggcggccaggaaccactcctgcctctgcgggaagcagggcagcacccaccatccgcccgaagcgcctcccagggtgcaagacctctgagtacgggtaaactagagggattccagtcaatagacgaggccatcgcctggctcaggaaagaactgacggaaatgaggctgcaggaccagcagctggctcgacagctgatgcgtcttagaggagatatcaacaagctcaagattgagcacacctgccggctgcatcggcgcatgctcaatgatgctacctacgagctagaagaaagagacgagctggccgacttgttttgcgatagccctctggcttcgagcttctccctgtccacccccctgaaactaattggcgtgacaaaaatgaacattaacagtcggcgcttttcattatgctag

SEQ ID NO: 116558 - DNA, 1248 bp, Artificial Sequence
  Description of Artificial Sequence: Synthetic coding sequence
atggctgcctccataagcgggtacacattttccgccgtctgcttccacagcgccaatagcaacgctgatcacgaagggtttctacttggtgaggttcgtcaggaggagacttttagcatcagtgactcacagatcagcaacactgaattcctgcaggtgatcgagatacataatcatcagccgtgtagcaaactcttctccttttatgactacgcgtctaaagtcaacgaggaaagcctggaccgcatcctcaaagatagacgcaagaaagttattggctggtatagattccggcggaacacgcagcagcaaatgtcctaccgcgagcaggtgctgcacaaacagctgacgagaatactgggcgtgcctgacctcgtttttctcctgttttcatttatttcaaccgccaacaatagtacccatgccctggaatatgttctgttccggcccaaccggcgatacaatcagaggatctcccttgctatccccaatctcggcaacacgtcccagcaagagtataaggttagttctgtgcccaatacctctcagagctatgcaaaggttataaaggagcacggcacagatttcttcgacaaggacggcgtgatgaaggacattagagcgatctaccaagtgtacaacgccctgcaagagaaggtgcaagcggtctgtgctgatgtggagaagagcgagcgggttgtagagtcctgccaagctgaagtaaataaactgcgcaggcaaatcacacagcgaaagaatgagaaagaacaggaacgtagactccaacaggcagtgctgtctaggcaaatgccatccgagagcttggatccagccttttcccctcgcatgccatcttctgggttcgcggctgagggacgatccactctgggtgacgccgaggccagcgatcccccgccgccctattctgactttcaccctaataatcaggagtctacactcagtcactctagaatggagcgaagcgtattcatgccaagacctcaggccgtgggctcctcgaattacgcatcaactagcgctgggctcaaataccccggaagcggtgctgaccttcccccacctcaacgcgctgccggcgacagcggagaagacagtgatgatagcgattacgaaaacctgatcgaccccacagaaccgagtaatagtgagtatagtcactctaaggatagtcggcccatggctcatcccgacgaagatcccagaaatacccagacctcccaaatttag

SEQ ID NO: 116559 - DNA, 3522 bp, Artificial Sequence
  Description of Artificial Sequence: Synthetic coding sequence
atgacccgacggtgtatgccagcccggccaggtttcccctcctcacctgcgccaggaagctctcccccaagatgtcatctcagacctggctccaccgcccatgcggccgctgggaaacggacagagtcacctggggaccgtaagcagagcattattgacttcttcaagccagccagcaagcaagataggcacatgctggactctccacagaaatccaatatcaagtatgggggcagtaggctgagtattacagggaccgaacagttcgagaggaaactgagctcacccaaagaatcaaaacctaagagagtcccccctgaaaaaagcccgatcattgaggcctttatgaagggcgtcaaagaacaccacgaggaccacggaattcacgagtcacgcagaccatgcctgtccttggcttctaaataccttgccaaagggactaacatctacgtgcctagcagttatcacctgcccaaggagatgaaatcacttaagaagaagcatagatcgccagaaaggcggaagagccttttcatacacgagaataacgagaagaacgatagagatcggggaaaaacaaatgctgactctaagaagcagactacggtggctgaggctgatatatttaataacagttcacgttcgctatcctccagatccagtctgtcccgtcatcatccagaagagtcacccttgggagcaaaatttcagctctctcttgcctcatattgtagggaaagagaactgaagcgactgagaaaggagcagatggagcagcgcataaattcagagaattctttttccgaggcgagtagcctcagcctgaagagtagcatcgagcgaaaatacaagccccgccaggaacagcgcaagcagaatgacataattcccggcaagaacaacctgtccaacgtggagaatggacacctctcacggaagcgtagttccagtgactcctgggaacccacttcagcgggctcaaagcagaataagtttcctgaaaaacggaaaagaaattctgtggactccgatttgaagtccacccgggagtcaatgatccctaaagccagggagagtttcctcgagaagaggcctgacggcccccaccaaaaggaaaagttcataaagcacatcgccctgaaaacccccggcgacgtgctcagactagaagatattagcaaagagcccagcgacgagacagatggaagctcggctggtctggccccctcaaacagcgggaattcagggcaccactccacaagaaattccgaccaaatacaggtcgctggcacaaaagaaaccaagatgcagaagcctcacctgcccctttcacaggaaaaatccgctatcaaaaaggcatcaaatctacagaaaaataaaacagctagcagcactactaaggagaaagagacaaaactcccgctgttgagtagagtgccttctgcaggatcttccctggtgccacttaatgccaaaaactgcgccctgcctgtaagcaaaaaagacaaggagcggtcttcgtctaaggagtgcagtgggcattcaaccgagtcaaccaaacacaaagaacacaaagctaaaactaacaaggctgatagcaacgtttcttccggcaaaatttctggaggaccattgagatcagaatacggaacacccactaaatccccacccgccgcactcgaggtggtcccatgtatccccagtcccgccgccccgtcagataaggccccttccgagggcgagagttccggtaatagcaatgcaggatctagtgccttgaagcgtaagttacggggcgactttgactccgacgaagagagcctcgggtacaacttagatagcgacgaggaagaggaaaccctaaagagcttagaggagatcatggccctgaactttaaccaaacacctgccgctacaggaaaaccacccgccctgtcgaagggccttcgttctcagagctccgattacactggtcatgtgcatcccggtacttacacaaatacactggagaggttagtaaaagaaatggaggatacccaacgcctggacgagctccaaaagcagctgcaggaggacattcggcaggggaggggcatcaaatcaccaattcgaatcggagaagaggactctactgatgacgaggatggactcctcgaggaacataaggagtttctgaaaaagttttcagttacaatcgacgcaatacctgaccatcaccccggggaagaaatctttaatttcctcaatagtggaaagatcttcaaccagtatactctggacttaagggattccggctttatcggtcagtctgccgtcgagaaacttattttgaagtcaggtaagactgatcagattttcctgactacccagggctttcttactagtgcttatcattatgtccaatgccctgtcccggtcttaaaatggctgtttaggatgatgagcgtacatactgattgcatagtgtctgtccaaattttgtctaccctgatggagatcaccatccgaaatgacactttctccgattctccagtgtggccttggatccccagcttgtctgatgtggctgctgtatttttcaatatgggcatagacttcagaagcctgtttccgctggaaaaccttcagcccgactttaatgaggactacttggtatctgagacgcagaccacgtccagggggaaagagtcagaagattccagctacaagcccatattctcaaccctcccagagactaatatactgaacgtggtgaagtttctcggcctgtgtaccagcatacatccagagggctatcaggacagggagattatgctactgatccttatgcttttcaagatgtctcttgaaaaacagttgaaacaaatcccccttgtggacttccagtccctcctcatcaatctgatgaagaatatccgggactggaatactaaggtccccgaactgtgcttgggcatcaacgagctctcctcacatccccataacctgctttggctcgtgcagctagtgcccaattggacaagccgcgggcggcaattgcggcaatgcctgtctctcgtaataatttctaaactgctggatgagaagcacgaagatgtgccaaacgcatctaacctccaggtcagtgttctgcaccgttacttggtccagatgaagccctctgatctgttaaagaaaatggtactaaaaaagaaggctgaacagcccgacggtatcatcgatgattccctgcatctggagttggagaaacaggcgtactacctcacatacatcttgttgcacctggtcggagaggtgtcatgtagccattcattcagcagcgggcagcgaaaacattttgtcctcctctgcggtgcactggaaaagcacgtcaaatgcgacataagagaagacgccagactcttctatcgaacgaaagtcaaggacctggtcgcaaggatccacggaaaatggcaggaaatcatccaaaactgtcgaccaactcaggggcagctccacgacttttgggtgccggacagctag

SEQ ID NO: 116560 - DNA, 3561 bp, Artificial Sequence
  Description of Artificial Sequence: Synthetic coding sequence
atgacacggcggtgtatgccggcaagaccaggattcccaagttccccggcacccggtagcagtccacctcgttgtcacctgaggcccggatccactgcccacgccgcagctggcaaaaggacagagtcccctggcgaccgcaaacagtctataatcgatttcttcaaaccggcgtccaagcaggatagacacatgttagacagcccacagaagtctaacattaagtatggcggcagccgcctgtcaataaccggcaccgaacagttcgaaagaaagctgtcctcaccaaaggagtcgaaacccaagagagtgccacctgagaagagcccgataatagaagcctttatgaaaggggtgaaagagcatcacgaagaccacggaatccatgagtcaaggagaccgtgcctgagtttggcttcaaagtacctcgcgaagggcactaacatttatgtcccttcttcatatcatctcccgaaagaaatgaagtctttgaagaagaaacatcggagcccagagcgccgaaagtccttgttcatccacgagaataacgaaaagaatgaccgggatcggggtaagactaacgcagactcaaaaaagcagacgacagtggcagaagccgatatctttaataacagcagtcgatctctgagttccaggagtagcctgtctcggcaccacccagaagaatctccactgggtgcaaagtttcagctctctctcgccagttactgcagagagcgggagctcaaacgactgcggaaggagcaaatggaacagcgaattaattctgagaactctttctcggaggcctcttccctgagtttgaagagtagcattgagagaaagtacaagcccaggcaggaacagaggaagcaaaatgatattatcccaggtaagaacaatctgtcgaatgtcgaaaatgggcacctatctcggaagcgtagctcttcggattcttgggaacccactagtgctggttctaagcagaacaagttccccgaaaaacgcaagaggaacagcgtagatagcgatctgaagagtactagggaaagcatgattcccaaggcaagagaatccttcctggagaagcgaccagacgggccacaccaaaaggagaagtttattaagcatattgctctcaagacccctggcgacgttctgagacttgaagacatcagcaaggagccgtccgatgagaccgacgggtcttcagccggacttgccccttcaaactctgggaatagcggccaccactcgactaggaacagtgaccagatccaggtggccggcactaaggaaacaaagatgcaaaagcctcatcttcccctcagtcaagaaaagtccgctatcaaaaaagcctccaacctccagaaaaataagaccgcctccagcacaacaaaggagaaagaaacaaagctgcccctgctctctcgggtgccatcagccgggtcaagccttgtccccctgaacgccaagaattgtgctctgcctgtgagcaagaaagacaaagagcgtagttcctctaaggaatgctcaggccactcgaccgagagtaccaagcacaaggaacacaaggcgaagacaaacaaggccgacagcaatgtgagctcagggaagattagtggtggcccccttcggtctgagtacggcacacctactaaaagccccccagcagcactagaagtcgtgccatgcatcccgtccccagctgcacctagtgataaggcacccagcgaaggagaatccagcgggaacagtaacgctggcagcagcgctctgaaacggaaattgcgcggtgactttgactcagacgaggagtcactcgggtacaacctcgactccgatgaggaggaagaaaccttaaagagtctggaggagattatggcattaaattttaaccagacacctgcggccaccggcaagccaccggctctctccaaagggttgcgctctcaatcttcagactataccggccacgttcacccaggtacttacaccaatacacttgaaaggctggtaaaggaaatggaagatacacagcgcctagatgagttgcagaagcagcttcaagaagatatcagacagggacgcggcataaagagtccaattaggatcggtgaagaagactcgacagacgacgaagacgggctgctggaggaacacaaagaattcttgaaaaagttctctgtgacgattgacgcaattccggatcaccacccaggcgaggagatcttcaactttctgaacagcgggaagatattcaatcagtataccttagacctaagagacagtggctttattggtcagagtgcagtagagaagctcatcctgaagagcggcaaaacagatcagatattccttacgacccagggatttctgacttccgcgtaccactacgttcagtgccccgtgcccgtcctgaagtggctcttccggatgatgagcgtacacactgactgcatcgtttcggttcagattttgtcgacactgatggaaattacgatccgtaatgacaccttcagcgatagccctgtgtggccatggattccctccctgtccgatgtggccgctgtgttctttaatatgggtattgacttccggagcttatttccattagaaaatctgcaacccgactttaacgaagattatcttgtttctgagacacagacaactagcaggggcaaggaatcggaggactcaagttacaaacccatcttttctacgctccccgagaccaacatcctgaatgtcgtgaagtttctggggttatgtaccagcatccaccccgagggataccaggaccgggagataatgttactgatcctgatgttgttcaagatgtctttggaaaagcaactgaagcagatccctcttgtcgatttccagtctctgcttattaacctgatgaaaaatattagggattggaacactaaggtacccgagctgtgtctggggatcaacgagctgagttctcatcctcacaacctgttgtggctcgtgcagctggtgcccaattggacctcacgggggcgacaactcaggcagtgcctctcactagtgattatctctaagctgctcgatgaaaaacacgaggacgttcctaatgcatccaatctgcaagtgagtgtgctccaccggtacttggtgcagatgaaaccttccgacttgctcaaaaaaatggtactgaaaaagaaggcagagcagccagatgggattattgatgattcccttcatctagaactggaaaagcaagcttattatctcacctatatcctcctgcacctcgttggtgaagtgagctgctctcactcatttagcagcgggcagcgaaaacactttgtcttgctttgtggggcacttgagaaacacgtgaaatgcgacattagggaggacgctcgcctcttctaccgcaccaaggtaaaagatctggttgcgcgaatccacggaaaatggcaggaaatcattcagaactgccgacccacacaggtctccttctgttacaccatttcttgcattctgaattcatttgccgagtggcattcctcttattgtctgaaatag

SEQ ID NO: 116561 - DNA, 2277 bp, Artificial Sequence
  Description of Artificial Sequence: Synthetic coding sequence
atgactcggcgctgcatgccagctaggccaggtttcccgtcctctcccgctcccggttcttctcccccgcggtgccacttgaggcccgggtccactgctcacgcagctgccggtaagaggacagagtcccctggcgacagaaaacagtccatcatcgatttcttcaaaccggctagcaaacaagatcgtcatatgctggactctccccagaagagtaatatcaagtacgggggcagtaggctctctattaccggcacggagcagttcgaacggaaactgtcatccccaaaagagagcaagccgaagagagtgccaccggagaaatcccctattattgaagccttcatgaagggggtgaaggaacatcacgaagaccatggaatccatgagtcaagacgtccttgtctcagtttagcaagcaagtacctcgcgaaagggacaaatatctacgttcctagcagttatcacctgccaaaggaaatgaaaagcctcaagaaaaagcatcggagccctgagcgcagaaagtcactctttatacatgagaacaacgaaaaaaatgatagggaccgggggaagaccaatgcagatagcaagaaacagacgacggtggccgaggcagacatttttaacaatagtagtcgatccctgtcctccagatctagtctgtcaagacatcatcctgaggaaagcccactgggggcgaagtttcaacttagtctcgccagttattgtagggagcgtgagctgaagcgcctgcgcaaagaacagatggaacagagaatcaattcagagaattcattctcggaggcatcaagcctgtccctgaagtcatctatcgagcgcaagtacaagccccggcaggaacagcgaaagcagaacgatatcatcccagggaagaataatttaagtaacgttgagaacggccacctatctagaaagcggtccagctccgattcttgggagcctactagtgcgggatctaagcaaaacaagttccctgaaaaaaggaagcgaaatagcgtggatagcgatctcaagagcaccagggagtctatgatcccaaaggcccgcgagtcattcctggagaaaaggccagatggcccccaccagaaagaaaagttcataaagcatatcgccctgaagacacctggggacgtgctgagactagaagatatcagcaaggaaccttctgatgaaacagatggatcctcagctgggttggctccgtctaatagtggcaactccggacaccactcgacaaggaactctgaccagatccaggtggccggcaccaaagaaaccaagatgcagaagccgcacttgcctctgtcacaggaaaaatcggccataaagaaggcttcaaacctgcagaagaataaaaccgcttctagtactactaaagaaaaagagaccaaactgcctctgctgtccagagtgccaagtgcagggtcctctctcgtgccactcaatgccaaaaattgtgcacttcccgtgtctaaaaaagacaaggaaaggtcttcatccaaggaatgtagcgggcactccacagaaagtaccaaacacaaggaacacaaggccaagaccaacaaggctgactctaatgtgtcaagcggaaaaatttccggcgggccccttaggagtgagtacgggacccctaccaaaagcccacctgcggctctggaggtggtcccctgcatcccaagccctgcagccccatcggataaagccccaagcgaaggcgagtcctccggcaattctaacgcagggagtagcgcactgaaacgtaagctcaggggggatttcgacagtgacgaggaaagcctggggtataacttagactccgacgaggaagaagaaacccttaaaagtctcgaggagatcatggccctcaatttcaatcagacacccgctgccactggaaagccacccgcactctccaagggactcaggtcgcaatcatcagattacacggggcacgtgcacccgggtacctacaccaataccctggaacggctggtgaaggaaatggaagatacgcaaagattcgtgagcatcaagattaatttgcttaaccttaccttctgtctgttcgtatggctcacttttaacctcccatttcttaagaatcacgaaaagctggcttgcatcctcgactccgtagtgaactgtgtgagaatccgctacgtgggacgaactcaatggctgatgcctgtgatcactacactgtgggaaacacaggctcgactgttagagcctcgctccagtcgcctgagatag

SEQ ID NO: 116562 - DNA, 675 bp, Artificial Sequence
  Description of Artificial Sequence: Synthetic coding sequence
atgaccagaattacggagctttggagttcaccacagtggaaggtcggagcggaagtgtgcggcagacaaatgagagagcagcggactgctgagcaatctgaaacgcaacggacttggctgagtatggcagccacactccagttcctcgtctgccttgttgttgccatatgcttactatccggagtaaccacaacacagccacatgcgggacagccaatggacagcacatccgtgggcggtggcctgcaggagccggaagcgcccgaagtaatgttcgagctgctatgggcaggactggagttggatgttatgggccaacttcacattcaggacgaggaactggcttccacacaccccggccgccgccttagactgctcctgcagcaccatgtgccttccgacctagagggcacggaacaatggctgcagcagctgcaggatctgcggaaagggccacccctgtcaacttgggatttcgagcaccttctcctgactggcttgagctgtgtttataggctgcatgccgcgtccgaagccgaggagcgcggtaggtgggctcaggtgttcgctctgcttgcccaagagaccctgtgggacctgtgcaaaggcttttgcccccaggatagaccgcctagtctgggaagctgggcctctattcttgaccccttcccctag

SEQ ID NO: 116563 - DNA, 606 bp, Artificial Sequence
  Description of Artificial Sequence: Synthetic coding sequence
atgcgcgagcagcgcacagccgaacagtccgaaacacagagaacatggctctcaatggcagccacactacagtttctagtgtgtctagtggtggctatatgtctattgtctggtgtcacgacgactcaaccccacgccgggcaaccaatggacagtacctctgtcgggggcggactgcaggaaccagaagcacccgaggtcatgttcgagctactgtgggccggcttggagctggacgttatgggtcagctccatatccaggatgaagagctagccagcacacaccctggacgacgcctaaggttactactccagcatcatgtcccttccgatttggaaggtacggagcaatggttgcagcaactacaggacctgcgcaagggtccccccctgtcaacatgggacttcgaacacctgctcctcacgggattgagctgcgtttatcgcctccatgctgcttctgaggctgaggagaggggtcgctgggcccaggttttcgccctgctggcccaggaaacactatgggacctatgcaaaggcttctgtccccaggataggcccccatcccttggatcatgggcttcaattctggatccattcccgtag

SEQ ID NO: 116564 - DNA, 1626 bp, Artificial Sequence
  Description of Artificial Sequence: Synthetic coding sequence
atgccagggctcaggcgtgatcgcctgctcaccctcttgctcctgggagctctgctctccgcagacctctattttcacctgtggcctcaggtccagcgtcagttgcggccgagagaaaggccgaggggatgtccctgcactgggcgtgcttcttccctggcaagagacagtgcggcagccgcttcggaccctgggactatcgtgcataacttttcgcgcacagaacctagaactgaacccgcaggtgggagtcatagcgggagctcatcgaagctccaggcactcttcgcccatcctctgtacaacgtacccgaagagccccccctcttgggcgctgaagactcacttctcgccagtcaggaggccctcagatactaccgcagaaaggtggccaggtggaaccgaagacacaagatgtatcgtgagcagatgaatctgacctctcttgatccccctctgcagctccgcctcgaggcctcttgggttcagttccatttaggaataaaccgacacggactgtacagtcgctcctccccagtggtttcaaaactgttacaggatatgaggcacttccctaccatctctgctgactactcacaagacgaaaaggcactgttgggagcatgtgactgtacccaaatagtcaaaccaagcggggtgcacctcaaactggtgctgcgctttagtgacttcgggaaggccatgtttaaaccaatgagacagcagcgcgacgaggagacccccgttgactttttctacttcatagattttcagagacacaacgccgagatcgccgcctttcatctagacagaatactggattttaggagggtccccccaacagttggtcggatagtcaatgttacaaaggagattctcgaggtgaccaagaatgaaatccttcagtcagtgttcttcgtgtctccagcttctaatgtttgttttttcgccaaatgtccttacatgtgcaaaacagagtacgccgtttgtgggaaccctcacttgctggaaggcagcttatctgcgtttttgccgtccctgaacttggcgcctagactatctgtaccaaacccttggatcaggagttatactttggctggtaaggaagagtgggaagtgaatcccctctactgcgataccgttaaacagatttacccttataataacagccagaggctactcaatgtaattgatatggcaatatttgactttctcatcggtaatatggaccgccatcactacgaaatgtttacaaaattcggagacgatggtttccttatccacctggacaacgccagagggttcgggagacactcgcacgacgagatcagtatattgagccccctatcccagtgttgtatgataaagaagaaaactctcctacatctgcagctgcttgcacaagccgactaccgactttctgatgtgatgcgcgaaagtctcctcgaggatcagctctcccctgtcctgaccgagcctcacctcctggctctcgataggaggttgcagaccatcctgaggacagtagaaggatgcatcgtggcccacggacagcagtccgtgatcgtagacggcccggtcgagcagcttgctccagattcaggccaggcaaacttgacttcgtag

SEQ ID NO: 116565 - DNA, 1023 bp, Artificial Sequence
  Description of Artificial Sequence: Synthetic coding sequence
atgggcccacctcacagcggccccggaggagtacgagtgggagcgctgctcttactaggagtgcttggcctggtgtcggggctgagcctcgaacccgtgtattggaactcggcaaataaacgtttccaggcagagggaggatacgttctttatccacagatcggggaccgccttgacctgctttgccctcgggcacgccccccaggacctcattcttctcctaattatgaattctataaactgtacctggtggggggggctcagggacgtcgatgcgaagccccccctgcgccgaacttgctgcttacttgtgatcgccccgaccttgacctaagatttaccataaagtttcaggaatatagtccaaacctgtggggtcacgagttcaggtctcaccacgactattacataatcgcaacgagcgacggcactcgcgaaggattggaaagtctgcagggcggcgtatgcctcacacgggggatgaaagtgctgttgagggtgggacagtcccctcggggcggagccgtgccaagaaaaccagtgagtgaaatgccaatggagcgggacagaggtgcagcccacagcctagagcccggaaaagagaatctgcctggcgatcctacctcaaatgctacaagccgcggggccgagggccctttaccacctccatcaatgcccgccgtggccggagccgccggcggactggctctcctattgctgggtgtggccggtgccggaggtgctatgtgctggcgtcgacgaagggcgaaaccctcagagtcacggcacccaggacccgggtcgttcgggcggggaggatccctgggcctaggcggcggcggcgggatgggacctcgagaagctgagccaggtgagttgggaatcgccctgcggggcggcggagcagctgaccctcccttctgcccgcattacgagaaggtgtctggcgattatggacatcctgtgtatatcgttcaggatggacccccgcagtcccctccaaacatttattataaggtgtag

SEQ ID NO: 116566 - DNA, 438 bp, Artificial Sequence
  Description of Artificial Sequence: Synthetic coding sequence
atgtttacctcccccagcgagggcaagcccggcaatatggatcggcaccattatgagatgtttaccaaattcggggacgacgggttcctcattcacctggacaacgcccgaggattcggacgtcactcacatgacgagattagcatactgtcgcccttgtcacaatgctgcatgataaagaagaagaccttgctgcacttacagctcctcgcccaggccgattatcggttgagcgacgtgatgcgcgagtccctgcttgaggaccagctctctcctgttctcacagagccccacctcctggctctggatagaagattgcagactattctacgtaccgtcgaaggatgcatcgtagcccatggacagcagtccgtaattgtggatgggcctgtggaacagttggcccccgattccgggcaggctaatctcacctcctag

SEQ ID NO: 116567 - DNA, 1230 bp, Artificial Sequence
  Description of Artificial Sequence: Synthetic coding sequence
atgaagctaaagcagcgggtcgtattgctggccatcctcctggtcatatttattttcaccaaggtcttcctcattgataatctagacacctccgctgccaacagggaagaccagcgagctttccacaggatgatgactggtctgcgggtcgagctggctccaaagttggaccacactcttcaaagtccgtgggaaatcgcggctcaatgggtggtaccccgggaggtgtacccagaggaaacccctgaactgggagccgtgatgcacgccatggctaccaagaaaatcattaaggccgatgtgggctacaagggaacccagcttaaggcactgctgatcctggagggcggccagaaagttgttttcaaacccaaacgatactcaagagatcatgtggtcgaaggggaaccgtatgcaggatatgacaggcacaacgcagaggttgctgcgttccacctcgaccgaatcctcgggtttcatcgtgcccctctggtggtcggacgattcgtaaatctgaggaccgaaatcaaacctgtagcgactgagcagctgctctctactttcttaacagtgggtaacaatacgtgtttctacggtaaatgttattactgtagagagacagaaccagcctgcgctgatggcgatatcatggaaggctcagtaacactgtggctgcccgatgtttggccactacagaaacacaggcatccatggggcagaacttaccgggaaggcaaattggcaagatgggaatatgatgaatcttactgcgatgccgtaaaaaagacttctccttacgatagtggccctcgcttgctggacatcatagacacagctgtgttcgattatctgattggcaatgccgatcgccatcattatgaatcatttcaggacgacgagggcgcatccatgctgattctgctcgataacgctaaatcattcggtaacccctctcttgatgaaagatcaattctggcccccctatatcagtgctgcatcatcagggtgagcacatggaaccggcttaattacctcaagaacggtgtgctaaaatctgcactgaagtctgctatggcccatgaccctattagccctgtcctctcagaccctcatttggacgccgtcgaccagcgtctgctgtcagtactggctactgtgaaacagtgcactgatcagtttggaatggacactgtcctcgtggaggatagaatgcccttatctcatctatag

SEQ ID NO: 116568 - DNA, 417 bp, Artificial Sequence
  Description of Artificial Sequence: Synthetic coding sequence
atgaagctgaagcagcgagttgttctgctcgcgattctgttagtgatatttattttcacgaaggtattccttatagataacttagatacttctgccgctaaccgtgaagaccaacgcgcgtttcaccgtatgatgacaggacttagagtggaactggctccgaagctcgaccacacattgcaatccccgtgggaaatcgctgcccagtgggtggtgccaagagaggtgtaccctgaagaaaccccagaactgggtgcagttatgcacgcaatggccacaaaaaaaatcattaaggcagacgtcgggtataaaggcacacagctgaaggcactactgatcttggaggggggtcagaaagtcgtattcaaacccaagcggtattctagggaccacgtagttgagggcgaaccatactag

SEQ ID NO: 116569 - DNA, 1755 bp, Artificial Sequence
  Description of Artificial Sequence: Synthetic coding sequence
atgaagatgatgctcgtcaggcgatttcgagtgctgatcctcatggtgttcctggtggcttgtgctctgcacatcgctctggacttgctaccccgtcttgaacggagaggagccaggccaagtggcgaaccgggctgttcatgcgctcaacctgccgcggaggtcgcggcccccggatgggcgcaggtgcggggccgccctggggagccacccgcagcctcgtccgccgctggggacgcgggctggccgaacaaacacactctgcggatactacaggattttagtagtgatcccagttctaacctgagctcacatagcctggaaaaactcccacctgcagcggaacccgctgagcgagcactccgcgggagggaccctggggccctgaggccacatgaccccgctcaccggccccttctgagggaccccggcccccgaagatctgaaagcccaccaggacctggcggagacgcatcactcctcgccaggttgttcgagcacccgctgtacagagttgccgtgcccccactcaccgaagaggacgtactgttcaatgttaatagcgacactcgactgagcccaaaggccgccgagaacccggactggccccacgccggagccgagggcgctgaattcctgagccccggcgaggctgccgtggacagctatcccaactggctgaaatttcacattggcattaacagatatgagctgtactctaggcacaaccctgccattgaggccttattacacgacttaagctcacagcgcataacatccgttgccatgaagtcaggcggtacccaactgaaactcattatgacattccagaactatgggcaagctttatttaaaccgatgaaacagactagggaacaagagaccccacccgacttcttctatttcagcgactatgagaggcataatgcggagattgctgctttccatctggacagaatactcgacttccggagggtcccacccgttgccggaagaatggtgaatatgactaaggaaatcagggatgttaccagggataaaaagctctggaggacattcttcattagcccagctaataatatttgcttctatggggaatgttcctattactgctctactgaacatgccctgtgcgggaagcctgatcagattgagggatccctggcagcttttttaccagatctgtcactcgccaaacgcaaaacttggcggaatccctggagaaggtcctatcataaacgcaaaaaggctgaatgggaggtcgatcccgactactgtgaagaggtgaaacagacgcctccgtacgactcttcccaccggatcctggatgtgatggatatgactatctttgacttcctcatggggaacatggatagacatcactacgaaaccttcgagaaattcggtaacgagacttttatcattcacctggataatgggaggggctttggcaaatatagccatgatgagctcagcatacttgtcccgttgcagcagtgttgtaggataaggaagtctacttaccttcgcctgcagctgctggccaaggaagagtacaaactgagcctgctgatggccgaaagccttaggggcgaccaggtggcacctgtgctataccagcctcatcttgaggccctggacagaaggctccgagttgtgctaaaggctgtgagggattgtgtcgagcggaacggactgcactctgtagtagatgacgatctggacaccgagcaccgcgccgcgtccgctcgttag

SEQ ID NO: 116570 - DNA, 3957 bp, Artificial Sequence
  Description of Artificial Sequence: Synthetic coding sequence
atgatgaatagaacaactcctgaccaagagcttgtcccagcatcagagccggtatgggagagaccatggtctgtggaggagatccgaaggtcttcccagagttggtcacttgcggctgacgccggcctgctgcagtttctgcaggagttctcacagcagacaatttcgcgcacccatgaaattaagaaacaggtcgatgggctgatacgtgagaccaaagccaccgactgccgcctccataatgtgttcaatgactttctgatgcttagcaacacgcaatttattgaaaatagggtatacgatgaagaggtcgaagaacccgtgctgaaagctgaggctgagaaaacagagcaggaaaagacaagggagcagaaggaggttgatcttatccctaaagtgcaggaggctgttaattacggccttcaggtccttgacagcgccttcgaacaactcgacattaaagcgggtaattccgactctgaagaggatgacgccaacgggcgggtggaactgatactggaacctaaagatttgtacatcgaccgcccgctgccctacctgattggctctaaactctttatggagcaggaggatgtggggctgggcgaactgagcagcgaggaaggcagtgtgggatcagacagggggtccatagtcgataccgaggaggagaaagaagaagaggaaagcgatgaggacttcgctcatcactccgacaatgaacagaatcagcacaccacccagatgtcagatgaagaagaagatgacgatggttgtgacctgttcgcggattccgaaaaggaggaagaggacattgaggacatcgaggaaaacaccagaccaaagcgatcaagaccaactagcttcgcagatgagctcgcagccagaatcaaaggggatgcaatgggcagagtggacgaggaacccacaactctgccctctggagaggccaagcctcgcaagacactgaaggaaaagaaggagcggaggacgcctagcgacgatgaggaagataatctgttcgcaccccccaagctaaccgatgaggatttttctccattcggttctggcggtgggctgttctctggcggcaaaggcctgttcgatgacgaggacgaagagtccgatctgttcacggaagcatcccaggaccggcaggctggggcgtccgtcaaagaagaatcttctagctcaaagcctggtaagaaaattcctgctggagctgtaagtgtgtttcttggtgataccgacgtgttcggcgccgcatcagtgcccagcctgaaggagccacaaaaacccgaacagccgacaccacgcaagtctccgtacggcccccctcctactgggctgttcgatgatgacgatggggacgacgatgacgacttcttttctgctccccatagtaaaccatccaagactcgtaaggtgcagagtacagccgatatttttggcgacgaggagggggatctgttcaaagagaaggctgttgcaagcccggaggcgactgtgtctcagacagatgagaataaagcccgggctgagaagaaagtaaccctgagctacagcaagaatctcaaacctagctctgaaacaaagacccagaagggactcttttccgatgaagaagattcagaggatctgttctcaagccagtcagcaagcaacttgaaaggggcctctctgctgcctggcaagctgcccacctctgtgtcccttttcgacgatgaagacgaggaggacaacctttttggcggtaccgcggccaaaaaacagaccctgagcttgcaggctcagagagaggagaaggccaaagcatctgagctgtccaagaagaaagccagcgccctattgttcagctcagacgaggaatggaatattcccgcaagccagacccatctggcttctgacagccggtccaagggggaaccaagagattcaggaactctgcaatcacaggaggccaaggcggtcaaaaagacatcactgtttgaagaagataaagaggacgatctatttgctatagccaaggacagtcagaaaaagacacagcgcgtgtcactgctctttgaagacgacgtcgactctggaggaagtctttttggttctccaccaacctcagtgcctcccgcgactaaaaagaaggaaacagtgtctgaagctccacccctgctgttcagcgacgaggaggaaaaggaggctcagctcggggtgaaatcagtggacaaaaaggttgagtcagccaaagagtcccttaagttcgggcgaactgacgtcgccgaatcagagaaagaggggcttcttaccaggagcgcacaggagaccgtgaagcactcggatcttttctccagctcctccccttgggataagggaaccaaaccacggacgaaaaccgtgctcagcctgtttgacgaggaagaagataaaatggaggaccaaaacatcatccaggcccctcaaaaggaggtggggaagggctgcgacccagatgctcacccaaaatctaccggagtgtttcaggacgaggaactcctttttagccacaagttacagaaggacaatgatcccgacgtggacctgttcgccgggacaaagaagaccaaactgcttgagccatccgtgggtagcctctttggcgacgacgaagatgacgatctgttctctagcgcaaaaagccagccactggttcaagagaaaaagagagtagttaaaaaggaccactcagtgaattcctttaaaaatcagaaacaccccgagtctatccagggaagtaaggaaaagggcatttggaagccggagactccccaagctaatctggccatcaaccccgccgcactgctgcccactgcggcaagccagatcagtgaggtgaaacctgtgctccctgagctggcatttcccagctccgagcatcgccgcagccacggcctagagtctgtgcctgttttgcctgggtctggcgaggccggggtgtctttcgaccttcccgcacaggcagacaccctgcactctgcaaataaaagtcgagtgaagatgcgaggcaaacgcaggccccagactagagcggctagacgcctggcagcccaggagtcctccgaggccgaagatatgtctgtccctaggggacctatcgctcaatgggcagacggggcaatcagtccgaacggtcaccggcctcagctccgtgcagcttctggggaggacagcacagaggaagcactggccgccgcagcagccccatgggagggaggaccggtccctggggtcgacacctcaccctttgctaagtccctagggcattcccgcggtgaagccgacctgtttgactcgggcgacatcttctctacgggaaccggctcacagtcggtggagagaacaaagccaaaggcaaaaatcgcagagaaccccgcaaacccccctgtgggcggaaaagctaagtctccaatgttccccgctctcggtgaggcatcatccgacgacgacctgtttcaatccgccaagccaaagccagcaaagaagactaacccttttcccctgcttgaagacgaagatgatctgttcacagaccaaaaggtgaagaagaatgaaaccaaatcaagcagtcaacaggatgttatcctgactacccaagacatatttgaagatgatatctttgcgacagaagccattaaaccatcacaaaaaactagagaaaaagagaaaacactggagtctaatctcttcgatgataatatcgatatcttcgcagatttgacggtgaaaccaaaggaaaaaagtaaaaagaaagtggaagctaagtctatcttcgacgacgatatggatgacattttttcaacggggatccaagcaaagacaaccaagcccaagtcacgctctgctcaggctgccccggaaccccgcttcgagcataaagtgagcaacatctttgacgacccgctgaacgctttcggcggtcagtag

SEQ ID NO: 116571 - DNA, 3789 bp, Artificial Sequence
  Description of Artificial Sequence: Synthetic coding sequence
atgaaccggactacccctgaccaagagctggtgcccgcatccgaaccagtctgggagagaccctggagtgtggaagaaatcagaagaagtagtcagtcttggtcgctggcagcagacgctggacgcgtttacgacgaagaggtcgaggagcctgtcctgaaagctgaggcggagaaaaccgaacaggaaaaaacacgggagcaaaaggaggtggacctgatccccaaagtccaggaagctgtgaattacggactgcaggtgctggactctgcattcgagcagctcgatatcaaggcgggaaatagtgactctgaggaagacgatgcaaacggccgagttgaactgatattagaacctaaggatctgtacatcgaccggcctctgccctatctcatcgggtctaaactgtttatggaacaggaagatgttgggttaggtgaattatcttctgaggagggatcagtgggctccgacagaggctcaattgttgacactgaggaagaaaaggaggaagaagagagcgacgaggacttcgcccatcacagcgacaatgaacagaaccaacatacgacccaaatgagcgacgaggaagaggacgatgacgggtgcgacctgtttgccgacagtgagaaggaagaagaagatatcgaggatatcgaggagaatacgaggcccaagcgcagtcgcccgacatcttttgctgatgagctggccgccagaatcaagggggatgccatgggtagagtcgacgaggaaccaaccaccctgccttctggggaggccaagccgcgcaagacactgaaggaaaaaaaggagaggcgaaccccttccgatgatgaagaggataacctgtttgcccccccaaaactgacagacgaggatttcagtcctttcggctccggggggggcctgttttctggaggcaaggggctgttcgatgacgaggacgaggagtccgacttatttaccgaggcttcgcaggaccgacaggcaggcgccagcgttaaagaagagtcttccagttctaaaccgggcaagaagatcccagctggcgcagtgagcgttttccttggcgacaccgacgtcttcggagcggcgagtgtcccgagcctcaaagagcctcagaagcctgaacagcccactcctagaaagtctccatacggacctccccctacaggactcttcgacgacgacgacggagatgatgacgatgatttcttctccgcccctcactcgaagccctccaagacacgcaaggtgcagtcaacagcagatatcttcggagacgaagagggagaccttttcaaggaaaaggcagttgcttctccagaagcaactgtgagtcagaccgatgaaaataaagcccgggcagagaagaaggttactctgtcatatagcaagaatctgaagccatcatcagaaaccaaaactcagaaaggactgttctccgatgaggaagacagtgaggatctgttttctagccaaagcgctagcaatctgaagggcgcgagcctcctaccaggtaagctgcctacttctgtctccctgtttgacgacgaggacgaagaggacaatctatttggcgggactgccgccaagaaacaaacgcttagtctccaggctcaaagagaagagaaggcgaaggcctcagagttgtctaaaaaaaaggcgagtgccctgctgttcagctccgatgaagaatggaatatcccagccagccaaacccacctggcatctgactcgagaagtaagggtgaaccacgcgacagcggcacgttgcagtcccaagaagccaaagctgttaaaaagacttccctgttcgaagaggataaagaggatgacctgtttgcgatcgcaaaagattctcagaagaaaactcagcgggtcagcttactcttcgaagacgacgtggacagcggagggtctcttttcggatcacctcctacctcagtgccccctgccacaaaaaagaaagagaccgtttcagaggcaccaccactgctgtttagcgacgaagaggagaaggaagcacagcttggagttaagtctgtggacaaaaaagtagagagcgccaaagagagtctcaagttcggaagaacagatgtcgcagagtccgaaaaagaaggtttgctcacacgtagtgcgcaggaaactgttaagcattccgacttattcagcagttcctccccatgggacaaaggcaccaaaccgcggactaaaacagttctctctctatttgacgaggaagaagacaaaatggaggatcaaaatatcatccaagcaccacagaaagaagtggggaagggttgcgaccctgatgcccaccccaaatctaccggcgtttttcaggacgaggagttgctattcagtcataagttgcaaaaggataacgatcctgacgtggacctgtttgcaggtaccaagaaaactaaactgttggaaccctccgtgggtagcttgttcggcgatgatgaggacgatgacctgttcagttctgccaaaagtcaacccctagttcaagaaaaaaaaagggtcgtaaaaaaagatcacagcgtaaactcgttcaagaatcagaagcatccggagagcatacaagggtctaaggagaagggcatttggaagccagagactccccaggccaatcttgctataaaccccgcagcactgctgcccaccgcagcctcccaaatttccgaggtgaaaccggtgttacccgagttggcctttccatctagcgaacataggaggtcacacggccttgaatctgtcccagtgctgccggggtcaggagaggctggtgtgagtttcgaccttcccgctcaggcagacaccctccactccgccaacaagtctcgtgtgaagatgcggggcaagcgcagaccacaaacaagagctgctagacggctggccgcccaagagtcctcggaagccgaggacatgagtgtgcctcgcggtcctatagctcagtgggctgacggcgccatctctcccaacggccaccggccacagctccgcgccgcttccggtgaggatagcaccgaggaggccctcgccgccgccgcagcaccatgggaaggcggacccgtgccaggtgtcgacacaagccctttcgccaaatccctgggccacagcagaggagaggccgacctgttcgattctggggacatcttctctacagggaccggatcacaatccgtcgagcggactaagcctaaagcgaaaatcgccgaaaatccagcgaacccacccgtgggcggaaaggccaaaagccctatgtttcccgcccttggagaggctagcagcgatgacgatctcttccagtcagccaagccaaaacccgctaaaaaaaccaacccgttcccattattggaagatgaggacgacctgttcactgatcaaaaggttaagaagaatgagaccaagtctagctctcagcaagacgtgatcctgaccacccaggacatttttgaggatgatatcttcgccactgaggctattaagccgtctcagaagacccgtgagaaggagaagactctcgaatccaacctctttgacgacaacatcgatatctttgccgatctgactgtaaagcccaaagagaagagcaagaagaaggtcgaggcaaagagcatcttcgatgacgatatggatgatatcttctctaccggcatccaggccaagacaacaaaacctaagtctcgatctgcacaggcagcccctgagccaagattcgagcacaaggtttccaatatcttcgacgaccccttgaacgcctttggtggccagtag

SEQ ID NO: 116572 - DNA, 399 bp, Artificial Sequence
  Description of Artificial Sequence: Synthetic coding sequence
atggaggatcagaatatcatccaggcgcctcagaaggaggtcggaaaagggtgcgatcccgacgcacaccctaagtcaacaggagtcttccaggacgaggagctgctttttagccacaagttacaaaaggataatgatcctgatgtagacttgttcgctggaactaagaagaccaaactcctggagccaagtgttggcagtctattcggtgacgatgaggacgacgacctcttcagcagtgctaaaagtcaaccactcgtgcaagaaaaaaaacgggtggtcaaaaaagaccactctgtgaattctttcaagaaccaaaaacaccccgagtcaatccagggctcgaaggaaaagggcatctggaagcctgagacccctcaggtgaggaatccgctctag

SEQ ID NO: 116573 - DNA, 3963 bp, Artificial Sequence
  Description of Artificial Sequence: Synthetic coding sequence
atgatgaatagaaccaccccagaccaggaactggtgcctgcaagtgaaccggtatgggagcggccgtggtctgtggaagagataagaagaagtagccagagttggtcacttgccgctgacgcaggtctccttcagttccttcaagagttttcacagcagaccatatctaggactcacgagatcaagaaacaggtggatgggttaattcgggagacaaaggccaccgattgtcgactccataatgtcttcaatgattttctgatgctatccaacacacagttcatcgaaaacagagtgtacgacgaagaagttgaagaaccagtgttgaaagcggaagcagagaagaccgagcaggagaaaacaagagaacagaaggaagttgatcttatccccaaagttcaggaggcggtgaactacggcctgcaggtgctcgattccgcctttgagcagctcgacatcaaagcaggtaacagcgactccgaggaggacgacgctaatggaagagtggagctgatactggagcctaaagacctgtacattgatcggcctctcccatatcttattggctccaagctgttcatggagcaggaggatgtagggttaggcgagttgagttctgaggagggatccgttggttcagatcgcggctcgattgtcgacactgaggaagagaaggaggaagaagaatctgatgaggacttcgcccatcatagtgacaacgaacagaaccagcatactacccagatgagcgatgaggaagaagatgacgacggatgcgacctgttcgctgattcagagaaggaggaggaagacattgaggatattgaggagaatacacgtcccaagcgtagtcgtccaaccagctttgctgatgaattagccgcacggatcaagggagacgccatgggccgagtggacgaagaaccaacaacactgcctagcggcgaagccaagccgaggaagacccttaaagagaagaaagaaagacggaccccttcagacgacgaggaagataacctattcgcaccgcctaagctcaccgatgaggactttagtccctttggatccggcgggggcctatttagtgggggaaaggggctgttcgatgatgaggacgaagagtctgacctgtttaccgaggcctctcaggacagacaggctggcgcgtcagtgaaagaagagtcctcttcatcgaagcccggcaagaaaatccccgcaggggcggtttctgtgttcctcggggatactgacgtatttggggctgcctccgtaccttctctcaaagaaccacagaagcctgagcagccaacacccagaaagtccccctacggtccaccccccacagggctcttcgacgacgacgatggagatgacgacgacgacttcttttccgcccctcactctaaaccttccaaaacccgcaaagtgcagtcgactgccgatattttcggagacgaagagggcgacctattcaaagagaaagctgtagcatctcccgaggccacggttagtcagacagacgaaaacaaggccagggcagagaagaaagtgactctgtcttactctaagaatttaaaaccttcttcagagaccaaaactcagaaaggactgttttcagatgaagaggattcagaagacctgttttcgtctcagtcggccagtaacttgaagggggcttctctcttaccagggaagctgcctacgagcgtttcactgttcgacgacgaagacgaagaggataatttgttcggtggcaccgcagccaagaagcagactttatcattgcaggctcagagagaggaaaaagctaaagcttcagaactgagcaagaagaaggcctccgccctactcttcagcagcgatgaggaggaccaatggaacatcccagcttcccagacacatctggccagtgactccaggagcaaaggagagcctagggattcaggcactttgcagtcccaggaagcaaaagccgtgaagaaaacatctctgtttgaagaggacaaagaggatgatttattcgcaatcgctaaggacagccagaagaaaactcaacgggttagtctcctgttcgaggatgacgtcgacagtggcggcagtctgtttgggagcccgcccacatcagtccccccagccaccaagaagaaagagaccgtttctgaggcgccacccctcctgtttagcgacgaggaagaaaaagaggcccagcttggagtgaaatcagtcgataaaaaggtcgagtctgccaaggagagtctaaagtttggacgaactgatgtcgctgaaagcgagaaggagggtttactcactaggtcggcccaggagacagtgaaacatagtgatctgttcagcagcagttccccatgggacaaggggacgaagcctcgtaccaagaccgtgctatccctgtttgatgaagaggaggataagatggaagaccaaaacatcattcaggcaccgcagaaggaggtcgggaaggggtgcgaccccgacgctcaccccaaatccacaggagtcttccaggacgaagagttattgttttctcataaactgcagaaggataatgatcctgacgttgatctgtttgccggaactaagaagacgaagcttctggaaccgtcagtcgggtctttgttcggtgatgacgaagacgatgacttattttcaagcgcaaaaagccagcctctagtgcaggaaaaaaaacgcgttgttaagaaggaccacagcgtaaactccttcaaaaaccagaagcacccagaaagcatacagggtagcaaggaaaaaggaatttggaagcctgagactccgcaggcgaacctggccatcaatcctgctgctttactcccaactgcagctagtcagatttcagaggtgaagccagtgttgcctgaactcgcttttccttcctccgaacaccgtagatcgcacggcttggagagcgtcccagtgctgccaggcagcggcgaggccggggtgtcatttgatctcccagcccaggcagacacattacactctgcaaataagtcccgggtgaagatgagagggaagagacgaccacagacccgcgctgcacgccgtctcgccgcccaggaaagctcagaagccgaggacatgagcgtgccaagaggcccaatcgcccagtgggctgatggggcaatatcaccaaacggccataggccccagttgcgcgccgctagtggcgaggactctacagaggaggccctcgcagccgctgctgctccttgggaaggggggccagtccctggggttgatacatctcctttcgccaagtcccttggccattctagaggcgaggctgacctgttcgattcaggagacattttcagcacaggcactggctcccagtccgtcgaaagaaccaaacctaaggctaagatagctgagaatcctgcaaaccctcccgtcggcgggaaagcaaagtcgcccatgttccctgcactgggagaggcttcatctgacgatgacttgtttcagtcggctaaacccaaacctgcgaagaaaactaacccattccctctgcttgaggacgaagatgatctgttcacagatcagaaagtgaagaaaaatgagaccaaatcttctagtcaacaggatgttattctgactacccaggacatcttcgaggacgatattttcgcaacagaagctattaaaccttctcagaagacacgagaaaaagaaaagacactcgagtccaacctctttgatgacaatatcgatatattcgcagacctgactgtgaagccgaaagagaaatcaaaaaagaaagtggaggctaaatctatcttcgacgatgacatggatgatattttctccaccggcattcaggcaaaaactacgaagccaaaatcccgcagcgcccaggccgcaccagaacctcgcttcgagcacaaggtctcgaacatattcgatgatccccttaacgctttcggcggacagtag

SEQ ID NO: 116574 - DNA, 4026 bp, Artificial Sequence
  Description of Artificial Sequence: Synthetic coding sequence
atgatgaatcgaaccacacccgaccaggagctggtgccagcgtctgagccagtgtgggaacgaccttggtcagttgaggagatccgcagatcgtctcagtcttggtcactcgcggccgacgctgggttgttacagttcctgcaggaattctcacaacagacaatctcccgtactcacgaaatcaaaaagcaggtggacggtctcatccgggagacaaaggcgactgattgcagactccataatgtgtttaatgattttctgatgctaagtaacactcaatttatagagaacagggtgtatgacgaggaagtggaggagcctgttctaaaggcagaggcagaaaaaacagagcaggaaaagacccgcgagcagaaggaagttgatctgatacctaaggtgcaggaggcagtgaactacggcctgcaggtgcttgattccgctttcgagcagcttgatataaaggccggaaatagtgattctgaagaggacgatgccaacggccgggtcgaactgattctcgagcccaaggacctgtatattgatagacccctaccctatctcattggctcaaagctctttatggaacaagaagacgtggggttaggcgagctgtcatctgaggaggggagtgtagggtctgaccgggggtctatagtggacacggaagaggaaaaggaggaagaagagtcagatgaggactttgctcaccactccgataatgagcaaaaccaacatacaacccagatgtccgatgaagaggaagacgacgatggctgcgatttgtttgcagacagtgaaaaggaggaagaggacatcgaggacattgaagaaaatacacggccaaagcggagccgtcctactagttttgccgacgaacttgcagccaggattaagggcgacgccatgggtcgggttgacgaagaacccacaaccctgcccagcggggaagctaagcccaggaagaccctcaaagagaaaaaagaacgtaggactcccagcgatgatgaagaagataacctattcgccccaccgaagctcacagacgaggattttagtcctttcggatctggcggtggcttgttctctggcgggaagggcctctttgacgatgaggatgaagagagcgatctcttcactgaggcaagtcaggatcggcaggcaggcgcttctgtcaaagaagagagctctagttcaaagcccggcaaaaaaattcccgccggggctgtctctgtgttcttaggggacacagatgtgtttggcgccgcgtcagtaccatccttgaaagagcctcagaaaccagagcagcccacaccccgtaaaagcccttatggaccaccccccactggactcttcgacgatgatgacggggacgacgatgatgactttttctctgccccccactcaaagcctagtaaaacaggaaaggttcagagcaccgcagatatcttcggtgatgaagagggtgatctttttaaagagaaggccgtggctagtccagaggctacggttagccaaacggacgaaaacaaagccagagcggaaaagaaggtcactctcagttacagcaaaaatctgaagccaagcagcgagaccaagacccaaaagggactcttttcagatgaagaggactccgaggacctgttctcgtcacagtccgccagcaatctcaagggcgcctccctactgcccggcaagcttcccacatccgtgagcctgtttgatgatgaagatgaagaagataacctgttcggagggacagcagcaaaaaaacaaacattgagtttgcaagcccagcgagaggaaaaagctaaggcttctgagctgagcaaaaagaaggcctccgctctgctcttcagttcagacgaggaagaccagtggaacattcctgcctcccaaacacatctggcctctgactcgaggtcaaagggtgagccccgtgactccgggacgttgcaatcacaggaggcaaaggccgtgaagaaaaccagcctgttcgaagaggacaaggaggatgacctgtttgccatcgctaaggacagccagaagaagacacaacgagtgagcctgctgtttgaggatgatgttgattcaggtgggagcctgttcggatcccctccaacctccgtcccacctgccaccaaaaaaaaagaaactgtcagcgaagcccctcccttactgttctctgacgaagaggagaaagaggcccagctgggcgtaaaatcagtggacaagaaagtggaaagcgctaaagaaagtctgaagttcggcaggactgacgtcgctgaatctgaaaaggaaggactgttgacgcgtagtgcccaagaaacggtgaaacacagcgatctgttctcctcttcctctccctgggataaaggcacaaagccaaggacaaaaacggtactcagcttattcgatgaagaggaggacaagatggaggatcagaatatcatacaggcccctcagaaagaagtcggcaagggatgcgatccggatgcccacccgaagagcactggagtgtttcaggacgaggagctgctctttagccacaagttgcagaaagataatgacccagacgtggatctgttcgcaggaacgaagaaaacaaagctcttggaaccctccgtgggatcactcttcggggacgacgaggatgatgacctatttagcagtgcaaaatcacagccactggtgcaggagaagaaaagagttgtgaaaaaggatcactctgtcaactcctttaaaaaccagaaacaccctgagtctattcagggctccaaagagaaaggcatttggaagcctgagaccccacaggattccagtggactggccccatttaagaccaaagaaccctctacacgtattggtaagatccaggctaacctcgccatcaacccagctgcactactgccaacagcagcgtcacaaatctccgaggttaagccagtgttgcccgagctggccttcccttcttccgaacatagacgttctcacggcctcgaatccgtgcctgtactccctggttctggcgaggccggagtatcatttgacctgcctgcccaagctgacactcttcatagcgctaacaaaagccgggttaaaatgcgcggaaaaagacggcctcaaacccgtgccgctagaagactggctgcccaggagagcagtgaagctgaagacatgtccgtgccccgcggcccgatagctcagtgggccgacggcgcaatcagtcctaacggccatagaccacagttgcgagccgcctccggtgaggatagcacagaagaagctcttgctgctgccgcagcgccttgggaaggcggccccgtgccaggggttgatacatctcccttcgcaaagtcacttggccactcaaggggcgaggcagacctgtttgactcaggcgatattttctccacagggacagggtctcagtcagttgaacgtacaaagccaaaggccaagattgccgagaacccagctaaccctcctgtgggtggaaaggcaaagtctcccatgtttcccgccttaggcgaggcgtcgtctgacgatgatctgttccaatcagctaaacctaagccagctaaaaagactaacccatttcccctgctggaagatgaggatgatttgttcacggatcagaaggtcaagaagaacgagaccaagtcttcaagtcaacaggatgtgatcctcacaacccaggatatttttgaagacgatatctttgcaactgaagccattaagcccagtcagaagacaagagaaaaagagaaaacgttggagtcaaacctgttcgatgacaatatcgacatctttgcagatttaacagtgaagcccaaagagaagtccaaaaaaaaagtggaggcaaagtccatctttgacgatgatatggacgatatttttagcacaggaatccaggctaagacaactaagccgaagagccggtctgcgcaagctgcaccagagccccgcttcgaacacaaagtgtctaatattttcgatgatcccctgaacgctttcggagggcagtag

SEQ ID NO: 116575 - DNA, 840 bp, Artificial Sequence
  Description of Artificial Sequence: Synthetic coding sequence
atgatgaataggacaacccccgaccaggagctggtgccagcctctgaacccgtgtgggaacgaccctggagcgtcgaagaaatacggagaagtagccagtcctggagccttgccgccgatgctggtcgggtatacgatgaggaagtggaggaacccgtgctgaaagcagaggccgagaagacagagcaggagaagacacgggaacagaaagaagtcgatctgatccccaaggtgcaagaagccgtgaattatggacttcaggtgcttgactccgccttcgagcagctcgacatcaaagcaggtaattctgattcggaagaagatgacgcaaacggccgcgtcgagttgattctggagcctaaggatctttatatcgaccggccacttccctacctaattgggagcaagctctttatggaacaggaggacgttggcttaggtgagctgagtagcgaagaggggtctgtcggttccgaccggggaagtatagtggatactgaggaggagaaagaggaggaggaatcagatgaggacttcgcgcatcacagtgacaacgagcagaaccaacacacaacacaaatgtccgacgaggaggaagatgatgatggctgcgacctgttcgccgatagtgagaaagaggaggaggacatcgaggacatcgaagagaacacaagacccaagcggagtaggcccacctcctttgcagatgagctggccgctcggattaagggcgacgcaatggggcgagtcgatgaagaaccaactacattgccttccggggaggcaaagcctcggaagacgctgaaggagaaaaaggagcgacgaactccctcagactag

SEQ ID NO: 116576 - DNA, 3762 bp, Artificial Sequence
  Description of Artificial Sequence: Synthetic coding sequence
atgccgcgcctgagcgggaagtccgtgcgggtctatgacgaggaagttgaggagcccgtcctaaaagctgaggcagagaagaccgagcaagagaagacgcgagaacagaaagaagtagatctcataccaaaggttcaggaagcggtaaattacggacttcaggtgcttgattctgccttcgaacagcttgacatcaaggccggcaactcagactctgaagaggacgacgcaaacggtcgcgtcgagctgatactggaacctaaagatctgtatatcgatcgccctttaccttacctaattgggagtaagctgtttatggaacaagaggacgtaggcttaggtgaactctcatcagaagagggtagtgtgggcagtgaccggggatctattgtggatacggaggaggagaaggaggaggaagagagtgacgaagacttcgcgcatcacagtgataacgagcaaaaccagcacactacacagatgtcagatgaggaggaggatgatgatggatgcgacctcttcgcggacagtgaaaaggaggaagaagacatcgaagacatcgaagagaatactcgcccgaaaagaagcaggccaactagctttgctgatgaattagctgcccggatcaaaggcgacgccatgggaagagttgacgaagagcccaccactctgccttccggggaagccaagcctcggaagaccctaaaagagaagaaagagagacggaccccaagcgacgacgaagaggacaacctctttgcacctcctaagttgactgacgaagattttagtccattcggtagcggaggagggctcttctccgggggcaagggtctgtttgatgatgaagatgaagagagcgacttatttaccgaggcaagccaagataggcaggcaggagcgtctgtcaaagaggaatcgtctagtagcaaaccaggcaaaaagatccctgccggtgcagtatctgtttttctgggtgacacagacgtgtttggggcagcctctgtgccgagcctcaaggagcctcagaaaccagagcagcctacacccagaaaaagcccttatgggcctccaccaacagggctattcgacgatgacgatggggatgacgacgacgatttctttagcgcacctcactcaaagccctctaagacaggcaaagtgcagagcacagccgacatatttggagatgaggaaggagaccttttcaaggaaaaggccgtggcgtcccccgaggccacggtctcccagacagatgagaataaggcacgcgctgagaagaaggtcacactttcctacagcaagaacctaaagccgtcatccgagacgaaaacacagaaggggctgttctctgacgaggaagattctgaagacctcttttccagtcagagcgcgagcaatctgaagggtgcatcactgctgcctggcaaactgccaaccagtgtgagcctatttgatgacgaggatgaggaagataatttgttcggcggtacggcggcaaagaaacaaactttaagccttcaggcccagagagaggagaaggctaaggcaagcgaactgtccaagaagaaagcttctgccctactgtttagctcagacgaagaggatcaatggaatattccagcatcacagactcatctggcatccgattccaggtcaaagggcgagccacgagactctggaacactgcagagtcaggaggcaaaggcggtcaagaagacatcactgttcgaggaagataaagaagacgatctgtttgctatcgccaaggattctcaaaaaaaaacacagagggtgtcgttactgttcgaggatgacgttgactccggtggatccctctttggatcgccaccaacgtccgtgcctcctgccaccaagaaaaaggaaacagtgtctgaagcaccccccctgctgttttccgatgaagaagaaaaggaagctcagctgggagtcaagtcggtggataagaaggttgagtccgccaaagaatctctcaagtttgggagaacagatgtggcagagtccgagaaagaaggccttcttactaggtcagctcaggaaacagtgaagcactctgacctgtttagtagtagtagcccatgggataaaggtaccaaacctagaacaaaaaccgttctctctctcttcgacgaggaggaagacaaaatggaagatcaaaatataatccaggcaccgcagaaggaggtaggcaagggatgcgatccagacgcacacccaaagtctacaggggtgttccaggacgaggagttactgttctcacacaaacttcagaaagataatgaccctgacgttgacctcttcgccggcaccaaaaaaacaaagctcctcgaaccctctgtcgggagcctgttcggggatgatgaggacgacgacctgtttagtagcgccaaaagtcagcctctcgttcaggagaagaagagagtggttaaaaaggaccactccgtgaattcttttaagaatcaaaagcatccagaatctatccaaggctctaaggaaaagggcatctggaagcccgagactccccaggattcctccggcctggctcctttcaaaacaaaagagccctcaacacgtattgggaagattcaggctaacctggccataaacccggctgctctgctaccaactgctgcctcacagatcagcgaggttaagccagtgctcccagagctcgccttcccatcttcagagcacaggagaagtcacggcctggagtcggttcctgtccttcctgggtccggcgaggccggagtgagctttgatctgcccgctcaggctgacactctccactctgccaacaaaagtagagtgaagatgcgagggaagaggaggccacagacacgtgccgcacgaaggttggccgcacaggaatctagcgaggccgaggacatgtcggtccctcgcgggccgatagcccagtgggccgatggagccatttcgcccaacggtcataggccacagctgcgcgcagcatccggcgaggacagcaccgaggaagcgttggccgctgccgcagccccctgggagggcggaccggtgcccggggtggatacttccccattcgcaaagagtctggggcacagcagaggtgaagctgatctgtttgatagcggggatattttcagtacggggactggtagccagagtgtggagcgcactaagccaaaagccaagattgctgaaaacccagcaaatccccctgtcggaggcaaggcaaaatcaccgatgtttcctgcgctgggcgaagcctcatcagacgatgacctctttcagtcagcgaagccgaagcctgcaaaaaaaactaatccctttccactccttgaggatgaggacgatcttttcacagaccaaaaggtcaaaaaaaatgagaccaagagctcaagtcaacaagatgtgatactgaccacacaggacatctttgaggatgacatttttgccactgaagctattaaaccaagccagaagacgcgcgagaaagaaaagacactcgagtctaaccttttcgatgataacatagatatcttcgctgatctgaccgtgaagcccaaggagaaatccaaaaaaaaggttgaggctaagagtatattcgacgacgatatggatgacatattttccacaggcatccaggctaaaaccacaaaacccaagtctcgttccgctcaagctgcccccgaacccagattcgaacataaagtcagcaacatattcgatgaccctcttaatgctttcggaggacagtag

SEQ ID NO: 116577 - DNA, 3738 bp, Artificial Sequence
  Description of Artificial Sequence: Synthetic coding sequence
atgatgaaccggacaacgcccgaccaggaattggttccagctagcgagccagtctgggaacgaccatggagtgtggaggagatacgccgatcctcccagagttggtctcttgccgccgatgccggcctgctgcagtttctgcaagaattcagccaacagacgatttctcgtacgcacgagatcaaaaaacaagtggacggattgatccgagagaccaaggccaccgattgtcgtctgcacaatgtgttcaatgactttcttatgctgagcaacacccaatttatcgagaacagggtttacgatgaggaggttgaggagcctgtcttgaaagcagaagctgagaagacagaacaggagaagacccgggaacagaaggaagtggatctgatcccaaaagtgcaggaagctgtgaattatggtctccaggtcctggatagtgccttcgaacagctggatataaaggccggaaactcagatagtgaagaggacgatgctaatggccgggtggagttgatcttggagccaaaagacctgtatatcgatcgccccttaccttacttgatcggcagtaaactcttcatggagcaagaagacgtcggactcggagaactaagcagtgaggaggggtccgtcggctccgatagaggcagcattgtcgacaccgaagaagaaaaggaggaggaggaatctgatgaggactttgcccatcatagcgacaacgagcaaaatcagcataccacacagatgtctgatgaggaggaggacgacgatgggtgcgacctctttgctgatagcgaaaaggaagaggaagacatcgaggacattgaagaaaacaccaggccgaagcggtcgcgcccgacatcgttcgcagatgagctggcagctcgcattaaaggtgacgccatggggcgcgtggacgaggagcccaccaacgaagaggataacctgttcgctccccccaaattaactgacgaagatttctcaccattcggatctggcggcggtctcttcagtggcggtaaaggactatttgacgatgaagacgaggagagcgacctgttcaccgaagcaagccaggaccgacaggcgggcgcttccgtgaaggaggagagctccagctctaagccgggaaagaaaatccctgccggagccgtttctgttttcctgggcgatacggacgtgttcggagcagcctccgtgccctccctgaaggagcctcagaaacctgaacagcccactccccggaaatccccatacggccccccacctacgggattattcgacgacgatgatggcgacgacgacgatgacttcttcagcgccccccactccaagccgtccaaaacccgaaaggtgcagtctacggcggatatctttggcgacgaagaaggcgacctcttcaaggaaaaggcggttgcctccccggaggccactgtctcacagaccgacgagaataaggccagggctgaaaagaaagtgaccctgtcttattccaaaaatctgaagccatcctcagagacgaaaactcagaaaggactcttcagtgacgaggaggatagcgaggacttgttctccagccaatccgccagcaacctgaagggggcttccctgcttcccggcaaactgccaactagcgttagccttttcgacgatgaagatgaggaagataacttattcggcgggactgctgccaagaaacaaacgctgagcctccaggctcagagggaagagaaagcgaaggctagtgagctttccaaaaagaaagcatcagcccttttgttctcgtctgacgaagaagatcagtggaatattcctgcttctcagactcatctcgcctctgactcccgctctaaaggggaaccgcgcgatagcggaaccctccaaagccaagaggccaaggcggtcaagaaaacttcgttgttcgaggaggacaaagaggatgatctgtttgcaatcgccaaagactcccagaagaagacacaaagggtgagcttgctttttgaggacgatgtggacagcggtgggagtttatttggcagtccacccacttcagtgccgcccgctaccaaggaggggctgcttaccagaagtgcccaagaaactgtgaagcactctgacctgtttagctcttcgtcaccctgggacaaaggcaccaagccccggacaaagactgtcctctctcttttcgacgaagaagaggataaaatggaggatcagaacattatccaagcaccccaaaaggaggtcggaaaggggtgtgatccagatgctcatccgaaaagtactggggtcttccaggacgaagagctgctgtttagtcacaagctccagaaggacaatgatcccgacgtagacctctttgccgggacgaagaaaacgaaattgctcgagccctcagtcggcagcttgtttggggatgacgaagatgacgatctgttcagctctgccaaaagccagccccttgtgcaggagaagaagcgcgtcgtgaaaaaggaccactctgtcaactctttcaagaatcagaagcatcccgaaagtatccagggtagcaaggaaaaagggatttggaagcctgaaacacctcaggctaacttggccatcaatcctgctgccctgctgccgaccgctgcctcgcagatatctgaggtgaagcccgttcttcccgaactggccttcccaagttctgagcaccgccggagccacggactagagtccgtacccgtgctgcctgggtccggggaggccggggtttctttcgacctccccgcccaggccgacactctgcatagtgcaaacaagtcgcgagtgaaaatgagaggtaagcgccggcctcaaactcgagccgctcgcaggctggccgctcaggagagctccgaggcggaagatatgtctgtgccccgcggacctatcgcccagtgggccgacggggccatttcccccaatggtcaccgaccccagctcagagcagcctccggagaggatagcactgaggaggctttggcagcagcggccgcgccctgggaagggggacctgtgcccggtgtggacacatccccgttcgcgaaatcgttaggccatagccggggcgaagccgacctttttgatagcggagacattttctccaccggaacggggagtcagagtgtcgaaaggacgaaacctaaggccaagattgccgagaatcccgccaacccccccgttggagggaaggccaaaagccctatgttccctgctttaggcgaggctagtagcgacgatgacctctttcagtcggccaagccaaagcccgccaaaaagacgaatcccttccctctgttagaagatgaggatgatctcttcactgaccagaaagtgaaaaaaaatgagactaagagcagttctcagcaagatgtgatcctgactacccaggatatattcgaagacgatatatttgctaccgaggccatcaaaccttctcagaagactcgcgaaaaagagaagactctggagagcaatttgtttgatgacaatatcgatatcttcgccgacctcactgtgaagcccaaggaaaaaagcaagaaaaaggttgaagctaaaagtatcttcgacgatgatatggacgacatcttcagtaccggcatccaagccaagacgactaagcccaagagtcgttccgcccaggccgcgcccgagcctagatttgaacacaaggtttcaaacatctttgatgatccgctgaacgcctttggcggacagtag

SEQ ID NO: 116578 - DNA, 3840 bp, Artificial Sequence
  Description of Artificial Sequence: Synthetic coding sequence
atgatgaacagaacaactcctgaccaggagctcgtgcctgcgtctgagcccgtttgggaaaggccttggtccgttgaagagatccggaggagttctcagagttggagtcttgcagccgacgccgggctgttacagtttctgcaggaatttagccagcagacaatcagtaggactcacgaaattaagaaacaggtggacggtctgatccgtgaaaccaaggccacagactgcaggctgcacaacgttttcaacgactttcttatgttaagcaatacgcagtttattgaaaaccgcgtatatgatgaagaggtggaggagccagttctgaaagctgaagcggagaaaaccgagcaggaaaagacaagggaacaaaaggaagttgacttgataccaaaggtccaggaggccgtgaactacggcttgcaggtactcgacagcgcttttgaacagctggacattaaggctggtaactcggactctgaggaagacgacgcgaacggcagggtggaactaattttggaacccaaagatctctatatagatcgccctctaccttatttaatcggcagcaaattgtttatggagcaggaagatgtcgggttgggagaattgtcctcagaggaaggttcagtgggaagcgacagaggtagtattgtggataccgaagaggaaaaggaagaggaggagagcgatgaggatttcgcacatcatagtgacaacgagcaaaatcagcatactacccagatgtccgacgaggaggaagacgacgacggttgtgacctgtttgctgattccgagaaggaagaggaggacattgaagacattgaagagaacacaaggccaaagagatctcgtcctacaagtttcgccgacgagcttgccgctagaatcaagggggatgcaatgggccgggttgacgaggagcccacaacactgccctccggcgaggcgaaaccgcggaaaaccttgaaagaaaaaaaagagcgccggacaccttccgatgatgaggaagataatctattcgccccacctaagctgactgatgaagatttcagccccttcggatcaggaggaggattattcagtggcggaaaaggcctgtttgacgacgaggacgaggagtcagacctcttcacagaagcatcacaggaccgccaggccggtgctagtgtgaaagaggaaagttcgtcctctaaacccggaaaaaagatccctgcgggcgcagtgtctgtgtttttgggggacacagacgtgttcggagccgcctctgtgccgtccttaaaggagcctcagaagcccgaacagccgactccccggaagtccccatatggtcccccaccaactggcctcttcgacgacgatgatggtgacgacgacgacgactttttttcagctcctcattcaaaacccagcaagactaggaaggtgcagagtaccgcagatatcttcggagatgaggagggagacctcttcaaggagaaggctgtagctagccccgaagccacagtaagtcagacagacgagaataaggcacgcgctgaaaagaaggtgaccctgagttactccaaaaacctaaagccatcctccgagacaaagacacagaagggcttgttctcagacgaagaggattcagaggacctattcagttctcagagtgcctctaatctcaagggagcatctctgttacccgggaagctgcccacctcggtgagcctctttgatgacgaggacgaggaagataatttgttcggaggtactgctgctaagaagcaaacattgtcactgcaggcccagcgtgaagaaaaggccaaggccagcgagttgtctaaaaaaaaggcgtctgcacttctcttcagttctgatgaggaggaccagtggaacattcctgcctctcagacacacctggccagcgatagcaggtctaaaggggagcccagggattccggtacactacaatcacaggaggccaaagccgtgaagaaaacaagcctgttcgaagaggacaaagaggatgacttgtttgctattgccaaggattctcagaagaagacccaacgggtgtcactcctctttgaggacgatgtcgacagcggaggttctctgttcgggagcccccccacatcggtgccacctgccacaaaaaaaaaagaaaccgtttctgaagctcctcctctgctgttctccgatgaggaggagaaggaggcccagctcggggtgaagtctgtcgacaagaaagttgagtctgctaaggagagtctgaaatttggacgaacggacgtggcggagagtgaaaaagagggtctgctgacgaggagcgcgcaggaaactgtgaagcacagcgacctattttcttccagctctccttgggataaggggaccaagcctagaaccaagacggtattaagcctgttcgacgaggaggaagacaagatggaggatcaaaatattattcaagcacctcagaaagaggtcggcaaaggatgcgatccagacgctcatccaaaaagcaccggagtcttccaagatgaagagctacttttttcgcacaagttacagaaggacaacgatcccgatgtggacctgtttgccggtactaagaagaccaagctcctggagccatcggtcggtagccttttcggcgacgacgaagatgacgatctgttctcgtccgctaaatcccagcctctggctaaccttgcaatcaaccctgctgccctcctgccaacagctgctagccagataagcgaggtcaaacccgtactgcctgagcttgcttttccgtctagtgagcaccgccgtagtcatgggctggaaagtgttccggtcctgcctggatccggcgaggccggggtgagtttcgaccttccagcccaggctgacacactccatagcgcaaataagtcccgcgttaagatgcgcggaaaaaggcgtccacagacccgcgccgcacggaggttggcagctcaggaatcctcggaagctgaagatatgtccgtccccagggggcccattgcacagtgggctgacggggcaatcagcccgaacggccataggccccagctgcgggccgcatccggcgaggacagcactgaggaagcactggcagctgcagcggccccgtgggaaggcggccccgtgcccggagtggatacatccccattcgcaaagagcttgggccacagccggggcgaagctgacttgttcgactctggggacatcttctcaactggcacggggagccagagcgtggagaggacgaagcctaaggctaaaatcgctgaaaacccagccaatcccccagtcggaggaaaggccaagagcccaatgtttcccgctctgggcgaggcctcaagcgatgacgacttgttccagtctgctaaaccaaaaccggctaagaaaaccaacccgtttcccttacttgaggatgaggacgatttattcaccgatcagaaggtcaagaaaaacgagacaaagagctccagccagcaggacgtgatcctgactactcaagacatatttgaggacgacatctttgcaacagaagccatcaaaccgtctcagaagacccgggagaaggagaaaactctcgaatccaatctgtttgatgacaacatcgatatttttgctgacctgacggtgaagcctaaagagaagagtaagaaaaaagtggaagcaaaatcaatttttgatgacgacatggatgacattttcagcacaggaatccaagccaagacgaccaaacctaagtccaggtctgcccaggctgctcccgagcctaggttcgagcacaaggtgtctaatatattcgacgaccccctgaacgcgtttggaggacagtag

SEQ ID NO: 116579 - DNA, 1329 bp, Artificial Sequence
  Description of Artificial Sequence: Synthetic coding sequence
atggccgagggggaagggtattttgccatgtccgaggacgagctagcttgttcaccttacatcccactgggaggagactttggtggtggcgattttggaggcggcgatttcgggggcggggacttcgggggcggcggtagttttgggggacactgcttggactactgcgaaagccccactgcccattgtaacgtccttaattgggaacaagtgcaacgcctagacgggatcctgtccgaaactattcccatccacggtcgcggtaacttccccaccctggagctgcagccaagcttgattgtgaaagtggtgcggcggagactggccgaaaagcgtattggagtgcgggacgtgaggctgaatggctctgctgcctcacatgtgcttcaccaagactccgggttgggatacaaagatctggatctgatattttgtgctgatcttagaggagaaggagagtttcaaaccgtaaaagatgtggttctcgattgtctgctggattttctgcccgagggggtgaacaaggaaaagattacccctctcactcttaaagaggcctacgtccagaaaatggttaaggtgtgtaatgattccgatcggtggagcctgattagcctatcaaacaattcagggaagaatgtggagctcaagttcgtcgatagcctgaggcgtcagttcgagtttagtgtggacagctttcagattaaactggactcacttctgctgttttatgaatgctctgaaaaccccatgacggagacctttcatcctaccataattggagagtccgtatatggggattttcaggaggcatttgaccacctctgcaacaagattattgccacccgtaacccggaggaaattagaggcggtggtctgctcaaatactgcaacttactggtgcggggcttcagacctgccagtgacgaaattaagacactgcagaggtatatgtgcagccggttctttattgactttagcgatatcggtgagcagcagaggaaacttgaatcgtacctgcagaatcatttcgtaggcctcgaggatagaaaatacgaatatttaatgaccctgcacggtgtggtgaatgagagcaccgtctgcctgatgggacatgaacgccgtcagaccctgaacctcattacaatgctggctataagagtgttagctgaccagaacgttatcccaaatgtggctaacgtgacctgttactaccagcccgcaccttacgtggcggacgccaacttttctaattactatatcgctcaggttcagcccgtcttcacttgtcagcagcagacttattctacctggcttccatgtaattag

SEQ ID NO: 116580 - DNA, 1176 bp, Artificial Sequence
  Description of Artificial Sequence: Synthetic coding sequence
atggccgaggaatcatcatgcacacgcgactgtatgtccttttccgtgcttaactgggatcaggtgtcaaggctgcatgaggttctaactgaggtggtgccgatccatgggagagggaacttcccaactctggagataacccttaaagacatcgtgcaaaccgttaggagtagattggaagaggccggcataaaggttcacgatgtgcggctcaatgggtcagccgccggacatgtcctcgtgaaggataacggcctgggttgtaaagaccttgacctcatctttcatgttgccctgcccactgaggcagagttccaactggtgagagatgttgtgttgtgtagcctcctcaattttctgcccgagggtgtaaacaagctcaagatatcacctgtcaccctaaaggaggcctatgtgcaaaagctcgtcaaggtatgcacggatactgacagatggagtctgatctctctttccaacaaaaatggcaaaaacgtggaactgaaattcgtggattctatacgaaggcagtttgaattctcagtcgattccttccagatcatactggactccctgttatttttctacgactgctcaaataacccaatcagtgagcactttcatccaactgtgattggagagagtatgtacggcgatttcgaggaggctttcgaccacctgcagaaccgactgattgcaacaaaaaatcccgaggagatccgaggcggcggcctgctgaagtatagcaatttgctggtacgagatttcagacccaccgatcaagaggaaattaagaccttggagcgatatatgtgtagcagattcttcattgatttcccggacatcctggaacaacagcggaaactcgaaacatatctacaaaaccacttcgccgaagaagaacgatccaagtatgactacctgatgatcctgagaagggtggttaacgaaagtactgtttgtctgatgggtcatgagagacggcagactttaaatctcatttccctgttagctctgcgggtgctggccgagcaaaatatcataccgtccgcaaccaacgtaacatgctactatcagcctgctccttacgtaagtgatggcaatttcagcaattactatgtggcccacccccccgtgacatacagtcagccatatccaacatggttgccttgtaattag

SEQ ID NO: 116581 - DNA, 2340 bp, Artificial Sequence
  Description of Artificial Sequence: Synthetic coding sequence
atgcagcaagccctcgaactcgccctagatcgtgctgaatatgtcatcgaaagtgcaaggcaaagaccccccaaacgaaagtacttaagcagtggcagaaaatccgtgttccagaagctctatgacttatacatcgaggagtgcgagaaagagcctgaagtgaaaaagctgagacggaacgtcaaccttctggaaaaactcgtgatgcaggaaaccctgagctgtttggtggtaaacctgtacccgggcaacgaggggtactctctcatgttaagaggcaagaacggaagcgactctgagacaataagactcccctacgaggagggcgaactactagagtatcttgatgctgaggaactgccgccgatcctggttgatcttctcgagaaatcccaagtgaacatctttcactgtggctgtgtcatcgctgagataagagactatcgacagtcctccaatatgaagagccctggctaccagtcacggcatatcctccttcgacccactatgcagacactaatctgtgacgttcattcgatcactagcgataatcacaagtggacccaggaggataagctgctcctagagtcccaattaattctggcgacagctgaacccctgtgtctggaccctagtatcgccgtaacttgtaccgcgaatcgcttgctgtataacaaacaaaaaatgaacactcgccctatgaagcgctgcttcaaaaggtacagtcggtctagtctgaaccggcaacaggacctttcccactgtccaccaccaccccagctgcgtctcctggattttctccagaaaagaaaggaaaggaaagcagggcagcattacgatctgaaaatttccaaagccggcaattgtgtagatatgtggaagcgctctccttgtaaccttgccataccatctgaagtggatgtggagaaatacgccaaggtggaaaagagtatcaagtcggacgatagtcagccgaccgtgtggcctgcacacgacgtcaaggacgattacgtcttcgagtgtgaagcaggcacccagtaccagaaaactaagctcacgatcctccagtcactgggtgatcccctgtactacggaaagatccagccttgtaaggctgacgaggaaagtgactcccagatgtcgccatctcactccagcaccgatgaccacagcaactggtttattatcggctctaagactgacgcagaacgggtggtcaaccagtaccaggagctggttcagaatgaagctaagtgccccgttaaaatgtctcattccagttccggctccgcgagtctaagtcaggtgtcccctggcaaggagacagaccaaactgagaccgtgagtgtgcagtcttccgtgttgggtaaaggcgtcaagcacagacccccaccgatcaaactccccagttctagtggaaattccagcagcgggaactattttactcctcagcagacgagcagcttcctgaaatctccgactccccccccgagctctaagcccagcagtatcccacgcaaatcttcagtagatctgaatcaggtcagcatgttgtctcctgccgccctgagtcccgcatcgagctcccaacgtactactgctactcaggtgatggcgaactctgccgggctcaacttcatcaatgtggtaggttccgtatgcggggcacaggccctaatgtcaggcagtaatcctatgctgggatgtaacactggtgccataaccccagctggcatcaacttatctggcctgctcccctctggaggcctgctgcctaatgccttaccgagtgccatgcaagctgcctcccaagcaggggttccctttggactgaaaaacaccagctccctccggccattgaacctgttgcagctcccaggaggttctctgatatttaatacactgcagcagcagcagcagcagctgtcacagtttactcctcagcagccacagcagcccaccacctgttccccacaacagcccggcgagcaaggaagtgagcaagggagcacatctcaagagcaagccctgagcgcgcagcaagctgcggtaatcaatttgaccggcgtgggttcgtttatgcagtcacaggctgccgtgttgtcacagttgggcagcgccgaaaaccggcccgagcagtcacttccccagcaacgcttccagctctcctccgccttccagcagcagcaacagcagatccaacagttaaggttcctccaacaccagatggcgatggctgccgccgccgcccagaccgcccagctgcaccatcacaggcataccgggagccagagcaaaagtaagatgaaaagaggcacaccaactacgccgaaattttag

SEQ ID NO: 116582 - DNA, 2202 bp, Artificial Sequence
  Description of Artificial Sequence: Synthetic coding sequence
atgcagcaggctctggagctggcccttgatcgagcagaatacgtcatcgaaagcgcgcgccagcgcccaccaaagagaaagtaccttagtagcggccggaagagcgtgttccagaagctgtatgacctgtatatagaggagtgcgaaaaggagcccgaagtaaagcagaagttgcgcaggaacgtaaatctcctcgagaagctggtgatgcaagagacattgagttgcctcgttgtcaacctgtacccaggcaatgagggttatagcctcatgctgcgcggtaagaacgggtcagattccgagacaattaggcttccctacgaggagggcgagctgctcgaatatctggacgctgaagagcttccaccaattctcgtggatttgttggagaagagtcaggtaaatatttttcattgcgggtgtgtgattgcagagatacgcgattataggcagagctctaacatgaagagccccggataccaatccagacatattctgttgcgaccgactatgcagaccctgatttgcgacgtccacagcattacaagcgacaaccacaaatggactcaggaggataaactgctgctagagtcgcagctcattctggccaccgcggagccactgtgtctcgacccctcaatcgctgtcacatgtacggcgaataggctgctgtacaacaaacagaaaatgaacacgcgccccatgaaaagatgtttcaaacggtattcccggtccagcctgaaccggcaacaggacctttctcactgtcccccccctccccagttaagactgctagactttctgcagaaaagaaaggagaggaaagccggccagcattatgacctcaagatcagtaaggcaggtaattgcgtcgatatgtggaagagatctccttgcaatctcgcgatcccctcagaggtggacgtggaaaaatacgctaaagtggagaagtccatcaagtcggatgattcacagcccacggtgtggccagctcatgatgtaaaagacgactatgtctttgagtgtgaagccgggacgcagtaccagaaaacaaagctgaccattctgcagagcctgggcgaccccctgtattatgggaaaattcagccctgcaaagctgacgaagaaagcgatagccagatgagccctagtcatagtagtaccgacgaccacagcaattggtttatcattgggtctaagaccgatgcggaacgggtcgtgaaccaataccaggagttagtgcagaatgaagccaaatgccccgtgaagatgagccacagctctagcggctcagcctctctcagtcaagtttcccccgggaaagagaccgatcagacggagaccgtgtccgtgcagtcctctgtgcttgggaagggagtgaagcatcggccacctccaattaaattacctagctcatctggcaattcaagttcaggcaattattttactcctcagcagacaagcagcttcctcaagtctccaacgccccctccatcaagcaaacccagctccatcccccgcaagagctctgtcgatctgaaccaggtgagcatgcttagtccagccgccctgagcccagccagctcgagccagcgcactaccgctacccaggtgatggcaaactcagccgggctcaactttatcaacgttgtgggctccgtgtgcggagctcaagctttaatgtcgggaagcaatcccatgctgggctgcaacacaggcgctatcacacctgctggaatcaatcttagtggccttcttcctagtggtgggctcctcccaaatgccctgccttcggccatgcaggcagcctctcaggccggcgtgcctttcggactgaagaacacatcaagccttaggccgttgaacctccttcaattgcccggggggtcacttattttcaacactttgcagcagcaacaacagcagctatcacagtttaccccccaacagccacaacagccaacgacgtgctccccgcagcagcctggtgaacagggatccgagcagggaagtacgagccaagagcaggcactgtcggcacagcaggcagcggtgatcaacctaactggagttggaagtttcatgcagagtcaggctgctgcggtcgcgattctcgccgcttctaacggatacggcagttctagttcgaccaacagctctgctacatcatcttccgcctaccgtcagcctgtcaagaagtag

SEQ ID NO: 116583 - DNA, 2202 bp, Artificial Sequence
  Description of Artificial Sequence: Synthetic coding sequence
atgcagcaagcgctggaactggcacttgaccgtgcagaatatgtgattgaatctgcaaggcagagacctcctaagcgaaagtacctgagcagcgggagaaagtccgtgtttcagaagctttatgatttatacattgaggaatgcgagaaagagccagaagtgaaacagaagcttagacgaaacgtcaatctgctggaaaaactggtgatgcaagagacgctgtcctgcctcgtcgttaacctttaccctggcaacgagggttactcccttatgcttcggggaaaaaatggttcggatagcgaaactattcggcttccgtacgaggagggcgagttgttagaatacctagatgctgaagaactcccccccattctcgtcgacctcctagaaaaatcacaggtgaacattttccactgcggatgtgtcatcgccgagattcgggattaccggcagagctccaacatgaagtcccccgggtatcaatccaggcacatcctgctgagacccactatgcaaacactcatctgtgacgttcactctattacttccgataatcataaatggacccaggaagataaactgctgctagaaagtcagcttattctcgctactgcagagccattgtgtcttgatccgtcaatcgccgtgacctgtacagcgaaccgcctcctgtacaacaaacagaagatgaacacaagaccaatgaaaaggtgcttcaaaagatacagcaggagttcgcttaaccgccagcaggacctgagtcactgccctccaccgccccagctgcgactgcttgacttcttgcagaagagaaaggagcgtaaagctggacagcactacgatcttaagatctccaaggccggaaattgcgtagatatgtggaagaggagcccctgtaacttggccatcccaagcgaggtggacgtggagaaatatgcaaaggtggagaagtccataaagagcgacgatagccagccaacggtctggcccgcacatgatgtgaaggatgactatgtttttgaatgcgaggccggcacccaatatcaaaagacaaaactgaccattctgcaatcattaggcgaccctctttactatggtaagattcagccctgcaaagcagacgaagaaagcgattcccaaatgtctccgtcacactcttccaccgatgaccactccaactggttcataattggctcgaagacagatgccgagagagtcgtgaaccagtatcaggagctcgtgcagaacgaagccaaatgcccagtcaagatgagccacagttcaagcggcagcgcttccctgtcccaggtctcccccgggaaggagactgatcagactgaaacggtctctgtgcagtccagtgtactgggtaaaggagtgaagcaccgccctccaccaataaagctccctagtagcagtggcaacagtagttcgggcaactattttaccccgcagcagacatcttcattcctgaagagtcctactcccccaccttcttccaaaccatcgagtatcccgcgcaagtcaagtgttgatttgaatcaggtgtcgatgcttagcccagccgctctgtcacctgcaagcagcagccagcggactacagcaacacaagtgatggccaactcagcaggcctcaacttcattaatgtagtgggatccgtgtgtggcgcacaggctctcatgtctggctccaacccaatgctgggctgcaacaccggagccatcacgccggctgggattaatctatctggtttgctgccgtctgggggcttgctgcccaatgcactgcctagcgccatgcaggcggcgtcccaggccggggttccatttggcctaaaaaatacctcttctcttcgccctctcaaccttctgcagctccctggcgggtcgctgatcttcaatacactgcaacaacagcagcagcaactctctcaatttaccccccagcagccgcaacaacccactacatgctcaccccagcagcccggggaacagggtagtgagcaagggtcgaccagtcaggaacaggccctatccgctcagcaggctgctgtgatcaatcttactggtgtcggatcttttatgcaatcacaggcagcagctgtggccatattagcggcttcaaacggatacggcagcagtagttcaactaatagtagtgcgacatctagcagcgcctaccggcaacccgtaaagaaatag

SEQ ID NO: 116584 - DNA, 2202 bp, Artificial Sequence
  Description of Artificial Sequence: Synthetic coding sequence
atgcaacaggcccttgagctggccctggatcgggccgagtatgttatcgaatccgcaagacaaaggccgccgaaaaggaaatatctgagctcaggcagaaaaagcgtgttccagaagctgtacgatttatacatcgaggagtgcgaaaaagagcccgaagtgaagcaaaagctccgtagaaacgtgaatctcctggaaaagctggtcatgcaggaaacattgagttgcctcgtcgtgaacctgtaccccggcaacgaaggatacagcttaatgctgagaggtaaaaacggttccgactctgaaaccattcgcttgccttacgaggagggtgaattactggagtacttagatgctgaggagctgccccccatcctggtggatctcctcgaaaagagtcaggtgaatatttttcactgtgggtgcgtaattgctgagatacgagactaccgtcagtcgtccaacatgaaaagcccaggttatcagtcgagacacatattgctgcgccccacaatgcagacacttatctgtgatgtgcacagcatcacatctgataaccacaagtggacacaggaggacaaactcctgctcgagagtcagttaatcctcgctacagctgaaccactgtgcctggacccttccattgccgtgacatgcactgccaataggctcctttacaataagcaaaaaatgaatactagaccaatgaaacgctgtttcaagcgctactccaggtccagcctcaatagacaacaggacctgtcccactgtccaccaccaccccaactccgcctgctagacttcttacagaagcgaaaggagcgcaaggcaggccaacattatgacctgaagatctccaaagcgggcaactgtgttgatatgtggaaacgaagtccctgcaacctggctatcccatcggaggtggatgtagaaaagtacgccaaggtggagaaatcaatcaaatctgatgactcccagccaactgtgtggccagcccacgatgttaaagacgactacgtgttcgaatgcgaagcaggcacccagtatcagaaaacgaagcttaccatcctgcagagcctgggtgatccgctctattatggcaagatacagccctgcaaggcggacgaggaaagcgattctcaaatgagtcctagccatagttcgacagacgatcatagcaactggttcataatcggcagcaagaccgatgccgaacgcgtggtgaatcagtaccaggaactggtacaaaacgaagcgaagtgcccagtgaaaatgtctcatagtagctccgggtcagcaagcctctcccaggtctcaccaggtaaagagacagatcaaacagagacagtgagcgtccagagctctgtcctcgggaagggcgtcaagcacagacccccccccattaaattacccagttcatcgggcaactcaagttctggcaactacttcaccccccagcagaccagcagcttccttaagtcccctacgccgcccccatctagtaagccaagctccatccctaggaaatcaagcgttgaccttaatcaggtgagcatgctctctcccgctgcactgagcccagctagtagttcacagaggaccacagctacacaagtgatggccaatagtgctggcttgaacttcattaatgtcgtgggaagcgtttgcggcgcgcaggcactgatgagtggctcgaacccaatgttagggtgcaatacaggcgctataacacccgctggcatcaatttaagcggcctgcttccatccggcggattactccccaacgcactgccgtccgccatgcaggccgcctcccaggcgggagtaccgttcggactgaaaaatacatcttctctcaggcctttaaaccttcttcagctgcctgggggctcattaatcttcaacacactgcagcaacagcaacagcaactgagtcaattcactccacagcagcctcaacagccaaccacgtgcagcccccagcagcccggggaacagggatcagagcaggggagcaccagccaggagcaggcactgtctgctcagcaggccgcagtcattaacctcaccggcgtggggtcatttatgcaatcccaggccgccgctgtcgccatcttggctgcctccaatggatacggaagttcaagctcaacgaattcaagcgcaaccagctcctcagcatacagacaaccagtgaagaaatag

SEQ ID NO: 116585 - DNA, 2217 bp, Artificial Sequence
  Description of Artificial Sequence: Synthetic coding sequence
atgcaacaggcacttgagcttgccttagacagagctgagtatgttatcgagagtgcccggcagaggcctcctaagaggaagtacctgtcctccggtaggaaatctgtgttccaaaagctgtacgacctttatattgaagagtgtgaaaaagagcccgaggtgaagaagctgcgccggaatgtgaatttgctggagaagttggtcatgcaggagaccttgagctgtctggtggtgaacctctacccaggcaacgaaggatactcactcatgctgagagggaaaaacggaagtgacagtgaaacaatccggcttccctatgaagagggagagctgcttgaatatctggatgcagaagaacttccgccaatcctagtggatctgctggaaaaaagtcaggtgaatatttttcattgcggctgcgtgattgcagagatacgcgattaccgccagtcaagtaacatgaaatcccctggctaccagtcacgacatattctgctcagacccacaatgcagacgttgatctgcgatgtccactctatcaccagcgataatcataagtggacacaggaggacaagctgctcctggagtcccagttgattcttgccacagctgagcccctttgtttggaccccagcattgcggtgacctgtacagctaaccgccttctgtataacaagcagaaaatgaacaccaggcccatgaagcgctgttttaagagatacagcagatctagcttaaatcgccagcaggacttgagtcattgtccaccaccccctcagttgagactgctcgatttccttcagaaaaggaaggagaggaaagcgggacaacactatgatttaaagatctctaaggcaggaaattgcgttgatatgtggaagcgctcaccatgcaatttggcaataccatccgaggtggacgtcgagaagtacgctaaagtcgaaaaaagcatcaaatctgacgatagccagcctactgtgtggcctgcacacgacgtgaaagatgactacgtcttcgagtgtgaggccggaacgcaataccagaaaacaaagctcactatcctgcaatctttgggtgatcccttatactatggtaaaattcaaccgtgtaaggctgacgaagaatccgatagtcagatgtcacccagtcacagctctactgacgatcattcaaattggtttattattggctccaaaactgacgctgaaagggtagtgaaccagtaccaagaactggtacagaatgaagctaagtgccctgtgaagatgagccatagttcgtctggtagtgcaagcctttcgcaggtgagccctgggaaggaaacggaccagacagaaactgtatctgtgcagtctagcgtgctgggaaagggggtgaaacaccggcctccgccaatcaagctgccttctagtagcggcaactcctcatccggtaactactttacccctcagcaaacctcaagctttctgaaatcacccaccccccctccgagctctaagcctagcagtatcccccgcaagagcagtgtcgacttgaatcaggtgagcatgctatcccctgccgctttgagccccgctagctccagccagcgcacaacagccactcaggttatggccaacagcgccgggctgaacttcatcaacgtcgtgggctcagtatgcggtgcgcaggccctcatgtcagggtccaatcctatgctcggctgcaatacaggcgctatcacgcctgccgggatcaatctgtctgggctgctgccatccggtgggttactgccaaacgcactgccctcagccatgcaggctgcttctcaggcaggggtaccattcggcctgaagaacacaagcagcctgagaccactcaacctgctgcagctgccaggaggatctcttatcttcaatacactgcagcagcagcaacagcagctgtcccaatttaccccccagcagccacagcagccaactacctgctcgccccagcagcctggggaacagggttctgaacagggctcaacgagtcaggagcaggccctctcagcccaacaggccgctgtgataaacctcaccggcgtgggctcttttatgcagagccaggccgcagctgtcgcaattttggcggcttctaatgggtacgggtcatccagctctacaaattcctctgccacgagctcctcagcttacaggcagcccgacacacgggccctgaatcagaagaactag

SEQ ID NO: 116586 - DNA, 1497 bp, Artificial Sequence
  Description of Artificial Sequence: Synthetic coding sequence
atgtatgtcatagaaagcgcacgtcagaggccgcctaaaagaaagtacctcagctccgggcgaaagagtgtctttcagaagctgtatgatttgtatattgaggagtgcgagaaagagcctgaggtaaaaaagttgagaagaaacgttaatttgcttgaaaaactggtaatgcaggaaaccctgtcttgcctcgtggtcaatctctaccctggaaacgagggctacagcctcatgctcagaggcaagaacgggtctgactcagagacaattagattgccttatgaggagggcgaattgcttgagtacctggacgccgaagaactgcctccgatccttgtggatctccttgaaaagtcccaggttaatatctttcattgtgggtgtgtgatcgctgaaattcgggactatagacagtcatccaatatgaaatcccccggttatcaatcgcggcacatcctgttacgccctacgatgcagactctaatttgtgacgtgcactcgattacgagtgataaccacaagtggacccaggaggataaactactgctggaaagccagttgattctggccaccgctgagccactgtgcttagaccccagcattgcagtcacctgtacagctaatagactgctttataataaacaaaaaatgaatacaaggcccatgaaacgctgtttcaagagatacagccgctcgtccttgaatcgtcagcaggacctgtcccattgtcccccgcccccacagctcaggttgcttgattttttacagaagaggaaggagcggaaggcaggtcaacattacgacctcaaaatcagcaaagccggaaactgcgtggacatgtggaaacggtctccatgcaacttggccattccttcagaagtggacgacgtcaaggacgattatgtgttcgaatgcgaggctggtacacagtaccagaaaacaaaactaacgattttgcaatcattgggggatccattatattatggaaaaatacagccatgtaaagcggacgaggagtcagacagtcaaatgtcgccatcgcactcctctacagatgaccacagcaactggtttattattggaagcaaaaccgacgcagagagggtcgtcaatcagtaccaggaactagtgcagaacgaagcaaagtgccccgtcaagatgtcccactcttcaagcggatctgcttctctgtcacaggtgagcccaggtaaagagacggaccagactgaaactgtgtcagtgcagagttctgtgctcggtaagggcgtgaaacatcggccgcctccaataaagttgccttcgtcttccggtaactcatcatctggcaattacttcacacctcagcaaacaagctcctttttgaagagccccactcctccaccatcaagcaagccgagttccattccaaggaagtcttccgtggatctcaaccaggtttccatgctttcccctgccgcactgagccccgctagtagttcgcagagacacgagtcttag

SEQ ID NO: 116587 - DNA, 678 bp, Artificial Sequence
  Description of Artificial Sequence: Synthetic coding sequence
atgctgctcaccctggcgggcggcgcgctgttctttccaggcttatttgccctttgcacctgggctctcagacggtcgcagcccgggtggtcccgtaccgactgcgtaatgatctctacaaggttggtctcttctgttcatgccgtactcgccacaggcagcggcatagtgatcatccgatcttgtgatgacgttattaccggacggcactggctggcccgcgagtatgtgtggttccttataccatacatgatttacgactcatacgctatgtacttatgtgagtggtgtcggaccagggaccagaaccgggccccttctctcaccctgagaaattttctgagtaggaaccgcctgatgatcactcatcacgcggtgatactcttcgtacttgtgcccgttgctcagctcaaacaacagcatacccttctctataaggtcaatggcatccttaccctagcaacattcctatcctgccgcatcctcctgtttccttttatgtattggagctatggcagacagcagggtctgtcactgctacaggtgccatttagcattccattctattgcaacgttgcaaacgcatttttggtggcccctcagatttattggttttgtctgctatgccgaaaagccgtccggctcttcgatactccgcaagcaaaaaaggatggttag

SEQ ID NO: 116588 - DNA, 774 bp, Artificial Sequence
  Description of Artificial Sequence: Synthetic coding sequence
atgctgctgactctcgcggggggcgcgctcttcttcccagggttattcgccttgtgcacctgggccctgcgccggagccagccggggtggagcaggactgactgcgtaatgatctccacccggctcgtgtcttctgtccatgctgtattggccacgggaagcgggatcgtgatcatccggagctgcgacgacgtgattaccgggcgtcattggctcgcccgggagtatgtgtggtttttaattccgtacatgatatacgattcgtatgccatgtacctatgcgaatggtgccggactcgcgaccagaatcgcgcaccaagcctcactttacgcaacttcctatctaggaaccgcctcatgattacacatcatgcagtgattttgttcgttttggtacccgtggcccaacgacttcggggcgacctgggagattttttcgtgggttgtatttttacggctgagttaagcactccctttgtgtctctgggacgggtgcttattcagctgaagcagcagcataccctgttgtacaaagtgaacggaatcctgaccctcgccacattccttagctgtcggatcctgttgttcccttttatgtactggtcctacgggagacagcaaggtctcagcctgcttcaggttcccttctcaattcccttttactgtaatgtcgccaacgcctttctcgtggccccccagatatattggttttgcctcctctgccggaaagctgttcgactgttcgatacaccccaggccaaaaaggatgggtag

SEQ ID NO: 116589 - DNA, 993 bp, Artificial Sequence
  Description of Artificial Sequence: Synthetic coding sequence
atgatcagcacacgctaccgccggagacgcgacgctcctagaggacccggcagatgcccccctcatccaactcggccccgaggcccagggcgcaagcggggggcggcaggctcccccggtgcagctccatccgcatcaagacgcccagaattccctaaaccactgagagtgttgccttggagagaacgcggtaggggcggtcgagaatggcctatgtccctgagaagcccgctgccaacaagcgcttgtggctggggtgaatccggtcgaagaccaggccgcgccccctgcggccctcggactgggcttagtgcgagggccgttctctctgcaagagcccgccttgtctcatccgtgcacgccgtcctggcaacaggcagtggcattgtgatcatccgttcttgtgatgacgtgatcaccggccggcactggctggcacgggaatacgtctggttccttatcccttacatgatctatgactcttatgccatgtatctatgtgagtggtgtcggaccagggatcagaatagagccccgagccttacattacgcaacttcttgtcaagaaaccgacttatgatcacccaccatgccgtgattcttttcgtcttagttcctgttgcgcagaggctacggggtgacctgggcgacttctttgttggctgtattttcacggctgagctgtccacaccatttgtatccctgggcagggtgctgattcagctgaaacagcagcataccttactatacaaagtgaacgggattttgacccttgctacttttctctcctgtaggatcttattgttccctttcatgtactggtcatatggacggcagcaggggcttagcctacttcaggttccttttagtattccattctattgtaatgtcgcgaacgcatttctcgtggctccacagatctactggttctgccttctgtgccggaaggcagtccggttatttgacacacctcaagccaagaaagatggttag

SEQ ID NO: 116590 - DNA, 741 bp, Artificial Sequence
  Description of Artificial Sequence: Synthetic coding sequence
atggaagcacccgaggcagccgagggaggtttgcagagaggggcacggagagctgccggggctcggtctcagggggccctcccatcaggcgaagttcatcacggaggcgtgaagctcggcatgcggtcaatcccgatcgccaccgcctgcacaatttatcataaatttttttgtgagactaacctggatgcatatgatccttatttaatcgccatgtcctctatctatttggctggcaaagttgaagaacagcaccttcgaactcgcgatatcatcaatgtcagcaatagatactttaatccatcgggcgaacctctcgaactcgactcgaggttctgggagctcagagattcaatcgtgcagtgtgaacttctgatgttgcgggtgcttagattccaagtgtcgttccaacacccgcacaaatatttattgcactatttggtaagtctccagaactggttaaaccgtcacagctggcagagaaccccagtagccgttacggcctgggccctcctgagggactcatatcacggcgccttgtgtcttcgctttcaggcacagcacatcgcagtggcagtcctgtatctggccctacaggtatatggcgtcgaggtgccagccgaggtggaggctgaaaaaccatggtggcaggtatttaatgatgacttaacaaagcctattatcgacaatatcgtatccgatctgatccagatctacaccatggataccgagattccttag

SEQ ID NO: 116591 - DNA, 585 bp, Artificial Sequence
  Description of Artificial Sequence: Synthetic coding sequence
atggaggcgggggtcaaactgggaatgaggagtatccccatcgcgactgcttgtactatttaccacaagtttttttgcgaaaccaatctcgacgcctatgacccctatctgattgccatgagcagcatctatctagctggaaaagtggaggagcagcacctgcggactcgtgacatcatcaacgtttctaatcgctatttcaacccaagcggggaacccttggaactggatagtagattctgggaactccgcgactcaattgtacagtgcgagctgctgatgctgagggtcctgcgtttccaggtgtcctttcagcatccacacaagtacctgctgcactacctggtatcattgcaaaattggctgaataggcacagctggcagagaactcccgtggctgttaccgcttgggcactgttgcgggatagctatcacggggctctctgcctccgatttcaggcacaacatatcgctgttgcagttttgtatttggctttacaggtgtatggggtggaggttccagcagaggtcgaagccgagaaaccttggtggcaaatctacacaatggacactgaaatcccctag

SEQ ID NO: 116592 - DNA, 681 bp, Artificial Sequence
  Description of Artificial Sequence: Synthetic coding sequence
atggaagcccctgaagcagcagagggaggcttacagaggggcgccagaagagccgccggtgcccggtcacagggcgcactgccaagtggcgaggtgcatcatgggggtgtcaagctggggatgcggtccatccccatcgccactgcatgtacgatataccacaaatttttctgcgagacgaacttggatgcgtacgacccatacttgatcgctatgtctagcatctaccttgctggtaaagtagaggagcagcacctccgaacccgtgacattataaatgtgtcaaacaggtatttcaatccatctggagagcctctcgaactcgattcccgcttttgggaacttcgggactccatcgtgcagtgcgaattgctgatgcttcgggtgcttagatttcaggtgtccttccagcaccctcacaagtacctgctgcattatttagtctcgctgcagaattggcttaacaggcattcgtggcagcggacccccgtggccgtgactgcgtgggctctcttacgagacagctatcacggcgctctctgcctgagattccaagcccagcatatcgcagtcgcagtcctgtatctggctttacaggtgtacggtgtcgaggtgcctgctgaggtggaagccgaaaagccctggtggcagatttataccatggatacagagatcccttag

SEQ ID NO: 116593 - DNA, 645 bp, Artificial Sequence
  Description of Artificial Sequence: Synthetic coding sequence
atggaagctggcgtcaaactggggatgcggagtattcctatcgccaccgcctgcacaatataccacaagttcttctgtgaaaccaacctcgacgcatacgacccatatctgatagctatgagctcaatctacctggccgggaaagtagaagaacaacatcttcgcaccagagacattatcaacgtatctaacaggtatttcaacccatctggcgaaccattagagctggattcacgattctgggaattacgggattccatagtgcagtgcgagcttctgatgctcagagtcctccgatttcaggtttcttttcagcatccccacaaatacctgcttcattatcttgtgtccctccagaactggttaaaccgccacagctggcagaggacaccggtcgccgtgactgcgtgggccctgctgcgcgactcgtatcacggggccctctgccttcgttttcaggcgcagcacattgccgttgccgtgttgtatttggccctccaggtgtatggagtagaggtgccggccgaggttgaggctgagaagccatggtggcaggtgttcaacgatgacctgactaagcccattattgacaacatcgtcagcgatctaatccaaatctacaccatggatacagaaattccctag

SEQ ID NO: 116594 - DNA, 741 bp, Artificial Sequence
  Description of Artificial Sequence: Synthetic coding sequence
atggaagcacctgagggcggaggtggaccggcggctaggggaccagagggtccggccccagaagctagggtccatttcagagtcgctagattcataatggaagctggcgttaaactgggcatgaggagcattccaattgccactgcctgtacaatttaccacaagtttttctgtgaaacgaatctggacgcctatgacccgtatctgatcgctatgtcttctatttatctggctgggaaagtggaggaacagcacctccgaactcgcgacatcatcaacgtctccaaccgctatttcaatccaagcggggagccactggaactggattctcgcttttgggagctgagggattctatagtccagtgcgagctcctgatgcttcgagtcctcagattccaagtatctttccagcacccccataagtacctattgcattatctagtaagcctgcagaattggttgaatcggcacagttggcagaggacccctgtggctgtgacagcttgggcgttattgcgagattcctatcatggagcactgtgtctcaggttccaagcccagcacatcgccgtggcagtgttgtacctggccctccaggtctatggcgtcgaggttcccgctgaagtggaggccgaaaagccttggtggcaggtgttcaatgacgatctcaccaaacccattatcgacaatatagtctctgacttgatacagatttataccatggacaccgagattccatag

SEQ ID NO: 116595 - DNA, 429 bp, Artificial Sequence
  Description of Artificial Sequence: Synthetic coding sequence
atggaggcgggggtgaaactgggcatgcggagcataccgatcgccactgcttgcacaatctatcataaattcttctgtgagaccaacttggacgcatacgacccctatctcattgctatgtctagcatctatctggccggaaaagtcgaggaacaacacctgcggactcgtgatattataaacgtgagcaatcggtttatcccatggacccagcggtcacctaaagtgttggcacaggcctgcccaaaacggtcccccggctggagcgccgcctgggggcactgtcatcacgtggctatgacagcaggccctcatcgtacctcatgggaagactggttgtgctgttggcgacgcgctggggaggggaacggaatgctcccgctgtgtcagagtttggaggtagccgtacaggtgatggtgggagcctag

SEQ ID NO: 116596 - DNA, 285 bp, Artificial Sequence
  Description of Artificial Sequence: Synthetic coding sequence
taagccgggaaggtggaggagcagcacctcagaacacgcgatatcatcaatgtgagcaacagatatttcaatccctcaggtgaacccctggagctggacagtaggttctgggaactgcgcgactcaatagtccagtgcgagctgttgatgctgagggtgctgcgcttccaggtgtcattccagcacccccataaagtcttcaatgacgacctcactaagcccataattgataacattgtcagcgacctgatacagatatataccatggataccgagataccatag

SEQ ID NO: 116597 - DNA, 366 bp, Artificial Sequence
  Description of Artificial Sequence: Synthetic coding sequence
tgaaggtatttcaatccgtccggagaacctctagagctcgactcccgtttctgggagcttagggactctattgtccagtgcgagctcttgatgctgagggtcctgagatttcaggtctcatttcaacatccccataagaattggctaaacagacactcttggcagcggacacccgtcgcggtcaccgcgtgggcgttgctgagagatagctatcatggggcgctgtgcctgaggttccaggctcagcacatcgctgtggcagtgctgtatctagctttgcaagtgtacggtgtggaggtgccagcagaagtggaggctgagaagccttggtggcaaatctataccatggatacagagattccatag

SEQ ID NO: 116598 - DNA, 3207 bp, Artificial Sequence
  Description of Artificial Sequence: Synthetic coding sequence
atgttggttggttcacaatcattcagccctgggggccccaatggcattatcaggtctcagagcttcgcgggatttagcggtttgcaggaacgacgctctcgctgcaactcattcatcgagaactcgagtgcccttaaaaaaccacaggccaagctgaaaaaaatgcacaatcttggccacaaaaacaacaatccccctaaagagcctcagcctaagagggtcgaggaggtgtaccgtgctctgaagaatggcctggacgagtatttggaggtgcaccagaccgaactggacaaacttacagctcaactaaaggatatgaaaagaaattctcgtttgggagtgctttacgacttggacaaacagattaagactatagagcggtatatgagacggctggagtttcatatctccaaagttgatgagctctatgaggcttactgcattcagcgcaggctgcaggatggggcatccaaaatgaagcaggcttttgcaacatccccggccagcaaagctgctagagaaagcctcacagagatcaaccggagcttcaaggaatacacagaaaacatgtgtacgatagaggtggaactggagaatctgcttggagagttcagcatcaagatgaaaggcctagcagggttcgccagactgtgtcctggagatcagtatgaaatctttatgaagtatggacggcaaaggtggaagcttaaggggaaaatcgaggtgaacggcaagcaatcctgggacggcgaagagacagtcttcttacccctgattgtgggcttcatctcaatcaaagtgaccgagttaaagggactggctacccatattctcgtggggagtgtgacttgtgagacgaaagagctgttcgcggcaagaccacaggtcgtggctgtggatattaatgaccttgggacaattaagctcaacctggaaattacgtggtacccatttgatgtggaggacatgaccgcgtcttctggcgcaggcaataaggctgcggcgctgcaacgacgaatgagtatgtattcccaaggcacgccagagacaccaacatttaaggatcacagcttctttcgctggttacacccctcccccgacaagcctcgccggctgtctgtgctatctgctctccaggacacattcttcgccaagctccaccgcagcagatcattttctgatctgccatccttaagacctagccccaaggccgtcctggaactgtatagtaacctgccagacgatatttttgagaatggaaaggccgctgaggaaaaaatgccattgtccctctcgttcagcgacctgccaaatggagactgtgccctaacgagccacagtactgggtctcctagcaattctactaacccggagattacaattacacccgccgagtttaatctgagttccttagcctcccagaacgagggcatggacgatacatccagcgcctctagcagaaacagcttaggcgagggtcaggaaccgaagtcacaccttaaggaggaggacccagaagagcctaggaagccagccagcgccccctccgaagcctgtcgacgccagagtagtggcgcgggcgctgagcacctcttcttggagaacgatgtagcagaagccttgctgcaggaatccgaagaagcgagtgagcttaaaccggtcgaactggatacgtctgagggtaacattacaaaacagctggtcaaaagattaactagcgcagaggtgccaatggctacagaccgacttctttctgaaggttcagttggtggggagtcagaggggtgtaggagttttctcgacggtagccttgaagacgcattcaacgggcttctgctggcactggaacctcacaaagaacagtacaaggaatttcaggatctcaaccaagaggtcatgaacttagacgatatcttgaagtgcaaacctgctgtctccagaagccggtcgtcctctctaagtctaactgtcgaaagcgcgcttgagtcttttgacttcctgaatacaagtgactttgacgaggaggaggatggcgacgaagtgtgtaacgttggtggaggagcggacagcgtcttcagcgatactgagaccgaaaagcattcctaccgctccgtccaccctgaggctagaggacatctgagcgaggccctgacagaagataccggtgtgggtactagcgttgccgggtcgcctttaccgttaaccaccggtaacgagagcctggacattaccatcgtgagacacctgcagtattgtacacaattggtacagcaaatcgtttttagctccaaaacccccttcgttgccaggtccctactggagaaactgagcagacagatacaggtcatggagaagttagcagccgtgagtgatgagaatatcggcaatatttcctcagtcgttgaagcaattccagaattccacaagaaactttcactcctgtcgttctggaccaagtgctgttcacccgtgggggtctatcattcaccagctgacagggtgatgaaacagctggaagcaagttttgcaagaactgttaacaaagagtaccctggcctcgccgaccccgtgttcaggactctggtgagtcaaatcctggatagagctgagcctttactgtctagcagtctctcaagtgaagtggtcactgtgtttcagtactactcgtacttcacatcccacggggtgtccgaccttgaatcctatctgtcacagttagcccgccaagtgtcaatggtgcagactctgcagagcctccgcgatgagaaacttttacaaaccatgtcagacctcgctccctcaaatcttcttgctcagcaggaggtcctcaggaccctggctttactcctgactagagaggacaacgaggtgagtgaggcggttacactgtatcttgccgccgcttccaagaaccagcactttagggagaaggcactgctgtattattgtgaagctcttacgaagactaatctccagctgcagaaggccgcttgtcttgctttgaaaattctcgaggccaccgagtcaatcaaaatgctagtgaccctgtgccagtctgatacagaggagattcggaatgtggccagtgaaactctcctgtccctaggagaagatggccgcctagcatacgaacagttggataagtttccgagagattgtgttaaagtgggcggaaggcacggaacggaagtggcaaccgctttttag

SEQ ID NO: 116599 - DNA, 1776 bp, Artificial Sequence
  Description of Artificial Sequence: Synthetic coding sequence
atgctagtgggatctcagagcttcagtcccggtggacctaatggaattatcagatcgcagtcatttgcaggcttttccggcctgcaggagaggcgctcccggtgtaatagctttattgagaattccagtgcccttaaaaagccgcaggccaagctgaagaagatgcacaatttgggccacaagaataacaatcctcctaaggaaccacaacctaaacgagtcgaggaagtgtatcgggccctgaaaaatggtcttgatgaatacctcgaggtccatcaaacagaactcgacaaactgacagctcaactgaaggacatgaaaagaaattcccggcttggcgtgctgtatgacttggataagcagataaagaccattgagcggtacatgagacggctggagttccatataagtaaggttgacgagttatacgaagcctactgcattcaaaggagactccaggatggggcctctaaaatgaaacaggcctttgccacatcaccagcatctaaagccgcaagggagtccttaactgagataaaccgatccttcaaagagtacaccgaaaacatgtgtacaatcgaggtggagcttgagaacctgttaggtgagtttagtattaagatgaaaggcctggcgggcttcgcccgcctctgtcccggcgatcagtatgaaattttcatgaaatacgggcgtcagcggtggaaactgaagggaaagatagaagtgaatgggaaacagtcatgggacggggaagagactgttttcctgcccttgatagttggcttcatctcaatcaaggtgacagaattaaaaggcttggctacccatattctggtgggcagtgtgacttgcgaaactaaagagctgtttgcggcacgtccgcaggtcgtagcggttgatataaatgacctgggaaccatcaagctaaatctagagatcacttggtacccttttgatgtagaagatatgacagcatcctcaggcgctggaaacaaggccgccgcactgcagcgccgcatgagcatgtattcgcagggaactcctgagacgccaacctttaaggaccacagtttcttctctaacctccctgacgacatttttgaaaacggtaaggctgcagaggagaagatgccattgtctctaagcttttccgacctacctaatggcgactgtgccctcacaagccattccaccggaagccctagtaactcaacaaaccccgagattaccattacgcccgccgagttcaatctatcaagtctcgcctctcaaaatgaaggaatggacgacacctcgtctgcctcgtccaggaatagcttgggagagggccaagagccaaagagtcaccttaaggaggaagatcccgaggaaccaaggaaaccagcctcagccccgagtgaggcctgccggagacagagttcaggggcgggcgccgaacacttgttccttgaaaacgacgtggctgaagcactgcttcaggagagcgaagaagcgtcggaattgaagcctgtggaactggacacctctgagggaaacatcacaaaacagctggtgaagcgactcacctccgcggaagttcccatggcaacagatcgactgctttccgaaggaagtgtgggtggagaatctgagggctgcagatcttttctagacggcagtctcgaggacgcctttaacggcctacttctggccctggagcctcataaggagcagtataaggagtttcaggacctaaaccaggaagttatgaacctcgatgacattctgaaaaagtag

SEQ ID NO: 116600 - DNA, 1944 bp, Artificial Sequence
  Description of Artificial Sequence: Synthetic coding sequence
atggtgctgccctcccgattacattggataagaaataggccgtggcgagataggatacgcagaaggcagctgaataggctgccaacgagattgccggagattatgctggtgggcagccaatcattctcaccagggggacctaatgggattataaggtctcagtccttcgctggttttagtggcctgcaagaacggcgctccaggtgtaatagttttatagagaactctagcgcactgaaaaagcctcaggctaagctgaaaaaaatgcacaatttgggccacaagaataataaccctcccaaggaaccacagcctaaaagggttgaggaggtgtatcgagctctgaaaaatggcttggatgagtatctggaggtgcatcaaacagaactggataagttgacagcacaactgaaagacatgaagcgcaatagcagattaggtgtcctatatgacctcgacaagcagataaagaccattgagaggtacatgcggagactagagttccacatttccaaagtggatgagctgtacgaggcttattgtatccagcgacgcctgcaggacggcgcctcgaagatgaaacaggctttcgcaacgagtcctgcctcaaaagccgctagagagtcactcactgaaatcaaccgatcatttaaggagtacacggagaacatgtgtacgattgaggtagaactcgagaacctgcttggggaattctcaattaaaatgaagggtctggccggtttcgcaagattgtgtcctggcgaccagtacgagatctttatgaagtacggcaggcagagatggaaattgaagggcaagatagaggttaatggaaagcagagttgggacggcgaagaaacagtttttctgccccttattgtggggttcatttctattaaggtcactgaactcaagggcctggcgacccatattctggtgggtagcgttacttgtgaaaccaaggaactgtttgcagcacgcccacaggtggtcgcagtggatatcaatgaccttgggaccataaaactaaacctcgagatcacatggtaccccttcgacgtggaagacatgacagcgagcagcggcgccggcaataaagcggccgcccttcaaaggcgcatgtccatgtacagccaagggacaccagagacacccacatttaaggaccatagcttcttttctaatcttcctgacgacattttcgagaacggcaaggcagcggaggaaaaaatgccgctgagcctgtcatttagtgatcttcccaacggcgactgtgctctcacctcccactcgactggttcaccttccaactccaccaatcctgagataactattacacctgcagagttcaatctctcatccttggcatctcagaatgagggtatggatgatacatcctccgcatcctcccgcaatagtcttggcgaaggccaggagccgaaatctcaccttaaggaagaagatcccgaagagcctagaaaacccgccagcgccccatctgaggcatgtagaaggcaatcctccggggccggagctgagcacttgtttttagaaaatgatgtcgcagaggccctgctccaggagagcgaagaagcatcggagcttaagcctgttgaattggacactagcgagggaaatattaccaaacagctggtcaaacgattgacgagcgcggaggtgcctatggcaacggaccggctgcttagtgaaggttccgtcggaggcgagtcagaaggctgccgaagctttctcgacggaagccttgaggacgctttcaatggactcctcttggcactggaacctcacaaggaacagtacaaggaatttcaggacctcaaccaggaggtgatgaatttggacgacatactgaaggacgctaagcatctggatgaccagaaactcaacggagccgctagctggactgagattaccgaaggcgagtag

SEQ ID NO: 116601 - DNA, 3144 bp, Artificial Sequence
  Description of Artificial Sequence: Synthetic coding sequence
atgcagttcttcgatgccgaggagctgttggtggatgaggaggacgatgttttcggagaggggcttcctactcggctgccggaaatcatgcttgtggggtcgcagagcttttctccaggcgggccgaacggcattattcgtagtcaatcgttcgcaggcttctcgggcctgcaagaaagacgctcccgctgtaattccttcatcgagaatagtagcgcactaaaaaagccgcaggctaaacttaagaagatgcacaacctcgggcacaagaacaacaaccctccgaaggaaccacagcccaaaagggtcgaagaggtctaccgcgcactgaaaaacggactggacgagtacctggaggttcaccagaccgagctggataagctgacggcccagctgaaagatatgaaaagaaactcacggctgggcgttttgtatgaccttgacaaacagatcaagaccattgagaggtatatgaggcggcttgaattccatatcagtaaggtggatgaactatatgaggcctactgtatacagcgacgtctgcaggatggtgcctctaaaatgaaacaggcttttgcaacttcccccgcctctaaagcagcaagggaatctcttaccgagattaaccggtcttttaaagaatacacagagaatatgtgcacaattgaggtggaactcgagaatcttctgggagaattttccattaaaatgaagggactggccgggttcgctcgcctctgccccggggatcaatatgaaattttcatgaagtacggcagacagagatggaaacttaaagggaaaatagaagtcaacgggaaacagtcctgggatggagaagaaaccgtcttcttgccacttattgtcggctttattagcattaaagttacggagcttaaaggcctggctacacatatcctcgtcgggagcgtgacatgcgaaaccaaggaattgtttgctgcccgcccacaagttgtggccgttgatatcaatgacctgggtactataaagcttaacctcgaaattacatggtacccttttgatgtagaagatatgactgcctcgagcggagcgggcaacaaagctgctgccttgcaacgccggatgagtatgtactcccaggggactccggaaacgcctaccttcaaagatcatagcttcttcagcaaccttcctgacgatatctttgaaaacggcaaagcagcggaagaaaagatgcccctcagcctttcgttttcggacctgccaaacggggattgtgctttaacatcacactctacaggaagtcccagcaactccactaatcccgagatcacaatcacaccagccgagttcaacttaagtagtctcgctagccagaacgaagggatggatgacacgtctagcgcgtcaagtagaaattcactcggcgagggccaagagcctaagtctcacttaaaagaggaagaccccgaagagccgcgcaaacccgccagcgcccctagcgaagcttgcagacgccagtcttctggtgccggggcggaacacctcttcctggaaaacgacgttgctgaagcgctgctgcaggagtcagaagaagcctccgaactgaaacctgtggaactggacacctccgaggggaacatcacaaaacaactcgtaaagcgcctgacttctgcagaggtcccgatggccactgatcggttactgagtgaaggctctgtagggggcgagagcgaaggatgccgttcctttctcgacggcagcttagaagatgcttttaacgggctcttattggcgctggagccacataaagagcagtataaggaatttcaagacttaaatcaggaggtcatgaacctggacgacattctaaagtgtaagccagcagttagccgctcgaggtcctcttccctttcactgaccgtggaaagcgcactggagtccttcgatttcctgaacacttcagacttcgatgaagaggaggatggtgacgaggtatgcaatgtgggcggaggagcggactccgtcttttctgacacagagacggaaaaacacagttataggtccgtgcacccagaggccaggggacacctgtctgaagcactgactgaggataccggcgtcggcacctcagtggccggaagtcctttgcccttaacaaccgggaacgagagcttagacattaccatagtcaggcaccttcagtattgtacgcaactcgtgcagcagatcgtattctcatctaagactccctttgtggcgcgcagcttactggaaaagctgtctcgtcaaatccaggtaatggaaaaactcgccgccgtcagcgatgaaaacatcggcaacatatcttctgtcgtagaggcaattccagaatttcacaaaaaactgtctctgttatccttctggactaaatgctgctcacctgtgggggtgtaccacagtcctgcagaccgggtcatgaagcaactcgaggcatctttcgctcggaccgttaacaaggagtaccccggcctggccgacccagtcttccggacactcgtgtctcagatccttgacagagccgagcctctcctgtccagttcactttcctctgaagttgtgacagttttccagtactacagctattttacaagccatggcgttagcgatctagaatcctacctgagccagctggccaggcaagtcagcatggtacagacactccaaagcctgagggacgagaaacttctgcagacaatgtccgatctggcgcccagcaacctcctcgctcagcaggaagtgcttaggactctggccctgctcttgacccgagaagataatgaagtgtcagaagcagtcaccctgtatcttgccgctgcgagcaagaaccaacattttagggagaaggcactcctgtattattgtgaggccctgaccaagaccaacttacagttgcagaaagcagcctgcctggcccttaagatcctggaagccacggaaagtatcaaaatgttggtcactctctgccagtcggatactgaggagattagaaatgtcgccagcgaaacactcctctccctgggtgaagacgggagactggcctacgagcaactggataaatttccgagagactgcgttaaagtgggcggacgccacggtacagaggtagctacagctttctag

SEQ ID NO: 116602 - DNA, 1842 bp, Artificial Sequence
  Description of Artificial Sequence: Synthetic coding sequence
atgctggtcgggtcccaatccttctcccccggtggtccaaatggaataatcaggtcacaatctttcgcaggattcagtgggctccaggagcgtcggtcacgatgcaattccttcatcgagaactcttccgccttaaagaagccacaggcgaaactgaagaagatgcacaacctcgggcacaagaacaataaccctcccaaagagcctcagcctaaaagagtggaggaggtttacagagcactgaagaatggccttgacgagtatctagaggttcaccaaaccgagctcgataagctcaccgcccagttgaaagatatgaaaaggaattctaggctgggagtgctatacgatctagataagcagattaagaccatcgaacgctacatgagaagactggaattccacatatcgaaagtggacgagctgtacgaggcctactgcatccaaagacggctacaggacggagcaagcaaaatgaaacaagcattcgctacatctcccgcctcaaaagccgcacgggaatccctcactgaaatcaatagatcctttaaagaatacactgaaaacatgtgcacaatcgaggtggaattggaaaacctcctcggagagttttcaattaaaatgaagggactggcaggtttcgcgcggctgtgtcctggagatcagtatgaaatctttatgaaatatgggcggcagagatggaaattgaaagggaagattgaggttaatggaaagcagagctgggatggcgaagagaccgttttcttacctctgatcgtgggcttcataagcataaaggtgacagagctgaaaggattggcgacccacattctggtcgggtccgtcacatgcgagaccaaagaactgtttgctgcacgccctcaggtcgtcgctgtcgacatcaatgatttgggaaccataaagctgaacctagagatcacgtggtacccgttcgatgtggaggacatgacagcttcgtcaggcgctggaaacaaagcagcagcactacaaaggcggatgtctatgtactcccagggaacgcctgagaccccgacattcaaggatcacagctttttctcaaatctacctgatgacatcttcgaaaacgggaaggccgcagaggagaagatgcccctgtccttgtccttctcggacctaccaaatggggattgcgcccttaccagccactcaacaggcagtccttcaaactcgacaaaccccgaaatcactattacccctgcagaatttaaccttagttctttggcttcgcaaaacgaaggtatggatgatacctcttccgctagtagtcgaaattcactgggagaagggcaggaacccaagtcccacctgaaggaagaagatcccgaggaacctcgcaaacccgcatccgccccaagcgaagcctgtcggcggcagtcaagcggcgctggggctgagcatttgttcctcgagaacgacgttgctgaggcactgctgcaggagtccgaggaggccagcgagctcaaacccgtggagcttgacacatccgaagggaacattacaaaacagctggtcaagagattgacttcagccgaagtaccaatggcgacggaccgactactctcagaggggtccgttggcggagaatctgaagggtgccgctctttcctcgatgggagcctggaggatgcttttaatgggctgctattggcactcgaaccacacaaagaacagtataaagagttccaggacctgaaccaagaggttatgaacctggacgatattctgaaggatgctaaacatttggacgatcagaagctgaatggggcagcatcttggacagagattaccgaaggtgagtag

SEQ ID NO: 116603 - DNA, 2673 bp, Artificial Sequence
  Description of Artificial Sequence: Synthetic coding sequence
atgtccgctaacaattcaccgccaagtgcccagaagagtgtcctgccgacagctattccagccgtgcttccagccgcaagcccctgctcttctcccaagacagggctctccgcgcgcctctccaacgggtcattctccgcgcctagcttgacaaacagtcgcggctcagtgcatacagtgagtttcttactgcagatcggcctgacaagggagtccgtgaccatcgaggcacaggaactgagtctttccgcagtaaaggacctagtttgttctatcgtttatcaaaagtttccagagtgcggcttctttgggatgtatgacaagatactgttattcagacatgacatgaattccgagaacatacttcagctgattacatcagccgacgagattcacgaaggagatctggtggaagtcgtgctatctgctctcgctaccgtagaggatttccagatccggccacatactctgtacgttcatagttacaaagcacccaccttttgcgactactgcggcgagatgctttggggattagtgcggcagggcttgaagtgtgaggggtgcggcctgaattatcacaaacggtgcgccttcaaaataccaaataattgctcaggggtacgaaaaagacgtctgtcaaatgtttctttgccaggaccgggactttctgtgcctaggcccctccagccagagtatgtcgccctgccctcagaggagtcccatgtgcaccaggagccttctaaacgaattccctcctggagcggtcgccctatatggatggagaaaatggttatgtgcagggtcaaagtcccccataccttcgccgtgcatagctacacaaggcccactatctgtcagtactgtaagcggctcctgaagggactgttcagacaaggtatgcagtgtaaagactgtaaattcaactgccacaaaagatgcgctagcaaagtcccccgggactgtctcggcgaggtaacgttcaacggtgaaccttcatctctgggcactgacactgacataccgatggatatcgacaataacgatattaattcagatagctcccggggcttagacgataccgaagaaccatctcctcccgaggataagatgttctttctggatccttccgacctggacgtcgagagagacgaggaggcggtgaaaaccatctctccctccacttcgaacaacatccccctcatgagagtggtacagtctatcaaacataccaaaaggaagtcctcaaccatggttaaggaggggtggatggtgcattacacgtcgagagataacctgcggaaacggcactattggcggttagacagcaagtgcctgactttgttccagaatgaaagtggatccaaatactataaggaaattccgctatcagagatcctgagaatctcgtctcctagagactttaccaatatcagtcaggggagtaatccccactgcttcgagatcattactgataccatggtgtacttcgtaggagaaaataacggcgattcgtcccataacccggtgctggccgccaccggagtgggattggacgttgcgcaatcttgggagaaggccattcggcaggcactcatgccagttactcctcaggcctccgtgtgtacgtcccccggtcagggcaaggaccataaggacttatccacctccatctctgttagtaactgccaaatccaggaaaacgtggacatttctactgtgtatcagatcttcgccgacgaggttctgggatccggccagtttggcattgtgtacggcggaaaacatcgcaaaacaggcagggatgttgcgatcaaggtgatagataagatgcgtttccccaccaaacaggaaagccagttacgtaacgaggtcgcaattctccagaacctgcaccaccctggaattgtgaatctggagtgcatgtttgagacccccgagcgagtcttcgtggtgatggaaaagctccatggtgatatgctcgagatgatcttgtcatctgagaaatcacgtctccctgaacggatcactaaattcatggtcactcagattttggtagcccttcggaatctgcactttaaaaacatcgtgcactgcgaccttaagcctgagaacgtgctgctagcaagcgcagagccatttccacaggttaagctgtgtgacttcggattcgctaggattattggggagaagtcttttcgacgctcagtggttggcacaccggcttacctggcccccgaggtgctgcgctcgaaggggtacaatcggagcttggatatgtggtcggtgggtgtcatcatttacgtctcattgtctggaacctttcccttcaatgaagatgaggatatcaatgaccagatccagaatgccgcatttatgtatcccccaaatccgtggcgggagattagtggagaggcaatcgatctgattaacaatctcctccaggtcaagatgcggaagaggtacagcgttgataagagtctttctcacccttggttgcaggattatcaaacgtggctcgatctcagggagtttgagacgcgaatcggggagcgctacattacacacgagagtgatgatgcccgatgggaaattcatgcatatacacacaatcttgtttacccgaaacactttattatggccccaaaccccgacgacatggaggaagatccctag

SEQ ID NO: 116604 - DNA, 1233 bp, Artificial Sequence
  Description of Artificial Sequence: Synthetic coding sequence
atgccgtactctactaacaaggaactcattctgggcattatggtcggaacggccggcatttccctcctgctcttatggtaccacaaggtgagaaaaccgggaatagccatgaaactgcccgaattcctgtccctgggcaatacatttaattctatcacactgcaggatgaaattcatgatgaccagggaacaaccgtcatattccaggaacgacagttgcagatactcgagaagttgaacgagctgttgacaaatatggaggaattgaaggaagagatcagattcctcaaagaagccattcccaagcttgaggaatatattcaagatgaactaggagggaaaatcaccgtccataagattagcccccaacacagggcaaggaagcgtagactgcccacaatccaaagctctgcaacaagtaattcctccgaagaggcagagtctgaaggtggatacatcactgcaaacactgacacagaggaacagtcttttcccgtacctaaggcctttaacactcgagttgaggaactgaatctggacgtgttactccagaaagtcgatcacctgcgcatgtccgaatccggcaaaagcgaatcctttgagctcctgagagatcacaaagagaaattccgagatgagatcgaattcatgtggcgttttgcccgggcctacggggacatgtatgaattgtccaccaacactcaggagaaaaaacattatgctaacattgggaagacgttatccgagcgtgccattaatagggcacccatgaatggccactgccacctgtggtatgcggtactctgcgggtacgtgagcgagttcgagggactacaaaacaagatcaactacggccacctctttaaggagcatcttgacatcgccattaaacttctccctgaagaacctttcctgtattacctgaaaggccgttattgttacactgtcagcaagttgagttggattgaaaagaagatggccgccactctgtttgggaaaattcctagctcaactgtccaggaggcgcttcacaactttctgaaggccgaagagctttgtccaggatatagcaacccgaattacatgtatttagctaagtgctatacagatttagaggaaaatcagaacgccctgaagttttgtaatctggctcttctgctcccaactgtcaccaaagaagataaagaggctcagaaggaaatgcagaagattatgacatctttaaaaagatag

SEQ ID NO: 116605 - DNA, 1233 bp, Artificial Sequence
  Description of Artificial Sequence: Synthetic coding sequence
atgccctattcgacgaacaaagagctgatcttgggtatcatggttgggaccgctggtatcagcctcctgttgttgtggtatcacaaggtccggaaacctggtatagccatgaaattgcccgagttcttatccctagggaacacattcaacagtatcactctgcaagatgagattcatgacgatcagggaactacagtcatttttcaagaaagacaactgcagattctcgagaagttaaatgaactgcttactaatatggaggagctaaaagaggagatcagatttctgaaagaggccatcccgaagctagaagaatacatccaggatgaacttgggggcaagattacagtgcacaagatttctcctcagcatagggcaagaaaaaggcggctcccaactatccagtcatcagcaacttctaacagctcagaggaggctgagtcagagggcgggtacattaccgccaatacagacactgaggagcagagcttccctgtacctaaagcttttaatacaagagttgaagaactgaatctcgatgtcttactgcagaaagtagatcatctgaggatgtcagaatcaggaaagtcagaatcgtttgagctcctgcgagaccataaagaaaagttccgagacgaaatcgaattcatgtggcgtttcgcccgcgcctatggggatatgtatgagctctccaccaacacacaggaaaagaaacattatgctaatatcgggaaaacactctctgaacgtgcaattaatcgagcgccaatgaacggccactgccacctatggtacgctgttctgtgcggatatgtgtcagagtttgagggactgcaaaacaagatcaattatggacatctgtttaaggagcatcttgacatcgcaatcaaacttctgccagaggagcccttcctttactatctgaagggccgatactgctataccgtgtctaaacttagctggattgagaagaagatggcagcaacacttttcggcaaaataccatcctctacagtacaggaggcgctccataacttccttaaggctgaggagctatgcccaggttacagcaaccctaactatatgtacctcgccaagtgctacacagacctcgaagagaaccagaatgctttgaagttctgtaatctggcacttttgcttcccacagttaccaaggaagataaggaggcacagaaagagatgcagaaaattatgacctcgctcaagcggtag

SEQ ID NO: 116606 - DNA, 528 bp, Artificial Sequence
  Description of Artificial Sequence: Synthetic coding sequence
atgccctattcaaccaacaaagaattaatcctggggatcatggtcggcaccgccgggattagcctcctgctgctttggtatcacaaggttaggaagcctggcatcgctatgaagcttccagaattcctcagccttggcaacaccttcaacagcattaccctacaggatgaaatccatgacgaccaggggacgaccgtgatctttcaggagcggcagctgcagatcctcgagaagctaaacgaacttctcactaacatggaggaactcaaggaagaaattcgtttcctaaaggaggccatccccaaactagaggagtatatacaggacgaacttggcggcaaaataaccgtgcacaagataagcccccagcaccgcgcaagaaaacgacggctcccaaccatccagagttctgccactagtaacagttctgaagaggccgagtctgaaggaggttatattacagctaacacagatactgaggaacagtcatttcccgtccctaaggcattcaatacccgggttgagtag

SEQ ID NO: 116607 - DNA, 798 bp, Artificial Sequence
  Description of Artificial Sequence: Synthetic coding sequence
atgggaaagtgcttgaggtacataactgccaacactgacaccgaggagcagagctttcccgtgcccaaagcctttaatacacgcgtcgaagagttgaacctagacgtgctcttgcaaaaagtcgaccatctacggatgtcagagtctggtaagtctgagtcatttgagctgctgagggaccataaggaaaagtttcgagacgaaatcgaatttatgtggcgattcgcccgggcctatggcgatatgtatgaacttagtactaatacccaggagaagaagcattacgcaaacatcgggaagacgttgtctgagcgagcaataaatcgcgctcctatgaatggccattgccacctgtggtatgctgtcctctgcggctatgtgtctgaattcgagggactccagaataagatcaattacgggcatttatttaaggagcacctggatatcgccattaaactactccccgaggagcccttcctttactatttaaaaggccggtactgctacacagtgagcaagctgtcttggattgaaaagaagatggccgctacactattcggcaaaataccaagctctacggtccaggaggccctgcacaatttcctgaaggcagaggagctttgccccggatatagcaatcctaactatatgtacttggcgaagtgttacacagacctggaggaaaaccagaatgccctgaagttctgtaacctggctttgctgctgcccaccgtgacaaaagaggataaagaagctcagaaggagatgcaaaagatcatgaccagtcttaagaggtag

SEQ ID NO: 116608 - DNA, 453 bp, Artificial Sequence
  Description of Artificial Sequence: Synthetic coding sequence
tgagtcctgtgcgggtacgtctccgagtttgaaggcctccagaacaagatcaattatggccacctctttaaggaacaccttgatatagctatcaagctcttgccagaggagcccttcctttattacctaaaggggagatattgctacacagtgtctaagttatcttggattgagaaaaagatggcagcaacgctgttcggcaagattcccagtagtaccgtgcaagaagcactacataatttcctgaaagcagaagagttatgcccaggctattctaatccgaattacatgtacctagccaagtgttacacagatctcgaggaaaatcaaaacgcacttaaattttgcaatctcgctctccttctgcctacagtgacgaaagaggataaagaggctcaaaaagagatgcagaaaataatgacctctcttaagcggctcagaaaaacaaaatag

SEQ ID NO: 116609 - DNA, 717 bp, Artificial Sequence
  Description of Artificial Sequence: Synthetic coding sequence
atggggaagtgtctcaggtacatcaccgcaaataccgacacagaagagcagtcttttcctgttccgaaagcattcaacaccagagtcgaggagcttaacctcgacgttctcctgcagaaggttgaccatcttcgcatgagcgaaagcggaaagagcgagtccttcgagctcctgagagaccacaaggagaagtttagggacgagatagagttcatgtggcgtttcgcccgcgcctatggtgacatgtacgaactctccactaatacgcaggagaagaaacattatgccaatatcggcaagaccctgagtgaacgggccattaatagggcccccatgaacggacattgccatctgtggtatgccgtgctgtgcggctacgtttcagagttcgaaggactgcagaacaaaatcaactacggccacctgtttaaggagcacctggatatcgctatcaagctcttgccagaggaaccctttctctattacctcaaagggcgatattgttatacggttagcaaactctcatggattgagaaaaagatggctgcaacactctttggcaagataccctcatccacagtgcaggaagctctgcacaattttctgaaagccgaagaactgtgtcctggctacagtaatccgaattatatgtatttggccaaatgctatactgatctggaagaaaaccagaacgctctgaaattttgcaacttgtag

SEQ ID NO: 116610 - DNA, 1413 bp, Artificial Sequence
  Description of Artificial Sequence: Synthetic coding sequence
atgtccagacttggtgcacttgggggagcacgggctggactggggctgcttctgggcaccgcagccggtctcggttttctatgtctcctgtattctcaaaggtggaaacgtactcaaagacacggtcggtcccagagccttcctaactctctggactacacacagacgtcagatccggggcggcacgtgatgctcctgagagccgttcctggaggagctggtgatgccagcgtgctgccatccttgccaagggagggccaggagaaggtgttagaccggctggatttcgtgctgacatctttggttgctcttagacgcgaagttgaggaactgagaagctccctgaggggtctggccggggagattgtcggggaagtgcggtgtcacatggaagagaaccagagggtggctagacggaggcggttcccgttcgtgagagaacgcagcgactctactggaagttccagtgtgtactttacagcttcatccggcgccacattcaccgatgccgagtccgagggagggtacacaaccgctaacgctgaaagcgacaacgagagagactccgataaagagagcgaggatggggaggacgaagtctcctgcgagaccgtcaagatgggccgcaaggactcccttgatctggaggaggaggctgcatccggtgcctctagtgccttggaggccggcggtagtagtggtctggaagacgtgctcccactgctccagcaagcagatgagttgcataggggtgatgagcaggggaaacgtgaggggtttcagctcctgctgaacaacaagcttgtgtatggtagtcggcaagatttcctgtggaggttagcccgggcctattctgacatgtgcgagctcacagaggaggttagcgaaaagaagtcttacgcactcgacggcaaagaggaagcagaggcagcgttagaaaagggagatgagagcgccgattgccatctctggtatgccgtactgtgcgggcagcttgccgaacacgaatcgattcagcgtcgcatacagtcagggtttagcttcaaggagcatgtcgacaaggctatcgctctccagcccgaaaatcctatggcacactttctgttaggcaggtggtgctaccaagtatctcacctgtcctggctcgagaaaaagacggccactgctctcctggaatccccactctctgccaccgttgaggatgcactccaatcatttctaaaagcggaggagctgcagccaggattttctaaggcgggtagagtgtacatttctaagtgttatcgtgaactgggcaagaatagcgaggctaggtggtggatgaaactcgccctcgagctcccggacgtcactaaggaagatctggccatccagaaagacctggaggaactggaggttattctgagagattag

SEQ ID NO: 116611 - DNA, 1413 bp, Artificial Sequence
  Description of Artificial Sequence: Synthetic coding sequence
atgagccgcttgggagcgctaggcggggccagggccggacttggactgcttttaggcactgccgctggcctgggctttctgtgcctcctgtactctcagcggtggaaacgcactcagaggcatgggcggtctcaatccctgccaaacagtctggactatacccagacgtctgatccgggtcgacacgtgatgcttctccgcgcagtcccgggcggcgctggtgacgcctccgtgttaccctcactccctcgagaaggacaggaaaaagttctcgaccgattagactttgtgttgactagcttggttgcattgcgtcgggaagtggaagagctgcgcagcagcttacggggcctagctggagagatagtgggtgaagtccgatgccatatggaggagaaccagagggtggcacgccggcgtcgatttcccttcgtgagagaaagatcagattctaccgggagcagctcggtgtactttaccgcttccagcggggcaactttcactgatgcagagtcagagggaggttacacgacagctaacgcagagtctgataacgaacgggattccgacaaagagtctgaggacggggaggacgaagtttcatgtgagaccgtgaagatgggccgtaaggactcactggatcttgaagaagaggccgcatctggcgccagtagtgccctcgaggccggaggcagctccggcctggaggacgtgctgcctctgttgcagcaggcggacgaactgcaccggggtgatgaacagggtaaaagagagggttttcagcttctgctgaacaataagctcgtgtacgggtcacgacaggatttcctgtggaggctcgctcgggcttatagcgatatgtgtgagctgacagaagaggtatcagaaaaaaaaagctatgccctcgacgggaaagaagaagccgaggcagcgttggagaaaggagatgagtcagccgattgccacctttggtatgcggtgttatgtgggcagctcgccgagcacgagagtatacagaggaggatccaatcaggcttctcctttaaagagcacgttgataaggccatcgctctacagcccgaaaacccgatggcccatttcctccttggtaggtggtgttatcaggtgtctcacttgtcatggctagagaagaagaccgccacagccctgctggaatcccccctttctgcaactgtggaagacgccctgcagtccttcctcaaggctgaagagcttcagccagggttttctaaggcagggagagtttatatcagtaagtgctatagagaactgggaaaaaactctgaggctcgatggtggatgaagttagcactggagctccccgacgtgactaaggaagacctagcgatacaaaaggaccttgaggaactggaggttatactaagagattag

SEQ ID NO: 116612 - DNA, 1224 bp, Artificial Sequence
  Description of Artificial Sequence: Synthetic coding sequence
atgcttctgagggccgtgcctggcggagccggggacgcatccgtcctaccttctctgcccagagaaggtcaggagaaggtgctggacagactggatttcgtactgacctcccttgtggccctgcggcgggaggtcgaggaattgagaagcagcctcagggggctggccggcgagatcgtaggggaggtgcgttgtcacatggaagaaaaccagcgtgtggcaagacggcggagattcccctttgtccgcgaacgatcagactctaccgggtcatcctccgtgtacttcacagcatcctccggagcaacttttacagatgctgaaagcgaaggcggttatacaacagcgaatgccgaatctgataacgagagagactcagataaggaaagtgaggacggtgaggatgaagtctcatgcgagactgtgaaaatgggccggaaagactctctcgatttggaagaagaggcagccagcggtgcctcctctgccttagaagcaggaggctcttctggtctcgaagacgtactgcccctgctgcaacaagccgatgagctgcatagaggggatgagcagggcaaacgcgaaggcttccagctccttcttaataataagttggtgtacggcagccggcaggacttcctatggcggcttgcccgggcatatagtgatatgtgtgagctgaccgaggaggtttcagaaaaaaaatcttatgcattggatggcaaagaggaggctgaggccgccctggagaaaggcgacgagagcgccgactgtcacctctggtacgccgtgctttgtggccaacttgccgagcacgaatctattcagcgcagaattcagtccggttttagttttaaagaacatgtcgacaaggctatcgccttacagccagaaaaccccatggcacattttctgctggggagatggtgctatcaggtgtcacatctgagttggctggagaagaaaacagccaccgcattactcgaaagccccctgtctgcaaccgtcgaggacgccttacagagttttcttaaggccgaggaattgcagccaggcttcagcaaagcgggacgtgtgtacatcagtaaatgttaccgggagcttggtaaaaactctgaggcccgctggtggatgaagctcgccctggaactcccagatgtaactaaggaagatctcgccattcagaaagacctggaggaactcgaagtcatcctccgcgattag

SEQ ID NO: 116613 - DNA, 864 bp, Artificial Sequence
  Description of Artificial Sequence: Synthetic coding sequence
atgtcccgcctaggggccctgggcggagccagggccggcctgggattgttgctcggtaccgccgccggtctgggcttcttgtgcctcctttattcacaacggtggaagcggacacaaaggcacggtaggagccaaagcctgccgaactcactggactatacccagacctccgatcccggacgccacgtcatgctgctgagggcggtgccgggtggagccggcgacgccagtgtgcttccctcgctcccgcgggaaggacaggaaaaagtgctagatcgactcgatttcgtccttacttccttggtcgctctgcgtagggaagttgaagaactgagatctagcctccgtggcctcgcgggcgagatcgtcggagaggttcggtgccatatggaggaaaaccagcgcgtggcacgcagaaggaggtttcccttcgtcagagagcgctctgacagcaccggaagtagctcagtctacttcacagcgagctctggcgcaaccttcacagatgctgaaagcgaaggggggtatactactgccaacgctgaatcggataacgaacgcgattcagataaggagtccgaagatggagaggacgaagtatcatgtgaaacggtgaaaatgggcaggaaagactcgctggaccttgaagaagaagctgcaagtggagcaagctcggcactcgaagctggcgggagctctggactggaggatgtcctgcccctactgcagcaagcggatgagttgcacagaggcgacgagcagggcaaaagagaggggttccagctgctgctcaataataagttggtgtatggatcacggcaagatttcctttggagactggcccgggcttactctgatatgtag

SEQ ID NO: 116614 - DNA, 945 bp, Artificial Sequence
  Description of Artificial Sequence: Synthetic coding sequence
atggctttggcagctagattgtggcggctcctcccctttcgccggggagcagctccgggatcccgcctcccagcaggaacttccgggagtagaggacattgcgggccatgccggtttcgggggttcgaagtgatggggaatccggggacttttaagcgaggcctgttactgtctgctctttcatatctgggatttgaaacctaccaagtgatctcgcaggccgccgtggttcacgccaccgcaaaggtagaggaaatcctggagcaagccgattacctgtatgaatcaggggagacagaaaagttatatcagctgctcacccagtataaggaaagtgaggacgctgaactactctggcggttagcgagagcaagccgggacgtagcacagctgtccaggacaagtgaggaagagaagaaactgcttgtgtacgaagccctagaatacgctaagcgcgcactcgagaagaatgagtctagcttcgccagccataaatggtatgccatttgcctcagcgatgtgggggattacgaggggatcaaggctaaaattgcgaatgcctatatcataaaggaacacttcgaaaaagcaattgaattgaacccgaaagatgcaacctctattcatttaatgggcatttggtgttacacattcgctgaaatgccatggtaccagagacgtatcgccaagatgctgtttgctacccccccctccagcacctacgagaaggctcttggctatttccatagggcggaacaagttgacccaaatttttactccaaaaatctgttacttctcggcaagacatacctgaagttgcataacaaaaagctggccgctttctggctgatgaaagccaaagattatcctgcccacacagaggaagacaagcaaattcagactgaagcagcccagctgttgacttccttttccgaaaagaattag

SEQ ID NO: 116615 - DNA, 855 bp, Artificial Sequence
  Description of Artificial Sequence: Synthetic coding sequence
atggcactggctgctcgcttgtggcgtcttttgccatttagaaggggggccgcacctggaagccgcctgcccgctggtacgtctggaagccggggacattgcggcccctgccggtttagaggttttgaggttatgggcaaccccggcacatttaagcgcggcctgttactgagcgctctctcctatctagggtttgaaacttatcaggtgataagtcaggccgcagtggtccacgccacagctaaggtggaagagattctcgagcaggctgattatctatatgaaagcggggagaccgaaaaactataccagttactcacacagtacaaagaatctgaggacgcagagctcctctggcgtttggcaagggcttctcgcgacgtagcccaactgagtcgcacatctgaagaggagaaaaagctcctggtctacgaagcactggagtacgctaagagagcactggaaaagaacgagtccagctttgcttctcataagaaagcgattgagctcaacccaaaggacgccacttccatccacctgatgggaatctggtgttatacatttgcggaaatgccatggtaccagcgacggattgcaaaaatgctgtttgccaccccgcctagttcaacatacgagaaggcacttggctactttcatcgagcagaacaggtggatcccaatttttatagtaagaatctgcttcttttgggcaagacctacctcaaacttcacaacaagaagctcgcagctttttggctgatgaaggccaaggattatcctgcccacaccgaagaagacaagcagatacagacggaggcggcccagcttttgacttccttttccgagaagaactag

SEQ ID NO: 116616 - DNA, 3540 bp, Artificial Sequence
  Description of Artificial Sequence: Synthetic coding sequence
atggcaagacgttcccagagctcatctcaaggagacaatccactggcgcctggttatctgccacctcactataaggaatattatcggttagccgtcgatgcactggccgagggcggttcagaggcatactccaggttcctggctaccgagggcgcccccgattttctctgccctgaagagcttgagcacgtgtccaggcatttaagacccccacagtatgtcacaagggagccgcctgagggcagccttctggacgtcgacatggatggttcctctggtacatattggcccgtcaactccgaccaggctgtgccagaattggacctcggatggccactgactttcgggttccagggaactgaggtcaccacccttgtgcagcctccacctccggacagcccatccatcaaagatgaagctaggaggatgatccgcagtgcacagcaggtggtggccgtcgtaatggatatgtttaccgatgtagacctgctctctgaggtcctggaagccgccgcccgacgtgtgcccgtctatattctattggacgagatgaatgcacaacattttctggatatggccgataagtgccgtgtaaatctgcagcacgtagattttctacgtgtgagaaccgtcgccggacccacctattattgccggaccggaaagtcattcaagggccacgtgaaggagaagttcctcttagtggactgtgccgtagtcatgagtgggagttattccttcatgtggtctttcgagaagattcatcggagcctcgctcacgtgtttcagggcgaactcgtcagcagttttgacgaagagttcaggatcctgttcgcacagagcgagcctctggtccccagtgccgctgcactcgcgcgaatggacgcttacgcacttgccccttacgcaggggctggtcctctagtgggcgtaccaggcgtgggagccccgaccccattttcattccctaagcgggcacacctcttattcccccccccgcgggaagaggggctgggctttcctagctttctagatccagacaggcatttcctctctgccttcagaagagaggaacctccccgtatgccaggtggcgccttggagccccacgccggtctgagaccgttgtcccggaggctcgaagccgaggcaggccccgccggtgagctggccggggcacggggatttttccaggctcggcacctggagatggacgccttcaaacggcatagctttgccaccgagggtgccggagcagtggagaactttgccgcggctagacaggtgagcaggcagacattcctgtcacatggggatgactttagatttcagacctcacacttccatagggaccagctgtaccaacagcagtatcagtgggatcctcaactgacacccgctcgccctcaggggttgttcgagaaactccgggggggccgcgccggattcgccgacccggacgacttcaccttgggagctgggccaagattccctgaactgggccctgacgggcaccagcgcctggattatgtcccttctagtgccagtcgagaggtgcgacacgggagcgacccagcatttgcccccggacctaggggcttggagcctagcggcgccccaaggcctaacctaacccagcgctttccatgccaggcagctgcacgtcccggcccagaccccgcccccgaggctgagccagagcggaggggtggcccggaaggaagagctggactcaggcgctggcgtctggccagctacctgtcaggatgccacggagaagatgggggcgacgatggccttcctgccccaatggaagccgaagcctatgaggacgacgtccttgcacctggcggaagagcaccagcgggagatctacttccctcggcgtttagagtgcctgctgccttcccaaccaaggttcctgtccctggccctggaagcggcggaaatggtccggaaagggaaggaccagaggaacccggtctggcaaagcaagactccttccgatcccggctgaatccgttggtgcagaggagtagtcgcctgcgttcctctctcattttctccacatcccaggccgagggcgccgccggggctgccgctgctactgagaaagtccagcttttacacaaggaacagaccgtctctgagactctggggcccgggggtgaggccgtccggtccgcggctagcactaaagttgcagagttacttgagaaatataaaggtccggccagggacccagggggaggcgccggggccatcacggtcgcaagtcattctaaggctgttgtgtcgcaggcctggcgagaggaggtggctgcccccggggctgtgggaggggagcgaagatctctggagtcttgcctcctagacctgagggattcattcgcccaacagctgcaccaagaggcagagaggcagcccggcgccgcctccctgacggccgcccagcttctggacaccctcggaagaagcggctccgataggctccctagccggttcctcagtgcacagtcccattcgaccagtccacagggtcttgacagccccctgcctctggagggctctggggcccatcaggtgctccataacgagtccaaggggagccccacatctgcttatccagagagaaagggctcgcctaccccaggttttagtactagaaggggttctcccaccaccggctttatagagcaaaagggcagtcccacatccgcatatcccgaacggcgaggttcgcctgtccctcccgtacctgagcgaagatcttctccggtgcctcccgtacctgaacggcggggatctctgacgctgacgatatctggcgagtcccctaaggcggggccagcagaggaaggcccaagcggtccgatggaagtcctgaggaaggggtccttgcggctgcgtcagttgctcagtcctaaaggcgagcgaaggatggaggatgagggtggattcccagtccctcaagagaacgggcagcctgagagtccacgtagactttctctgggtcagggcgattcaaccgaggccgccaccgaggaacggggaccaagagccaggctatccagcgccaccgcaaatgctttgtattcatccaacctgcgcgatgatacaaaggcaatcctggaacagatcagcgcacacgggcagaagcacagagctgtgcccgcacctagccccgggcctacacacaactcacctgaactcggacgtccacctgcagcgggcgtgttggcccccgatatgagtgacaaggataagtgctcagccatctttagatctgactccctgggaactcagggcagactctccaggaccttgcctgcttccgctgaggaaagagacaggctccttcggcggatggaaagtatgcgaaaagagaaaagggtgtacagccgctttgaggtgttttgtaaaaaggaagaagcgtctagcccaggggccggcgagggacccgcagaagagggtactagggattccaaagtggggaagttcgtgcctaaaatactgggaacctttaaatcaaaaaaatag

SEQ ID NO: 116617 - DNA, 933 bp, Artificial Sequence
  Description of Artificial Sequence: Synthetic coding sequence
atgggaaatcaggtggaaaagttgacccacctaagctacaaggaggtgcctactgccgaccccaccggagttgatagagacgatggcccccgcattggagttagttatattttcagtaatgacgacgaggatgtagaacctcaaccacccccgcagggacccgatggtggcggactgccagacggcggggatggcccgccaccgccacaaccccagccttacgacccaagacttcatgaagtggaatgttccgtgttctaccgcgacgagtgcatataccaaaagtctttcgctccaggctccgcagcactttctacctatacacctgagaatctcctcaacaagtgtaagccgggggatctcgtagagttcgttagccaagctcagtatccccactgggcagtttatgtgggaaattttcaggttgttcacctgcatcgactggaagtgataaatagcttcctcaccgatgcgagccaggggcgcaggggccgggtagtgaacgacctgtacaggtacaaacccttgtcctccagtgcagtggttcggaacgcactagcccacgtgggcgctaaggaaagagagctgtcttggcgtaatagtgagtctttcgcagcttggtgccggtatggcaagcgggagtttaaaattggcggagagctcaggatcggaaagcagccctatcgcttacagatccagctcagcgcgcagcggagccacactctcgaatttcaatccctggaggatcttatcatggaaaagagaagaaacgaccagattggcagagccgctgtgctccaggaactcgcaacccacctgcatccggccgaacctgaagagggcgacagcaatgttgcacggactacacccccaccagggaggccaccagctccgtcatccgaagaggaggacggagaggctgtggcgcattag

SEQ ID NO: 116618 - DNA, 999 bp, Artificial Sequence
  Description of Artificial Sequence: Synthetic coding sequence
atggaaccagtcggccggaaacgaagcagaaaggccgccaaagcccagcttgaggcccaggtcaccgcggcacagggagcaactaaagagggaagtggaatagccagcaacttccccggccagcccactatggagcccgtggggcgcaagcgcagtcggaaagcagcaaaggctcaactggaggcacaagtacgcgccgctcccgcgaagaaacataccggaaaagatcctgtgcgagacgaatgtgaagaacgtaatcctttcacagaaacccgagaggaggacgtcaccgatgagcacggggaacgcgagcctttcgctgaaaaggatgaacacactgggatccataccatgaagcttgagcatattgccgcagacatcaagaaaggcctcgctgcaaaacgggagatgatcaaaatcgacaaagctgcctacaggaaaaccaaaaatacaatcgagcgcgcacttaagaaaaaacagctgaagaggcagaagcgcgactatcgacacactaggaagctgctgaacgtgcttaaagagtatatcgctgagaagcagaaggatgacgaagcggaggaggccgaggcagctgccgccgccgccgaggccgcagccgccgcagaagcagcagcggccgccgctgaggtgattgtggtggaggacgaagaagaggaggagaaggaggaagaagaggaaaaggaagaagaggaggaggagggagaggaggaggggggcggagaggaaggagaggagggaggcgggggcggcgaaggtgaagaaacggaggaagaggaggaagaggaggaagaagaggaggaagaagagcagattaaggccttccaggaaaagcagaaaaggtggcagcaaccgaccggcgtccgcagctggcgccttagagagatgaaaccgctccttgagcagctccttaaggcagccaaggatactaaggataattattgcataattagttccagcgaagagtctgaactcgacaactag

SEQ ID NO: 116619 - DNA, 999 bp, Artificial Sequence
  Description of Artificial Sequence: Synthetic coding sequence
atggaaccggtaggaaggaagcgctcccgcaaagcagcaaaagctcagctggaagcccaggtgaccgccgcacagggcgccacaaaggaaggctccggcatagcctcgaactttccaggtcaacccactatggagcctgttggtaggaagcgcagtcgcaaagctgcaaaggcccaactggaggcgcaggtccgggccgcgcctgccaagaagcacactgggaaagaccccgtgagagacgagtgcgaggagagaaacccctttaccgagacccgagaagaagacgtgaccgacgaacacggcgagcgggaacccttcgccgaaaaagacgagcataccggcatccataccatgaaattggagcatatcgctgctgacatcaaaaagggcctggcagccaagagagagatgatcaaaatcgacaaggctgcctaccgcaaaactaaaaatactatcgaacgcgccttgaaaaagaaacagctcaaacgccaaaagagagattatagacacacacgaaagctgcttaacgtactgaaagaatacattgccgagaaacagaaagacgacgaggccgaagaagctgaggctgccgccgcggccgccgaggcggccgccgcggccgaggcggctgccgccgccgccgaagtcattgtggttgaagatgaagaggaagaggagaaagaagaggaggaagagaaggaagaagaggaggaggagggtgaagaagagggagggggcgaggaaggcgaggaaggaggtggtgggggcgagggggaagaaactgaggaggaagaagaagaggaggaggaggaagaggaagaggaacagatcaaagccttccaggagaagcaaaagcgatggcaacaacctacaggagtgcgctcatggcggctgcgtgaaatgaaaccgctgctggagcagctgctcaaggcggccaaggatacgaaggacaattattgcatcattagctcctctgaagagagtgaattagacaactag

SEQ ID NO: 116620 - DNA, 561 bp, Artificial Sequence
  Description of Artificial Sequence: Synthetic coding sequence
atggccgcctgggggaaaaagcatgccgggaaagatcccgtgagagacgagtgcgaagaaaggaacagattcaccgagactcgtgaggaagatgtaaccgatgagcacggtgaaagggagccatttgccgaaacagatgaacataccggcgcgaacacaaaaaagcccgaagacaccgctgaggacctgacagccaagcggaaacgcatgaagatggacaaaacatgcagcaagacaaaaaacaaaagcaagcacgccctgagaaagaaacagctgaagcggcagaagcgtgattacatccattcgttaaaacttctgaatgtgctcgaagaatacatcacagacgaacagaaggaagaggaggaagaggagggcgaagaagaggagttaattcgcatctttcaggaacagcaaaaaaaatggcagcaatatcggtccgtccgacgggagcgcctgaaagaaatgaaactgctccgggatcagttcgtgaaagctctggaggatttcgaggacctgtgcgaccgtgttttttcagatgaggactctgagctggacaactag

SEQ ID NO: 116621 - DNA, 681 bp, Artificial Sequence
  Description of Artificial Sequence: Synthetic coding sequence
atgcctgggttcctgtcattcttgagcgtcagtcttagatcaccggggagtggtatagctagttcatttcccggccagccggctaccgatcctgtcggacgcagggctgcaaaagcccaactcgaggcgcagttcatggctgcttggggaaagaagcatgcaggcaaggacccagtgagggacgagtgcgaggaacggaacagattcacagaaaccagagaggaagacgtgacagacgagcatggggagagagagccatttgcagagaccgacgagcacacgggcgccaataccaaaaagcctgaagacaccgccgtaggggccaacaacttcaagaattatccagtgcacatcggggtgagttctgagcagcatattctgttggactgctctctgagcagacaaaaaagggattatattcattccctcaaattgctgaatgtcctggaggaatatattactgacgagcaaaaagaggaagaggaggaggaaggagaagaagaggagcttattagaatctttcaggagcagcagaaaaaatggcagcagtacagaagtgtgcggcgtgagcggctgaaagagatgaagttgctgcgagatcagttcgttaaggcccttgaggattttgaggacctatgcgatcgcgttttcagcgatgaggacagcgaactcgataattag

SEQ ID NO: 116622 - DNA, 561 bp, Artificial Sequence
  Description of Artificial Sequence: Synthetic coding sequence
atggccgcctggggtaaaaaacacgcaggtaaggaccctgtcagagacgaatgcgaggagcgtaacaggtttaccgagacaagagaggaggacgtaacagatgagcacggtgaacgtgagcctttcgctgaaaccgacgagcataccggggccaatacaaaaaagcccgaagacactgccgaggacctgactgcgaaaaggaagcggatgaagatggataagacttgttctaagacaaagaataagagcaaacacgccttaaggaaaaagcagttgaaacggcagaaaagagattatatccattccttgaagctcctgaatgtgctggaggagtatatcaccgacgaacaaaaagaagaggaggaagaggagggggaggaggaagaacttattcgaatatttcaggaacaacagaagaagtggcagcagtaccgctctgttcgacgcgaaaggctcaaagagatgaaactcctcagggatcagttcgtgaaggccttagaggattttgaggacctctgtgatcgcgtctttagtgacgaggattcagaactggacaattag

SEQ ID NO: 116623 - DNA, 501 bp, Artificial Sequence
  Description of Artificial Sequence: Synthetic coding sequence
atggcggccaaagaccagctggaggtgcaggtcatggctgcccaggagatggagctcgcaggaaaggatccggtgtcccacgaacatgaagagaggaaaccggttaccgagacgaaggaaggcgatgttaccgatgaacatggtgaacgtggttcatttgctgagacggatgaacacacaggcgtggacacaaaggagctggaggacatcgcagccgacataaaagaacacctcgcagccaaacggaagcggattgagaaaatcgctaaggcctgctctgaaattaagaatcggatcaaaaatgtgctcagaacaacccagctgaaacgccagaagcgggactatcgaatctcattgaaactccccaatgtgctggaggagtttatcaccgacgaacagaaggacgaagagggcgacggagaaaaggaagaacaaatcaagatttttcaagagcagcagaaaagatggcaacaggacgggaaaggcaccgagagagactag

SEQ ID NO: 116624 - DNA, 501 bp, Artificial Sequence
  Description of Artificial Sequence: Synthetic coding sequence
atggcggctaaagaccagctcgaagtgcaagtgatggctgctcaggagatggaactagctggtaaggatccagtgagccatgagcatgaggagcgtaagcccgtgacggagactaaggagggcgacgttaccgacgaacacggtgaaaggggatcgtttgcggagactgacgaacatacaggcgtcgacactaaagaactggaggacattgccgccgatatcaaagagcatttggctgccaagcggaaaagaatcgaaaaaattgccaaagcttgtagcgagatcaagaacagaataaagaatgtcctgcgtaccacgcagctgaagaggcagaaacgggattatcgcataagcctgaagctgccaaacgtcctggaagaatttattacagatgaacagaaggacgaggaaggagacggcgagaaggaggagcaaattaagatcttccaagagcagcagaaacgctggcagcaggatgggaagggtaccgaacgcgattag

SEQ ID NO: 116625 - DNA, 381 bp, Artificial Sequence
  Description of Artificial Sequence: Synthetic coding sequence
taggacgtgacagatgagcacggtgagcgcggcagcttcgcggagactgacgaacataccggcgtggacaccaaagagttagaggacattgccgcggatatcaaggagcacctcgcggctaaaagaaagcgcattgagaaaattgcgaaggcgtgcagcgaaattaaaaacagaattaaaaatgttttgcgcaccacacagctcaaacggcaaaaacgcgattacagaatttcattaaagctgcccaatgtcctggaggagttcattacagatgaacagaaagatgaggaaggtgacggagagaaagaggaacagatcaagatatttcaagagcaacaaaagcgctggcagcaggacggcaaggggaccgaacgggactag

SEQ ID NO: 116626 - DNA, 387 bp, Artificial Sequence
  Description of Artificial Sequence: Synthetic coding sequence
atggcagctaaagatcagctcgaagttcaggtgatggccgcacaagaaatggaattagccggcaaagatccagtgagccacgaacatgaggagaggaagccagtgacagagactaaagaaggcgacgttacggacgagcacggggaacgcggctcctttgcagagaccgatgagcatacgggagtggataccaaagagcttgaggacatagcaggcatgttttatgaactgtttgttgtgtacgaaaactgcttccaaccctataatccatactctaggctttacgaactggttgacgataagactgtcctcaacgctttcttctcttatatagcttttaatgtgatctgcctcataattttcctcacttattttttcaattgttag

SEQ ID NO: 116627 - DNA, 1395 bp, Artificial Sequence
  Description of Artificial Sequence: Synthetic coding sequence
atgatggcacggcgggatcctaagcccggcgccaaaagactcgttagggcacagaccctgcagaaacagcgcagggccccggttggcccacgggcaccgcctccagacgaggaggatcccagattaaagtgtaagaactgcgaagcattcggccacaccgcgcggtcaaccagatgccctatgaagtgctggaaagccgctcttgttccccccaacttcggggagaaggaaggtaaagagaatctgaagccctggaagccacaagtcgaggcaaatccagggccccttaataaagacaagggagaaaaggaagagcggccaaggccacaagacccacagcgaaaggcgctcctccatatcttcagccggaagcccccggagaaacccttgcctaatcagaagggatcaaccgagtccagtgattacctccgcgtggcgagtgggccgatgcccgtacacacaacttccaaaaggcctcgagtcgatccagtgttgagcgaccggtccgccaccgaaatgtccgaccgcggcagtgtgctggctagtctgagccccctacgaaaagccagtctgtcctcttctagtagcttgggccctaaagagcgccaaacgggagccgccgcggacatcccccaaacagctgtgcgacaccagggtccagagcccctgctggtggtcaaacctacccattcttctccagccggtggctgtcgcgaagtaccccaagcagcctctaaaacacacggtctgctgcaggccgtgagtccgcaggcacaggataagcgccccgcggtaacatcacagccttgccccccagccgctacccacagccttgggctgggaagcaatctgtcttttgggccaggcgcgaagcgctccgcccccgctcccatccaggcctgccttaactttccaaagaaacccaggctcggccccttccaaattccagaatctgccattcagggaggggagctcggagctccagaaaatctgcagcctcctcctgccgcaactgaattaggacccaggacatcaccccagaccggtaccaggaccccggctcaggtgctgtcaggcgataggcagccgcctcactcaagaccttgtctgcctaccgcccaggcgtgtaccatgtcccatcacccggctgcttcgcatgatggggcacagccactcagggttctgttcaggagattagaaaatggcagatggtcttcaagtctccttacagctccttcgtttcacagccctgaaaagccaggggcctttttggctcagtccccccacgtttccgaaaagagcgagggtccttgcgtgagagttcctcctagcgttttatatgaggatctccaggtgccgagcagtagcgaggacagtgacagcgatctcgagtag

SEQ ID NO: 116628 - DNA, 45 bp, Artificial Sequence
  Description of Artificial Sequence: Synthetic coding sequence
atgatggccaggcgagacccaaagcctggcgctaaacgactatag

SEQ ID NO: 116629 - DNA, 1395 bp, Artificial Sequence
  Description of Artificial Sequence: Synthetic coding sequence
atgatggcccgcagggatcccaaacccggagccaagagactggtccgggcacagaccctacagaaacaacgccgagctcctgtgggccctcgtgcgcctcccccagatgaagaggacccacgcttgaaatgtaaaaactgcgaagcattcggacacaccgcacggtccaccaggtgtccgatgaagtgttggaaagcggccctggtccctcctaattttggagagaaagaggggaaagagaacctgaagccctggaagccgcaggtcgaggcaaatcccggaccgctaaataaggacaagggcgagaaagaggaaagaccccggccacaggacccacaaagaaaggccctgctgcacatcttttcaaggaagccccccgaaaagcccctcccaaaccagaaaggtagtaccgagagcagtgactatttgcgcgtggcaagcggccctatgcccgtgcacaccacctctaaacggcctagggttgatcccgtcttgtccgatcgaagcgccacagaaatgtctgacaggggatcggtgctggccagcctgagtcccctcaggaaggcctctttgtctagctcaagcagtctggggcccaaggaaaggcaaaccggagccgcagccgacatcccccagacagcggtgcgccatcagggcccagagccgttgctcgtagtcaaaccaactcactctagtccagcaggtggttgtcgcgaggtgccgcaagcagcctccaagacccatggcctacttcaagcggtgtcaccacaagcgcaagacaagcggcctgccgtaacaagtcaaccctgcccacccgcggcaacacatagcctgggcctcggaagcaatctgtccttcggacctggtgcaaaaagatcagccccagcacctatccaggcttgcttaaatttccctaaaaagcccagactgggtccattccagataccggaaagtgcaatccagggcggggaactgggggcccctgagaacttacagccacccccggctgccacagagcttggcccacggacctccccacagacaggcacacgcactccagcccaagtcctgtccggggatcggcagcccccacactctcgcccgtgtctcccaacagcgcaggcctgcacaatgagtcaccatcctgctgcttcgcacgatggcgcccagcccctacgggtacttttccgtcgactagagaatgggcggtggtcctcatctctcctgacagccccctcctttcatagccccgaaaagcccggagcgttcttggcccagtctccccatgtctcagagaagtccgaggggccttgtgtgagggttccaccatctgtgttgtatgaggacctacaggtgccaagctcctccgaagactctgacagcgacctggagtag

SEQ ID NO: 116630 - DNA, 1143 bp, Artificial Sequence
  Description of Artificial Sequence: Synthetic coding sequence
atggccgtcactgaagccagtcttttgcggcagtgcccactgctcctgcctcagaaccgctccaaaactgtgtacgagggctttatctccgcgcagggtagggatttccatttgcgcattgtgctcccggaggatctgcaactgaagaacgcaaggctgttgtgctcctggcagctgcgtacaattttaagcgggtaccatagaatcgtgcaacaacggatgcagcacagtcctgaccttatgtccttcatgatggagttgaagatgttgctggaggtggcactgaaaaatcggcaggagctgtacgctctccctcccccaccgcagttctactcgtcactcattgaagaaataggcaccctgggttgggataaattggtctatgcagacacatgttttagtacgatcaagctgaaagctgaagacgctagtggtcgcgaacatctcataacactcaagctgaaggccaaatacccggcggagagccccgactacttcgtcgatttcccagtgccgttttgcgcctcttggacaccacaagtcaacagtccgcagtcaagtttaatctccatctatagccaattccttgctgctatcgagtccctgaaggctttttgggacgtgatggacgaaatcgacgaaaagacatgggtgctggagcctgagaagcccccccggagtgccaccgcacgtcgtattgccctggggaataacgtgtccattaacatcgaagtggatccgcgccacccgacaatgctgccagagtgtttttttctaggggcggaccatgtggtcaaacctctcgggatcaaactgagcaggaatatccatctctgggacccagaaaacagtgtgttgcagaatctgaaggatgtgttggagattgactttcccgcacgggccatattggaaaaaagcgacttcactatggactgcgggatttgctatgcatatcagcttgatggcacaattcccgatcaggtgtgtgataacagccagtgtgggcagccattccaccagatctgtctgtacgagtggctgcgaggcctcctcacaagcaggcagagcttcaacattatctttggggagtgcccttattgttcaaagccaattacccttaagatgtccgggcgaaagcactag

SEQ ID NO: 116631 - DNA, 2580 bp, Artificial Sequence
  Description of Artificial Sequence: Synthetic coding sequence
atgacctctaagcaggccatgtcgagtaatgaacaggagcgcttactgtgctataacggcgaggtcctggtgtttcagctctccaaaggcaattttgccgataaagaacctacaaaaaccccgatcctgcatgtgaggagaatggtcttcgatcggggcactaaagtcttcgtgcaaaagtcaacagggttcttcacaatcaaggaggagaactcccacctcaaaatcatgtgctgcaactgtgtttcggatttcagaactggtattaacctcccttatatcgtcattgaaaagaacaaaaagaacaatgtgtttgagtactttctcttgatcctgcactccactaacaagttcgagatgcgtctctctttcaagctaggctatgaaatgaaggatggcttgcgggtattgaatgggcccctgatcctgtggcggcacgtgaaagcatttttttttatcagctcccagacgggcaaggtggtgtctgtttccggaaatttctcttcaatacagtgggctggcgaaattgagaatctgggcatggtcctgcttggcctgaaagaatgctgcctatccgaggaggagtgcactcaggaaccttccaagtcggactatgctatatggaacaccaaattctgcgtatatagcctggaatcccaggaggtgctctctgacatctacattatcccccccgcatacagctcggtcgtgacatacgtccatatctgcgccactgagatcatcaagaaccagctgcgcatctccttgatcgctctgactagaaagaatcaattgatctcattccagaacgggacccccaagaacgtgtgtcagcttcccttcggtgacccatgtgccgtgcagttgatggattctggaggcggaaacctcttcttcgtcgtgtcctttattagtaataacgcttgcgcagtgtggaaagagtcgttccaagttgccgccaaatgggaaaagctgagccttgtgctgatagacgatttcattggtagcggtacggaacaggtgctgttgctttttaaagactcactgaactctgactgtcttacttcctttaagatcaccgatctgggtaaaatcaattattctagcgaaccctccgattgcaatgaggatgacctattcgaagacaaacaggagaaccgctacctcgtagtgccccccttggagacagggctgaaggtgtgtttctcaagcttcagggaactgaggcagcatctgctcttaaaagagaagataatttccaaatcctacaaagcactgataaaccttgtgcagggaaaggacgataataccagtagcgccgaagagaaggagtgtctggtcccactctgcggggaagaagagaacagcgtccacattctggatgagaaactcagtgataactttcaagacagtgagcagctcgtggagaaaatttggtaccgcgtgattgacgattccttggtagtgggcgtgaagactacctcctctctgaaactgagcctaaacgacgttactctgagtctgctgatggatcaagcacatgacagcaggtttcgtttgctgaagtgtcaaaatcgtgtgatcaagctatcaacaaaccctttcccggctccatacctgatgccctgcgagatcggattggaagctaaacgggtcaccctgaccccagactctaagaaagaggagtcattcgtgtgcgagcatcccagcaagaaggaatgtgttcagattattactgcagtgaccagcctgagtcccctgttaactttctccaagttttgttgtaccgtcctactgcagattatggagcgcgaaagtggaaactgtcctaaagatcgctacgtggtgtgtggcagggtctttctcagtctagaggatttgtcaacaggcaaatacctgctgaccttcccaaaaaagaagccaattgagcatatggaggatctattcgccctgctcgccgccttccacaaaagttgtttccagattacttcacccggctacgccctgaatagcatgaaagtgtggctgctggaacatatgaagtgcgagatcattaaggaatttcctgaagtctacttctgtgagaggcctggcagcttctatgggaccctgttcacatggaagcaacgcacaccatttgaagggatcctgatcatctactcgaggaatcaaactgttatgtttcagtgtctccataatcttatacgaatcctgccaatcaattgcttccttaaaaatctcaagagtggatccgaaaattttctgatcgacaatatggcctttactctagaaaaggagctggtgactctgagctccttgagctcagctatcgcgaaacatgagtcaaatttcatgcagcgctgcgaagtaagtaaaggcaagtcgtccgtggtggccgcagctctgtcagacaggcgagagaatatccacccttacaggaaggaactgcagcgggagaaaaagaaaatgcttcagaccaatctgaaggtgagcggagccctgtacagggaaatcactttaaaggtggccgaagtgcagctcaaatccgacttcgcagcacaaaagttaagcaacctatag

SEQ ID NO: 116632 - DNA, 2580 bp, Artificial Sequence
  Description of Artificial Sequence: Synthetic coding sequence
atgacctccaagcaggccatgtcctccaatgagcaggagaggctgctgtgctacaatggagaagtcctggtgttccagttgagtaagggcaattttgcggacaaagaaccaacaaagaccccgatccttcatgtgcgtcgcatggtcttcgacagggggaccaaggtcttcgtgcaaaaatccacagggtttttcaccataaaggaggagaactcacacttgaaaattatgtgttgcaactgcgtgagcgatttcaggactggcatcaacctgccctatatcgtgatcgaaaaaaacaagaaaaataatgtgtttgaatacttcctgttaattctacactctaccaataagtttgagatgagattgtcgttcaagcttggatatgaaatgaaagatggtttgcgcgtgttaaatggacctctgatcctatggcgccacgtgaaagcatttttctttataagttcacagacggggaaggtggttagcgtaagcggcaacttctcctctatccagtgggctggcgaaatagaaaacttggggatggtgctgttgggcttgaaggagtgttgtctgagcgaagaggaatgcacacaagaacccagcaagtccgattacgctatctggaacacaaagttttgtgtctattctctggaatctcaggaagtgctgtccgatatatatattattccaccagcctatagcagcgtggttacatacgttcatatttgcgcgacggagataatcaaaaaccaactcagaatttctcttattgctctgacaaggaagaatcaactcatcagtttccaaaatgggacgcccaaaaacgtatgccagctgcccttcggggatccatgcgctgtccagctgatggatagtgggggcggaaacctgttctttgtggttagctttatttctaacaatgcgtgtgcagtatggaaagagtcctttcaggtagccgcgaagtgggagaagctaagtcttgtgctgattgatgactttatcgggtcagggaccgagcaggtgcttttgctctttaaagatagcttaaatagcgactgtctcacaagttttaaaataaccgatctggggaaaatcaattacagcagcgagccctcggactgcaatgaagacgatctgttcgaagataagcaggagaaccgttatctcgttgtacccccactggaaacaggcctgaaggtgtgtttttctagcttcagggagttgagacaacacctccttcttaaggagaagatcatttctaaatcctacaaagctctgatcaacctggtgcaggggaaagatgataacaccagcagtgccgaggagaaagaatgcctggtgcccctttgcggagaggaggagaatagcgtccacatacttgatgaaaaactatccgacaacttccaagattccgagcagcttgtggagaaaatctggtatagggttatagacgatagcctcgtagtcggggtgaagactacttcaagcttgaagttgtctttgaatgatgtgacacttagtttgctcatggaccaggcccatgattctaggttcaggctgctcaagtgccaaaaccgggttattaagctctctacgaatccatttccggcgccgtatcttatgccttgcgaaataggcttggaagccaagagagttaccctcacacccgacagcaagaaagaggaatcattcgtttgcgaacatccatctaagaaagaatgcgtacagatcataaccgcggtgaccagcctgagtcctctgcttacctttagcaagttctgctgcacagtgctgctgcagataatggagagagagtcaggaaattgccccaaggatcggtacgtcgtctgtggtcgagtgttcctgagtctggaggacctgtccaccggcaagtacctcctgacgtttcccaagaagaagcccattgagcatatggaagatttgttcgccctattggctgccttccacaagtcatgctttcagatcaccagcccaggatatgctctgaattccatgaaggtgtggttgctggaacacatgaaatgcgagattatcaaagaattccctgaggtttacttctgtgagcgacccggtagcttctacgggactttgttcacatggaagcagaggaccccttttgaggggatattgattatctattcccgcaaccagacggtcatgtttcaatgccttcacaacctcatacgcatactcccaattaattgtttcttgaaaaacctgaagagtggctccgaaaattttcttatagacaatatggcttttaccttggagaaagagctcgtgaccctgtcaagtctttcctctgccatcgcaaagcacgaatctaatttcatgcaaaggtgtgaggtgtcaaagggcaaaagctccgttgttgcagccgccttaagcgatcgcagggagaacattcacccctataggaaggagttgcagagagagaaaaagaagatgttacagaccaatctcaaagtcagcggggccttgtatagggagattacattgaaagtcgcagaagtgcagctcaaaagtgactttgcagctcaaaagctgtcaaacctctag

SEQ ID NO: 116633 - DNA, 2457 bp, Artificial Sequence
  Description of Artificial Sequence: Synthetic coding sequence
atgacctcgaagcaggcgatgtcctcaaatgagcaagagaggctcctgtgttataacggagaggtgcttgtttttcagctgtcaaagggaaatttcgcagataaggagccaaccaaaacaccaatacttcacgtgcgtagaatggtcttcgatcgcggaactaaggtttttgtgcagaagtcaactggttttttcacaatcaaggaggagaactcccacttaaaaataatgtgctgcaactgcgtgtctgactttcgaactggtattaatcttccctatattgtaatcgagaagaacaagaaaaacaacgtattcgaatattttctgctgatccttcacagcacaaataaatttgagatgcgtctgagttttaaactaggatatgagatgaaggatggtcttcgggtcctgaatggcccactcatactttggcgccacgtcaaggccttcttcttcatcagttcccagaccgggaaggttgtgtccgtgagtggaaatttttctagtatccagtgggcgggagaaatagaaaaccttgggatggtcttgttgggactgaaggagtgttgcctcagtgaggaagaatgcacacaggagccctcaaaaagcgactatgcaatctggaacacaaagttttgcgtgtacagcctggagagtcaggaggtgctctctgacatatacattataccgccagcctatagctccgtcgtaacatatgtccatatttgcgccactgagatcatcaagaaccagctgaggattagcctgattgccttgacacgcaagaaccagttgatttcttttcaaaatgggacccctaagaatgtgtgtcagttgccctttggcgatccgtgcgccgtgcaactcatggactctggggggggcaacttgttttttgttgtgtccttcatatcgaacaacgcctgcgcagtgtggaaagagtccttccaggtggccgccaagtgggagaaactctccctggttttgatagacgactttattggtagtgggacagagcaggtgctcttgctgttcaaagacagccttaacagcgattgtttgacgtccttcaaaattactgatctcggcaaaatcaactattcttccgaaccctcggattgcaacgaggatgatctgtttgaggataaacaggagaaccgatatttagtggtcccaccattggaaacaggactgaaagtgtgtttctctagctttagagagctgagacagcatctgctgttgaaggagaaaatcattagcaagagctacaaggctctgattaatctcgtgcagggcaaagacgacaatacttcttcagccgaagagaaagagtgcctcgtgccattgtgcggagaggaagagaactccgttcatatcctggatgagaagttgtctgacaacttccaggattccgaacagcttgttgagaagatctggtacagagtgattgacgatagcctagtagtgggtgtgaagacaacctcctctcttaaactgtctcttaacgacgttacactctcactgctgatggaccaagcacatgactcccggtttaggcttctcaaatgccagaatagagtcatcaagctgagtactaatcctttcccggcgccgtatctcatgccatgtgaaattggcttggaggccaagcgggttactctgaccccagattcaaagaaggaggagagctttgtgtgcgagcacccgagcaagaaagaatgtgtgcagatcataacggcagtgacctcgctctcacccctgctgaccttttccaagttctgctgtactgtccttttgcagatcatggagagggagtcgggaaactgtcctaaagaccgctacgtcgtgtgcggtcgggtgtttctctcactggaggatctatctaccggcaagtatttactgacctttccaaagaagaagcccatagaacacatggaggatctgttcgccttgctggcagcttttcataagtcctgttttcagataacatctcctggctacgcattaaactccatgaaggtctggctcctggaacacatgaagtgtgaaattataaaagaatttcccgaggtctacttctgtgaacggcccggatctttttacggcactctgtttacatggaagcagagaacaccgttcgagggcatcctgattatttattcaaggaaccagacggtgatgttccagtgtctgcacaacttgattcggattctaccaatcaattgttttcttaaaaatctgaaatcgggctcggaaaactttctgattgataatatggcctttactttggagaaggagctggtaaccctcagtagcctgagctccgctatcgctaagcacgaaagcaattttatgcagaggtgtgaggtttctaaaggcaagtcttctgtagtggccgccgccctgtccgaccgtagagaaaacatacacccttatcgtaaggagctgcaacgctag

SEQ ID NO: 116634 - DNA, 1677 bp, Artificial Sequence
  Description of Artificial Sequence: Synthetic coding sequence
atggctcaggacagcgtggatttaagctgtgactatcagttttggatgcaaaagctgagtgtctgggatcaggcgagcacgctagaaacacaacaagacacgtgcctgcacgtggctcaatttcaggagtttttacgcaagatgtatgaggcactgaaagaaatggattcaaacactgtgattgaacggttccctacaatcgggcagttactggctaaggcctgctggaatccgtttatccttgcatacgatgagtcacaaaagattctgatctggtgcctgtgttgcctcattaataaagagccccagaactccggtcagtcaaagctgaacagctggatccaaggggtcctctcacatattctgtcagcgctccgcttcgataaagaggttgccctgtttacccaggggctgggctatgcacctatcgattattatccaggactgctgaagaacatggtgctgagtctcgcttcagagcttagggagaaccatttgaatggctttaacactcaacgtaggatggcacctgaacgagtggcatctctctcgagggtgtgtgttccgctcatcaccttaaccgatgtcgaccccctggtcgaggccctactgatttgtcacgggcgggagccccaggaaattctacagcccgaattcttcgaggccgttaacgaggccattctgctaaaaaaaattagcctgcccatgtccgccgtggtttgcttgtggttgcggcacctaccaagtctggagaaggccatgctgcatctcttcgaaaagctcatttcctcggagcggaactgtctgcggcgtatagagtgtttcatcaaggattccagcctgccccaggccgcttgccatcccgccatctttcgcgtcgtcgatgagatgttcaggtgtgcattacttgaaaccgacggcgcacttgaaatcattgctaccattcaggtgttcactcagtgctttgtcgaggccctggaaaaggctagtaaacagcttaggttcgcattaaagacctactttccctacacaagcccgtccctggctatggtgctcctgcaggaccctcaagacatcccccgggggcactggttacagacccttaagcacatctccgagctcctgagggaagccgtcgaggatcaaacacacggatcttgcggaggacctttcgaatcatggttcttgtttatccactttgggggctgggccgaaatggtggcggaacagctgctcatgagcgccgccgagccacccactgcgctgctctggttgttagcattttattatgggccaagagatggacggcagcagagagcccagaccatggttcaggttaaagcggtcttaggccacttactggccatgtctagaagtagttccttatctgctcaggatctgcagacagtggcaggacagggtacggacacagacttgcgcgctccggcccagcaactcattcgtcatctgcttctgaacttcctgctgtgggctccaggcggtcacacaattgcctgggatgttattaccctgatggcccacacggctgaaattacccacgagatcatcgggtttctggaccagactttatatcgatggaatcggctgggtatagagtctccccgctccgaaaagctcgcaagagagctcctgaaagagttgcgaacacaggtgtag

SEQ ID NO: 116635 - DNA, 1677 bp, Artificial Sequence
  Description of Artificial Sequence: Synthetic coding sequence
atggctcaggactccgtggatctttcctgcgattaccagttctggatgcagaagctcagcgtatgggatcaggcctctaccctggaaacgcagcaagacacctgcttgcatgtcgcccagttccaggagtttctgagaaagatgtacgaggccttaaaggagatggatagcaataccgttattgagcgctttcctactattggccagctacttgcaaaggcttgttggaacccctttatcctcgcttatgacgaatctcagaaaattttgatctggtgcttatgttgtcttattaataaagaaccccaaaactccggccagagcaagctcaactcctggatacagggggtcctgtcccatattctcagtgccctgagattcgacaaagaagtggccctgtttactcaggggctcgggtacgctccaattgactactatcccgggcttcttaaaaatatggttctctcattagccagtgagttgcgggagaatcatctcaacggatttaatacccaacgtcggatggccccagagagggttgccagcttgagtagggtgtgcgtgcctctaatcacactgactgatgtcgaccccctggttgaggctcttctcatatgccacggcagagagccacaggaaattctccagcccgagtttttcgaggccgtgaatgaagctattttgcttaagaaaatctccctgcctatgagtgcggtggtctgtctgtggttacggcacttgccctctctcgaaaaggcaatgctgcacctattcgaaaagctgatttctagtgaaaggaactgcctgcgccgcattgaatgcttcattaaagactccagtctccctcaggccgcttgtcatccggcaattttccgagtggtcgacgagatgtttagatgcgccctgctagaaaccgacggggccctggaaataattgcgacaatccaggtcttcacacaatgtttcgtggaagcacttgaaaaggcgtccaagcagctgcgttttgcactcaagacatatttcccatatacttctcctagcctggcgatggttttgctgcaggatccccaagatataccaagagggcattggctacagactttgaaacatatttctgaactcttgcgagaagctgtggaagaccagacccatgggagttgcgggggacccttcgagtcatggttcctattcatccatttcggcggctgggccgagatggtggctgaacagctactcatgagtgctgctgaacctcctaccgcgcttctctggttactggccttttattatggtccgcgggacggaaggcagcagagggcgcaaaccatggtgcaggtcaaggcagtgctgggtcacctgctggctatgagccgaagtagcagtctcagcgcgcaagatttgcagacagttgccggtcagggaactgacacggatctgagggcccccgcccagcagttgataaggcatttgctccttaattttctgctttgggctcctggtgggcacactatagcctgggatgtcatcactctaatggctcacaccgccgagataacacatgagatcatcggcttcctggaccagacactctaccgctggaacagactaggcattgagtctccgagatctgagaaactcgcaagagagctacttaaggagctccgaactcaggtctag

SEQ ID NO: 116636 - DNA, 453 bp, Artificial Sequence
  Description of Artificial Sequence: Synthetic coding sequence
atggcacaggactctgtggatctatcttgtgactaccaattctggatgcagaaactttctgtttgggaccaggcatccactctggagacacagcaagacacctgcctgcatgttgcgcagttccaggaattcctgcgcaaaatgtatgaagccctcaaagagatggatagtaacacagtgatagaacgattccctaccatcggccagctgctggctaaggcctgttggaatccttttattctggcttacgacgaatcacagaagatcctgatttggtgcctttgttgtctcataaacaaagagccccagaattctggacagtctaaattaaatagttggatccagggggtgctctcccatattctatctgcgttgagattcgacaaagaagtcgccctgtttactcagggtctgggttatgcaccaatcgactattatccagggcttttatag

SEQ ID NO: 116637 - DNA, 4416 bp, Artificial Sequence
  Description of Artificial Sequence: Synthetic coding sequence
atggtgagcaagagaagattgtctaaaagtgaggacaaagagtctctgaccgaggacgcaagcaagaccaggaagcagcccctgtccaaaaagacaaagaaatcacacattgctaatgaggtggaggagaacgactccatcttcgttaaactgcttaaaattagcggtattatcctgaaaactggcgagtcacaaaatcagctggccgtcgaccaaattgcctttcagaaaaagcttttccagacacttaggcggcacccatcatacccaaagatcattgaagagtttgtgtctggactagaatcatacattgaggacgaagattcattccggaattgtctgctgtcttgcgagaggctgcaagacgaagaggcctctatgggtgcctcttactcaaagagtttgattaagctgcttctgggcatagacatcctgcaaccagcaattatcaaaacgctgtttgagaagctccctgagtacttcttcgagaataaaaattccgacgagattaacattcccaggcttatcgtgagccagctgaaatggttggatcgcgtggtggacgggaaggatctaacaacaaagatcatgcagctgatctcaatagctccagagaatctgcagcacgatattattacttctctgcctgaaatactgggagattcccaacacgccgatgtcggcaaagagttaagcgatcttctcatagagaatacatccctcaccgtgcccattttagatgtgctctcctccttgcgcctggaccctaattttctgctcaaagttagacagctggtaatggataaactgtctagtatccggctggaggacttgccggttatcatcaagttcatcctacactctgtgacagcaatggacaccttggaggtaatttccgagctcagggaaaaacttgatttgcagcactgtgtgcttccctcacgactgcaagcttctcaggtgaaactcaagagcaaaggcagggcctcatctagcgggaaccaggagtcaagcggccagagctgtattattctattatttgatgttattaagagtgcaattaggtatgaaaaaaccatctccgaagcctggattaaggcaatagagaatacagcctctgtcagcgagcacaaggtgttcgatctggtgatgttattcatcatttactccactaatacccagactaaaaagtacattgaccgggtgctgcggaacaagatccggtcaggatgcattcaggaacagctcttacagagtaccttttctgttcactatcttgttctcaaagatatgtgctcctccattctatccctggcacagtccctgctacactcactggaccaatcaatcatctcattcggtagccttctttacaagtacgccttcaagttttttgatacgtactgccagcaagaggttgtaggagcccttgtgactcatatttgctcaggcaatgaggccgaggtggacaccgctctcgacgttctgctcgagttggtggttctcaatccttcggcgatgatgatgaacgcagtgttcgtgaaaggcattctggactatcttgataacatctcaccacaacagattcgcaagctgttctatgtactgtccactctggctttttccaagcagaacgaagcctccagccacattcaagatgatatgcacctcgtgattcgtaaacagctcagctccactgtgttcaagtataagctgatcgggattataggggccgtgaccatggcgggtatcatggccgctgatcgtagtgagagcccgtctctgacccaggaacgagcaaatctaagcgatgaacagtgcacccaggttacctctcttttgcagcttgtccattcctgcagcgagcagagtccccaggccagcgcattatactatgatgaattcgcaaacctgattcaacatgagaagttggatcctaaggccttggaatgggtcggccacactatttgcaatgattttcaagacgcattcgtagtcgactcatgcgtggttccagaaggcgatttcccctttcccgtgaaagcactgtacgggctggaggagtatgacacacaagacggcatcgccattaacttgctgccccttctgttcagtcaagatttcgcaaaggacggtggccccgttacttcacaggaatcaggccagaagctggttagtcctttgtgcctggctccgtatttccgtttgctcaggttgtgcgttgagcgccagcacaatgggaatcttgaggaaatcgacggtttgctggactgtcctatttttctgactgatcttgagccaggcgaaaagctggaatcgatgtctgcaaaggaaagatcttttatgtgcagcctgatctttctaaccctcaactggttcagagagatcgtgaacgccttttgtcaagaaaccagccctgaaatgaagggcaaggtgttaacccggcttaagcacatcgtggagctgcagatcatcttggaaaaataccttgcagttacccccgactacgtcccaccattaggaaatttcgatgttgaaacactggatatcacaccccatactgtgacagccatcagtgctaaaattaggaagaagggtaaaatcgaacgcaagcagaagactgacggttccaagacctcgtcttctgatactttatctgaggagaagaatagtgagtgcgatcctacgcccagccacagagggcagctgaacaaagaatttactggcaaagaggagaaaacaagtcttttgctgcacaactctcacgccttcttccgcgaactggacatcgaagtgtttagcatcctgcattgcgggcttgtcacgaagtttatactggatacagagatgcacaccgaagccacagaagtagtgcagctggggcctcctgagcttctgttcctgctggaagacctgagccagaagctggaatcaatgctgacaccgcccattgctaggcgtgtgccatttttaaaaaataaggggagtagaaacattggattcagtcacctgcaacagaggtctgctcaggagatagtccactgtgtttttcagctgctgacacccatgtgcaaccatttggagaatattcacaactactttcagtgcctggccgcagaaaatcacggcgtcgtggatggtcctggagtgaaggtgcaggagtaccacattatgtcaagctgttaccaaagactcctgcagatttttcatggactcttcgcatggagcgggttctcccaacccgaaaatcaaaatctgctgtatagcgccttgcacgttttgagctccagactcaaacaaggggagcatagccaacccctggaagaactgctgtcccagagtgtgcactacctccagaactttcaccagtcaattccaagctttcagtgcgcgctctatctgatcagactattaatggtaattctggagaagagtactgcaagcgctcaaaacaaagaaaagatcgcctctcttgctcggcagttcttatgccgagtgtggccttctggagacaaggagaagtcgaatatctccaatgatcagctgcacgcgctgttgtgcatctatctcgaacacacagagtctattctgaaggccatagaggagatcgccggggttggcgtgccagaacttattaactccccaaaggacgccagctcatccacttttcctaccctgaccagacatacttttgtcgttttctttcgggtgatgatggccgaactcgagaaaactgttaaaaagattgaacctgggactgctgctgactctcagcagatccacgaggaaaaactcctgtactggaacatggctgtccgggacttttccatcctaatcaatttaattaaggtcttcgatagccacccagtactccacgtctgccttaagtacggccgcctgttcgtcgaggctttccttaagcagtgtatgccgctcttagatttctcatttcgaaagcatcgtgaggacgtcctgtctcttctggagacatttcagctggacacaaggctcctgcaccacctgtgtgggcattctaagatccaccaggatacgcgcctgactcaacacgtccccctgctcaaaaaaaccctggagctgctggtatgccgagtaaaggccatgttaacgttaaacaactgccgcgaggcattttggctgggcaatcttaagaacagggatctgcagggagaagagatcaaaagccagaactcccaagagtccacagctgatgagagtgaagacgacatgagctcgcaagcatccaaatcaaaagcgactgaggtgtctctgcagaatcctccagaatcaggcacagatggatgcattttgttgattgtgctctcttggtggtctaggaccctgccaacgtacgtgtattgtcagatgcttttgtgcccatttccctttcccccttag

SEQ ID NO: 116638 - DNA, 3750 bp, Artificial Sequence
  Description of Artificial Sequence: Synthetic coding sequence
atggtgtcaaagaggcgcctgtcaaagagcgaggacaaagagtctctaaccgaagatgcctcaaagaccagaaaacagcccctgagtaaaaaaactaaaaaatcccacatcgcaaacgaagtcgaggagaatgattctatcttcgttaaactgcttaaaatcagtgggataatcctgaaaacaggcgagagccagaaccagctcgcagttgaccagatcgcctttcagaagaaactgtttcagaccctgcggcggcatccatcgtacccgaaaataattgaggagttcgttagcggtctggaatcatatatagaagatgaagattcgttccggaattgcttactgagttgcgagagactccaggacgaggaggcgagtatgggagcttcctacagcaagtctcttataaagctcctgctcgggattgatattctgcagcctgctatcatcaagactctgttcgaaaagctgcccgaatacttctttgagaataagaattcagacgaaatcaatattccacgacttatcgtaagccaattaaagtggctagaccgagttgtggatggcaaagacctgaccactaaaattatgcagttgatatccatagcacctgagaatctccagcacgatataatcactagtttacctgagatcttgggggacagccagcatgctgatgtgggaaaggagttatccgatctgctcatcgagaatacaagcctaacagtccccatattggatgtacttagttccttacgccttgaccccaattttctgctaaaggtgcgccaactggtcatggataaacttagctcaataaggctcgaggaccttcccgtcatcatcaaatttattttacactctgtgaccgctatggacactctggaggtgatctccgaactcagagagaagctggacctgcaacattgcgtgttaccatcccgactgcaagccagccaggtcaagctgaagagcaagggtcgtgcctctagtagcggaaatcaggagtcgagcggacaatcctgtatcatactgttgtttgacgtcattaaaagcgctattcggtatgagaagacaatctctgaagcgtggatcaaagccatcgaaaacacggcctccgtgagcgagcacaaagttttcgatctggtaatgctctttattatttattcaacaaatacacagacgaaaaagtacattgaccgagtgctgcgcaacaagattaggagtggttgcattcaggaacagttgctgcagtctaccttctccgtgcattacctcgtactgaaggatatgtgttcctctattctatcactggctcaatctctgctgcactccttggaccagagcattatttccttcggttctctgctgtacaagtacgcttttaagttcttcgacacttattgccaacaggaggtcgtcggggcccttgtcactcacatatgctcagggaatgaagcagaggtggacacggccttagatgtattgctagaattggtcgtgctaaatccatccgccatgatgatgaatgctgtttttgtgaagggaattctagactacctggacaacatttccccccaacaaattcggaagctcttttacgtgctgtccacacttgctttctctaaacaaaacgaggcgtccagccacattcaggatgacatgcacctggtgatccgtaagcagctgtcatccacagtgtttaagtacaaactcattgggataattggggctgtaacaatggcaggaattatggctgccgataggagtgagagcccaagcctaacgcaggagcgcgccaatctctcagacgagcagtgtacacaggtgacctctctcctgcagctcgtgcactcttgttccgaacaatcgccccaggctagcgccttatactatgacgaattcgcaaacttgatccagcacgagaaactggatccaaaggcactggaatgggttgggcacacaatctgtaacgactttcaggacgctttcgttgtggactcatgtgttgtgcccgagggagattttcccttccccgtgaaagcgctgtatggcttagaggaatacgacacacaggacggtatcgccattaacctgctgcccttactcttctcccaggactttgccaaagatggcggaccggtaacgtcccaggaaagcgggcagaagctcgtttcccccctgtgcttggccccctatttccggctactaaggctgtgtgtcgagcgccagcacaatgggaatctggaggaaatagacggcctgctcgattgcccaatattcttaactgacctggaacctggcgagaagctggagtccatgagtgccaaggaaaggagttttatgtgttctctgatctttttgaccctcaactggttcagggaaatcgtcaacgctttttgtcaggaaacaagccctgaaatgaagggtaaagtgctcacccgcttgaagcacatcgtcgagctccagatcatactggagaagtacctagctgtgactcctgattatgtgcccccactgggcaactttgacgtggaaaccttggatatcactccccacactgtgacggctatatctgcgaagattcggaaaaaggggaagatcgagaggaagcaaaaaactgacgggagtaagacctccagttcagacacactctcggaggaaaaaaactctgaatgcgacccgactccttcccatagagggcaactgaacaaggaattcactgggaaggaggaaaagacttccctgctcctccacaatagccacgccttcttccgcgagcttgatatagaggtttttagtattcttcactgtggcttagtgactaagttcatcctcgacaccgaaatgcacactgaggccacagaggttgtccagttaggacctccagaattactgttcttactggaggatttgtcacagaaactggagagcatgttgacccctcccatcgcccggcgcgtgccattcctgaaaaataagggaagtcgaaatataggtttttcgcacttgcagcaacgatcagcacaggagatcgtgcactgtgtgtttcaactgctgacccctatgtgcaaccatctggaaaacattcacaactatttccagtgtctggcagccgagaatcacggtgtcgttgatggtccgggggtgaaggtacaggagtatcatataatgtcaagttgttaccagcgattgctgcaaatttttcacggcttgtttgcatggagtggcttctctcagccagagaatcagaatcttttgtatagtgcactccacgtgctttcatcacggctcaagcaaggggagcacagccagcccctggaggagctcctttctcaatccgtgcactatctgcagaactttcatcaatctattccgagtttccagtgcgctctgtacctcatccgcctgctgatggtgatcttagaaaagtccacagcatccgcccagaacaaggaaaagatagctagcctggcaagacagttcctgtgccgtgtatggccctcaggcgacaaggaaaaaagtaacatttccaacgaccagctgcatgctttactgtgtatttacctggagcacacagagtcaatactcaaggcaatagaggaaatagcaggcgtgggggtacccgaactcatcaacagccctaaagacgccagctccagtacttttcccaccttgactcggtttatgaagcggaatagttcgactggcacctggctttttgaaacatctgtgtcgtccagcacctag

SEQ ID NO: 116639 - DNA, 4356 bp, Artificial Sequence
  Description of Artificial Sequence: Synthetic coding sequence
atggttagcaaacgcaggctcagtaaatcagaggataaggagtctcttacggaggatgcaagcaagacaagaaaacagcctctctccaaaaaaaccaaaaaatcccacattgctaatgaggttgaagagaacgactctatattcgtgaagttacttaaaatttctggcattattctgaaaacaggcgagtcgcagaaccagctggccgtggatcagatcgcattccagaaaaagctgttccaaactctgcgaagacacccatcttatcctaaaatcattgaagaattcgtgtccggactggaatcatatattgaagatgaggactcttttcggaattgtctactgagctgtgagaggctccaagacgaggaggcctcaatgggagcaagctacagcaaatcattgattaaactactgcttggtattgatatcttacagcccgctatcatcaaaaccctgtttgaaaagttgccagaatatttcttcgagaataagaatagtgatgagatcaacataccaaggctcatcgtgtctcagttaaaatggttagatcgcgtggtcgatggaaaggatctgacaaccaaaattatgcagctcattagcattgcccccgaaaatctccaacacgacattataactagccttccagagattcttggcgacagccagcacgccgacgttggaaaggagctgtcagatctcctgatcgagaacacaagcttgacagtacctattctcgacgtgctgtcctccctcaggctggatcctaattttcttttgaaggtcaggcaactggtgatggacaagctttctagcatccggcttgaggatctgcctgtgattatcaagtttatcctccatagcgtgactgccatggacacactagaggtaatcagtgagcttcgcgaaaagctggacctgcaacactgcgtcctcccgtccagactccaagctagccaggtcaagctgaagagcaaaggtcgcgctagttcaagcggtaatcaagagtctagtggccagtcctgtattattcttctatttgatgtgatcaagagcgctatacgctatgagaaaacaatcagtgaagcctggattaaggcaattgagaacacggccagtgtgagtgagcacaaagtgtttgatctggtgatgttgtttatcatctactctaccaacacgcagactaaaaaatacatcgatagggtgttgcgtaacaagatacgtagcgggtgcatccaggaacaattactccagtccacgttctccgtgcactacctcgtgctgaaagacatgtgtagtagcattctctcgcttgctcaatctctgttgcactccctggatcagagcatcattagtttcggctctttgctttacaaatatgcgtttaaattcttcgacacttactgtcagcaggaggtggtgggtgccttggtgactcatatatgctcagggaatgaggccgaagtggacaccgccctcgatgtcctgctggaactggtagtgctcaaccctagtgctatgatgatgaacgctgtgtttgtgaagggtatcctcgactacctggacaatatcagccctcagcaaatcagaaaactgttttatgtcttgagcacccttgcattctccaaacagaatgaggcctcctctcacattcaagacgacatgcatttggtaatccgcaagcagctgtcgagcaccgtttttaaatacaagcttatcggcatcattggcgcggtcaccatggctggtatcatggccgccgacagatccgaatctccttccctaacacaggaacgtgccaatctctcagatgagcagtgcacccaggttactagtctactacaactggtccactcctgctccgaacagtcacctcaggcatccgcactgtattacgatgagttcgcaaatcttatacagcacgaaaaactggaccccaaagcgctggaatgggtcggacataccatctgcaacgattttcaggatgccttcgtggtggacagctgtgtagtccccgagggagattttccgtttcctgtcaaagccttgtatggtttggaggaatatgatacacaggatggaattgctatcaacctgttgccactcctgttttctcaggactttgcaaaagacggcggccccgttacatcccaggagtctggccagaagctggtgtcacccctgtgtctggctccgtactttcggttactgcggctatgcgttgagcgtcagcataatggcaacctggaggagattgatgggctgctcgactgccctatatttctgacagacctggagcctggtgaaaagttggaatctatgagcgccaaggagcgcagctttatgtgctccctgattttcttaactcttaattggtttcgcgaaatcgtcaatgcattttgtcaggaaacctctccagaaatgaaaggcaaggtgttgacccggctcaaacacatagttgagttgcagatcatcctcgaaaaatacctcgcagtcacccctgactatgtcccccccctcggtaactttgatgtggaaacacttgatattacccctcacactgtgacagcgataagcgcgaagattagaaagaaaggtaagatcgaacggaaacagaagacggacgggtccaagactagcagttctgacacgctgtcagaagaaaaaaactctgaatgtgatccgacaccatcacaccggggccagctcaataaagaattcaccggaaaggaggagaagacgtccctcctcctccacaactcacacgctttctttcgagagctggacatcgaggtgttctcaatcctgcattgcggcttagtgaccaaattcattttggatacagaaatgcacaccgaagccacagaggtagtgcaactcggccccccagaactcctgttcttgctggaggatttgagtcaaaagctcgagagtatgctcacccctccaattgctaggcgcgttcctttcttgaaaaacaagggtagtagaaacatcggattcagccacctgcaacagaggtcggcacaagaaattgtgcactgcgtgttccaattgcttaccccgatgtgtaatcatcttgagaacattcataactactttcagtgcctggccgccgagaatcacggggtcgttgatgggcctggcgttaaggtccaagaatatcatatcatgtccagctgttaccaacgcctcctgcagatatttcatggcttatttgcgtggtcaggcttttcccaacccgaaaaccagaatctactttacagtgctttacacgtcctaagtagtcgccttaagcagggggagcattctcagccactagaagagttgctgtcccagagcgttcactatttacaaaatttccatcaatcgatccccagcttccagtgcgccctgtacctaatacgactactaatggtgatcttggagaaaagtactgccagtgctcagaataaggagaagattgccagcctggccagacagtttctgtgccgggtttggccctccggggacaaagaaaaatccaatatttccaatgatcaactgcatgcactgctctgcatttacctagagcataccgagtcgattcttaaagccatcgaagaaatcgcgggtgtgggcgtgcctgagctcataaattctcccaaggatgcgtcctccagtacattcccaacccttacgcgacatacattcgtggtgttcttcagagtgatgatggctgagcttgagaaaaccgtgaagaagatcgagcccggcacggctgccgatagccagcagatccatgaagagaagttgctctactggaacatggccgtaagagacttttctatcttaatcaacctgattaaagtcttcgacagccatccagttttgcacgtgtgcctgaaatatggtaggttgtttgtggaggcattcctgaaacagtgcatgcctctgctggatttttccttcaggaagcaccgtgaggatgttctgtctttactggagacatttcagctggacactcgactgcttcatcacctgtgcggtcattcgaagattcatcaggataccagactgactcagcacgtgcccttactgaaaaaaacattggagttgctcgtctgcagagtgaaggctatgctcaccttgaataattgccgggaggccttctggctaggcaatctcaagaacagagacctccagggggaagagatcaagtctcagaactcccaggagtccaccgcagatgaaagtgaagatgacatgtcaagccaggctagcaagagtaaggcgacagaagatggcgaggaggacgaggtgtccgccggtgagaaggagcaggactcggacgagagctatgacgactccgattag

SEQ ID NO: 116640 - DNA, 4356 bp, Artificial Sequence
  Description of Artificial Sequence: Synthetic coding sequence
atggtgtctaagaggaggttgagcaagagtgaagacaaggaaagcctcactgaggatgcctcaaagactcgtaagcagcctctctctaagaagaccaaaaaaagtcatattgcgaatgaggttgaagaaaatgattccattttcgttaagttgctcaaaatcagcggaattatactcaagactggcgaatcccaaaatcagttggcagtggaccagatcgcttttcaaaaaaagctctttcaaactctgcgtcggcatccctcctacccaaaaatcatcgaggagtttgtatcgggcctggaaagttacatcgaagacgaagattcatttaggaattgcttgttgagctgtgaacgccttcaggacgaagaggccagtatgggcgctagttacagcaagtcactgatcaagctgctgctcggaattgacattctgcagccagcaataatcaagacactgttcgaaaagctccccgaatacttttttgaaaacaagaattctgatgagatcaacattcccagactcatcgtgtcacagctcaagtggcttgaccgggtggtggatgggaaggatcttaccaccaagattatgcagcttatcagtattgcaccggagaatcttcagcacgatatcattacatccctgcctgagatactaggagacagccaacatgcagatgtgggcaaagagttgtcggaccttttaatcgagaataccagtctgacagtcccaattcttgatgtacttagctcgctgcggctcgatcccaattttctgctaaaagtgaggcagttggtaatggacaagctgagctctatccggctggaagatctgcctgtgataatcaaattcattctgcacagcgtgaccgcgatggacactttggaggtgatttcagagctgcgggaaaagctcgatctgcaacactgcgtgctgcctagtagactgcaggcctctcaggttaaacttaagagcaagggtagggcatcgtcttcaggcaatcaggagagcagcggacagagttgcataatcctgttgttcgacgtcatcaagtctgctatcagatatgagaagacaatctcggaggcctggataaaagccatcgaaaacactgcgtctgtgtctgaacataaagtcttcgatttagtgatgctgttcattatatatagtactaatactcagacaaaaaaatacattgaccgtgtactcaggaacaagattcgcagtggctgcattcaagaacagctcttgcagtcaacattcagtgtgcactatctagtcctgaaagatatgtgttcctctatattatctctggcccaatccctgctgcactccctcgaccagagtatcatcagcttcggttctctgctgtacaagtacgctttcaagtttttcgacacttattgtcagcaggaggtggtgggtgctctcgtaacacacatctgttctggcaacgaagctgaggtggacaccgccctcgatgtgctgctcgaactggttgtcctaaacccttccgcaatgatgatgaacgcagtgtttgtaaagggaatcctggactacctggacaacatttcaccccagcaaatacgtaagttgttttacgtgttgagtaccctcgcatttagtaaacagaacgaagccagttcacacatccaggatgatatgcacctcgtcattcgcaagcagctaagcagtacagtttttaaatataagctgatagggatcatcggagccgtgacaatggctggcattatggccgctgatcggagcgaatccccctctctgacccaagagagagcaaacttgagcgatgagcagtgcacgcaggtcacgtcccttctgcagctcgtccattcttgctccgagcagtcaccacaggcatctgccctctattacgatgaatttgccaacctgattcagcatgaaaaactggatccaaaggctttagagtgggttggccacactatctgcaatgatttccaagatgcctttgttgtggactcctgcgtggtccccgagggtgacttccctttccctgtcaaggcactctatggattggaagaatacgacacgcaggacggaatcgcaataaacctgctgcccctgttattttcccaagacttcgccaaagacggcggcccagtgacctctcaggaaagtggccagaaactggtgtcacctctgtgcctcgctccgtatttcagactattgcggctgtgcgtggagaggcagcacaacggcaacttggaagagattgacgggctgctggattgtcctatcttcttgaccgacctggaacccggagagaagctcgagagcatgtctgcgaaagagagatctttcatgtgtagtcttatctttctgacactgaattggttccgggaaattgtgaacgccttctgtcaggaaacctcacctgagatgaaaggaaaggtgctgactagattgaaacatatagtcgagctgcagataatcctagagaagtacctggccgtaacccctgactatgtgcctcccctggggaattttgatgtcgagacccttgacataacgccccacaccgtaacagctattagcgcaaagattcggaaaaaaggaaagattgagcgcaagcagaagactgatggcagcaaaacgtccagcagtgacaccctatcagaggagaaaaattctgagtgcgacccaaccccctcacaccggggtcagctcaataaagaattcacaggcaaggaagagaaaacttcactcctgttgcacaattcacacgcattttttcgagaactggacatcgaggtattcagtatccttcactgcggtcttgttacaaagtttattcttgataccgagatgcacaccgaagctacagaggttgtacagctgggccccccggagctgctttttttgctagaggacctgtcacagaagctggagtccatgttgacacccccaatcgccaggagggtgcccttcttgaaaaacaaaggttcacggaatatcggtttctcccacctgcagcagcgctcagctcaggaaattgtccactgcgtctttcagcttctgacaccaatgtgcaaccaccttgagaacattcacaactatttccaatgcctggctgccgagaaccacggcgtcgtggatggtcccggggttaaagttcaggaatatcatataatgtcgagctgctaccaacgcctgctccagatcttccacgggctgttcgcatggtccggtttctcccagcccgagaaccagaatcttctgtactcagctctgcacgtcctaagtagccgcctgaagcaaggcgagcactcccaacctctggaagaactgctgtctcagagcgtgcattacctgcagaactttcatcagtcaatacctagcttccaatgtgctctatacttaatccggctgctgatggttatactcgaaaaaagtaccgctagtgcacagaacaaggaaaagattgcaagcctggcgaggcagtttctgtgccgggtctggccttccggtgataaagagaaatccaacatctccaatgaccagctacacgccctgctctgtatttatctagaacatacggaaagcattctcaaggccatcgaagaaatagcaggagtgggcgtgccagagctgattaatagtcccaaagacgcctcatcttccaccttcccaactctgacaaggcacacattcgtagttttctttagagtcatgatggcagagcttgagaaaacagttaagaaaatcgagccaggaaccgccgccgattcacaacagatacatgaggagaagctcctctattggaatatggcagttcgagacttctcaattctgatcaatctgatcaaagtgtttgattcacatcctgttctgcacgtgtgcttaaagtatgggaggcttttcgtggaagcctttctgaagcaatgtatgcccttactggatttcagctttcgtaaacacagagaggacgtgctgagcttactggagaccttccagctggataccaggctgttgcatcatctttgcggccattctaagatccaccaggataccaggctgacccagcacgtcccattactgaaaaaaactcttgagctgctggtgtgccgagttaaagcaatgttaaccctcaataattgcagggaggccttttggttgggcaacctgaagaaccgcgatctccagggagaggaaatcaaaagccagaacagccaggaaagcacggccgacgagagcgaagatgacatgtcttctcaggcctccaagagcaaagctaccgaggacggcgaagaggacgaagtatctgctggcgaaaaagagcaggattccgacgagagctacgacgatagtgactag

SEQ ID NO: 116641 - DNA, 1341 bp, Artificial Sequence
  Description of Artificial Sequence: Synthetic coding sequence
atggattcctctgccgccccgacaaacgccagtaactgtactgacgctctcgcctactcttcctgttcacctgcgccctccccaggttcttgggtaaatctgagccaccttgacggtaatctgtcagacccatgtggaccaaatcgaactgacctcggggggagagattccctgtgcccaccaaccggatcgccgtctatgatcacagcgataacgataatggccctctactcaattgtttgcgtggtcggcctgttcggcaacttcttagtaatgtatgttattgtacgctatacgaagatgaagaccgcaactaacatctatatatttaaccttgcccttgcagacgcactcgcaacttccacgctcccatttcaatctgtaaattacttaatggggacctggcctttcggcacgatattatgcaaaatcgttatctctatcgactactataacatgtttacgtcgattttcactctctgtacgatgagcgttgacagatacattgctgtgtgccatcccgtgaaggcgctcgacttccggactcccaggaacgcaaaaatcatcaatgtgtgtaactggatcctctcttctgcgattggactgcctgtgatgttcatggccactacgaagtatcggcagggctcaatcgactgcacactcaccttcagtcatcccacctggtattgggaaaacctactcaagatatgcgtgtttatatttgccttcatcatgccagtgctgataattacagtgtgctatggcctgatgattcttcgtctgaaatctgttcggatgctgagcggcagcaaggaaaaagaccgcaatctgagacggataacccggatggtgctggtggtagtggccgtgttcattgtctgctggacccccatacacatctacgttataattaaggctctggtaacgattcccgagaccacattccagacagtctcctggcatttttgcatcgcactgggttacacaaactcatgtttgaaccccgtactttacgcctttctggatgaaaacttcaaacgatgttttcgagagttctgcataccaaccagctcgaacatcgaacagcagaacagcacacggatccggcaaaacacccgggaccacccgagcacggccaatactgtcgatagaactaatcaccaatgtcttccaattccttctctttcctgttgggccctcgagcaaggctgcctagtcgtctatccaggtcccctgcaggggccactggtccgttacgatctgcccgccatcctgcactccagttgcctgaggggcaataccgccccttcaccctccggaggggcctttctcttatcttag

SEQ ID NO: 116642 - DNA, 1125 bp, Artificial Sequence
  Description of Artificial Sequence: Synthetic coding sequence
atggagtccttgctccaacaccttgatcgattctctgagcttttggccgtttccagcacaacatatgtatctacctgggaccccgccaccgtccggagggccctgcagtgggctaggtatttgaggcatatccacagaagatttggtcggcacggtcccatcagaacagccctggagagacggctgcataaccagtggcgccaggaagggggttttggtcggggccctgtgccaggcctggcgaatttccaggccctcgggcattgcgacgtactgctctctctgcggctgcttgaaaatagggccctgggtgatgcagcccgctaccacctggtgcagcagttatttccaggcccaggggttagagatgcggacgaagagactctgcaagaaagtctggctagactggcgcggaggcgatccgctgtgcatatgctgcgctttaacggatatagggagaatccgaatctgcaggaggacagtctgatgaaaacacaggccgaacttctcctcgaacggttgcaagaggtggggaaagctgaggccgagcggcccgccagattcttatcgagcctctgggaaagacttcctcaaaacaattttctgaaagtgatagccgtggccttattgcaaccccctctgtcccggaggccacaagaagaactggagcccggcattcataaaagccccggggagggttcccaggttctggtgcactggctgctgggaaacagcgaggtctttgccgccttttgtagagccttgccagcaggattgctcacactggtgacaagccgtcaccctgctctcagtccggtgtacttgggactgttgactgattggggacagcggttgcattatgacctgcagaaaggaatatgggtaggcaccgaatcacaggatgtgccctgggaagagctgcataaccgatttcaatcgctgtgccaagcccctcctcctctcaaagacaaggtactgaccgcgcttgaaacgtgtaaggcccaggatggtgacttcgaggttcctggactttccatctggacagatctccttctcgcactacgctctggcgccttcaggaaacggcaggtactcgggctctccgccgggctgagtagtgtttag

SEQ ID NO: 116643 - DNA, 3807 bp, Artificial Sequence
  Description of Artificial Sequence: Synthetic coding sequence
atggatcagaagatattgagtctcgccgccgaaaagaccgcggacaagctgcaggagttcctgcaaactctgcgcgaaggagacctgaccaacctattgcagaatcaggcagtcaaagggaaggtggctggcgccctgcttcgggctatttttaaaggatctccatgcagcgaggaagccggaacgctccgccggcggaagatctatacgtgttgcatccagttagtggaaagcggagatctgcagaaggaaatcgcgagtgagatcattgggctgctgatgctcgaagcgcaccattttccaggccctttgctcgtggagttggcaaatgagttcatatctgccgtgcgggaggggagcttagtcaacggcaagtccctggagttgttgcccatcatcttaactgccttggccactaaaaaggaaaacttagcatacggtaagggggttctttccggtgaggaatgtaagaagcagctgattaataccctgtgcagcggtaggtgggatcagcagtacgttatccagctgacgagtatgttcaaggatgtgcccctgacggctgaggaggtggagttcgtagtcgaaaaagctctttcgatgttttccaaaatgaatctgcaagagatcccccccttagtgtaccaactgctggtgctttccagtaaagggtccagaaaaagcgtcctggagggcatcatcgcgttcttcagtgccctagataagcaacacaacgaggagcagtctggtgatgagcttttggatgtagtgaccgtaccgtccggagaacttaggcacgtggagggaactattatccttcatattgtgtttgctataaaattagattacgaactcgggcgagaactggtcaaacatctcaaggtgggtcagcagggagacagtaataataacctttccccattctctattgccctgctgttatccgtgacacggatccaacgcttccaggatcaggtcctcgacctcctgaaaacttctgtggtcaagagttttaaagatctgcagctcctgcagggaagcaagttccttcaaaatctggttccacatcgctcttatgttagcactatgattttggaagtggttaagaactcggtgcactcttgggaccacgtgacacagggactggtggaactgggctttatcctcatggacagttacggacccaaaaaggtgctggacggtaagactatcgagacctctccgtccctatctaggatgcctaaccagcacgcatgtaaactcggcgccaatattctactcgagaccttcaagatccatgagatgattagacaagaaatattagagcaagtgctgaaccgtgtggtaactagggcttcctcccctatatcccactttctggacctactgtccaacatcgtcatgtacgctccgctcgtactgcagagctgctcctctaaagtcaccgaagccttcgattatctgagttttcttcccctgcaaaccgtgcagcgcctattaaaggcggtgcagccgctgctaaaggtgagtatgtcaatgagagattgcctaattctcgtgctgaggaaagccatgtttgccaaccagcttgatgcacgaaagtctgccgttgccgggtttttgctgttgctgaagaacttcaaagtcttgggaagcctcagctctagccaatgctcccagtctctgagcgtttcgcaggtgcacgtggacgttcattcacattataactctgtcgctaacgagacattttgtctggagattatggactcactaaggcggtgcctctcacagcaggcagacgtgcgcctgatgttgtatgaggggttttacgatgtgctcaggcgcaattctcaactggccaattcggtgatgcaaacgctgctcagtcaattgaaacagttctacgaacctaaacccgatttactccctcctctcaaactggaggcgtgcatcctgacgcagggagacaagatcagtttgcaggaaccgctggactacttattgtgttgcatacaacactgcctcgcatggtataagaatactgttatcccccttcagcaaggggaggaggaagaagaggaagaagaagctttttatgaagacttagacgacatcctggaatctatcaccaacagaatgattaagagtgagctggaagatttcgagcttgataagtcagctgatttttcgcagtccacctcaatcggcatcaagaacaatatatgtgcattcctcgtcatgggagtgtgcgaggtcctgattgaatataatttttctatctcctctttttctaaaaacagattcgaggacattctgagtctgtttatgtgctacaagaaactgtctgacattctgaacgagaaggccggcaaggcaaagacgaaaatggccaacaagaccagcgatagcctgctctccatgaaatttgtcagctcactgttgaccgctctgtttcgagtgctgctgtggaggtatacttcgatccccacgtcagtggaggagagcggcaaaaaagaaaaaggaaagagtattagcctgctttgcctcgagggtctgcaaaagatcttcagtgcagtgcagcagttctaccagccaaagatccagcagttcctccgcgcgcttgacgttaccgataaggagggggaggagcgtgaggatgctgacgtatccgtgacccagcgcacagccttccaaattcggcaattccagcggtcactgttgaatttgctgagctcacaagaagaggattttaatagcaaagaggcactcttgttggtaacggtcctgactagtctgtccaagttgctcgaacctagcagcccccagttcgtgcagatgctgagctggacttccaagatttgcaaggagaactcacgcgaagacgcactcttctgtaagtcactaatgaatttactgttttctcttcacgtgtcatacaagtccccagtaattttgcttcgagacctgagccaggacatccacgggcaccttggcgacattgaccaggatgtggaggtggagaaaacaaatcacttcgcaattgttaatctgagaaccgccgccccaaccgtatgcctactggtgctctcacaggctgaaaaagttcttgaagaagtcgattggttgatcacgaaactgaagggccaagtgtcccaggaaacccttagtgaggaggcatcttctcaggccacgttgccaaaccagccggtggaaaaggctatcatcatgcagctcggaacgttgctcacctttttccacgagctggtccagaccgcgttaccctcagggtcatgcgtcgacaccctgcttaaagacctgtgtaagatgtacactactctaaccgcgcttgtgcggtactatctccaagtgtgccagtcatccggcggcatccctaagaacatggagaaactggtgaagctatcaggttctcacttgacccctctgtgctattcattcatatcatacgtgcaaaacaagagcaagtctctgaactatacaggggaaaaaaaagaaaaaccggctgccgttgccactgctatggcccgcgttttaagagaaactaaaccaatccccaacctgatattcgctatcgaacagtacgagaaattcctgattcacctcagcaaaaagtccaaggtgaacctcatgcagcatatgaaactgtcaacctctcgcgattttaagataaagggcaacatcctcgatatggtgttaagagaggatggagaagacgaaaacgaggagggtacagcctccgaacacggcgggcaaaacaaggagcctgctaagaagaaacgcaaaaaatag

SEQ ID NO: 116644 - DNA, 3987 bp, Artificial Sequence
  Description of Artificial Sequence: Synthetic coding sequence
atggatcaaaagatactctctctggccgccgagaagactgccgacaaactacaggaatttctgcaaactttgcgggagggagatcttactaacctgctccaaaatcaagcggtgaaagggaaggtagcgggagcacttctccgggcaatctttaaaggtagcccttgttctgaagaagctggtaccctgagacgtcggaagatttacacttgttgtattcagctggtagagagcggagacttgcagaaagaaatcgcttcagaaattattgggttgctgatgctcgaagctcatcactttccggggcccctgcttgtagagctggccaatgaatttatatctgccgttagagaggggtccttggtgaatggcaagagtctggaactgctgcccatcattttgaccgcactggctacaaagaaagagaacctggcatatggaaagggtgtgttatctggcgaagaatgtaagaagcaactcatcaataccctctgttctgggcgctgggatcagcagtatgttatccaactcacgtctatgtttaaggacgtgcccctcaccgcagaggaagtggagtttgtcgtcgagaaggccctgagtatgttctcaaaaatgaacctgcaggaaataccccccctcgtataccagttgctggttctgtctagcaaggggagtcgaaaatctgttttggaaggtatcatcgccttttttagcgccctagacaaacagcataatgaagagcagagcggggatgagctgttggacgtggtgaccgtgccaagcggtgagcttaggcatgtcgaggggactatcatactccacatcgtgttcgccattaaattggactatgagctgggacgagagctcgtaaaacacctgaaagtggggcagcagggggactcaaataacaacttgtccccctttagcatcgctctcttgctgtctgtcacgcgcatacagcgattccaagatcaggtgctggatcttttaaaaacatctgtagtcaagtccttcaaggacttgcagctgctacaggggtccaaatttctgcagaatcttgtgcctcatcggtcatacgtcagtactatgatcttagaggtggtgaagaattctgttcacagttgggaccacgttacacagggactggttgaactggggtttatcctgatggacagttatggaccaaagaaggtgttagatggcaaaaccattgagacatctccctcactgtctaggatgccaaaccagcacgcttgtaaattgggcgctaacatccttctagagactttcaagatacacgagatgatacgacaggaaatcctcgaacaggtccttaacagggtggttacacgggcctcgtctcctatctcccactttttggatctgctgtcgaacatcgttatgtacgctcccctcgtgttgcagtcctgcagtagtaaggtgacagaagctttcgactatctgagcttcttgccccttcagactgttcaaaggttacttaaggctgtccagccactgcttaaggtgtcaatgtccatgcgagattgtctgatcctagtgctgaggaaggcgatgttcgcaaatcagcttgatgcccgcaagtcagccgtggctggttttctgctgctgctaaaaaactttaaagtgctgggttccctcagcagctcccaatgcagtcaatccctctcagtgtcccaggtccacgtggatgtgcactctcactataattcagttgcaaatgagaccttttgtttagaaatcatggactctctgagacgatgtctatcccagcaggcggacgtccgtttgatgctgtacgagggattttatgacgtcctacggcggaattcgcagttggccaatagtgtgatgcaaaccttgctatctcagttaaagcaattctatgagcccaagccagacctgttgcctccactgaaactggaggcctgtatcctcactcagggcgacaaaattagccttcaggaaccccttgattacctgctgtgttgcatacaacactgtctcgcctggtacaaaaacaccgtgatacctttgcagcaaggcgaggaggaggaggaagaggaggaggctttctatgaggatctcgacgatatacttgaatcaattactaacaggatgattaagtctgagctcgaggacttcgaactggacaagtcggcggactttagccagtcgacttcaattggaatcaagaataatatttgtgcctttctggtaatgggggtctgcgaagtgttgatcgagtataactttagcatctcaagcttttcaaagaacaggtttgaagatatcctttctctgttcatgtgctacaagaaactgagtgacatcctgaatgagaaagcaggcaaagccaagacaaaaatggccaataagacgtccgatagccttctctcgatgaagtttgtttcatcactgctgaccgctctctttagggacagcattcaaagccatcaggagtccctgtccgttctgcggtctagtaatgagtttatgagatatgctgtcaatgtggcgctgcaaaaggttcagcagctgaaggaaacaggccatgtgtccgggcccgacggtcaaaacccagagaaaatattccagaacctatgtgacatcaccagggtgctcctctggcggtacacctcgattccgacctcagtggaagagtccgggaaaaaagagaagggtaaatccattagcctgctatgcctggagggtctgcaaaaaattttttccgccgttcagcagttttaccagccaaagatccagcagtttttgagagccctcgatgtgaccgataaggaaggcgaagaacgagaggatgcagatgtttcggtaactcagcgaacggcttttcagatacggcagtttcagaggtctctgctgaatcttctgagtagtcaggaagaagatttcaactccaaggaagccctcctccttgtgaccgtcttgacctcactgtccaagctgctggagccgtccagcccccaatttgttcagatgctctcttggacgagtaagatttgcaaggaaaactccagagaggatgccctcttctgcaagagcctgatgaatctcctgttctctctccacgtgagctacaagagccctgtgatcctgttgagagacctcagccaagacattcacgggcatctgggagatatcgaccaagacgtggaggtggaaaaaaccaatcatttcgccattgtgaatctgaggacagctgctcctacagtttgcctgcttgttctttcccaggccgagaaggtgctggaggaagttgattggctcattacaaaactcaagggccaggtctcccaggaaaccctcagtgaagaggcatcttcccaggccacgctacccaatcagcccgtcgagaaagccatcatcatgcaactggggaccttactgacgttttttcacgaactggtccagaccgctctgcccagcggctcctgcgtcgatacactgcttaaagacctgtgcaagatgtacaccacactgacagccttggtgcgctactaccttcaagtgtgccaatctagtgggggaattcccaagaacatggagaaactggtgaagctaagtggtagtcacctgacccctttgtgttacagctttatctcttacgtgcagaacaaatctaagagcttgaattatacaggcgagaagaaagagaagcctgctgccgtggcaacagcaatggcacgagtgctcagggaaacgaaacccatccccaatctaatatttgctattgagcagtacgagaaattcttgatacacctgagtaagaagagcaaggtcaacctcatgcagcatatgaagctgtcaacctctcgggactttaaaatcaagggtaatatcctggacatggtcctgcgtgaagatggggaagacgaaaacgaggaagggacagccagcgaacacggggggcagaataaagagccagcaaagaagaagaggaagaagtag

SEQ ID NO: 116645 - DNA, 3288 bp, Artificial Sequence
  Description of Artificial Sequence: Synthetic coding sequence
atggatcagaaaatactgagtcttgcagctgagaaaacagccgataaactacaggaatttctccaaacactcagggagggcgatctgaccaatctacttcagaaccaagcagtgaaagggaaggtggcgggggccctcctccgcgccattttcaaagggtcaccatgttcagaggaagcagggactttgcggagacgaaaaatttatacttgctgtatccagctggtggaatcgggcgacctgcagaaagaaattgctagcgagataattggcctactcatgctcgaagcacaccacttcccaggcccactgctcgtagaactcgcgaatgaatttatatcagcagtgcgcgagggatccctagttaacggtaaaagtctggaactactgcccatcatcctcactgcattggctactaaaaaggaaaatttggcttacggaaaaggagtgttgtcaggagaagagtgcaagaagcagttgataaacacactctgttcgggtcgatgggaccagcaatatgttatccagttgaccagcatgtttaaagatgttcccttgactgccgaagaggttgagtttgtcgtggagaaagccctgtcaatgttctccaagatgaatcttcaggagattcctccactggtgtatcagcttctggtcctttcaagtaaaggcagcagaaagtccgttcttgagggaattatcgccttcttttccgccctggacaaacaacacaatgaggagcagagtggagatgaactgctggacgtggtaactgtcccttctggagagctccgccatgttgaaggcacaatcatcttacatatagtgttcgccattaagctggactacgagctgggacgagagctggtgaagcacttgaaagtggggcagcagggagactccaataacaacctctccccttttagtatagctctgttgctgtccgttaccaggatccaacggtttcaggaccaggtgctcgatttgttgaagacaagcgtagtgaagagctttaaggacctccaactgctgcagggctctaagttccttcagaatctcgtccctcaccgctcctacgtgtctacgatgatacttgaagtagtcaaaaattctgttcatagttgggaccatgtgactcaaggccttgtcgagttgggatttatcctcatggactcctacggccctaagaaggttctggacggcaagaccatagagacatctcccagcttatctcgcatgcccaatcagcacgcttgtaaactgggggcaaatattttgctggaaaccttcaagattcacgagatgattaggcaggagattctagagcaagtgttgaacagagtggtcacacgtgcctcttcacccattagccactttctagacctgctgagcaatatcgtgatgtacgctccccttgtccttcagtcctgttctagcaaggtgactgaggcattcgattacctctcatttctgcccctacagacggtacagagattgctgaaggctgtgcaaccactcttgaaagtgagcatgtctatgagagactgtctgatcctggtccttcggaaggccatgttcgccaatcagttagacgcacgcaaatctgctgtcgccgggttcctgttgctgctgaaaaactttaaggttttaggttccctcagctcatcccagtgctctcaaagcctcagtgtcagccaggtgcatgttgacgtccattctcattataatagcgtggcaaacgaaacattttgtttggagattatggactctcttagacgctgtctctcccaacaggcagacgtccgcctaatgctgtacgagggattctatgacgtgctgaggcgaaactctcagcttgctaatagcgttatgcaaaccttactctctcagctgaagcaattctacgagccgaaaccagacctccttccacccctgaagttggaggcttgtattctgacgcagggagataagatttcattgcaagagccactcgattacctcttgtgctgtatacagcattgcctggcttggtataagaacactgttattcctcttcagcagggcgaagaggaggaagaagaggaggaagctttctacgaggacctcgatgatatactcgagagtatcaccaaccgaatgatcaagagcgaacttgaagattttgaattggacaaaagtgccgatttttcacaaagtaccagcatcggtatcaagaacaacatctgtgcttttctggttatgggtgtgtgcgaagtgctgatcgagtataacttttcaatatcaagcttctcaaagaatcggtttgaagatattctgtctcttttcatgtgctataaaaagcttagcgatatcctgaacgagaaagcaggcaaggcaaaaactaagatggctaataaaactagtgatagtctgctgagcatgaagtttgtgtcatctctcctgactgccttgtttagagtgctgctgtggcggtacacctctattcctacttccgtcgaagaatccggtaagaaggagaaaggaaaatctatcagtttattgtgcctcgagggacttcagaagatcttttctgctgtgcaacagttttaccagccaaagattcaacagtttctgcgggcgcttgacgtcactgacaaagaaggagaagaacgtgaggatgctgatgtctccgttacccaaaggacggccttccaaatacgacagtttcagcggtccctccttaatttactctctagtcaggaagaggattttaatagtaaggaagcgttactactggttacggttttaacaagtctgagcaagctgctggaaccgagtagccctcagtttgtgcagatgctttcatggacatctaagatctgcaaagagaacagtcgtgaggatgctctcttttgtaagagtcttatgaacctattgttcagccttcacgtcagctataagagccctgtgatcctactccgggacctcagccaagacattcacgggcatctcggcgacatcgatcaggatgtggaagtagagaaaaccaatcacttcgccattgtgaatctgcggactgcggccccaacggtgtgcctgctagtcctttcacaggccgagaaagtactggaggaggttgattggctgatcaccaagttgaaaggacaggttagccaggagacactctcagtaagccctggcgtgagcgaactgcgcaggaacagcaaaaagtatggaaaagctggggaagcagtctggttctcctctgacccgccggtcctgttcttccatttcctcagaaccgaatag

SEQ ID NO: 116646 - DNA, 222 bp, Artificial Sequence
  Description of Artificial Sequence: Synthetic coding sequence
atgtttaaagatgttccactgactgctgaggaagtagaattcgtcgtggagaaagctttgtccatgttcagtaaaatgaatcttcaggagatcccaccccttgtgtatcagctgcttgtgctctcatcaaaggggagcaggaaaagcgtgctggagggtatcatcgccttcttttccgccttggacaaacagcataatgaggagcaatcaggagatgagtag

SEQ ID NO: 116647 - DNA, 501 bp, Artificial Sequence
  Description of Artificial Sequence: Synthetic coding sequence
atggctcagacttcctcttacttcatgctaattagttgtctgatgttcctctcccagtcacagggccaagaagcccaaaccgaactgccacaagcgagaataagctgtcccgaaggcactaacgcctatcgcagctattgctactattttaacgaggaccgagaaacctgggtggacgccgacctttactgtcagaatatgaatagcggcaatctcgtctccgtccttacccaggcggagggggctttcgtggccagtctcattaaagaatcaggaactgacgacttcaacgtgtggattgggttacacgacccgaaaaagaacaggagatggcactggagtagcggctcactggtctcttataaatcttggggcattggagcccccagttccgttaatccaggctattgtgtctcactgacttcatctacaggctttcagaagtggaaagatgtaccctgcgaagacaagttttcctttgtgtgtaaatttaaaaactag

SEQ ID NO: 116648 - DNA, 384 bp, Artificial Sequence
  Description of Artificial Sequence: Synthetic coding sequence
atggctgtcactgaagcctctctcctccggcagtgccctctccttctgccacaaaaccgctcaaaaaccgtgtatgagggcttcatttctgctcagggacgggatttccatctgcggatcgtcttgccggaagatctgcagctgaagaatgctagactcttatgcagctggcagttacggaccattttgtcgggctatcaccgcatcgtacagcagcgcatgcagcactctccggacctgatgagtttcatgatggagctcaaaatgctgctggaagttgcactcaagaatagacaggagctgtatgcattgccaccacctccgcagttttattccagtctgatagaagagattggtacactcgggtgggacaaggccccctag

SEQ ID NO: 116649 - DNA, 6147 bp, Artificial Sequence
  Description of Artificial Sequence: Synthetic coding sequence
atgagtggccgccaaagaacgcttttccagacatgggggtctagcatctctaggagctccggaactcctggctgcagctccggtacggaacgcccacaatcgcccggctcgagcaaagcacccctacccgctgcagctgaagcacagttggagagcgatgatgacgtgctcctggtggcagcttacgaggccgagagacaactttgtctggagaatggaggcttctgtacatccgcgggagccctctggatatatcctaccaattgccccgttcgagattaccagctccacatctctcgtgctgccctgttttgcaacactctggtgtgtcttccaactggactgggtaaaacttttattgcagccgtggtgatgtacaatttctatcgatggttcccatccggtaaagtcgtgttcatggcaccaacaaagcctctcgttactcagcagattgaggcctgttaccaggtgatgggaattcctcagagccacatggcggagatgacggggagtacacaggcctctactcgcaaagagatttggtgctcaaaacgcgtgctcttcctgacaccacaggtgatggttaatgacttgtcacggggcgcctgccccgccgcagagattaaatgccttgtcatcgacgaagctcacaaagccctaggcaattacgcatactgccaggtagttcgggaactcgtgaagtacacaaatcatttccgtatcttggctctgtcagctacccctgggagtgacatcaaagcagttcagcaagtcataacgaatctgctgataggccagattgagctgagatccgaagacagtcccgacatccttacatactcccacgaaaggaaagtggagaaactcattgtgccgctgggagaggagttggcggccatccagaaaacctatattcagattctggagtccttcgcgcggtctcttatccaacgtaacgtgctgatgaggagggacatccctaacctgaccaaatatcagattatcctggccagggatcagtttcggaagaatccgtcgcccaatatcgtgggcatccaacagggtatcatcgagggcgaatttgccatctgtatctctctgtatcatggttacgaactgctccagcagatggggatgaggagcctctacttttttctatgtgggattatggacggcactaagggcatgactagatccaagaatgagcttggacgcaatgaagacttcatgaagctgtataaccatctggaatgcatgttcgcccgtacccgcagtacatctgcaaacgggatctcggccattcagcagggagataagaacaagaagtttgtttatagtcaccctaaacttaagaaactggaagaggtggtcatcgagcacttcaaatcttggaacgcggagaacacaactgagaagaaaagagacgaaacacgggtgatgatattctcttctttcagagacagtgtccaggaaattgcagagatgctttcgcagcaccagccgatcattagggtcatgacattcgtgggacatgcaagcggaaagagtacaaaggggttcacccagaaggagcaattagaggtggttaagcagtttcgagacggaggatataacacactggtgtcaacctgcgttggggaggaaggactagatattggcgaggtagaccttatcatttgtttcgactctcagaaatcacccatccggctggtccaacgaatgggcaggacgggacggaagaggcagggacggatcgttattattctgagcgagggtcgagaggagaggatatacaaccaaagccagtcaaataaacgatcaatatacaaagctattagctctaataggcaggtgctgcatttctaccaacggagtcccagaatggtacctgatggcataaatcctaagttgcacaaaatgttcattacccacggggtgtatgagcccgaaaaaccctctagaaacctgcagcgcaagagctcaatcttcagctaccgagatggaatgcgccaatccagcctgaagaaagattggtttctgagcgaagaggaatttaagctgtggaacagactctatcgattgagggactcggatgagatcaaagaaatcactctcccccaggtccagttctccagcctccagaatgaagagaacaaaccggcccaggagagtacaaccggcattcatcagcttagcctgagcgaatggcggctgtggcaggatcaccccttgcctacccatcaggtagatcactccgatcgttgcaggcattttatcggcctgatgcaaatgattgaggggatgagacatgaggagggtgaatgtagttatgagctggaagtggagtcttacctgcagatggaagatgtcacatctactttcatagcccccagaaatgagagcaacaacctggcttctgacacattcattacgcacaaaaagagttctttcattaagaatataaatcagggatcctcgagcagcgtgatagaaagtgatgaagaatgtgcagaaatcgtgaaacagacgcatattaagccgactaaaattgtgtccttgaagaaaaaagtcagcaaagaaataaagaaggatcagttaaaaaaagagaataaccacggcattatcgattcggtcgataacgataggaactctacagtcgagaatatatttcaggaggatctgcctaacgacaagaggacctctgacactgacgaaattgccgccacatgcaccatcaacgagaacgtgattaaggagccttgcgtattgctaacagagtgtcagttcacaaataagagcaccagtagtctggccggtaatgtgctggattccggctacaatagctttaacgatgagaagtcagtgtcctccaatctgttcctgcctttcgaagaggagctttacatcgtcaggacagacgaccagttctacaactgccacagccttaccaaggaggtcctggctaatgtggagcgctttttatcctactcgcctccgccactgagtggcctgtccgacctggagtacgaaattgcaaagggaactgccctagaaaatctgctgtttctgccatgcgccgaacatctaagatccgacaagtgcacatgcctgcttagccactctgccgtgaattctcagcagaacctcgaactgaatagtctgaaatgtatcaactacccttctgagaagtcctgtctttatgacattcctaatgacaacatctccgatgaaccgagcctgtgcgactgcgatgtgcataagcacaatcagaacgagaatttggtgcctaacaaccgcgtgcagattcatcgttcacccgcccagaacctcgttggcgaaaacaaccacgatgtcgataacagcgatctccctgtcttgtcaacagaccaggatgaatccctgctgctgttcgaggacgtgaacaccgaattcgatgatgtttcactgtcaccccttaactcaaagtcagagtccctacctgtttcagataagaccgctattagcgaaaccccactggtttctcaattcctgatctcagacgagctgctgttagataataatagcgaactgcaggaccaaatcacgcgtgacgccaacagcttcaagtcaagggaccagcgcggggtgcaggaagagaaagtcaaaaatcacgaagatattttcgattgctctcgggacctgttcagcgttactttcgatctgggattttgttctcccgattctgacgatgagattctcgagcataccagcgactctaatcgcccactcgatgacctgtacggccggtacctcgagattaaggagataagcgacgctaattatgtgtctaaccaggctttgatacccagagaccattcgaaaaattttaccagtggcaccgttattataccttcaaacgaagacatgcaaaatcctaattacgtacatcttcccctgagtgcggccaagaacgaggaactgctttcgcctggctattcccagttttctctccctgtccaaaagaaggtgatgtccacaccattatcaaagtcaaacaccctcaacagcttcagcaagatccgcaaggaaattctgaagacgcctgattcaagcaaagagaaagtgaatctgcagcgtttcaaagaggccttgaatagcactttcgactacagtgaattctccctggagaagagtaaaagcagcggacctatgtacttacataaatcctgccacagcgtcgaggacggacagctcctgaccagcaacgagagcgaagacgacgagatctttcgcagaaaggttaaaagagccaaagggaacgtcctgaattcgcctgaagatcaaaagaattctgaggtggactcgccgctccacgccgtaaagaaacgcagattccctatcaacagatcggaactgagcagctccgacgagtcagaaaattttccgaagccgtgttctcagctggaggactttaaagtctgcaacggcaatgccagaaggggaatcaaggtcccaaagaggcagtctcacctgaaacatgtagcacgcaagttcctggacgacgaagctgaattatcagaggaggatgctgaatatgtcagttctgacgagaatgatgagtccgaaaacgagcaagatagtagccttctggactttttgaacgacgagacacagttatcccaggcaatcaacgattcagagatgagagctatctacatgaaatcactccgatcccccatgatgaataacaagtataaaatgatccacaagactcacaaaaacattaacattttctctcagatcccagaacaggatgagacttacctggaagattcattctgcgtggacgaagaagagagctgcaaaggtcagtcttctgaggaggaggtgtgtgtggacttcaatcttattactgacgactgtttcgctaatagtaagaagtacaagacaagacgagccgtgatgctgaaagaaatgatggagcaaaattgcgcccattctaagaagaagctctctaggattatcttacctgatgatagttctgaagaggagaataacgtgaatgataagcgcgaatcaaacatagccgttaatccctcaacagtaaaaaagaataagcagcaggaccattgtttgaactcagttcctagcggcagctccgctcagtctaaggtccgcagcactcccagggtgaacccacttgccaagcaatccaagcaaacgagtctgaatctgaaagataccattagcgaggtgtcagatttcaaacctcagaatcacaatgaggtccagtcaaccactccacctttcaccactgtggatagccagaaggactgtcgaaagttcccggtgcctcagaaggatggctccgcactcgaagattcatccacttccggggcctcttgcagtaaaagtagaccacacttagcagggacgcatacatctctgcggttgccccaagagggaaagggcacctgcatactggtgggcggtcatgagattacttcgggtctagaggtcattagctccctgcgggccatccatgggctccaggttgaggtgtgcccgttgaacggctgcgactatatcgtcagtaacagaatggtggtcgaacggcgcagtcagtccgaaatgctgaattctgtgaataagaacaagttcatagagcagatccagcacctgcagtcaatgttcgagagaatatgtgtcattgtcgaaaaggaccgcgagaaaacgggcgacacctcaagaatgttccgccgaaccaagtcctatgatagtctcctcacaacgctcattggagcgggaatacgcatattatttagttcatgccaagaggaaacagcggacctgttgaaggagttgagcctggtcgaacaacgcaagaatgtcggtatacatgtgcctaccgtggtgaacagcaacaagagtgaagcactgcaattctatctctcaattcccaatatctcctacatcacagcactgaatatgtgccaccagttcagctcagtgaaacggatggcgaactcaagcctacaagaaatctcaatgtacgcccaggttactcatcagaaggcagaggaaatctatcgctacattcactatgtcttcgatatccagatgcttcctaatgacctcaaccaggacaggctgaaatccgacatttag

SEQ ID NO: 116650 - DNA, 2010 bp, Artificial Sequence
  Description of Artificial Sequence: Synthetic coding sequence
atgtctggtcgtcaacggacactgttccagacctggggtagcagcatttcaagaagcagcgggacccccggctgctcatctggaacagagcgaccacaatctcctggcagttctaaagcacccctccccgcggccgctgaagcacaactcgaatccgatgacgacgtgttgcttgtggctgcatacgaagccgagagacagctttgtctggagaacggggggttttgcaccagcgcaggcgccctttggatttatcctacaaactgtcctgtgcgagattaccagctgcacatctctcgcgctgccttattttgcaacacactagtatgcttgcccactggactgggcaagacatttattgctgctgtcgtgatgtacaacttctatcggtggtttccctcaggtaaagtcgttttcatggctccaacaaaacctctcgtcacacagcagattgaagcctgctaccaagtgatgggcatccctcagtcccatatggcggaaatgaccggctccacccaggcatcgacaagaaaggagatttggtgtagcaagcgggtcttattccttacgccacaagtaatggtgaacgacctgtctcggggggcgtgtcccgccgcagaaatcaagtgcttggtcattgatgaggctcataaagccctcggaaactatgcatattgtcaggtcgtcagagaactagtcaaatatacaaaccattttcggatcctcgctttgtctgctacacccggttcagatattaaggccgtacaacaggtaatcaccaacctgttaatcggccagatcgaactgcgctcggaggatagtcctgatattctaacatactcgcacgaacgcaaggtagagaagctgatcgttcccctcggggaggagctggccgcaatccaaaagacatacatccagatccttgaatccttcgccagatctctgatccagaggaatgtcctaatgaggcgcgacatcccaaatcttaccaagtaccaaatcatcctcgccagagaccagtttcgcaaaaacccttcaccaaatattgtgggaatccaacaggggatcatcgagggtgagttcgccatttgcatcagcctttaccacggctatgaactgctgcaacagatgggaatgagatccctgtattttttcctgtgcggaattatggatggtaccaagggaatgaccagaagcaagaatgaactaggacgcaacgaagacttcatgaaattgtacaatcacctggaatgcatgttcgcccgaacgcggagcacaagtgctaacgggatctcagctatccagcagggagacaagaacaaaaagttcgtgtactcgcatcccaagcttaagaagctcgaggaagtggtgatcgagcactttaaatcttggaatgctgaaaacacaactgagaagaagagagacgagacgcgggtcatgatattttcctccttcagggatagcgtgcaggagatcgcggagatgcttagtcagcaccagccaattattcgggtgatgacttttgtcggtcacgcctccggcaaaagtacgaagggattcacccagaaggagcagcttgaagtggtgaaacagttccgagacggcggatacaacacgctggtgagcacatgtgtgggagaggagggacttgacataggagaagtagatctgataatctgcttcgatagccagaaaagtccaatccgcctagtacaacggatgggaaggacaggtcggaagagacaaggaagaatcgttatcatcctctcagaaggccgtgaggagcggatttacaaccagtcccagtccaataagcgctctatctacaaggcaatctctagcaaccgacaggtccttcacttttaccaacggagccccagaatggtacccgatgggatcaaccccaaattgcacaaaatgttcatcacccacggggtttatgagcctgagaagccatcacggaatctgcagcggaagagtagcatcttttcttaccgggatgggaaatag

SEQ ID NO: 116651 - DNA, 1968 bp, Artificial Sequence
  Description of Artificial Sequence: Synthetic coding sequence
atggctgactatagcacagtacccccaccatcctctggaagtgccggcggcgggggcggaggtggaggcggggggggggtcaatgatgccttcaaagacgcactccagcgtgcccggcaaatcgccgcaaagattgggggtgatgcggggacctctctgaacagtaatgactacggctacggaggtcagaagcgaccattggaggacggcgatcaacctgatgctaaaaaagttgctccccaaaatgactcttttggaactcagctgccccctatgcaccaacagcagtcgcgcagcgtgatgacggaagagtacaaggtgcccgacggtatggtggggtttattatcgggaggggtggcgaacaaatctcacgaattcaacaggagagcggttgtaagatccagatcgccccagactctggcggcttgcccgaacgttcttgtatgctgactggcaccccagagagcgttcagtccgccaagaggctattggaccagatcgttgagaaaggccggcctgcgccaggcttccaccacggcgacggacctgggaacgctgtgcaggagatcatgattcccgcttctaaagccggactggtgattggaaaagggggagagactatcaagcagcttcaggagcgcgctggcgtgaaaatggttatgatccaggacggaccacagaatactggtgccgacaaaccactcagaattactggcgatccctataaggttcaacaggcaaaagagatggttctcgagctcataagggaccagggtggatttagagaggtccgtaatgaatacggcagtaggattggcggaaatgagggaattgacgttcctatcccgagatttgctgtcggaatcgtgattggccgtaacggcgagatgattaagaaaatccagaacgatgcgggagtacggatccagtttaagccagacgacggaacaacccccgagagaatcgcacagatcacaggccctccagataggtgtcagcacgccgcagagattataacggacttgctgcggtctgtgcaggcaggaaatcctggcggccccggccccgggggcaggggtcgcggccgcggacaaggcaattggaacatggggcccccaggcggtctgcaggagtttaacttcattgtccctacaggaaagacaggccttataatcggaaaaggcggcgaaacaataaagagcatctcccagcagtcgggcgcacgcattgagctgcagaggaatccgccacctaatgccgaccctaacatgaaactgtttacaatccgggggaccccacagcagatcgactacgctcggcagcttattgaggaaaagatcggcggccctgttaatccactgggccccccggtgccccacggcccgcacggcgtgcctgggccccacggacccccgggaccccctggcccgggcactcccatgggaccgtacaaccccgccccttacaaccctggaccacccggccctgctccacacggcccaccagcaccttacgcaccccagggttggggtaacgcttaccctcactggcagcagcaagcaccccctgaccctgcaaaggccgggaccgaccccaatagcgccgcatgggcagcctattatgcccactattaccagcaacaggcccagcccccaccagccgctcctgcaggggcacccacaaccacacagaccaatggccagggtgatcagcaaaatccagcccccgctggacaggtggactacacaaaagcttgggaagaatactataaaaaaatggggcaagctgtaccagcaccgactggtgcccctccaggcgggcagccagactatagcgctgcctgggcagaatactataggcagcaggccgcatactacgctcagacctctccacagggcatgcctcagcacccccccgctccgcagggatttgcaaaccatgctaggtcccatcaccacctttactag

SEQ ID NO: 116652 - DNA, 1935 bp, Artificial Sequence
  Description of Artificial Sequence: Synthetic coding sequence
atggccgattactcgaccgttccacctcctagttctggatccgccggtggcgggggaggtggaggcggcgggggaggagtgaatgacgcttttaaagatgcattgcagcgggctcggcagatcgctgctaagatagggggagacgccggcacatccctgaattctaacgactacggctatggaggccagaagcgccctttggaggatggggaccagcccgacgccaagaaagttgcaccacagaatgattccttcggcacacagttgccaccaatgcatcagcagcaatctcggagcgtgatgacagaggagtacaaagtcccggatggaatggttggtttcattatcggacgcggaggcgaacagatctcgaggatccaacaggaaagcgggtgcaaaatccagattgccccagactctggtgggttgccggaacggtcttgtatgctgaccgggactccggaaagcgtgcagagtgccaaacggcttctcgatcagatcgtcgaaaaaggcagaccagcccctggttttcaccacggcgatggacctggtaacgctgtgcaggagatcatgattcctgcctccaaagccggccttgtgatcgggaaaggaggcgagaccatcaagcaattacaggaacgggctggggtcaagatggtgatgatccaggatggtccacagaacacaggcgctgacaagccgttgagaatcaccggggatccttacaaagtccagcaagctaaagagatggttctggaactgattcgcgatcaaggcggttttcgggaagtcagaaacgaatatgggtcaagaattggagggaacgaggggattgacgttcccatccctcgtttcgcagtgggcatcgtaattggacgaaacggagaaatgataaaaaagatacaaaacgatgctggcgtgagaattcagtttaaaccagacgacgggactacccccgagaggatcgcgcaaattaccggaccgccggatagatgtcagcatgctgcggagatcattaccgacctcctaaggagcgttcaggctgggaaccccggggggcccggccccggggggaggggtagaggaagagggcaaggaaattggaatatgggcccgccaggaggtctgcaggaattcaacttcattgttcctacggggaagacagggctgattattgggaaggggggggaaaccattaaatcgatttcacagcagagcggagctcggattgagctgcagcggaaccctccccctaatgccgatccaaacatgaaactctttacaatcaggggaaccccacagcagatcgattacgcccgtcagttaatcgaggagaagatcgggggccccgtcaaccccttgggacctcccgtaccccacggcccccacggcgtgcctggccctcacgggcctccgggcccaccagggcctggcacccctatgggtccctacaatcctgctccttacaatccaggcccgccagggccggcaccacacggaccccctgcaccttacgcacctcagggctggggaaatgcgtacccccattggcagcagcaggccccgccagatcccgccaaagctgggactgatcctaacagcgccgcatgggcggcctactatgcacattattaccagcaacaggcccaaccccctcctgctgctccggccggagcccctacaactacccagactaacgggcagggcgatcagcagaaccctgcaccagccggtcaggtggattatacaaaagcttgggaagagtactacaaaaagatgggacaggcagttcctgcccctacgggagcgccaccaggtgggcagcctgactactcagctgcctgggcagagtattaccgccagcaagccgcttattatgctcagacgtcgccacaaggtatgccccaacacccccctgcccctcagggacagtag

SEQ ID NO: 116653 - DNA, 1965 bp, Artificial Sequence
  Description of Artificial Sequence: Synthetic coding sequence
atggcggattacagcaccgtgccaccaccatccagtggaagcgctggcggcggtggggggggagggggaggagggggagtgaatgacgctttcaaagacgccctccagcgcgcccgacagattgccgccaagatcggaggcgatgccggcacatctcttaatagtaatgattacggatatgggggacagaaaaggccattggaggatggtgatcagcctgacgcaaaaaaggtggcccctcagaatgactcattcggtacccaattgccgccaatgcatcagcagcagcgtagcgtaatgacggaagagtataaggtaccagatggcatggtgggattcattataggacgcggcggagaacagatttctagaatacaacaggagagtggctgtaagattcagatcgcaccagactctgggggactgcccgaacggtcttgtatgctaactggaacaccagaatcagtgcagtcagccaagagactgctggaccagattgtcgagaaaggaagacctgctcccggatttcatcatggtgatgggccgggaaacgcggtgcaagagatcatgatccccgctagtaaggccggacttgtcatcggcaaggggggcgagactatcaagcagctgcaggagcgcgcaggggtgaagatggtgatgatccaggacggccctcagaacaccggcgccgataaaccacttcggattacaggagacccatacaaagtgcagcaagcgaaggagatggttctagagctcattagagaccagggaggattcagggaggtgagaaacgaatatggaagtcgcatcggaggaaacgagggaattgatgttccaattccccgctttgctgtgggcatcgtgatcggaagaaacggagagatgatcaagaaaatacagaatgatgccggagtccgaatccagtttaagcctgacgatggaacaacgccggagcggatcgcccagataactggcccccctgaccggtgtcagcacgccgccgagatcatcacagatctgctgcggtccgtccaggctggtaacccaggcggtcccggtcctggggggagggggcgcgggagagggcagggcaattggaatatgggtccacccggaggtttacaggagtttaactttatcgtcccgaccggcaagaccgggttgatcattggtaaagggggtgagaccatcaagtccatctcccagcaatcgggggcccgtatcgaactccagaggaacccgccaccaaacgcagaccccaatatgaagctttttacaatcaggggcacacctcagcagatagattatgctaggcagcttattgaagagaagattgggggtcccgtgaatcctctcggcccacctgtccctcacggaccacacggcgtgccggggccacatggccctcccgggcccccgggacctggaactcctatgggaccttataaccccgcgccatataaccctgggccacccggtcctgctccacatggtccgcctgccccatatgccccccagggctgggggaacgcctatccgcattggcagcaacaagcccctccagatcctgcgaaagccggtaccgatcctaactcagccgcttgggctgcgtactacgcccactactatcagcagcaggcccagccccccccagctgctcctgctggcgccccaaccactactcagacgaacggccaagagggtgatcagcagaatcctgcccccgctgggcaagttgattacacaaaagcatgggaggaatactacaaaaagatggggcaggcagtccccgctccaaccggcgctccacccggggggcagcccgactactcagccgcctgggctgaatactatagacagcaggcagcatattatgctcaaactagtccccagggaatgccccagcacccacccgcgccacagtgtcgatttgatcccgccagcattgagcttgccctgtag

SEQ ID NO: 116654 - DNA, 1890 bp, Artificial Sequence
  Description of Artificial Sequence: Synthetic coding sequence
atggcagactactctacggtgccccccccatcatcagggtctgctggaggcggaggaggaggaggggggggcggaggcgtaaatgatgcatttaaggatgcgcttcaacgcgccagacagatcgccgccaagattggcggcgacgcgggcacatctctgaatagcaacgattacggatacggtggtcagaagcggcccctggaggatggcgatcaacccgacgctaaaaaagtggcaccccagaacgattcctttggaacccagcttccacccatgcaccaacagcagaggtcagtgatgactgaagagtacaaagttcccgacggcatggtgggatttataatcggaagggggggcgagcagattagccgaatacagcaggagagcggctgcaaaattcagatcgcgcctgacagcggggggctgccagagcgttcctgcatgctaacaggcaccccggaatccgtacagtccgcaaagcgcctcttggatcagatcgtcgagaagggacgcccagcaccgggatttcatcacggtgacgggcccggcaatgccgtgcaggaaattatgatcccagctagcaaggcgggactggttataggtaagggcggagaaacgataaagcaactgcaggagcgggctggggtgaaaatggtgatgattcaggatgggccacaaaacaccggcgcggacaaacctttacgaataaccggagacccttacaaagttcagcaagccaaagaaatggtgttagaattgatcagagatcaggggggattccgggaggtcagaaacgaatatgggtcccggatcggtggcaatgaagggatcgacgtgcccatcccccgctttgctgtcgggatcgtgataggtcggaatggcgagatgattaagaagattcaaaacgacgcaggtgtccgtattcagtttaaacctgacgatggaactaccccggagcgcatcgcccaaattactggaccacccgaccgctgccagcacgcagccgagattattactgaccttctgcggtctgtgcaggcgggcaatcccgggggccccgggccagggggtagaggccgggggagagggcagggcaactggaatatggggccgcctggaggattgcaggagttcaatttcatagttccaactggcaagacgggactcattatcggtaagggtggggagacaatcaaatcaatctctcagcagagcggcgctaggattgaattgcaaagaaatcctccgccaaacgcagacccaaatatgaagttgttcacgatcaggggcacccctcagcagatagactacgctaggcagcttatcgaggaaaaaatcgggggacccgttaatccgctgggtcctccggtcccccacggtccaccagggacacctatgggaccctacaacccagcgccctataatcctggtcctccgggtcccgcccctcacggccctcctgcaccctatgctccccagggttggggaaatgcctatcctcactggcagcagcaggcccccccggaccctgcgaaagccgggacagacccgaatagcgccgcctgggccgcgtattatgctcattactaccaacagcaggcccagccgccccctgctgcaccagccggagcccctacgaccacacaaactaatggccagggggaccagcagaacccagctccagcgggccaagtggactacaccaaggcctgggaggagtactataagaaaatgggccaagcggtccctgcacccacgggtgctccacctggaggccagcctgattactctgccgcttgggcagaatactatcgacagcaggcagcctactatgctcaaaccagcccccagggcatgccacaacatccccctgccccgcagggacagtag

SEQ ID NO: 116655 - DNA, 699 bp, Artificial Sequence
  Description of Artificial Sequence: Synthetic coding sequence
atggcggattattcaaccgtccctccccccagctctggctctgctgggggcggtggcggaggtggtggcgggggcggcgtgaacgacgctttcaaggacgcactgcaaagggcacgacaaatcgccgcaaagattggtggagacgctggaactagcctgaactccaacgactacggttatggcggacaaaagcggcccctggaagacggggatggcagctggaccagtccttcttccacaacacattgggaggggatgccctccccattcaaagatcaacctgacgccaaaaaggtggccccccaaaacgatagctttggcacccaattgccccctatgcatcaacagcagcggtccgtgatgaccgaagagtataaagtgcccgatgggatggtgggcttcattattgggaggggcggcgagcagattagtcggatccaacaggagtcaggatgtaagatccagattgccccagattcgggtggcctgccggaacgctcatgcatgttgaccggcacccctgaatctgtgcagagtgccaaaaggctgttggatcaaatcgtcgaaaagggtagacctgcccctggtttccatcacggagacggccccgggaatgccgtccaagaaatcatgattcctgcctcaaaagcaggccttgtgattggaaaagggggggaaaccataaaacagttacagtag

SEQ ID NO: 116656 - DNA, 1998 bp, Artificial Sequence
  Description of Artificial Sequence: Synthetic coding sequence
atggcagactacagcacagtgcctcctccatcatctggcagcgccggaggcggtgggggaggcgggggaggcggtggggtcaatgatgcctttaaagacgctttgcagcgcgcacgacaaattgctgccaagattggcggggatgctggaacttccttgaactccaacgattatgggtatggagggcagaaaaggccactggaggatggagatggctcatggacatctccgagctcaaccacacactgggagggaatgccatcaccttttaaagaccagcccgatgccaaaaaggtggctccacagaacgatagcttcgggacccagctcccacctatgcaccagcaacagagccgtagcgtcatgaccgaagaatacaaagtgcctgacggaatggtgggctttattattggcagggggggcgaacaaattagtagaatccagcaagagagcggctgtaagattcagattgcccccgacagcggggggttaccggagcgatcatgcatgctcaccggcacaccagagagtgtccaaagcgccaagcgattgctggaccagatcgtggagaaagggaggcccgctcctggattccatcacggcgacggtccgggtaacgcggtccaggagattatgataccagccagtaaggctggtctggtaattggtaagggaggtgaaaccattaagcagcttcaagaacgggctggagtcaagatggttatgattcaggatggacctcaaaacacgggggcagataagcctctgaggatcacaggggatccctataaagtgcagcaggcaaaggaaatggtcctcgagctcattagagatcagggaggcttcagagaagtgcggaatgaatacggcagccgtatcgggggcaatgaaggcattgatgtccccatacccaggttcgctgtcgggatagtcatagggagaaatggcgagatgattaaaaagatccagaacgacgctggagtgcggattcagttcaaaccagatgatgggacaacgccagaaaggattgcgcagatcactgggcctccagataggtgccagcacgctgcagaaatcatcacagatctgttgaggtcagtgcaggcggggaaccctggggggccgggtcccggcggccggggaagggggcgcggccagggaaactggaatatggggccccctggcgggctgcaggagtttaatttcatcgtgccaaccggtaagaccgggctgatcattggcaaaggtggagaaaccatcaagtcgatatcccagcagagcggcgcacggatcgagctgcagcgcaatcctccaccaaacgccgaccccaacatgaaattgtttacaataagggggacacctcaacagatcgattatgcccgtcaactgattgaagagaagattggtgggccagttaatcccctcggtccaccagtaccacatgggccccatggtgttcctggtcctcatggccctccagggccccccggacctggtaccccaatgggtccatacaatccagcgccctacaatccgggaccaccaggtcccgctcctcacggaccacctgccccatatgccccccagggatggggcaacgcttacccccactggcagcaacaggcccctccagatcccgcaaaagccgggacagaccccaatagcgcggcgtgggccgcatattatgcccactattaccagcagcaagcccagccccccccggctgcgcccgccggagcgcctacgactacacagacaaacggtcaaggggatcagcagaaccccgcaccagccggacaggttgattacactaaagcatgggaggagtattataaaaagatgggccaggcagtgccagcacccacgggggcaccgccaggcggtcagcctgactactcagcagcatgggcagagtattaccgccaacaggccgcatactacgcacagacgagcccccagggcatgccacagcaccctccagccccacagggccaatag

SEQ ID NO: 116657 - DNA, 1260 bp, Artificial Sequence
  Description of Artificial Sequence: Synthetic coding sequence
atgcctctgagcagatggcttcgcagcgtaggggtcttcctgctgccagcaccatattgggcgcctagagaacggtggttaggcagtctccggagaccatctctggtgcacggctaccccgttttggcgtggcactcagcccggtgctggtgccaagcatggacagaagaacctagagctctctgttctagtctccgcatgaacggcgaccagaattccgacgtctatgcccaagaaaagcaggatttcgtgcagcactttagccagatcgtgcgcgtgttaacagaggacgagatgggccaccctgagattggcgacgccatagccaggctaaaagaagtacttgagtataatgccatcggcggcaaatataaccgggggctgactgtggtcgtggccttcagagagctcgtggagccccgaaaacaggatgctgacagccttcagagagcttggaccgttggttggtgtgttgaacttcttcaggctttttttctcgtggcggatgatatcatggacagctccctgaccagacgcggtcagatttgttggtatcagaaaccaggggtgggactggatgctattaatgatgctaatctgctcgaagcttgcatttaccgcctcttgaaactctactgtagagaacagccctattacttaaacttgatcgagctcttcctccagtcctcatatcagacagaaatcgggcagacactggatctcctcacagcgccccagggaaatgtagacctggtgaggtttactgagaagcgctataaaagcattgtcaaatacaaaaccgcattctatagcttttatctccccatcgctgcagctatgtacatggccgggatagatggagaaaaggagcatgccaatgcaaagaaaattctcctggagatgggagaattcttccagattcaggatgactacctcgatctcttcggcgatccatctgtgaccgggaagattggcactgacattcaggataataagtgctcttggctcgttgtgcagtgtttacagcgcgcaacacctgagcaatatcagattctgaaagagaattatggccagaaggaagccgaaaaagtggccagggttaaagccctgtacgaggagctggacctgcccgctgtgttcctgcagtatgaggaggactcctattctcatatcatggccctgatcgaacagtacgccgcaccattaccaccagccgtatttctgggcctggcccgcaagatctacaaaagacgcaagtag

SEQ ID NO: 116658 - DNA, 1260 bp, Artificial Sequence
  Description of Artificial Sequence: Synthetic coding sequence
atgccactcagcaggtggcttcgcagcgtcggcgttttcctgttgcccgcaccatattgggccccacgagagcgctggctgggttcactgcgaagaccatctttggtccacggctatccggtgctcgcctggcattccgccagatgttggtgtcaggcatggacagaggaacctcgagccctgtgtagcagcctgagaatgaatggtgatcagaattcagacgtctatgcacaggaaaaacaggactttgtccagcacttcagtcagattgtacgcgtgctcacggaagatgagatggggcacccggagataggtgacgccattgccaggctgaaggaggtcctagagtacaatgctatcggcggcaagtataacaggggcctcaccgtggtggtggcatttcgggagcttgtggagcccagaaagcaggacgcagatagcctgcagcgcgcttggactgttggttggtgtgtggaactgctgcaggcatttttcttagtggccgatgatatcatggactcttcactgactaggagagggcaaatatgctggtaccaaaagcctggcgtgggacttgacgccatcaatgatgccaaccttcttgaggcctgtatttatagacttctgaaactatactgccgcgagcaaccctactatctgaacctgattgaactcttcctccaatccagctaccagactgaaataggacaaacactggatctgctaaccgcccctcagggcaacgtggacctggtcaggttcactgaaaagcgctacaaaagcatagtcaaatataagacagcattttattctttctaccttccgatcgccgcggcaatgtatatggctggtatcgatggcgaaaaggagcatgctaacgcaaaaaaaatacttctggagatgggcgagttcttccagatccaagacgactacctggacctcttcggcgatccctcagtaacaggtaagataggcactgatatccaggataataagtgttcctggctcgttgtccagtgtttacagcgagccactcctgaacaataccaaatcttgaaggagaattacggtcagaaagaggccgagaaggtggcaagggtgaaagcactctacgaggagctggacctgccagctgtgttcctccagtatgaagaggattcttattcccacataatggcattgatagaacagtacgcagcgccactaccgccggctgtctttctgggattagctagaaagatatacaagcggagaaaatag

SEQ ID NO: 116659 - DNA, 1062 bp, Artificial Sequence
  Description of Artificial Sequence: Synthetic coding sequence
atgaatggagatcagaatagtgatgtgtacgcgcaggaaaagcaagattttgtgcagcacttttcccagatcgttcgcgttttgacggaagatgagatgggccaccctgaaatcggcgatgctatcgcccggctcaaggaggtgctggagtataatgctattggtggcaaatacaacaggggtttgacagtggtggtggcctttcgcgagcttgtcgaacctaggaagcaggatgcggactctctacagagagcctggaccgttggctggtgcgttgagctgcttcaggcattcttcttagtggccgacgacataatggactcgtctctgacgcgccgcggccagatttgctggtaccaaaagcccggggtaggactcgacgctatcaatgacgcaaacctgttagaagcatgtatttatagactccttaagttatattgccgggagcagccctactacttgaacctgattgaacttttcctgcaatcatcataccagacagagattggtcaaaccctcgatttgttgaccgcaccacagggaaacgtggaccttgtgagattcaccgaaaaacgttacaaaagcattgtcaagtacaagactgcattctactctttttaccttcctatcgccgctgccatgtatatggctggcatcgatggggagaaagaacacgctaacgccaagaagatcctcctggaaatgggagagtttttccagatccaggacgattatctcgatttgttcggagatccatcagtgacagggaaaataggaactgacattcaggacaataaatgtagctggttagttgtgcagtgtctgcagcgggccacacctgagcaatatcagattcttaaggaaaattatgggcaaaaggaagccgagaaagtagcaagggtgaaagcgctctacgaagaactggatcttcctgcagtgtttcttcaatatgaggaagattcctacagccacatcatggccctgattgagcagtacgctgcccctctcccacccgcggtgttcctcgggttagctcggaaaatctataaaaggaggaagtag

SEQ ID NO: 116660 - DNA, 2760 bp, Artificial Sequence
  Description of Artificial Sequence: Synthetic coding sequence
atgactggttacaccatgctgaggaatggtggagcggggaacggaggccagacctgtatgcttcggtggtctaatcgaatacgacttacatggctgtctttcaccctttttgtcatacttgtgttttttcctctgattgcccattactacttgacaactctcgatgaagccgatgaagccgggaagcggatctttggaccaagagttggcaatgaactttgtgaggtcaagcacgtcctcgatttgtgccgaattagagaaagcgtcagtgaggaactgctgcagctcgaggcaaaacgtcaagagctgaactctgaaatagccaaattgaatctgaagatcgaagcgtgcaaaaaatccatcgagaatgccaaacaagacctgctgcagttgaaaaatgttatatcacagacagaacattcgtacaaagagctgatggcccagaatcagcccaagttaagcctgccaatccggctgctgcctgaaaaagacgatgccggacttcctcccccaaaggctacccgaggctgccgacttcacaactgttttgattattctagatgcccactgacaagcggtttccccgtttatgtttacgattctgaccagtttgtgttcgggtcttatctggaccccctcgtaaaacaggcgtttcaggcaacggcacgggctaacgtatacgttactgaaaacgccgatatagcttgcttgtatgtgatcctcgtcggggagatgcaagagcccgtggtgctgcgaccagccgagctggaaaaacagctgtacagccttccccactggcgtaccgacggacacaatcacgtgataatcaatctgtcacggaagtccgacacccagaatctcctgtacaacgtctcaaccgggcgggccatggtcgcgcagagcaccttctatactgtgcagtacaggcccggctttgacctggtggtctctccactggttcatgcaatgagcgagcctaattttatggaaatcccccctcaggtcccagtcaagagaaagtatttatttacttttcaaggagagaaaatcgaaagtctgcgatccagcctgcaggaagcacggtcatttgaggaggaaatggagggcgaccctcctgcagactacgatgaccgaattatagccacgttgaaagctgtccaggatagcaaactggaccaagtgctggtggaattcacctgcaagaatcagccaaaaccgtccttaccgactgagtgggcattgtgtggcgaaagggaagataggctggaattgcttaaactgagtacatttgccttgatcatcactcccggcgatccaagattagtgatcagcagtggatgcgctacaaggctgttcgaagctctggaagttggcgccgtgcccgttgtcctcggggaacaggtgcagctgccctatcaggacatgctgcaatggaacgaggcagcattggtcgttcctaagcccagagtgaccgaggtgcattttcttctccgttctctgtccgactccgatctcctggcaatgcgcagacagggtcgtttcctgtgggagacatatttcagcactgccgattcaatatttaacactgtgttagccatgattcggacccggattcaaatacctgccgcgccaatccgtgaggaagcagctgcggagatcccacaccgctccggaaaagcagccggtacggacccaaacatggcagacaacggagatttggacctgggaccagtggaaacagaaccaccatatgcatccccaagatatctgcgcaatttcaccttgacagtgaccgacttttacagatcctggaactgcgctcccggaccatttcatctgttcccacatactccatttgaccccgttcttccctcggaggctaaattcctaggatcaggcaccggatttcggccaataggaggcggcgctggaggaagtggaaaagaattccaggccgcgctaggcggtaatgtgcctcgagagcagtttactgtggtaatgctgacttacgaacgggaggaggtcctgatgaattcattagagcggctcaatggcttaccatatctcaataaagtagtcgttgtctggaacagtcctaagttgccatctgaggacttactgtggccggatattggagtgccaattatggttgtaagaacggagaaaaactcgctgaacaacaggtttctgccatggaacgagatcgagaccgaggccatcctctctatcgatgatgacgctcaccttagacatgatgagatcatgtttggatttagagtatggagagaagcacgcgatcggatcgtgggctttccaggtaggtatcacgcatgggatatcccgcatcagtcatggttatacaattccaattactcatgcgaactaagcatggtgctgactggcgctgccttctttcacaagtactatgcctacctgtattcctatgttatgcctcaggccatcagggatatggtcgatgagtatattaactgcgaggacattgctatgaacttcctggtgagtcacattactaggaaacctcctatcaaagtcacctccaggtggactttcaggtgtccgggttgcccccaggcactctctcatgatgattcacactttcacgagaggcacaagtgcataaatttcttcgttaaagtgtatgggtatatgcctctgctgtacacccagtttagagtggatagcgttctgttcaagacacgcctgccccatgacaagaccaagtgtttcaaatttatatag

SEQ ID NO: 116661 - DNA, 1125 bp, Artificial Sequence
  Description of Artificial Sequence: Synthetic coding sequence
atggaattcgtgaagtgcttgggacacccggaggaattctacaacctcgtccggttccggattggcggcaagcggaaagtgatgccaaagatggatcaggactccctgtcctcttcactcaagacttgctacaaatatctcaaccaaacaagcagaagctttgccgccgttattcaggctctcgatggcgaaatgaggaatgctgtctgcatcttttaccttgtgctaagagcactggacactctggaggacgatatgactatctccgtcgaaaaaaaagtcccgctgctgcataattttcactccttcttataccagcccgattggcggtttatggaaagtaaggagaaagaccgacaagttctggaagacttcccgacgtattgtcactacgtagctggcctggtgggtattggactctcccggcttttcagtgcaagcgagtttgaagatcctctggtgggggaggacaccgagagagctaacagcatgggtttgttcctgcagaaaaccaatataattcgcgactacctagaggatcaacagggcggccgggaattttggcctcaggaggtgtggagtagatatgtgaaaaagctgggcgacttcgcaaaacccgagaacatagacctggcagtccagtgtttgaacgaattgattaccaatgcactgcaccatatccccgacgtgattacctacctgtcgcggcttcggaaccagtctgttttcaacttctgcgctattccacaggtgatggccattgcaacgctggcagcctgctacaataaccagcaggtctttaaaggcgctgtgaaaattcgtaagggccaggccgtgactttaatgatggacgccactaatatgcccgcagtcaaggccatcatctaccagtatatggaggaaatctatcacaggattccggactcggatccatctagctctaagactaggcagatcatttcaacaatcaggacacagaacctcccaaactgtcagctgataagccgaagccactacagtcccatctacctgtcttttgtaatgctactcgcagcactgtcctggcagtaccttaccaccctgagtcaggtgactgaagactacgttcagactggcgagcattag

SEQ ID NO: 116662 - DNA, 999 bp, Artificial Sequence
  Description of Artificial Sequence: Synthetic coding sequence
atgactatttctgtcgaaaaaaaagttcccttactccacaacttccattcatttctgtatcaaccagattggcggtttatggaaagtaaggagaaggaccgacaggttctcgaggatttcccgaccatttccctggaattcagaaatctggccgagaaataccaaacagttattgctgatatttgtaggaggatgggaatcgggatggctgagtttctggacaaacatgtgacgagcgagcaagaatgggataagtactgtcattacgtggccggactggtaggcatcggtttgagtagactgttctcagctagcgaattcgaggaccccctagtcggagaagacacagaacgcgctaacagcatggggctatttctgcaaaaaacaaacattatcagagactatctggaggatcagcagggtggtcgggaattttggccacaggaggtctggagtcgctacgtaaagaaacttggtgatttcgccaagcccgaaaacatagacctggctgtacagtgcctcaatgaacttattactaacgcactacatcatatccctgatgtgatcacctacttgagccgccttcgcaatcagagtgtatttaacttttgcgctataccgcaggtcatggcgatcgccacgttggctgcatgctacaacaaccagcaggtgtttaaaggggctgtgaaaatccggaagggacaggctgtgacgctgatgatggatgcaactaatatgccagccgtcaaagccataatttaccagtacatggaagaaatctatcacagaatacctgattcagacccgtcctcatctaaaactaggcaaatcatctccaccataagaactcagaatctgcctaactgccagctgatctcacgctcacattatagtcctatctatcttagcttcgtgatgctcctcgctgccctgtcttggcagtacttgactacccttagccaagtgacggaggattatgtccagaccggcgaacactag

SEQ ID NO: 116663 - DNA, 1233 bp, Artificial Sequence
  Description of Artificial Sequence: Synthetic coding sequence
atggagttcgtaaaatgccttggacaccccgaagagttttacaatctggtaaggtttcggattggtggaaagcgaaaagactccttgtcaagctccctcaagacgtgttataaatacctgaatcagacatctcgttcgtttgctgcggtcattcaggccctcgatggagagatgagaaatgctgtgtgcatattttacctcgttttaagggccctggacactctggaggacgatatgacgatttccgtggagaagaaggttccccttcttcacaactttcacagcttcttgtatcagccagattggcggttcatggaaagtaaggaaaaagacaggcaggtgctggaggacttccctactatcagcctggagtttcggaacctagcagagaaataccagacagtaatagccgacatttgcaggcgtatgggtatcgggatggcggagtttctggacaaacacgttacgtcagagcaagagtgggacaagtattgccactatgtcgcagggcttgtcggtatcggcttgtcccggctgtttagcgccagcgaattcgaggatcctctggtgggagaggacaccgaaagggcaaatagcatgggtttgttcctgcagaagactaacatcatccgggactacctggaagatcaacagggcggacgggagttctggccccaagaggtgtggagtcgttatgtgaaaaagctcggggattttgccaagccagaaaacattgacctggccgtccagtgcctaaatgagctgattaccaacgctctgcaccacattccagatgtaattacctacctctctagattaaggaatcagtccgtatttaatttttgtgccattccccaggtgatggccattgccactctagccgcatgttacaataatcagcaggtgttcaagggggccgtgaagatcagaaaagggcaagcagtcactctcatgatggacgctaccaatatgccagcagtcaaggctattatttatcagtacatggaggagatctaccacaggatcccggactccgatccaagtagcagcaagacacgtcagattatttcaacaattagaacccaaaacctgcccaattgtcagcttatcagcagatctcactatagccccatctacctctcatttgtaatgttactcgctgctctctcttggcagtatctgacgacgcttagccaggtcaccgaagattacgtgcagactggagagcattag

SEQ ID NO: 116664 - DNA, 999 bp, Artificial Sequence
  Description of Artificial Sequence: Synthetic coding sequence
atgactatttctgtggagaaaaaagtgccactattacacaatttccactctttcttataccagcctgactggcgcttcatggagagcaaagaaaaggaccggcaggtgttggaggactttccaaccatcagtctggaattcagaaatctcgccgaaaagtaccagaccgttatagccgatatttgcaggcggatgggaataggaatggctgaattccttgataaacacgttacatccgagcaagagtgggataaatattgtcactatgttgccggattggttgggattggcctcagccggctgttctccgcaagcgagttcgaggatcctcttgtgggggaagacactgaacgggcgaattctatgggactgtttctccagaagaccaatataattcgggattacctcgaggaccaacagggaggacgcgagttttggcctcaagaagtgtggtcccggtatgtgaagaaactgggcgactttgcaaagcccgagaatattgatctagctgtgcagtgtctgaatgagctcatcacgaatgccttacaccacattcctgacgtgatcacgtatctcagccgtcttcgcaaccagagcgtcttcaacttttgtgccatcccgcaggtcatggctattgctactttggctgcttgctataacaatcagcaagtgtttaagggagccgtaaaaatccgtaaaggacaggccgttacacttatgatggatgcgactaacatgcctgccgtaaaggccattatttatcagtacatggaggaaatataccataggatacccgattctgaccccagcagctcaaagacgaggcagatcatctccactatccggactcagaacctcccaaactgccagctgatcagcagatctcattactctcctatttatctaagttttgtgatgcttctcgcagctctatcctggcagtatctgactaccctttctcaagtcaccgaagattatgtacagactggcgaacactag

SEQ ID NO: 116665 - DNA, 1062 bp, Artificial Sequence
  Description of Artificial Sequence: Synthetic coding sequence
atgagaaatgcagtgtgcattttttatcttgttttgagggccctggacacccttgaagatgacatgacaatcagcgttgaaaagaaagtccctctgctgcacaacttccacagtttcctctatcagcccgattggcgcttcatggagtcgaaagagaaggaccgccaggttttagaggattttcctaccatcagcctggagtttaggaacctggccgagaaatatcagaccgtcatagccgacatctgtcgccgtatgggtattggtatggcagaatttctcgacaaacacgtcacgtccgaacaagagtgggacaagtattgccattatgtcgccgggctcgttgggattggcctgtctagactttttagcgccagtgaattcgaggacccacttgtgggggaagacactgagagagcgaattccatgggcctgtttctgcagaaaactaatattatcagggactacctggaggatcagcagggcggtcgcgaattttggccacaggaggtgtggagcaggtatgtgaagaagctgggtgactttgccaaaccagaaaacattgacctggccgtgcagtgcctgaacgaactgattactaatgccctgcaccacattcctgacgtcatcacttacctttcaaggttacggaatcaaagcgtgtttaatttttgtgcgataccccaggtgatggctatcgcaaccttggccgcttgttacaataatcagcaagtgtttaagggagcagtaaaaatcagaaagggccaagccgttacattgatgatggatgcgactaacatgcctgcagtcaaggccatcatttatcagtacatggaagaaatctaccaccggatcccagattccgatccttctagttccaaaactcgtcagattattagtactataagaacacaaaaccttcctaattgccagttaatctcccggtctcactattcaccaatctacctgtcattcgtgatgctgctggctgctctttcctggcagtacctcacgaccctgagccaagtgacagaggattacgttcagaccggcgaacactag

SEQ ID NO: 116666 - DNA, 1062 bp, Artificial Sequence
  Description of Artificial Sequence: Synthetic coding sequence
atgagaaatgccgtctgcattttttacttggtgttacgtgcgctggacacactcgaagacgatatgactatcagcgtggagaaaaaggtgccgctgctccacaactttcacagcttcctctatcagcctgattggcgctttatggagtctaaagaaaaagatcgccaagtgctggaggatttccccacaataagcctggagtttaggaatttggcagagaagtaccaaacagtcatcgctgatatttgccggaggatgggtattggtatggccgaattcttggacaaacatgtaacatccgagcaggagtgggacaaatattgtcactatgtggccggcctcgtagggattggcttgagtcgcctgttctccgcctcagagtttgaagacccgctggtcggggaagataccgagcgggccaactctatggggctgtttctccagaaaacaaacattattcgggactatcttgaagaccagcagggcggccgagaattttggccacaagaggtgtggagtcgctacgtgaaaaaactgggggactttgccaagccagagaatatcgatctggctgtgcagtgcctgaacgagttgatcacaaatgccttgcatcacatcccagacgtgattacatatctgtcgagactgcgaaatcagtcagtgtttaatttctgcgcgattccgcaggtgatggctatcgccacattagcagcctgttacaataatcagcaggtcttcaaaggcgctgtcaagatccgcaaaggccaagcagtcactctcatgatggacgccaccaacatgccagccgtcaaggcaattatttaccagtatatggaggaaatctatcaccgcatcccagattctgacccgagcagctccaagacccgacagatcatctctacgatccgcactcagaacctgcctaattgccagcttatttctcgctcccattattcacccatctacctcagctttgtgatgctgttggctgccctgtcatggcagtaccttacaactttaagccaggtcacagaggattacgtccagaccggcgagcattag

SEQ ID NO: 116667 - DNA, 921 bp, Artificial Sequence
  Description of Artificial Sequence: Synthetic coding sequence
atggaatccaaagaaaaagaccgacaggtgctggaggatttccccaccatcagcctcgagttcagaaatctcgctgaaaagtatcaaacagtaatcgctgatatctgtcgtcggatggggatcggcatggcagaatttctggacaagcatgtgacttccgagcaagaatgggataagtactgtcattacgtagccggactggtggggatcggccttagcaggctgttctccgctagtgagttcgaagatcctctggtgggcgaggatacagaacgtgcaaatagtatgggcctgttcctgcagaagacaaacattattagggactacttggaagatcagcaaggaggccgtgagttctggcctcaggaggtatggtcacgatatgttaaaaaactgggggattttgccaagccagagaatattgaccttgcagtccagtgtctgaatgagttaatcactaacgctcttcatcatatccctgacgttattacttatctcagccggttgcggaatcagtctgtgtttaacttctgcgctattcctcaagttatggctattgcaacccttgctgcgtgctacaacaaccagcaggtgtttaagggtgcagttaaaatcaggaagggccaagctgtgacactcatgatggatgccacaaatatgcccgccgtaaaagcaataatttaccagtatatggaagagatttaccacaggattcctgattccgacccaagcagttctaagactcggcagattatcagcacaattcgcacacagaatctgcctaactgccaactcattagcagatcccactattcgccaatctatctgtcattcgtgatgttgctagccgccctttcttggcaataccttaccactttgtcgcaagtgactgaggactatgtccagactggggagcattag

SEQ ID NO: 116668 - DNA, 1140 bp, Artificial Sequence
  Description of Artificial Sequence: Synthetic coding sequence
atggccgctacagaaggggtaggagaggccgcccagggaggtgagcccggccagccggcacagcctccccctcagccgcacccacccccgccgcagcagcagcacaaggaggagatggccgccgaagcaggtgaagcagtcgccagccctatggacgatggctttgtgtcactggacagcccatcctacgttctgtaccgggatcgcgctgagtgggccgacattgatcccgtgccccaaaatgacggccctaaccctgtggttcagatcatttactccgataaatttcgcgacgtttacgattactttcgggccgtgctgcagagggacgagaggtccgagcgcgcgtttaagctcacacgcgatgccatcgaactcaacgccgccaattatactgtgtggcacttccggagagtcttactgaaatctctccaaaaggacttgcatgaggaaatgaactacatcacagctattatcgaggagcagcctaagaactatcaggtgtggcatcatcggagggtgctcgtcgagtggttgagggacccttcccaggagcttgagttcatcgcagatattctcaatcaggatgcaaaaaactatcatgcatggcagcaccgacaatgggtgattcaagagttcaagctgtgggataatgaactgcagtacgtggatcaattattgaaggaggacgtcagaaataactccgtctggaaccagcggtactttgtgatttccaacaccaccggttacaacgatagggccgtgcttgagcgggaggtccagtacacattggagatgataaaactggtcccccacaatgaatccgcctggaactatctgaaggggattttgcaagaccggggcctctctaaataccccaacctgctgaaccagctgctcgatcttcaaccgtctcattccagcccatacctaattgccttcctcgtagacatctatgaagacatgctggaaaaccagtgcgataacaaggaggacattctgaataaggcactggagttgtgtgagattttggctaaagagaaggatacaatccgcaaggaatactggcggtatatcggccggtctctgcagtccaagcactcaacagaaaacgattcccccaccaatgttcagcagtag

SEQ ID NO: 116669 - DNA, 939 bp, Artificial Sequence
  Description of Artificial Sequence: Synthetic coding sequence
atggccgcgacagaaggcgtaggtgaagctgcacagggtggggagcctggccagcctgcacaaccccccccacaacctcaccctcctccgccgcagcaacagcacaaagaagaaatggccgcagaagccggagaggccgtcgcctctcccatggacgatggctttgtctccctggatagtccatcttacgtgctatatagacacttccgcagggtcttgttgaagtccttgcagaaggacctgcatgaggaaatgaactacattaccgctatcattgaagaacagccaaaaaactatcaagtttggcaccatcgaagagtgttagtggaatggttaagagatccaagccaggagctggagtttatcgccgatatcctaaaccaggatgctaagaattatcatgcgtggcagcataggcagtgggtgatccaggagtttaaactgtgggataatgagctccagtatgtagaccagttattgaaagaggacgtgagaaataacagcgtgtggaaccaacgttactttgtgatctccaacactacaggctataacgacagggccgtcttagagcgggaggttcagtatacactcgagatgattaaacttgtgccccacaatgagtccgcttggaactacctgaagggcatcctacaagatcgggggctaagcaagtatcccaatttgttgaaccaactgctggacttgcagccttcgcacagctccccctacctaatagcatttttggttgacatttacgaagacatgctggaaaaccaatgcgacaataaggaggatattttgaacaaggctctggaattatgcgagattctcgccaaggaaaaggatactataaggaaggagtattggcggtacatcggcagatccctgcaaagtaagcactccacagaaaacgatagtccaaccaacgttcagcagtag

SEQ ID NO: 116670 - DNA, 1314 bp, Artificial Sequence
  Description of Artificial Sequence: Synthetic coding sequence
atggctagtcccagctcattcacctactactgcccgccatccagctcccccgtttggagcgagcccctgtacagtctgagacctgagcatgccagagagcgattacaagacgactctgtggagacggtaacaagcatcgagcaggctaaggtggaagagaagattcaggaagtgttttcttcatacaagtttaatcatctggtcccgcgcttggtcctgcaacgtgagaagcatttccactacctcaagcggggcctgcgtcagttaaccgatgcatacgaatgcctggacgctagtcgaccctggctctgttattggattctccacagcctggaactgctcgatgagccaatcccacagattgtggcaactgacgtctgccaattcctggagctttgccaatcacccgagggaggctttggaggcggcccagggcagtatccccatctggcccctacctatgccgctgtgaacgcattatgcattatcgggacagaagaagcatacgacatcattaatcgtgaaaagctgctgcaatacctgtattctctgaaacaacccgacggttccttcctaatgcacgtgggcggggaggtcgacgttagaagtgcttactgcgcggctagcgtggcctcgctgacgaatatcataacaccggacctcttcgaagggaccgctgagtggattgcacgctgtcagaactgggagggaggaattggcggagtgcctggcatggaggcacatggtggctataccttttgtggtttagcagcactggtcatacttaagagggagcgctcacttaatttgaagagccttttacagtgggtcacatctcggcagatgcgatttgaaggtggatttcagggtcgatgtaataaacttgtcgacggatgttactcattctggcaggctggactgctgccgctgctccatcgagctctgcatgcacagggtgatcctgcactgagtatgagccattggatgttccaccagcaagccctgcaggagtacattctcatgtgttgccagtgtcccgccggcggcctgcttgacaagccagggaaatcccgagatttttaccacacctgttactgtctgtctggcctgtctatcgctcagcatttcggctctggcgccatgttacacgacgtggtacttggcgtccccgaaaatgccctgcaacccacacacccggtgtataatataggccctgataaggttatccaggcaacgacatattttctgcagaaaccagtaccggggtttgaggagcttaaagacgaaacatcagcggagcccgcgacggattag

SEQ ID NO: 116671 - DNA, 1953 bp, Artificial Sequence
  Description of Artificial Sequence: Synthetic coding sequence
atggcttcaaatatggacagagaaatgatacttgccgacttccaggcctgcactggcatcgagaatatcgacgaagcaatcactctcttagagcagaacaattgggatctggttgccgcgattaatggagttatcccacaggaaaacggaattctgcagagcgaatacggaggagagactatcccaggtccagcatttaacccagcatcccacccagcatccgctcccaccagtagctcctctagcgcctttagacccgtgatgcccagcaggcagatcgtagagcgccagccaagaatgttggattttagggttgagtatagggatcgtaatgtggacgtagttctggaggacacttgtactgttggcgagatcaaacagattctggaaaatgaactgcaaattcctgtcagtaagatgttgcttaagggatggaaaactggggacgtcgaggactcaacagttctgaagtctctccacctgcccaagaacaacagcctctacgttctcacgcctgatttgcctccaccatccagctcctcccatgccggcgcactccaggagtcccttaaccagaacttcatgctgatcatcacgcacagggaggtacagcgggagtacaatctgaacttcagcggttcctccaccatccaggaggtgaaacgaaatgtgtacgacttaacctccatcccagttaggcatcagctctgggaggggtggcctacttccgccaccgacgatagcatgtgtctcgccgaatcaggtctgtcttatccctgtcaccggctgacagttgggaggcgctctagtcctgcccaaacccgcgagcagtctgaggagcagattactgacgtgcatatggtttccgactcagacggcgatgattttgaagacgccacggagttcggcgtcgatgatggtgaagtgtttggtatggcctcttcagcactgcggaaatccccaatgatgcctgagaacgcagagaatgagggcgacgcactgcttcagttcacagcagaattttcttcacgatatggcgattgtcaccccgtcttttttattggctctcttgaagcagccttccaagaagccttctatgtgaaagcgagagatcgaaagctgctagccatttatcttcaccacgacgagagtgtgctaaccaacgtattctgcagtcaaatgttgtgcgccgagtcaatagtgagctatcttagccaaaactttattacttgggcatgggacctcactaaggactctaaccgcgcaaggttcctgaccatgtgcaatcggcattttggttctgtagtagctcaaactattagaacgcagaaaactgatcagtttccattgttcctgattatcatgggaaaacgcagtagtaatgaggtgttgaatgtaattcaaggcaacacaactgtagacgaactcatgatgcgactaatggctgctatggagatttttacggctcagcaacaggaggatataaaggacgaggatgagagggaggcccgcgagaacgttaagcgcgagcaggacgaagcttatcggctgagtctagaggcagatagggctaagcgtgaggcacacgaaagggagatggccgaacagttcaggctcgagcagattcggaaggaacaagaggaggaaagggaagccatccgactgagcctcgagcaagcactgcctcccgagcccaaggaagagaatgccgaaccagtgagcaagctgcgtattcgtacgccatccggcgagttcctggaaagaaggtttctggcctcaaataagttgcaaattgtgtttgattttgttgcatctaagggcttcccatgggacgagtacaaacttctgtccacatttcccaggcgcgacgtgactcagctggatcctaataaatcgcttctcgaggttaagctttttccccaggaaacgttattcctcgaggcaaaagagtag

SEQ ID NO: 116672 - DNA, 1473 bp, Artificial Sequence
  Description of Artificial Sequence: Synthetic coding sequence
atgattttagccgactttcaggcctgcacaggtatcgaaaatatcgatgaagcaatcaccctcctcgagcaaaacaattgggacctcgtagcggcgattaatggggtgatcccccaggagaacggtatattacagagcgaatacggtggtgaaaccattcccggccctgcattcaatccggcatcccacccagccagcgcgcccactagttcatcctcaagcgcatttcgccccgtcatgcccagccggcagatcgtggaaaggcagccgcgtatgttggattttagggtcgagtatagagacaggaacgttgatgtggtcctggaggacacttgcaccgttggcgagatcaaacagatcctggaaaatgaactccagattccggtcagcaagatgctgctgaagggctggaaaactggggatgttgaggactctacagtactgaaaagtttacatctgcccaaaaacaattctctctatgtgctgacccctgacctgccccccccgtctagctcaagccacgccggagccctccaggaattctcttctaggtacggcgattgtcaccccgtgttttttattggaagccttgaggcagccttccaggaggcattttatgtaaaggcccgggacagaaaacttctggccatctacctacaccatgatgaatctgttcttacgaatgtcttctgtagccagatgttgtgcgcagagtcaattgtttcttacttgtcgcaaaattttataacatgggcatgggacctcaccaaggactccaatcgggcccgctttctgacgatgtgtaatcgacactttggctctgtagtggcgcagactatcaggacccagaaaaccgaccagttccctttgtttctcatcattatgggcaaacgatcgtctaacgaggtgcttaacgtcattcaaggcaatactacagttgacgaactgatgatgcggctcatggcagctatggaaatcttcactgctcagcagcaggaagacataaaagacgaagatgagcgtgaagccagagaaaatgttaagcgagaacaggacgaagcataccggttgagtctggaagccgaccgcgcgaagagggaagcccatgagcgggaaatggcagagcagttcagactcgaacaaatcaggaaggaacaggaggaggaacgtgaagccatccggctgtcattggagcaagccctcccccctgagcctaaagaagagaatgccgagcccgtgtccaaactacggatcaggactccatctggtgaattccttgagcgccggttcctcgctagcaataaactgcaaatcgttttcgacttcgttgcaagcaaaggctttccgtgggacgagtacaaacttctgtccacctttccccggcgcgatgttacacaacttgaccctaacaagagtcttctggaggtgaaactctttccacaagagaccctcttccttgaggccaaagagtag

SEQ ID NO: 116673 - DNA, 1953 bp, Artificial Sequence
  Description of Artificial Sequence: Synthetic coding sequence
atggcgagtaatatggacagagagatgattctggctgattttcaggcctgcaccggaatagagaatatcgacgaagccataaccttactcgaacagaacaattgggacctggtcgccgccattaatggggtgatcccccaggagaatggaattctgcagtccgagtacggcggcgagacaatacccgggcctgccttcaaccctgcatcccatcctgcctctgccccaacgtccagtagtagctccgcctttcggccagtaatgccttcaagacaaattgtcgagcggcagccacgtatgttagacttcagggtggagtatagggatagaaacgtcgacgtggtgctggaagacacttgtaccgtcggagaaattaaacagattctggagaacgaactccagatccccgtctccaaaatgctcctcaagggctggaagaccggtgacgtcgaggattccaccgtgctgaagtccctgcacctccctaagaataactccttatatgtcctcactcctgacctgccccccccatcatcctcttctcatgctggagctctgcaggagagcctgaaccagaatttcatgctcatcatcactcatagagaggtgcagagggagtacaaccttaacttctctggcagttcgacaatccaagaagtgaagcgaaacgtgtacgacttgacctctattccggttcgtcatcagctgtgggagggatggcccacttcagcaacagacgactcaatgtgcttggctgagtccggtctctcctacccgtgccatcggcttaccgttggacgccggtccagccctgcacagacccgcgagcagtctgaggagcagattacggacgtccacatggtgtctgacagtgacggcgatgactttgaggatgctacagagttcggagtggacgatggagaagtttttgggatggcctcttcagccctgaggaaatcacccatgatgccagagaatgcggaaaacgaaggtgatgcactcctgcagttcacagcggagttctcaagcagatacggcgactgtcaccccgtctttttcatcgggagcctagaagcggcatttcaagaagccttctacgtaaaggctcgtgatcgcaagctgttggcaatttacctgcatcatgacgagtctgtacttactaatgtattttgcagccagatgctgtgcgcagagagcattgtctcttatctgtcacagaactttatcacttgggcatgggacctaacaaaggacagtaacagggctagatttctaaccatgtgtaacaggcattttgggtctgtggtcgctcagaccatccggactcaaaagacggaccaattccccctattcctaataatcatgggcaaacgctcaagcaacgaagtgctgaacgtcatccaaggcaacaccaccgtcgacgaactgatgatgcgccttatggcagcaatggaaatttttacggctcaacagcaggaagatataaaggacgaggacgagagggaggcccgtgaaaatgtgaaacgagagcaggacgaagcctatcgcttaagtctggaagccgacagagccaagagagaagcacacgagcgcgaaatggccgaacagttcagactggaacagatccgtaaagaacaggaggaggaacgagaggctatcaggctaagtctggagcaggcccttccgcctgagcctaaggaagagaatgctgaacctgtgtccaagcttcgtatccgcactccgtccggtgagttccttgagagacgctttctcgcctccaacaagctgcagatcgtatttgatttcgtcgcatctaaagggtttccatgggatgaatacaaattgttgtcaacctttcccagacgtgacgtaacacagctggatcctaacaagagcttactggaggtcaaactcttcccccaggagaccctatttctcgaggcaaaagagtag

SEQ ID NO: 116674 - DNA, 1497 bp, Artificial Sequence
  Description of Artificial Sequence: Synthetic coding sequence
atggcctcaaatatggaccgcgagatgatcctggccgacttccaggcctgcaccggcatagaaaatattgatgaggctatcaccctgcttgagcagaacaactgggacctcgtggcagcgatcaacggggtcatcccccaggagaatgggattctgcagtccgagtatggcggtgaaacgatccctggacccgcctttaatccggccagccaccctgcttccgcgcccacaagctcctcatctagcgccttccgtccagtgatgccaagcaggcagattgtggaacggcagccaagaatgctggattttagagtggagtacagggacagaaatgttgacgtcgtattagaagatacttgcaccgtgggcgaaattaagcagatactggaaaacgaactgcaaattcccgtatcaaagatgcttctgaagggatggaagactggggacgtggaagatagtacagttctgaaaagccttcacctgccaaaaaataacagcctgtacgtattgacacctgatcttccaccccctagtagctcttcccatgccggcacacttcagcagttcagttatcgatacggcgactgccatccagtatttttcatcggttcacttgaagccgccttccaggaggcgttctacgtcaaagctcgcgatcgcaagttgttggctatctacctccaccacgacgagtctgtgctgactaatgttttttgttcccagatgctgtgcgccgaaagcatcgttagctatctctctcagaacttcatcacctgggcctgggacctgaccaaggattctaatagggcccgctttctcacaatgtgtaacaggcacttcgggagcgtcgtggcccagactatacggactcagaagacagatcaatttcccctttttctgataatcatggggaaaagaagctcaaatgaagtgctgaacgtgattcaggggaatactacagtcgacgaattgatgatgaggctgatggccgctatggagatatttaccgcgcagcaacaggaagatatcaaggacgaggatgaaagagaagcacgcgagaacgttaaaagggagcaggatgaagcttaccgactctctttggaggccgatagagccaaacgagaagcacatgagagagaaatggccgaacaattccgcttagagcagattagaaaggaacaagaagaagagcgtgaggcaattcgtctcagtctggagcaggccctgccccctgagcccaaggaggagaacgccgagccagtctccaagctgcggatccgcactccaagtggcgaatttctggagcgacgcttcctcgcttccaacaaactacagatcgttttcgacttcgtggcttccaagggattcccatgggacgagtataagctgttatccacattcccgaggagggatgttacccagctggatcccaataagagtctcctggaggtcaaattgttccctcaggaaacactgtttcttgaggcaaaggaatag

SEQ ID NO: 116675 - DNA, 1227 bp, Artificial Sequence
  Description of Artificial Sequence: Synthetic coding sequence
atgagaaatctgctggagatgtgtctggccgagagtggtctgagttatccctgccatagactcacagttgggcgccgctctagccccgcacagacgcgggagcaaagcgaggaacagatcaccgacgttcatatggtgagtgatagtgacggcgatgatttcgaagacgctacggagtttggagtggacgacggagaagtgtttgggatggcctcttctgccctacggaagtctcctatgatgcccgaaaatgcagagaacgaaggtgatgccctgttgcaattcaccgcagaattttcatctaggtatggcgattgtcacccggttttctttatcggttccctggaggccgctttccaggaagctttctatgtgaaggcaagggatcgcaagcttcttgccatttatctacatcacgacgagtccgtccttactaatgtgttttgcagtcagatgctgtgcgctgaatctatcgtgtcctatctgtcccaaaactttatcacatgggcttgggatctgactaaggattccaatcgggctcggtttctcacaatgtgtaacagacactttggttccgtggtggcccagaccattcgaactcagaaaactgatcagtttccgctgtttctgattataatgggcaaaaggagttcaaacgaggtactcaacgtgatacaaggaaacacaaccgtggacgaactgatgatgcggctgatggccgctatggagattttcacagctcaacagcaggaagacataaaagatgaggacgaaagggaggctagagagaacgtgaaacgggagcaagatgaggcctacaggttatccctggaggcagatcgggccaaacgagaggcccatgagagggaaatggctgagcagttcaggttggaacaaatacgaaaagagcaggaggaggagcgtgaggctatccgtctgagcctcgagcaggcactcccacctgaacccaaggaggaaaatgccgagcctgtgtccaagctgagaatcaggacaccttcaggggagttcctcgaaaggagatttttggcctccaacaagcttcagattgtgttcgactttgttgcatctaagggcttcccctgggatgaatataaactcctctctaccttcccaagacgcgacgttacccagttggaccctaacaaaagtctcttggaagtaaaactgtttccccaggagaccctgtttcttgaggcaaaagagtag

SEQ ID NO: 116676 - DNA, 951 bp, Artificial Sequence
  Description of Artificial Sequence: Synthetic coding sequence
atgacccagggcaagctgagcgtggccaataaggccccgggcacggagggacagcagcaggttcacggcgagaagaaagaagcccccgccgtgcctagtgccccaccatcatacgaggaggcaacgtcaggggagggtatgaaagcaggcgcatttccacccgctccaaccgctgtgccactgcatccttcttgggcttatgttgatccaagctcttcctcctcatacgacaacggatttcctaccggagatcacgagctgttcaccaccttctcttgggacgatcagaaggtgcggcgtgtattcgtacgcaaagtgtacaccatcttattaatccagcttttggttaccttagccgtggttgcactgttcaccttctgcgacccagtgaaggactatgtgcaggctaaccctggttggtattgggccagctacgccgttttctttgcaacctatcttactctggcatgttgcagcggcccacgccgccattttccctggaatcttatcctcctgaccgtatttacgctcagtatggcttatcttaccgggatgctgtcctcatactacaatacaacatcagtgctgctctgcctcggcatcaccgcactggtctgcctctcagtcaccgtcttcagctttcaaaccaagttcgattttaccagctgtcagggcgtcctgtttgtgttattgatgacactgttcttcagtggactgatcctggccatactgctgccattccagtatgtcccttggctgcatgctgtatacgctgctcttggagctggcgtgtttacattgtttttagctctggacacccaactattgatgggaaacagacggcacagtttgagccctgaggagtacattttcggcgcactcaacatttatttagatatcatctatattttcacttttttcttgcaactctttggaactaaccgggagtag

SEQ ID NO: 116677 - DNA, 951 bp, Artificial Sequence
  Description of Artificial Sequence: Synthetic coding sequence
atgacacaggggaaactgtccgtcgcgaacaaagcccctggtaccgagggccaacaacaggtgcatggtgagaaaaaagaagcacccgccgtaccaagcgcgcccccatcctacgaggaggccacatctggcgagggcatgaaggccggtgcctttccccctgctccaactgctgtcccactgcaccccagttgggcctatgtcgatccttcaagctcgtcttcgtacgacaatggctttcccacaggcgaccatgagttatttaccacctttagttgggatgaccagaaggtccgccgcgtctttgttaggaaagtctatacgatcctcctgatccagttgttagtaaccctcgctgtggtcgctctgtttaccttttgcgatccagtaaaggactatgtgcaggcaaatccgggatggtattgggcttcttacgccgtgttctttgccacataccttaccctcgcatgttgctcaggccctcgacgtcactttccctggaacctcattctcctgaccgtcttcacactgagcatggcatacctgacgggtatgctttcatcttactacaacaccacctccgtactgctctgtctgggcattaccgccctggtgtgtctttctgttacagtgttcagtttccagaccaagttcgacttcactagctgccagggcgtgctgtttgtccttctcatgacactcttcttcagcggcctcatcctggccatcttgctgcccttccagtacgtgccctggttacatgccgtgtacgccgccctgggcgcgggcgtttttacacttttcctggcactcgacacccagcttctaatgggcaaccgccgccattccctgagccctgaagaatacatctttggcgccctgaatatctacctggacataatttacattttcacgttcttcctgcaactttttggtaccaatagagagtag

SEQ ID NO: 116678 - DNA, 813 bp, Artificial Sequence
  Description of Artificial Sequence: Synthetic coding sequence
atgaaagcaggtgctttcccccctgcccccactgccgtgcccctgcacccctcttgggcttatgttgatccctcctcatcaagttcttacgataatggctttcccacgggcgaccatgaactgttcactactttctcctgggacgatcagaaggttcgaagagtgttcgttcgaaaagtgtatacaattttgttgatccagctgctcgtgacactggccgtggtggccctgtttaccttttgtgatcctgtcaaggattatgtgcaggccaatcctggctggtactgggctagctacgccgtgttcttcgccacgtacctgactctggcatgttgctctggtcctcggcgtcatttcccttggaacttaatcttactcaccgtctttacattgtcaatggcatatcttactggtatgttatccagctactataatacgacttccgtgctgctgtgtttaggtattaccgctcttgtgtgcctctccgtgaccgtgttctcttttcagaccaagtttgacttcaccagctgccagggcgtcctattcgtgttgctgatgactctgttcttcagcggcctgattctggcaattttgttgcccttccaatacgtcccctggttgcacgcagtatacgctgctctgggcgccggagtgttcaccttgttcctggcgctagacacacagttgcttatgggtaataggagacacagtttgagccctgaggagtacatctttggtgcattaaatatatatctggacatcatctatatatttactttcttcttacaactgtttggcaccaaccgggagtag

SEQ ID NO: 116679 - DNA, 1173 bp, Artificial Sequence
  Description of Artificial Sequence: Synthetic coding sequence
atggacttctggctgtggccactctatttcctacctgtctcgggggccctgagaatcctccctgaggttaaagtcgagggcgagctggggggtagcgtgacaatcaagtgtccacttcccgaaatgcatgtccgcatctacttgtgtagggaaatggctgggtccgggacttgcggtaccgtggtgtcaacgactaatttcattaaggctgagtacaaaggtagagttactctgaagcaatacccccggaagaacctgttcctggtcgaagtgacccagctgaccgaatctgacagtggagtatacgcatgtggggcagggatgaatactgataggggaaagacccaaaaagtgaccttgaacgtccactctgagtacgaacccagctgggaggaacagcccatgcctgagactcctaaatggttccatctgccttacctattccagatgccagcgtacgcatcctcttcaaagttcgtgaccagagttaccactcctgcacagcggggtaaagtccccccagtccaccactctagtccaactactcagatcactcataggccccgggtgtcccgagccagcagcgtggccggcgataaaccaaggactttcctcccgagtacaactgcctcaaagatctccgcactcgagggacttctgaaacctcagacaccatcctacaatcaccatacccggttacatcgacagcgggcattggactacggcagccaaagcggcagggaggggcagggtttccatattctcatacctactatacttggactattccttctggccttgttgggcctggtggtcaaaagggccgtggaaaggcgaaaagccctctcacggcgagctaggaggctggccgtgagaatgcgagcccttgaatcatcccagaggccacgaggctccccaaggccaaggtcacaaaataatatttacagcgcatgccctcgccgagctcgaggagcagatgctgctggaaccggcgaagctcctgtcccagggccaggcgcgccgctgcctcccgctcccctgcaagtgtcggagtccccttggttacacgcccccagcttgaaaactagttgtgaatatgtcagcttgtatcaccagcccgcggcgatgatggaggatagcgactccgatgactatatcaatgtccctgcttag

SEQ ID NO: 116680 - DNA, 921 bp, Artificial Sequence
  Description of Artificial Sequence: Synthetic coding sequence
atggacttttggttgtggcctttgtacttccttccggtgtcaggggccttgcgcatactgcctgaggtaaaagttgaaggcgagctcgggggaagtgtgaccattaaatgccctttgccggagatgcacgtacgtatatatttgtgccgagagatggccggaagcggaacatgtggcacagtggtgtccactaccaattttatcaaggctgaatacaaaggtagggtgacgctgaagcagtacccacggaagaatctgttcctggtggaggtgacccagctgacagagtccgattctggcgtctatgcctgcggagcaggaatgaacaccgacagaggcaaaacccagaaggttacacttaacgtccacagcgaatatgaaccaagttgggaagaacaaccaatgcctgaaactccaaaatggtttcatcttccctatctgtttcagatgcccgcctacgcttcgtcctccaaattcgtgaccagagtgacaacgcccgcacagaggggcaaagtcccccctgtccatcattcttcgccaacaacgcagattacacaccggccgcgggtctccagagctagttccgtggccggcgacaagcctcggacctttttgcctagtaccactgcaagcaaaatcagtgcgttagagggcctgttgaagcctcaaacgcccagctataaccatcacacccgcctgcatagacagtctcctttacaggccggaccgcccactgggcgcgaggatgcacgccctggtgaattgccagaagccccaagagttgccgcgactgcactccccaagcagcacctacagaggctgcccgccgcacggagctggagcggccgctgccgtcaccgcggcggccctaggtctcgtcctagatccgctgtggcccctagaccagccgcgggagtctag

SEQ ID NO: 116681 - DNA, 837 bp, Artificial Sequence
  Description of Artificial Sequence: Synthetic coding sequence
atggatttttggctctggccgctttacttcctacccgagtatgaacctagctgggaggagcagcccatgcccgagactccgaaatggttccatctgccctacctcttccagatgcccgcttacgctagctcgtctaagtttgtgacgagagtcactaccccagcacagaggggaaaggtgccacccgtgcaccactcttcccctaccactcaaatcactcaccggccccgggtaagccgtgcttcctctgtggccggagataagcctcgtacttttctcccctctactactgcttcgaagatttcagccctggagggactcctcaaacctcagacaccttcctataatcatcatactcgactgcacaggcagcgagccctggactatggctcccagagcggacgtgaggggcagggctttcacatactgatccccacaattctgggccttttcttgcttgcactgttgggcctggtggtcaagcgcgcagtggagcgaagaaaggccctaagccgccgtgcgcggcgtctggccgtgcggatgagagcgttggaatcaagccaaagacctaggggaagcccaagacctcgaagccagaacaatatatacagcgcatgtccccgccgtgccagaggggcagacgccgccgggacaggggaagcacctgtcccaggccctggtgcccctcttccccccgcacctctccaggtgagcgagtcaccctggcttcacgccccatctcttaagacttcctgtgaatatgtgtccctttatcaccagcctgcagccatgatggaggactctgacagcgatgattacatcaacgtaccagcgtag

SEQ ID NO: 116682 - DNA, 456 bp, Artificial Sequence
  Description of Artificial Sequence: Synthetic coding sequence
atggacttctggctgtggccgctgtatttcctcccggtgtcgggagcactacgaatccttcctgaagtgaaggtggagggtgagctgggaggatcagtaactatcaagtgcccattgcctgaaatgcatgtacgtatttacctgtgtcgggaaatggccgggagtggcacttgtggaactgtggtaagcactaccaacttcatcaaggcggaatataagggcagggtgacactgaagcagtacccacgcaaaaatctgtttcttgtggaggtcacgcaactcaccgagtccgattctggggtctacgcctgtggcgccggaatgaacacagatcgcggcaagactcagaaagtgacgttgaatgtgcactcggagtacgagccatcttgggaagaacagcctatgcccgaaactccaaaatggttccatctaccctatcttttccagatgccttag

SEQ ID NO: 116683 - DNA, 444 bp, Artificial Sequence
  Description of Artificial Sequence: Synthetic coding sequence
atggacttctggctctggccattgtacttccttcctgtgtccggcgcacttagaatactgcctgaggtcaaggtggagggcgaattaggtgggagtgtgacgattaaatgccccttaccagagatgcatgtgcgaatatatttatgcagggaaatggccggtagtggaacctgtggcacggtcgtgagcacaactaacttcattaaagctgaatacaaggggcgggttacattgaagcagtatccacgaaagaatctttttttggtagaggtaacacagctgacagaatcagactctggagtgtacgcttgcggtgcaggcatgaataccgatagagggaagacacagaaagtcactctgaatgttcatagcgagtacgagccctcttgggaagagcagccgatgccagaaacccccaagtggtttcatttaccgtacctgtag

SEQ ID NO: 116684 - DNA, 426 bp, Artificial Sequence
  Description of Artificial Sequence: Synthetic coding sequence
atggatttctggctgtggccattgtatttcctaccggagatggagagctgttgtgtggcacaagatggattggaactggtcgctttatccgatccccctgggtccgcgtctcagtcagctggtatcacggtttcaggtgccctcagaattctgccagaagttaaggtcgaaggcgagctgggtggaagtgtgactattaagtgtcccctgccggaaatgcacgttcgcatctacttgtgccgcgagatggctggctccggcacttgcggtactgtcgtgagtaccaccaattttatcaaggctgaatataaggggagggtgacactgaagcagtatccaagaaagaatttgtttctggtggaggtgacccaactgactgaatctgactccggtgtgtacgcttgtggcgcgggcatgaatacctag

SEQ ID NO: 116685 - DNA, 1398 bp, Artificial Sequence
  Description of Artificial Sequence: Synthetic coding sequence
atgcgcagacccaggggcgagcctggtccccgagctccacgtcccaccgaaggggctacttgcgctgggcctggagaatcttggtctccctcccctaattcaatgctccgggtactgctctcggctcaaacgtcacctgctagactctccggtttattattgattccaccagtacagccttgctgtctcggccctagcaaatggggagatcgcccagttgggggggggcccagcgcaggccctgtacagggtctccagcgtctcctggagcaggctaagtcgccgggggagttgttgagatggctgggccagaacccttctaaggtacgcgctcatcattacagtgtcgccctgaggcggcttgggcaactactagggtcccgccctcgtcctcctcctgtcgaacaggtgacactgcaggaccttagtcagttgatcattcgaaattgtccatcgtttgatatccacacaattcacgtttgcttacacctagctgtgctgctcggcttcccttccgacgggccactggtgtgtgcactcgaacaggaacggcggttgcggctgcccccgaagccaccccccccattgcagccacttcttcgtggcggacagggcttggaggcagcactgagttgtccacgttttctgaggtacccccggcaacatcttatttcttccctcgccgaagctaggccggaagaattaaccccacacgtaatggtgctgctcgcccagcacttagccaggcatcgactaagagagccacaattgctggaggcgattgcccactttcttgtagtgcaggagactcaactatcttctaaagttgtgcagaagttggttttgccatttggacgcctgaattacttacctttggagcagcaatttatgccgtgccttgaacgcatcctggctcgagaggccggcgtagcccccctcgcgacagtgaacatcctgatgtctctctgtcaattgagatgcttgcctttccgggctctgcactttgtcttcagccctgggttcatcaattatatctccggaacccctcacgccttaatcgtgcggcgctacctgtccctgcttgacactgccgtagagctagagctgcctggctatcgcgggccacggctcccgagaaggcaacaggtgcccatttttcctcagccacttattacggaccgggcccggtgtaaatattcccacaaagatatcgttgctgaagggctccgccagctgctgggggaagagaagtataggcaggatctgacagtgccgccaggctattgcactgatttcctcctctgcgcctcctctagcggagcagtgcttcctgtgaggacacaggatccctttttaccctatcctcccagagcctgcccatcttcccgtgctacttag

SEQ ID NO: 116686 - DNA, 1650 bp, Artificial Sequence
  Description of Artificial Sequence: Synthetic coding sequence
atgagacggccccggggcgagcctggaccccgggcgcctaggcctaccgaaggcgcaacctgtgctggtcccggggagtcatggtcaccttccccgaacagtatgctgagggttctgctgtcagcacagacttcccctgcacgactttccggactgctgctaattcctccagtacaaccttgttgtctcgggccctctaagtggggagacaggcccgtgggcgggggccctagcgcgggccccgtacagggattacaacggcttctcgagcaggcgaagtctccgggggaactgcttcgttggttgggccagaacccctcaaaagtgagagcacatcactacagtgttgccctgagacggctgggccaactgcttggttcccgcccgcgaccccccccagttgagcaagtgactctgcaggacctgtcccaactgatcattcggaactgccccagtttcgatattcatactattcatgtctgccttcatcttgcagtactgctggggttcccttccgatggcccgctggtgtgtgcactggagcaggagaggaggttacggctccctcccaaacccccgccgccactacagccccttttaagaggtggacaaggccttgaggccgctctgtcttgtccacgtttcctgaggtacccaagacaacatctgatcagcagtctcgccgaagcgaggcctgaagagctcaccccccacgtaatggttctgctcgcgcagcacctggcccggcaccggctgagagaaccccagctgctggaagccatcgcccacttcctcgttgtgcaggaaacccagttatcttcaaaagtagttcagaagctggtgctcccattcggcagattaaactacctgccactggaacagcagtttatgccgtgtctggaacgtattctggctagggaagctggcgtcgcgccgctggcaactgtgaacatccttatgtctttatgtcagctgcggtgcttgccatttagggcactccattttgtcttctctccgggcttcattaattatatctcgggaactccacatgctctgatcgtgcgacgatatctgtctctccttgataccgccgttgaattggaattacccggctatcgcggccccaggctgccccgacgacagcaggtcccgattttccctcaaccactaatcaccgatagggcacggtgcaaatattcccacaaagatatagtcgctgaggggctacgacagctgctaggagaagagaagtatcggcaggatctgacggtgccacccggatactgcaccgacttcctattatgcgcgtctagttctggagccgtactgcctgtgcggacccaggatccgttcctcccgtaccctccccgtagttgcccgcagggccaggccgcttctagcgccactacccgagatccagcccagcgggtggttttggtcctgcgggagcgctggcatttctgtagggacggccgagtgttgttgggttctcgggcccttagggaacgccacctcggcctgatgggttatcagcttctccctcttcctttcgaggaactggagtcccagaggggcctacctcaactgaagagttacctgcgacaaaagttgcaggctctggggctgcgctggggcccggaaggcggttag

SEQ ID NO: 116687 - DNA, 1227 bp, Artificial Sequence
  Description of Artificial Sequence: Synthetic coding sequence
atgcgtcgccctcgtggcgagcctggacctagagcaccaagacccacagaaggtgcaacatgcgcagggccaggagagagttgtttcccaagcgatggccctcttgtttgtgccctggaacaggagcggagactgcggcttccgcccaaacccccacccccgttacagcccctgctcaggggtggccaaggacttgaggcagccttaagttgcccaaggtttctgagatacccccgtcagcacctgatcagtagtctcgccgaagcacggccagaggagcttactccacatgtgatggtgttattggcacaacacctggctagacacaggctgagggagcctcagttgctcgaggcgatcgctcatttcctagtggtgcaggaaacccagttgtcgtcgaaagttgtgcagaagcttgtcctgccgtttgggcgcctgaactacctgccactagagcagcagttcatgccatgcctggaaagaattctcgctcgagaagcgggggtcgcccctcttgctactgtgaacatattgatgagtctgtgccaactgagatgcctgcccttccgagctctccattttgtgttttctccaggttttattaactacatttctggcacacctcatgccctgatcgtacgacgctacttgtccctattggataccgccgtggagctggagctgccaggctaccgaggacccagactaccaagaaggcagcaggtgcccatctttccgcagcccctgatcactgacagagcccgatgcaaatatagccacaaggacattgtggcggagggtcttcgccagctgctgggggaagagaaataccgtcaggatctcacagtcccaccgggatattgcacggacttcctgctttgcgcatcttcatccggtgctgttctgccagtgagaacacaggatccatttctcccttatccgcccagaagttgccctcaagggcaggctgcatcctcagcaacgactcgggaccccgcccaacgggtcgtgctcgtcctgcgggagagatggcatttctgtcgtgacggacgcgtgctcctcgggagccgggccctcagagaaaggcatctggggttgatgggttatcagctcctcccactgccatttgaagagttagagtcccagcgcggcctacctcaactcaagtcatatttgcgccagaaactgcaggctctgggtctgagatggggacccgaaggcggttag

SEQ ID NO: 116688 - DNA, 480 bp, Artificial Sequence
  Description of Artificial Sequence: Synthetic coding sequence
atgttaagagtgcttctgtcagctcagacatctcccgcgcgcctctccggactacttctaatcccgccggtgcagccttgctgcctaggcccaagtaagtggggcgatcggcctgtcggagggggcccctccgccgggccagtgcagggcctgcagaggctcctggaacaagccaagtcacctggtgagttgctgcgctggctcggacagaatcctagcaaagttagagcacatcactattcagtcgctctgaggcggttgggtcagctcctggggtcccgccctcgccctccacccgtcgagcaggttacactacaagacttgtcacaattgattattcgcaattgtcctagcttcgacatacacactattcacgtatgtttgcacctggccgtgctgctcggaggaacagaagtggggcccgcactgtgggcaacggagctgccagcccccggaaccgccgtatacgccctcccctag

SEQ ID NO: 116689 - DNA, 1569 bp, Artificial Sequence
  Description of Artificial Sequence: Synthetic coding sequence
atgaggcgcccccgaggcgagcccggaccccgggcccccaggcctacagaaggggctacgtgtgcaggtccaggcgaatcttggtctccaagtccaaactccatgctgagagtacttctgtcggcccagacaagccctgccaggctgagcggcttactgttgatcccgcctgtgcagccgtgttgcttgggcccctctaagtggggggatagaccagtcggcgggggaccctccgctggaccagttcaaggacttcagagacttcttgagcaggcgaaatcccctggggagttgctgaggtggttgggccaaaatcccagcaaagtgagggctcatcactattcagtcgccctgcggcggctcgggcagttgctcggctcacggcctcgtcctcctcccgtggaacaagtgaccctacaagacctgagccaactgatcattaggaattgtccctccttcgacattcacaccatccacgtgtgcctgcacctggccgttctgttaggcttcccttccgacggcccactcgtctgcgcactggagcaagaaagacgcctgaggctccctccgaaaccgccccctccacttcagcccctgcttcgtgaagctagaccagaagagctcacccctcacgtgatggtgctacttgcccagcacttggcccgacaccggctcagggagccacagctgttggaggctatagcccattttctggttgtgcaagagacacaactgagtagcaaagtggtgcagaagctggttcttcccttcggaaggctcaactatctgccattggaacagcagttcatgccgtgcctcgagagaattcttgccagagaggctggcgtggcgccgttggccaccgtgaacattctcatgtccctctgtcagctcagatgtctgcctttcagagcactacacttcgttttttcaccaggctttatcaactacatctccggaacccctcacgcactcatcgtcagaaggtatctcagtctgctggacacagctgttgaactggagctacccggttataggggccctagacttcctcggagacaacaggtgcccatctttccccaacctctgattacagaccgtgcaaggtgtaagtattctcacaaagacattgttgccgaaggtctgaggcaactgttgggcgaggaaaagtaccggcaggaccttacagtccccccgggctactgcaccgattttcttctctgtgcctcgtcttccggggctgttctgccagtaaggacccaggatccatttttgccataccccccacggtcttgtccacaagggcaagcagctagttcagcgaccacacgggaccccgcacagagggtcgtcttggtgttgagagaacgatggcacttttgccgagacggtcgggtcctcctgggctccagggcactgcgcgagcgtcacctgggactgatggggtaccaactgcttccactgcccttcgaggaactcgaatcacaacggggcttgccacaactcaagtcttacttgaggcagaagcttcaggccttggggttacgctgggggcctgaggggggatag

SEQ ID NO: 116690 - DNA, 1179 bp, Artificial Sequence
  Description of Artificial Sequence: Synthetic coding sequence
atggaggcaccactcgtctctctggatgaggaatttgaggacctgaggccctcttgcagcgaggaccccgaggagaaaccccaatgtttctatggcagctctccacatcacctcgaagacccgtctctgtccgagctggagaacttttcctccgagattatttcttttaagtcaatggaagacctggttaacgaatttgacgagaagctaaatgtctgcttccggaattataacgccaaaactgagaacttggccccagtgaaaaatcagcttcagattcaggaggaggaagagacactacaggacgaagaggtgtgggatgccctaacagataactatatcccaagtctgtcagaggactggcgcgaccccaatattgaggcccttaacggcaactgttccgacacagaaatccatgaaaaggaggaggaagagttcaatgaaaaaagtgagaacgactctggcattaacgaggaacccttgctgaccgccgaccaggtgatagaggagattgaagagatgatgcagaatagtcccgacccagaggaggaagaagaggtgctggaagaagaagatggtggtgaaacatcttcccaggccgactctgttttactccaggaaatgcaggcactgacacagacctttaacaataattggtcctatgagggcctgagacacatgagtggatccgagctaaccgagctccttgaccaggtcgaaggagctatccgcgacttttcagaggaacttgtacaacagctggcacgccgagatgagctcgaattcgaaaaggaggtgaagaacagtttcataacagtacttatcgaggtccagaacaaacaaaaagaacagcgagaactgatgaagaaacgtcggaaagaaaaagggctgagcctacagtcaagtaggattgagaaagggaaccagatgccattgaagaggttctctatggaggggataagtaacattcttcagagtggaattcgtcaaaccttcgggtcgtcaggaacggataaacagtatctgaacactgtgattccctacgaaaaaaaagcctcacctccatctgtcgaagatctccagatgttgactaatattttattcgccatgaaagaggataatgaaaaggtgccgaccctgttgaccgattacattctcaaggtgttgtgtccgacgtag

SEQ ID NO: 116691 - DNA, 315 bp, Artificial Sequence
  Description of Artificial Sequence: Synthetic coding sequence
atggaggcaccgctggtgtcgcttgacgaagaattcgaggatttgaggccaagctgcagtgaagaccccgaagaaaagccacagtgtttctatggatcctcaccccaccacctagaggacccaagcctgtccgagctagaaaatttttctagtgagattatcagtttcaaatctatggaagatcttgtcaacgagttcgacgaaaagcttaatgtatgcttccggaattataatgctaagaccgaaaaccttgctccggttaaaaaccaattgcagatccaggaggaggaggaaaccctgcaggatgaggagtag

SEQ ID NO: 116692 - DNA, 315 bp, Artificial Sequence
  Description of Artificial Sequence: Synthetic coding sequence
atggaggcccctcttgtgtctctcgacgaggagtttgaagatctgaggccatcatgtagcgaagatcctgaggaaaagcctcaatgcttttatggctcgagtccgcatcacttggaggacccttcactctctgagctcgagaacttctcttctgagataatcagcttcaagtcaatggaagatctcgtcaatgagttcgatgagaaattaaacgtctgctttcgcaactataacgccaaaacggagaatctggctcctgtgaaaaaccagctgcaaatccaggaggaggaagagaccctacaggatgaagaatag

SEQ ID NO: 116693 - DNA, 1419 bp, Artificial Sequence
  Description of Artificial Sequence: Synthetic coding sequence
atgacagctaacggcactgccgaggctgtccagattcaattcggactcatcaactgtggtaataaatacctgaccgcagaagcctttggtttcaaagtgaacgcttccgccagctctctcaagaagaaccacctaggtagatatctcgctgctgacaaggacggaaacgtgacatgcgagcgcgaggtaccgggcccagactgccggttcctgattgtggcacacgatgacggccgttggtctctgcagtctgaggctcacaggaggtattttggtggcactgaagatcgtctgagttgtttcgctcaaacggtctcccccgccgagaagtggtccgttcacatagctatgcacccacaggtcaatatttattccgtgacaagaaagcgttacgcccacttgtccgcaagacccgccgatgagatcgccgtggatcgggacgtaccttggggggtggactcactgatcacacttgcattccaggaccagcgttatagtgttcaaacagccgatcacagattccttagacacgatggaagactcgtagcaagaccagaacctgctactgggtacaccctggaattcaggtcaggtaaggtggctttccgggattgcgagggtaggtacttagctccctctggcccttccggaaccctcaaagctggaaaagccacaaaggtgggaaaggacgagctctttgctttagagcagtcatgcgcccaagtggtattgcaggctgcaaacgaaagaaacgtatcgacacggcaaggcatggacttgtctgctaaccaagacgaggagaccgaccaggaaactttccagctggagattgaccgcgataccaagaagtgcgccttccgaacccatacaggtaagtactggactctgactgccacgggtggggtgcagtctaccgcctcatctaagaatgccagctgctattttgatatagaatggagggatcgaaggataactctgagagcttctaacggtaagtttgttactagtaaaaagaatggacagctggcagcttccgtagaaactgcaggggattcagaactgttcttgatgaagctgataaatagacctatcatcgtctttaggggcgagcacggattcattggctgccggaaagtgacggggacccttgacgccaaccgaagctcttatgacgtgttccagctggagtttaatgacggtgcctacaatataaaagactccaccggcaaatactggactgttggaagcgactcggcagtgacttcctccggtgacacacctgtggactttttttttgagttctgcgactataataaagtcgccatcaaggtcggcggaaggtatcttaaaggggaccatgctggtgtgctcaaagcttccgcggaaacagtggatccagcaagcctgtgggagtactag

SEQ ID NO: 116694 - DNA, 1482 bp, Artificial Sequence
  Description of Artificial Sequence: Synthetic coding sequence
atgacggccaacggaaccgcagaagcagtgcagatccagttcgggttaataaactgcggtaataagtacctaacagccgaagcttttggatttaaagttaatgcttcagcaagctccctcaagaaaaagcagatctggacgttggagcagcccccagacgaagccggttccgcggccgtctgtttgcgcagccacctcggcagatatctcgcagccgataaagacggtaatgtgacatgtgaaagggaagtacccggccctgactgccgctttctgattgtagctcacgatgacggccgttggtctttacaaagcgaagcccacagacggtacttcggaggcaccgaggatcgtctgtcctgcttcgcccaaacggtgtcccctgccgagaagtggagcgtgcacattgccatgcacccccaggtgaatatttactctgtaacccgaaagaggtacgcacacctttcagcaagacctgcggatgagatagctgtcgatagagacgtcccttggggggtagactccctcatcacgctcgcatttcaggaccagcgttattccgttcaaacagctgatcaccgctttttacggcacgatggacgcctcgtggcgaggcccgaaccggccacagggtatacccttgaattccgatcgggaaaagtagctttcagagactgcgaggggagatacctagccccctcgggcccatcaggcaccctgaaggcaggcaaggctacaaaagttgggaaagatgagttgttcgcattagagcaatcctgcgcacaggtggtgctgcaggcagctaatgaaaggaatgtttccactagacaagggatggatctgagcgccaatcaggacgaggaaaccgaccaggagaccttccagttagagatcgaccgggatacgaagaagtgtgcctttcggacacacacagggaaatactggactttgacagccactggcggtgttcagagtactgcttctagtaaaaacgctagctgttacttcgatattgagtggagggacaggagaattacactccgggcatccaacggaaaattcgtgaccagtaaaaagaacggccagctggcagcctcggtcgaaactgctggtgacagcgagctgttcctgatgaagctgattaatcgccccattatcgtgttcagaggcgagcacggctttataggctgccgaaaagtcacgggcacattagatgccaacaggtcctcttatgatgtgtttcagcttgaatttaatgacggtgcatacaacatcaaagactcaaccggcaagtattggaccgtgggttctgactccgcagtgacaagttctggcgatactccagtggactttttctttgaattttgcgattataacaaagtggccatcaaggttggaggaaggtacctgaagggtgaccacgcaggcgttttgaaggcttcagctgaaaccgtagaccccgccagtttgtgggaatattag

SEQ ID NO: 116695 - DNA, 648 bp, Artificial Sequence
  Description of Artificial Sequence: Synthetic coding sequence
atggatctgtccgctaatcaggatgaggaaactgaccaggagacatttcaactcgagattgaccgggacacgaaaaagtgtgcatttcgtactcacacaggaaagtattggactttgacggctactggaggcgtgcagtctactgcgtcctctaagaacgcttcgtgttatttcgacatagagtggcgggacaggcggatcacgctgcgcgcctccaacgggaaatttgtgacgtcgaagaagaatggccagctggcggcaagcgtggagaccgcaggcgattcagagctgttcctgatgaagttgataaatcgcccaatcattgttttcagaggcgagcacgggtttattggttgccgcaaggtgacaggcaccctggacgcaaacaggtcctcttacgacgtctttcagctcgagttcaacgacggtgcctataacatcaaggactccaccggcaaatactggacggtcggatccgacagtgctgtaacgagctccggggacaccccagtggacttcttttttgagttctgtgattacaacaaagtggcgataaaggtaggaggcagataccttaagggagaccacgcaggagtgctgaaagccagtgccgaaactgtcgatcccgcctccctgtgggagtactag

SEQ ID NO: 116696 - DNA, 1551 bp, Artificial Sequence
  Description of Artificial Sequence: Synthetic coding sequence
atgcctaccaatggccttcaccaggtgctaaagatacaatttggtcttgttaatgacactgaccgctacctcaccgcggagagctttggctttaaggttaacgccagcgccccttccctgaagcgcaaacaaacatgggtattggagccagacccaggccagggaacagcagtgctcctcaggtcatcccatctgggtcgctatctgtcagcagaggaggacgggcgggtggcttgcgaggccgaacagccgggccgggattgccgtttcctcgtgctgccgcagccggacgggcggtgggtcttgcgtagtgaacctcatggcagattctttgggggaaccgaggatcagcttagttgttttgctaccgcagtgtcaccagctgagctgtggacagtccacctcgccatccacccacaggcccacctcctgtcggtgagccggcggcggtacgtgcacttatgtccccgggaagatgaaatggcggcagacggtgacaagccctggggtgttgacgctttactcaccctcatatttcggtctcgccggtactgcttgaagtcctgtgatagcagatacctgaggtccgacgggagactggtatgggagcctgagcccagggcctgctacacattggagtttaaggctggcaagttagcttttaaagattgcgatggtcactacctcgctccagtaggcccagccgggaccttaaaagccggccggaacaccagacctggaaaggacgagctgtttgacttagaagagtcccacccccaggttgtgctcgtcgctgcgaaccacaggtatgtgtctgttaggcaaggggtaaacgtttccgccaatcaggatgacgagctcgaccatgagacgttcttgatgcaaattgatcaggagacgaagaaatgcactttttactccagcaccggtgggtactggaccctagtcactcatggaggcatccacgccaccgccacgcaggtgagtgctaacaccatgttcgagatggaatggcgggggcggcgggttgcgctgaaagcatctaatgggaggtacgtctgtatgaaaaagaacggccagctcgctgctatcagcgactttgtcgggcctccaccaaggcccgcgtggactgggaaggtggccggtggggcagcccagcagactctgtcccctccaggaaaggacgaggagttcactctgaagctgatcaatcggcccatactcgtgctgcgcggcttggatggcttcgtgtgccatcaccgcggcagcaaccagctcgacactaacagaagcgtgtatgacgtcttccatctgagttttagtgacggtgcctaccgcatccgcggtcgtgacggggggttctggtacacaggcagtcatggttccgtgtgtagcgatggagaacgcgcggaagattttgtattcgagtttcgggagcgggggaggcttgctatccgggcccgctctggaaaatacctgagaggcggcgcctcgggactgctgagagccgacgcggatgcaccggctggaactgcgctttgggagtactag

SEQ ID NO: 116697 - DNA, 1479 bp, Artificial Sequence
  Description of Artificial Sequence: Synthetic coding sequence
atgcctacgaatggactccaccaggtgctgaagatacagtttgggctcgtcaacgataccgaccgctacctgactgcggaatctttcggatttaaagtgaacgctagtgcccctagcctgaaaaggaagcagacatgggtgcttgagcctgaccccggacagggcaccgctgtactcttgcggtccagccacctaggcaggtacctatccgctgaagaagacggtagggtggcctgtgaagcagagcagcccggaagagattgtcgatttttggtgctgccgcaacctgacggacgatgggtgttgcgaagcgagccacacgggcgcttctttggaggcacagaagaccagctgagctgttttgccacagctgtgtctccagccgaattgtggactgttcacttggctatacatcctcaggcgcatctcctatcagtgtcacgtcggagatacgtccatctgtgtccccgtgaagacgaaatggctgccgacggcgataagccatggggagttgacgcactgctcacgttaatcttccgtagtcggcgctactgtttgaagtcttgtgactcacgctacctccggtccgatggtagactcgtgtgggagcccgaaccccgagcatgttacacactcgaatttaaagctggcaagttagccttcaaggattgcgatgggcattatctggctccagtcggtccagctggcactctgaaggcagggcgcaataccaggcccggaaaggacgaactcttcgatctcgaagaatctcacccccaggtggttctcgtggcggcaaaccaccgttacgtatccgttaggcagggtgtcaacgtgagcgccaaccaggacgacgagctcgaccacgagacattcctcatgcagattgaccaggaaactaaaaaatgcacattctattccagtactggtggttactggactctggtgacacatggaggaatccatgcgactgccactcaggtgagcgcaaacacaatgttcgaaatggaatggaggggccggagggtcgcactgaaagcctcgaacggacgatacgtctgcatgaagaagaacggacagctggccgccatctctgacttcgttggcaaggacgaggaattcaccttaaaacttatcaacaggcccattctcgtgctccgagggctggacggcttcgtctgccaccaccgtggctccaaccagctggacacaaaccgtagtgtctacgatgtgttccatctgagctttagcgacggcgcataccgcatccgagggagggatggaggattctggtacactggcagccacggcagcgtgtgttctgacggcgagcgggctgaagacttcgtcttcgagttcagagagcgcggacgccttgccatcagggctaggtctggaaagtatttgagggggggcgccagcgggttactgcgggcagatgctgacgctcccgcagggaccgcactctgggaatattag

SEQ ID NO: 116698 - DNA, 2133 bp, Artificial Sequence
  Description of Artificial Sequence: Synthetic coding sequence
atgcttacaactctaaagccctttgggagcgtctcagtcgaaagcaaaatgaacaacaaggccggctccttcttctggaatttacgccaattttctaccttggtttcaactagcaggaccatgcgactgtgctgcctgggcctgtgcaagcctaaaatcgtacactcaaactggaatatattgaacaactttcacaaccgtatgcagtccaccgatatcattcgctatctttttcaagacgcatttattttcaaatccgacgtcggatttcagactaaagggatctccacacttacagctctgaggatagagcgccttctctacgccaaacgcctgtttttcgacagtaagcagagcctggtgcccgtggataagtctgacgatgaactcaaaaaggtgaacctgaatcacgaggtcagtaacgaggacgtcctaaccaaagaaacgaaaccgaaccgcattagctctagaaagctgagtgaagagtgcaattcccttagtgacgtcctcgacgcgttttcaaaagctccaaccttcccgagcagcaactattttacagctatgtggacaattgccaaacgcttgtcagacgatcagaagagatttgaaaagaggcttatgttctctcatcctgcattcaatcagctttgtgaacacatgatgcgggaggccaagattatgcagtacaagtacctgctatttagtctgcacgccatcgtgaagctcggcatcccccagaacacaatcctagtgcagaccctcttgagagtgacccaggagagaattaacgagtgtgatgaaatatgcctgtccgtgctgagtacagtattagaggcgatggagccttgcaagaatgtccatgtcctgcgtacagggttccgcatactcgtcgaccagcaggtgtggaaaattgaggatgtgtttaccctgcaggtggtgatgaaatgcattgggaaagacgcccccatcgcattaaagaggaagctggagatgaaagctctcagggagctggaccggtttagcgtgctgaatagtcagcacatgtttgaagttcttgccgccatgaatcatcgctctctcatcttgttggacgaatgttcaaaagttgtcttggataacatccatggatgtcccctccgcatcatgattaacatattacagtcttgcaaggatttgcagtaccacaacttggacttgttcaagggcctggctgattatgtggccgccacattcgacatttggaagttcaggaaggttctgttcattctgatattattcgagaatttgggattccgccccgtaggccttatggacctgttcatgaagcgcatcgtggaggaccccgagtcccttaatatgaagaatattttatccattctgcacacttattctagcctgaatcatgtgtacaagtgtcagaacaaagaacagttcgtagaagttatggcttcagctctcactggataccttcatactatctcatcagaaaatctgctcgacgccgtgtatagcttctgcctcatgaactattttcccctggccccctttaaccagttgttgcagaaggacatcatctccgaactcctcactagcgatgacatgaaaaatgcctataaactacacacgcttgatacttgcctaaaactggacgacactgtatatctgagggatatcgctctgagcctcccccagcttccacgggaactgccttcaagccacacaaatgccaaggtggcagaagtgctgtcgtcactgcttggcggagaagggcactttagtaaagacgtgcacctcccccataattatcacattgactttgaaataaggatggacactaaccgaaaccaagtactgcctctgtcggacgtggacacgacaagcgccaccgatatccagcgggtggccgtgctatgtgtctcccggtcagcttactgtcttgggtccagccacccacgcggatttcttgccatgaaaatgcgacacttgaacgccatgggcttccacgtcattttggtgaacaactgggaaatggacaaactcgaaatggaggacgcggtgaccttcctgaagaccaagatctacagcgtggaagctttacccgttgcggccgtcaatgtccagtctacccaatag

SEQ ID NO: 116699 - DNA, 2133 bp, Artificial Sequence
  Description of Artificial Sequence: Synthetic coding sequence
atgttaacgacacttaaacctttcggaagcgtgtccgttgaatctaaaatgaataacaaggccggctcatttttctggaatttacgacagttcagcacgctcgtgagtacaagtagaactatgaggctatgttgcctagggctgtgtaagcccaagattgtgcattcaaattggaatatcctgaacaatttccacaatagaatgcaaagtaccgatattattaggtacctctttcaggatgcgttcatttttaagtccgacgttggcttccaaaccaaagggattagcacactcactgcactgcggatcgaacgtcttctgtacgcaaagaggttgtttttcgacagcaagcagtcactggtgcccgttgacaaaagcgacgatgagctcaagaaagttaacctgaatcacgaggtctcaaatgaagatgtgttaacgaaggaaacaaagcccaaccgcatcagctctagaaagcttagcgaagaatgcaattctctgagcgatgtgcttgacgctttttctaaggctcctacattcccatctagcaattactttacggccatgtggacgattgccaagagactgtccgatgaccaaaaaagattcgaaaaacgtcttatgtttagtcaccctgcattcaatcagctttgtgaacatatgatgagagaagctaagattatgcagtacaagtatctgctgttttccctccatgccatcgtcaaactgggtattccccagaacacaatactagtgcagactttgttgagggtaacacaggaacgcataaacgagtgcgacgaaatttgcctaagcgtgctaagcactgtgctggaagccatggagccctgtaaaaatgtgcacgtgctgaggacagggtttagaatccttgtcgatcagcaagtgtggaaaatcgaggacgtgttcaccctgcaggtggtaatgaaatgtattggcaaggatgcaccaatcgcactcaagcgaaaattagagatgaaagccttgagggagttggaccgcttctccgtgctgaactctcaacacatgtttgaagtgctagcagctatgaatcacaggtctctgatcttgctcgatgaatgcagtaaggtcgtgttggacaatatccacgggtgtcctctccggattatgattaacatccttcagagctgtaaggacttgcagtatcataacctggacctgttcaaaggcctcgctgattatgtcgcagccacatttgacatatggaagttccgaaaggttcttttcattctgatcctgttcgaaaacctggggtttcgtcccgtgggccttatggatctgttcatgaagaggatagtagaggatccagagtcgttgaatatgaagaacattctatcaattctccatacatactccagcctgaatcacgtgtataaatgccagaacaaggagcagttcgtcgaagttatggcatccgcgctcaccggctatctgcacacaatctcctcagagaacctactagacgctgtatattctttctgcttaatgaattatttcccgcttgcccctttcaaccaactgttgcagaaagatatcataagcgagctcctgacatccgacgacatgaaaaacgcctacaaactgcatactctcgacacctgcctcaaactcgatgatacagtgtacttaagagatatagcactgtcactcccacagctgccaagggaactcccatcttctcatacgaacgctaaagttgcggaggtgctttcgagtctgttgggcggggagggacatttctctaaagatgtgcacttacctcacaactaccatatcgattttgagattcgcatggacacaaatcgaaaccaggtgttgcctctttcagacgtcgacaccacatccgcaactgacatacagagagtggcagtgttgtgtgtcagtagatcggcgtactgtttgggatcttcccacccccgcggatttctggccatgaaaatgcgtcatctgaatgccatggggtttcatgtgatcctcgtaaacaactgggaaatggataagctggaaatggaggacgccgtgacctttctgaaaaccaagatctacagcgtcgaggcgctccccgtcgccgccgtcaacgtgcagagtacccagtag

SEQ ID NO: 116700 - DNA, 2133 bp, Artificial Sequence
  Description of Artificial Sequence: Synthetic coding sequence
atgttgaccactctgaagcctttcggatctgtgagcgtggagtcaaagatgaacaacaaagcgggcagtttcttttggaacttgaggcagtttagcactcttgtctcgacaagtcggaccatgcggctctgttgtcttgggctttgcaagccaaagattgtacactccaattggaatattctgaacaacttccacaaccgaatgcagtcaaccgacataatccgttatctgttccaggacgccttcatttttaagtctgatgtcggctttcagacgaagggcatatcaacactgactgcactcaggatcgaacgacttctctacgcgaaacggctgtttttcgattcaaagcaaagtctcgtgcctgtagacaaaagcgacgacgagttaaagaaagttaatctgaaccatgaggtgtccaacgaagacgtcctaactaaggagaccaagcctaaccgaatctcttcaagaaaattgtctgaagaatgtaacagcctgagcgacgtgttggacgctttcagcaaggcacccactttcccgtcctccaattacttcacagcaatgtggacgatcgccaagaggctttcagacgaccagaagaggttcgaaaagcgtctgatgttttcccatccagctttcaaccagctctgcgagcacatgatgagagaagccaaaatcatgcaatataagtatctgctattttctctgcatgctatcgtgaaacttgggattccccaaaatactatccttgtgcagactctgctaagggtaacacaggaaaggatcaacgaatgcgatgagatttgcctctctgtgctctccaccgtgcttgaagccatggagccctgcaaaaatgtacacgtgctcaggaccggttttcgtatcctggtagatcagcaggtgtggaaaatcgaggacgtgttcactctgcaagtggtaatgaaatgcattggcaaagacgcaccgatcgcgcttaaacgcaagttagaaatgaaggccctgagggagctggaccggttctcggtgttgaatagccagcacatgttcgaagttctggctgctatgaatcatagatctctgattctgctcgacgaatgctccaaggtggtactcgacaatatccatgggtgccccttgagaataatgatcaacatcctccagtcttgcaaggatcttcagtatcacaatctcgacctgttcaagggtctcgccgattacgtcgctgccacctttgacatctggaaattcaggaaggttttattcatcctgatactgtttgaaaatcttgggttccggccagtagggttgatggacttgtttatgaagcgaattgtggaggatcccgagtctcttaatatgaaaaacatattgtccattctgcacacttattcctctttaaaccatgtctataagtgtcaaaataaggagcagttcgtcgaggtgatggcaagcgctttaacaggatatctacacaccatcagttccgaaaatcttctggatgctgtctactccttctgcctgatgaattactttccactcgctcctttcaaccagcttctgcagaaggatataatctctgaactgttaacatcagacgacatgaagaacgcttataagctgcacactctggatacttgcctcaagttagacgatacagtgtatctgcgggatatcgctctatctttaccccagttgccccgggagctacctagcagtcacacaaacgccaaggtcgctgaggttttgtccagcctactgggcggcgaaggacatttttccaaggacgtgcacttaccgcacaattatcacatcgacttcgagattcggatggataccaaccgcaaccaggtgctgcctctgtcagatgtggacacaaccagcgcgacagacatacagagggtggccgtcctctgcgtgtctcgatctgcctattgtctagggagtagccacccacgcggctttctagcaatgaagatgcgtcacctgaacgctatgggctttcacgtgattctcgtgaacaattgggagatggacaaattagagatggaagatgctgtcactttcctaaagacaaagatctactctgtggaagctctgcccgttgcagccgtcaatgtgcagagtacccagtag

SEQ ID NO: 116701 - DNA, 375 bp, Artificial Sequence
  Description of Artificial Sequence: Synthetic coding sequence
atgctgaccacgctgaaaccctttggtagtgtaagcgtggagtctaaaatgaacaacaaagcaggcagcttcttctggaatttgagacagttttctactttggtcagcaccagccgaaccatgaggctctgctgccttgggctctgcaagccaaagatagtccattccaattggaacattctgaacaacttccataatcgaatgcagtcgacagatatcatcaggtacctgttccaggacgcgttcatctttaagtccgacgtgggattccaaactaaggggatatcaacccttaccgccctgagaatcgaacggttgttgtatgctaagcgtctcttttttgactccaagcagtcgttagtgcccgtggattag

SEQ ID NO: 116702 - DNA, 2295 bp, Artificial Sequence
  Description of Artificial Sequence: Synthetic coding sequence
atggccgcaaccctgaaatctctcaagctggtgaggtaccgagcgttttgcagcccaagcgcattcggggctgtcagatccgtcagttattggaatgtgagttcaacacagcacggggggcaggaccctcccgagcacatctcactctgccacagtgctaagaaggttaaaaacatttgttcaaccttttcttctcgcagaatcctgaccacaagttcagcccatcccggactggagttcagtaagacctcttcctccaaagcctcaaccctgcagctcgggtcacccagagccaccggcgtggacgaggaggatgtggaagtattcgactcatttgaaaacatgcgggtgttcctgcagctccgaccagagtatcgcgtgcattcttacaatgccagcgaaacaagccagttacttagcgtgagcgagggagaattgatcctacataaagtgagggttaaccagaataacttgcaggcacaggtcattgtggattacctgtgtaaactgtccagcctacctgcagaacagcaccctgtgctgttgggcagtaccagcttcgccttgttgtgccaactgtccgtgaaaaaaatccagttgttcgatacacaggacctgataaatgtgctgaaggctttcgtgattttgggcattccgcatagccacagcatgcttgatgtatatgagaccaagtgttgccaccaggtgtgggagatgaatatggaccaactgctattagtagcagacctttggagatatttggggcgcaaagtacccagatttctcaacattttctcttcctacctgaacctgcactggaaagaccttagcctatctcagctcgtccatctgatttatgtgataggtgagaatcggcaggtttcacaggatcttatgcagaagttggagagcctcatcttaaaatacatagatctgattaacctggaggaggtgggaaccatatgtctcgggttcttcaaatccagtaccaacctgagcgagttcgtcatgagaaaaataggcgacctcgcatgtgccaacatccagcacctgtcttcaagaagcctggtaaacatcgtgaagatgtttaggttcacacatgttgatcacataaactttatgaaacaaataggggagatcgcgcctcagcgcattccctcactcggggtccagggcgttatgcacctcacgttgtattgttcagccctcagatttttaaacgagggtgtgatgaacgccgtcgccgcttcacttccacctagggtggctcactgcaggtctaaggacgttgcaaaaatattatggagcttcggcaccttgaattataagccccctaacgccgaagagttttacagctccctaatctctgagattcaccgcaagatgccggagttcaaccaatacccagaacatctgccaacatgcctgctgggtctcgcttttctggagtattttccggtggagctcatcgacttcgcgctctctccagggtttgtacgactggcccaggagcgaaccaagtttgaccttctgaaggagctgtataccttagacggcacagtgggtattgaatgcccagactaccgcggtaaccgcctcagcacgcatctccagcaggaggggagtgagctcctgtggtatttggcggagaaagacatgaactcaaaacccgagtttctggagaccgtgttcctccttgagacgatgctgggaggaccacaatatgtcaaacaccacatgattctgccacacacacgcagtagcgatctggaagtgcagttagacgtcaacctgaagccactgccctttaatcgcgaagcgactcccgccgagaacgtggctaagctgcgcctagaacacgtaggggtctccctgactgacgacctcatgaacaagctgctcaaggggaaagcccggggccattttcagggcaagacagagtcagagcccggacagcagcctatggagcttgaaaataaggcagccgtcccactgggtggctttttgtgcaatgtcgctgataaaagcggtgctatggagatggccggtttatgccccgctgcttgcatgcaaacaccacgcatgaaacttgcagtacagtttactaaccgtaaccaatattgttacggcagccgggacctgctcggcctgcacaatatgaagaggaggcaattggcaaggctgggatatagagtcgtggaactgtcctattgggagtggctgccactgctgaaaagaacgcgcctggagaagctggccttccttcatgagaaggtgttcacctctgccctttag

SEQ ID NO: 116703 - DNA, 183 bp, Artificial Sequence
  Description of Artificial Sequence: Synthetic coding sequence
atggcatgccaaggtcgcgaggagtgctggtgccaatctaggattgctcgcacactgcctgctgaccaaaaacccgaatgtcgcccatactgggagaaagatgacgcgtcgatgccacttccatttgatctgactgatatagtgtcagaacttcgaggccagctgctggaagccaaaccatag

SEQ ID NO: 116704 - DNA, 630 bp, Artificial Sequence
  Description of Artificial Sequence: Synthetic coding sequence
atgttggatgatctaaacgcaacacatcaacactgcgtgctggccggcagtcaaccaaggtttagctcgacgcaccgagtggcggaatgttccactggaaccttggactatattttacaaagatgccagcttgccctgcagaacgtctgcgacgacgtggataatgatgatgttagcctgaaatcctttgagcccgccgtcctgaagcagggggaggagatccataatgaagtggagttcgagtggcttcgacagttttggttccagggcaaccgatatcggaagtgcacagactggtggtgtcagcccatggcccaactagaggctctgtggaagaaaatggaaggcgtgaccaacgctgtgttgcacgaggtgaagcgggagggcctgcctgtggagcagcggaatgaaatcctgaccgcgattcttgccagtctgacggcacgccagaacctaaggcgggagtggcacgcccgctgtcaatcacgcatcgcacggacactgcccgccgatcagaaacctgagtgccgaccttactgggaaaaggatgatgcttccatgcctctgcctttcgacctgaccgacattgtgagtgagcttcgtggacagctgctcgaagctaagccttag

SEQ ID NO: 116705 - DNA, 321 bp, Artificial Sequence
  Description of Artificial Sequence: Synthetic coding sequence
atggcacagctagaggctctttggaagaaaatggagggtgttaccaatgctgtcctgcatgaggtcaaaagagaaggattgcccgtggaacagcggaacgaaatattgacagctatccttgcgtccctgaccgcccggcagaaccttcgccgagaatggcacgcccggtgccagtcgcggatagcccggacacttcctgccgaccagaagccagaatgccgaccctactgggaaaaagatgacgcaagcatgcccctcccttttgacctgactgacatcgtctctgagttaagggggcagctccttgaagccaaaccttag

SEQ ID NO: 116706 - DNA, 321 bp, Artificial Sequence
  Description of Artificial Sequence: Synthetic coding sequence
atggctcaattggaggccctgtggaagaagatggaaggagtgactaatgctgtcttacacgaggtgaagcgggaggggctcccggtggaacagcggaacgagattctgacagctatcctcgcctccctgaccgcccgccagaatctgcgacgggagtggcatgcacgctgccaatctcggatagccaggacgttacccgccgatcagaagcccgagtgtcggccctattgggaaaaagatgacgcaagcatgccgctccccttcgatttgaccgacattgtgagtgagcttcgcggccaactgctggaggcgaagccctag

SEQ ID NO: 116707 - DNA, 384 bp, Artificial Sequence
  Description of Artificial Sequence: Synthetic coding sequence
atggaatggcgaaaagtgtccgagtgtaactctgtggagccctgtagggaggtaaaaaagtggccctaccggtgcattcaccacggaaaaaatttttctcggatgacaaatgccgtgctccacgaggtaaagcgcgaagggctgcctgtggagcagcgaaacgaaatcttgacggccattctggccagtctcactgctagacagaacctgaggagagaatggcatgctcggtgtcaatcgcgaatcgcacgaacgctcccagcggaccaaaagcctgaatgtcggccttactgggagaaggacgatgcaagtatgccattaccatttgatttgactgatatagtcagcgagctccgagggcagttgctggaggctaagccatag

SEQ ID NO: 116708 - DNA, 1518 bp, Artificial Sequence
  Description of Artificial Sequence: Synthetic coding sequence
atgaagcgcacacctaccgccgaggagagggagagagaggctaagaaactgcggctcctagaagaattagaggatacatggctcccttacttgactcctaaagatgatgagttctatcagcagtggcagctgaaatacccaaaactcattttgcgcgaagcgagttctgtgtcagaggagctgcacaaggaggtgcaggaggccttcttgacgctgcacaaacacggatgcttgtttagagacctggtccgcatccaggggaaggacctccttacacccgtttctcggattctcattggtaaccccggctgcacatataaatatctgaatactaggctcttcaccgtgccatggcccgtgaagggcagtaacatcaaacacactgaggcagagattgccgccgcctgcgagacatttctcaagctgaatgactatctgcagatcgagacgatccaagcgttggaggagttggctgcgaaagagaaggccaacgaggatgccgtcccactgtgcatgtctgctgacttcccccgcgtgggaatgggaagctcttacaacggccaagatgaggttgacataaaatctcgggccgcctataacgttacccttctcaatttcatggatccacagaaaatgccctacctgaaagaggaaccctatttcggcatgggcaaaatggccgttagctggcaccacgatgaaaacttggtcgacaggtctgccgtcgcagtttactcgtattcctgcgagggacccgaagaggagtcagaggacgactcccacctcgaagggagagatcccgatatttggcacgtggggtttaaaatctcttgggatatcgagacacccgggttggccatcccgctccatcaaggcgattgttatttcatgctggatgatctcaatgccactcatcaacactgtgtgctcgccggttcccaaccccggttttcctcgacacatcgtgtcgctgaatgctccacaggtacactggattacatcttacagaggtgccagctggctctgcagaatgtgtgtgacgatgtggataatgatgatgtatctttgaagagcttcgaaccagcagttctgaagcagggcgaggaaattcacaatgaagtcgagttcgaatggctgcggcagttttggtttcaaggcaacagataccgtaaatgcaccgattggtggtgtcagccgatggcccaacttgaggccttatggaaaaaaatggaaggtgtgaccaacgcagttttacacgaagtgaagagagagggactccctgttgagcagcggaatgagatccttacagcaatcctggccagcctgactgctcgtcagaatcttcgaagagaatggcacgcgaggtgtcaatctagaatcgctcggacactgccagcagaccagaagcccgaatgccgaccatactgggagaaagacgatgcctcaatgcctctcccatttgatctgaccgacatagtttcagagctccggggccagttgctcgaagctaaaccatag

SEQ ID NO: 116709 - DNA, 321 bp, Artificial Sequence
  Description of Artificial Sequence: Synthetic coding sequence
atggctcaactcgaggccctgtggaagaagatggaaggagtgaccaacgcagtgctgcacgaggtcaaacgggagggcctgcccgtggagcaaagaaacgaaattctgactgcaatcctggctagcctgaccgcgagacagaatctgaggcgagagtggcatgcacggtgtcagagcagaattgccaggaccttacccgcagaccagaagcccgagtgccgcccttactgggaaaaagacgacgcctctatgcccctgccctttgacttgaccgacattgtctcggagctgcgaggacaactactcgaagcaaagccatag

SEQ ID NO: 116710 - DNA, 13050 bp, Artificial Sequence
  Description of Artificial Sequence: Synthetic coding sequence
atgaccatcgcccttctgggcttcgctatctttctgctgcactgtgccacttgtgagaaaccactggagggaattctgagctcgtctgcatggcacttcacccactctcattacaacgccacaatctacgagaattcttcccctaaaacctacgtggaatcattcgagaagatgggaatctatctcgccgagccgcagtgggccgtccggtacaggataatcagtggtgacgtcgctaatgttttcaagactgaggagtacgtggtggggaacttctgttttcttaggatccggacaaaaagctcaaacaccgcgctgctcaatagggaggtccgggatagctacacactgatcatacaggctaccgagaagacactggaattggaggccctcacccgcgtggtggttcacatcctagaccagaacgatcttaagcctcttttttcccccccatcctatagagtgaccatatcggaggatatgcctctgaagtccccaatctgtaaagtcacagctactgatgcagatctggggcagaatgcggagttctactacgctttcaacaccaggtctgagatgtttgcgattcatcctacctctggtgtggtgactgtggccggcaaacttaacgtgacatggcgtggcaaacatgagctgcaggttctcgctgtggataggatgagaaaaatttctgagggcaacggtttcggcagtctcgccgccctggtcgtccatgtcgagccagccctccgcaaaccgcccgctatcgcctccgtcgtagtgacaccaccagattctaacgatggcaccacatacgccaccgtgctggtcgatgcaaactcaagcggagctgaagttgagagcgtagaagttgtgggaggcgaccccgggaagcattttaaagcgattaaatcatacgccagaagcaacgagttctccctggtgtccgtgaaagacattaattggatggaatatcttcacggattcaatctgtctcttcaggcacggtcaggatccggaccatacttttactctcagatcaggggtttccacctccctccctcaaagctgtcatccctgaagttcgagaaggctgtgtatagggtgcagcttagtgagtttagcccaccagggagcagggttgtgatggtgcgggtcacaccagcattccctaacctccaatacgtcttaaaaccctctagtgagaatgtgggatttaagttgaacgcacgcactggtctgataacaaccacaaaactcatggattttcatgatcgagctcattaccagttgcacattcgcacctcaccagggcaggcctctactgtggtggtaattgacattgtggactgtaataatcatgccccactgttcaatcgctcaagctatgacggtactctcgatgagaatatccctccaggcacgtcagttctggctgtcaccgcaaccgatagggaccacggagagaatgggtacgttacatactctatagctggcccaaaagccttgccgttctcgatcgatccctacttgggaattatttctacgagcaaacctatggactatgagttgatgaagaggatctacacatttagggtccgagcctccgactgggggagccccttccggagggagaaggaagtttctattttcctgcagcttcgaaacctgaacgataaccagccaatgttcgaggaggtgaactgtacaggatctataaggcaagactggccggtaggaaagagtatcatgacaatgtctgcaatcgatgtcgacgagctgcaaaatcttaagtatgagatcgtgtctgggaacgagttggaatacttcgacctcaaccatttttcaggcgtcatatctctgaaaaggcccttcatcaatctgaccgcaggacagcctaccagttatagcctcaaaatcacagcgagcgacgggaaaaattacgcctcccctacaacccttaacattacagtcgtgaaagaccctcattttgaggtgccagtgacttgtgacaagacgggggtactaactcagtttacgaagacaatcctgcattttatcggtctccagaaccaggagtcctccgacgaagagtttacttctctgtctacctaccaaatcaatcactacacacctcagttcgaagatcatttcccacagagcatcgatgtgttggagagcgtgcccatcaataccccactcgccagacttgccgctacagatcctgacgctggatttaacgggaaactcgtgtacgtgattgccgacggaaacgaagaaggttgtttcgacattgagctggagaccgggttgctgacagtcgcagccccattggattatgaagctaccaacttctacattctgaatgtgaccgtatatgaccttggtactccacagaagagtagttggaagctgctgaccgtgaacgtcaaggactggaatgacaatgcccctcgcttcccacccggaggctatcagttgaccataagtgaggatacagaggtgggcaccacaatagctgaactgactaccaaggatgcggattctgaagacaatggcagagtccgctacacactgctcagtccaacagaaaagttctccctccaccccttaaccggtgagctagtagtcactggccacctcgatcgagagtctgagcctaggtacatactgaaagtggaggcaagagatcagcccagcaaggggcaccagctttttagtgtaaccgacttaattattactcttgaggacgtgaatgacaactcaccacagtgcattacagaacacaatcgccttaaggtgcccgaggatctgccccccggaactgtcctgaccttccttgatgcctcggacccagatcttggccctgccggcgaagtacggtacgtcctgatggacggcgcccacgggacttttagagtggacctcatgacgggagctcttatacttgagcgggaattggatttcgagcggagggctggttacaatctgtccctctgggctagcgatggcggacgcccactcgcacgccggacactttgtcatgttgaggtaatcgtattggacgtgaatgagaatttgcaccccccccattttgccagctttgtgcaccaagggcaggtacaggaaaactcgcccagcggtacccaagtcattgtcgtcgcagcccaggatgacgactctgggctggatggtgaattgcagtactttcttagagcagggaccggactggcagcgttctcaataaaccaggatacaggcatgatccagacattagctcctctggatagggaattcgcctcctactattggttgaccgttctggctgttgatagaggcagcgtgcctctgagtagcgtgactgaagtgtacatagaggtcacggacgcgaatgataatcctccacagatgagccaggccgttttctacccatctattcaggaggatgcgcccgttggaacatccgtgctgcaactggacgcctgggacccagattcttcatcgaaggggaaattgacctttaatatcacaagcggtaactatatgggtttttttatgattcacccagtgaccgggttgctgtcaaccgcccagcaactggatagagagaacaaagacgaacatatcttagaagtgaccgtattagacaatggcgagcctagtttgaaatcaacctctagagtcgttgttggcattcttgacgtgaacgacaatccaccgatcttctcacataagctgtttaatgtgagacttcccgagagactcagccccgtgagccccggaccagtgtaccgccttgtagcttccgacctggatgaaggcctgaacggtcgggtgacgtactctattgaggatagcgatgaggaagctttttcgattgacttagttaccggagtggtatcaagctcgtccaccttcaccgccggagagtataatattctgacaattaaggctacagactctggtcagcctccgttgtcagcctcggtccgcctgcacattgaatggattccgtggcccaggccatctagcattcctctcgccttcgacgagacatattacagtttcactgtgatggagacagatccagtgaaccatatggtcggcgttatctcagttgagggcagacccggcctgttttggtttaacatctctggtggtgataaagacatggatttcgatattgagaaaactaccggcagtattgtgatcgcgaggccactcgacactcgaagacgcagtaactacaatcttactgtagaggtaacagatgggtcgcggactatagcaacacaggttcatatctttatgatcgctaatataaaccaccaccgtccccaattcttagaaacacggtatgaggtcagagtgccccaggacactgtgccgggggtggagctgttgagagtccaggccatcgaccaagataagggtaagagcctgatttatacgatccatgggagtcaggatcctggttcagcaagcttgtttcagcttgatcccagctctggtgttctggtaaccgtggggaaattggacctcgggtccgggccgtctcagcacacattgacagtgatggtgagagatcaagagattcccataaagaggaatttcgtctgggtaaccatccacgtggaggacgggaacctccatccaccacgcttcacccaactccactatgaggcgtctgtcccagacacgattgctcctggtactgagctgctgcaggtgcgggcaatggacgcggacaggggggtcaatgcggaggtgcactactcgctgttgaagggaaatagcgagggcttttttaacataaacgccctcctgggcatcattacgctggcccagaagttggaccaggccaaccatgctccacataccctgaccgttaaggcagaggaccaaggctcgcctcagtggcacgacctggctaccgtgatcatccacgtgtatccctcggaccgttcagcaccaatattcagtaaaagcgagtacttcgtggaaattcccgagtccatccccgtcggcagtccgatactgttagtctcagccatgtctcctagtgaagttacatacgaactgagagagggtaataaagatggtgtgttctctatgaattcttacagcggactgatcagcacccaaaagaagctagaccatgagaaaatatcttcctaccagctgaaaatccgaggctcaaacatggctggagcctttacggacgttatggtggttgtagacatcatcgatgaaaacgacaacgcccccatgtttttgaaatcaactttcgttgggcaaataagcgaagccgcaccgttatacagtatgattatggataagaacaacaacccattcgttatccacgccagtgactcagataaagaggctaattcattactcgtctataaaatccttgagcctgaagccttgaagtttttcaaaattgatcctagtatgggcaccctcacaatcgtgtccgagatggactacgaaagcatgccaagtttccagttctgcgtgtatgtccacgaccaggggagtccggtcctattcgcacccagacccgcacaagtgatcatacatgtaagggacgtgaacgattctcctccaaggttctctgaacagatctacgaggtcgctattgtggggccaattcacccgggcatggagctcctgatggtaagggcaagcgacgaggatagtgaggttaactactccattaagaccggaaatgccgatgaggctgtcactattcatcccgtaactgggtccatctcagtccttaatccagcctttttgggactgagtcggaaactgacaattagagcgtctgacggtctgtaccaggacactgccctggtgaagatcagcctgacacaagtcctcgataaatccctgcagttcgaccaagatgtgtactgggccgccgttaaggagaatctgcaggacagaaaagccctggtgattcttggggcccagggaaatcacctcaacgataccttgagttatttcctgctcaacggcacagacatgtttcatatggtgcagagtgctggcgttctgcaaacacgcggagtggctttcgatcgtgagcaacaggacacgcatgagcttgcagtggaggtaagagacaatcgaactccccagcgcgtggcccaagggctggtgcgggtttcgattgaagacgtgaacgataacccgcctaagtttaaacatcttccgtactacactatcatccaggacggcactgaaccaggggatgtcttgttccaggtttctgctaccgacgaggacctcggcaccaatggagccgtcacatacgagtttgccgaagactacacatacttcagaatagacccttatctgggagatatctccttgaaaaagccatttgactaccaggccctcaataaataccacctcaaggtcattgcaagggacgggggcacccccagcctgcaaagcgaggaggaagtcctggtgacggttaggaataaaagcaaccctctgtttcagagcccttactataaagtcagagtacctgagaacattacactctatactccgatcctccatacacaggcaagatcaccagagggacttaggttgatttacaatattgttgaggaggagcccctgatgttgtttactaccgacttcaaaactggagtgctgaccgtcactggccccctggattacgaaagcaaaaccaaacacgtctttactgtgcgggcaactgataccgccctgggcagttttagtgaagccactgtggaagtgctggtggaggacgtgaacgataatccgcccacattctcacagctggtatacactacctccatttcagagggtttgcctgcgcagacccccgtgatccaactgctggccagcgatcaggacagtggacgcaatcgggatgtgtcttatcagattgtcgaggatgggtccgatgtcagcaagtttttccagattaacggctctacaggggaaatgtccaccgtgcaggagctggattatgaggcacaacagcactttcacgtgaaggtgcgagccatggataagggcgatcctccccttaccggcgaaactcttgtcgtggttaacgtttccgacattaacgacaaccctccagaattcaggcagcctcagtacgaagctaatgtgtctgaattagctacatgcggtcaccttgttttgaaggtgcaggctatcgaccctgattctcgtgatacatcccgtttggaatatctgatattaagtggaaaccaggaccggcactttttcataaacagttcgtcgggaatcatttcgatgtttaatctttgcaagaagcacttggatagttcttataacctccgtgtcggcgcttcagacggcgtgtttagggccaccgtccctgtgtacatcaatacgactaacgcaaacaaatattcacccgaatttcaacagcatctctatgaagccgagcttgctgagaacgctatggtgggaacaaaggttattgacttgcttgctattgataaagactctggcccctatggtaccatagactacacaatcattaataagctggcgtctgagaaattctctatcaatccgaacggccagatcgccaccctacagaaactcgaccgggaaaacagtactgaaagggtgatcgccattaaagtgatggcacgggacggcggcggtagggtagctttttgcacggttaaaatcatcttaaccgatgaaaatgacaatcctccacaattcaaggcctcagagtacaccgttagtatacagagcaacgtttctaaagacagccctgttatccaagtgctagcgtatgatgcagacgaaggacagaacgccgacgtgacctattcagtgaatcccgaagatcttgtgaaggatgtgattgagatcaaccccgttaccggagtcgtgaaggtcaaagatagtctcgtggggcttgagaaccaaacactcgatttttttatcaaggctcaagacggtggtcccccccactggaacagcctggttcctgtccgtctccaggtggtacctaagaaggtgtcgctgcctaaattctccgaacccctgtatactttttcagcccccgaagacctacccgagggctctgagatcggcattgtgaaggcagtggctgcccaagaccctgtgatatacagcctcgttcggggtaccacccctgaatctaacaaagacggagtgttctcactggatcccgataccggcgtgatcaaggtgcgcaaaccaatggatcatgaaagcaccaagttgtatcagatcgatgtaatggctcattgcctgcagaacaccgatgttgtgtcgttagttagtgtcaacatacaggtcggcgatgttaacgataaccgaccagtgttcgaagcagatccttacaaagctgttctaaccgagaacatgccagtgggtacctctgtcattcaggtcaccgcgatcgataaagacaccggccgggacggtcaagtgtcttaccgcctgtctgcagaccccggttcgaatgtccatgaattattcgctatcgacagcgaaagcggatggataactaccttgcaggagctggactgcgaaacgtgccagacctatcacttccacgtcgtggcttatgatcatggccagacgattcagctgtcttcccaggcactggtccaggtctcaatcacagacgagaatgacaatgctccccgctttgcctcagaggagtacaggggatccgtcgtcgagaactctgagcccggagagcttgtggctacactgaagacccttgacgccgacataagcgaacagaataggcaggtgacttgttacattacagaaggcgatcccctcggccagttcggcatttcgcaagtgggagacgaatggcggatcagctcccggaaaactttggacagggagcacaccgctaaatacctgctgagggtgacagcctccgacggaaagttccaggccagcgtgacagtcgagatatttgtcctcgacgtaaatgacaacagccctcagtgctcccagctgctctacaccggcaaagtccatgaggacgtattccctggccactttattctcaaggtctccgccacagacttagatacggataccaacgcccagattacatactctctccacggcccgggagcacacgaattcaagctggacccacatactggcgaacttaccacgctgaccgctctcgaccgggagcggaaagatgtgttcaacttagtcgccaaagcaactgacggcggtgggagatcatgtcaggctgacataactctgcatgtagaggacgtgaatgacaatgccccgaggttcttccctagccactgtgctgtggctgtatttgataatactacagttaagactcctgttgcagtagtgttcgccagagatccggaccaaggcgcaaatgctcaagtcgtgtattctctgccagatagcgccgagggccatttttccattgatgcaacgacgggcgtaatccgactcgagaaacccttgcaggtcaggcctcaggcccccttggaacttacggtgcgggccagtgacctggggacacccatccctttgagtacactgggtaccgtcacagtctctgtcgtcggcctggaggactatcttcccgtcttcttgaacactgaacatagcgtgcaggtgcctgaggatgcaccacccggcaccgaagtgctccaactggcaacactgacacgacccggagccgagaaaaccggatatagggtagtgtccggaaacgaacagggtaggttcagactggacgctaggaccggaattctgtacgtaaatgcttccctcgacttcgaaacatcacccaagtattttctgtctatcgaatgttctagaaaatcttcatcaagcctctccgacgtaactactgtcatggtaaatattacagatgtgaatgaacatcggcctcagttcccccaggacccttattctacaagagtgctggagaatgccctcgtgggcgatgtcattttgacagtgtccgcgaccgatgaggacggccccttgaattccgacattacatacagcctaattggcggaaaccaacttggccactttactatccatcccaagaaaggcgaactgcaggtcgctaaggctcttgatagagagcaggcctccagttattccctaaagcttcgggccaccgactccggtcagcctcctctgcatgaggacactgacattgccattcaagttgcagacgtcaatgataatcccccgcgcttcttccagctcaattacagcaccacagttcaagagaacagtcccataggttctaaagtgttgcaattgattctaagtgaccctgattcgcccgagaacggacccccatatagctttagaattacaaaggggaacaacggttcagcctttagagttactccagatggatggctcgtgactgcagagggtttaagccggagagcccaggagtggtaccaactccagatccaggcatcagatagtggtataccaccactgtcctcactgacctccgtacgcgtgcacgtgacagagcagagccactatgcaccaagcgctctgccactggagatcttcattacagtgggcgaggacgagtttcagggcggcatggtgggtaaaatccatgccacagatagagaccctcaagacactctgacatactcattggccgaggaagaaacattaggtaggcacttttcggtcggggctccagatggaaaaataatagctgcccagggactcccaaggggtcactatagttttaatgtcacggtgagtgacgggacatttaccaccactgctggcgtgcacgtgtatgtgtggcacgtggggcaagaagcccttcaacaggcaatgtggatgggcttttatcagttgacaccggaagaactggtctccgaccactggagaaacttacagcgctttctctcacataaactggatataaagcgagcaaatatccatttggccagtttacaaccagctgaggccgtcgccggggtggatgtgttattggtgtttgaggggcacagtggtacattctacgagtttcaggaactggcctccatcatcacacattctgccaaagagatggagcactctgtgggggtacagatgcgatcagctatgccgatggtaccgtgccaagggcctacctgccagggccagatttgtcataacaccgtgcatttggaccctaaagtcggacctacctacagtacggcgcgtttaagcatcctaacaccaaggcaccatctacagagatcttgcagctgtaacggcactgccactaggttctccggccaatcttatgtcaggtaccgcgctccagccgccaggaactggcacatacacttttatctcaagaccttacagccccaagccatcttactgttcacaaacgagaccgccagtgtatccctgaagcttgcgtctggagtgccccagctcgagtaccactgcttaggcggcttctatggcaatctctcatcccagcgacacgtcaatgaccacgagtggcattctattctggtggaggaaatggacgcttcaatccggctaatggttgattccatgggaaatacctctttggttgtcccagagaactgtcggggcctaagaccggaacggcacctgctgctgggaggcttgatcctgttacacagcagtagcaacgtctcccaaggctttgaaggatgtctcgatgccgtggtggttaacgaagaggcattggacttacttgcaccaggcaagactgtggctgggctgctcgagacgcaggcacttacccagtgttgtctgcattctgattattgctcccagaacacctgcctgaacggtggcaaatgtagctggacacatggtgctggctacgtgtgcaagtgtccaccccaattctccgggaagcactgtgaacagggtagagagaactgtacattcgccccgtgcttggagggggggacttgtatcctgtctccaaagggagctagttgcaactgtccgcatccttacacgggcgacaggtgtgaaatggaggcaagggggtgtagtgagggtcactgtctggtgacacctgagattcaaaggggagattgggggcaacaggaactcctgatcatcaccgtggccgtggccttcatcatcatcagcacggtgggcttgctgttctactgtcggaggtgtaaatctcacaagccggtggctatggaagatccagatctactggccaggagtgtcggagtagacactcaggctatgcccgctatcgagttgaaccccctctcagcctcgtcatgtaataacttaaatcagcctgaaccatctaaggcctcagtgcccaatgaactggttacttttggtcctaattcaaagcaaagaccagtggtgtgttcagtcccgccacgcctgccacctgccgcagtgccatcccacagcgacaacgaaccagtcataaaacgcacatggtcttccgaggaaatggtctacccgggaggagcaatggtttggcccccgacatattcccgtaacgaaaggtgggagtatccccattctgaggtaactcaaggtccactgccaccctccgcccaccggcatagcacccctgtggtgatgcctgagcccaatggcctctatggcgggttcccatttccactggagatggagaacaaacgagcaccactgccaccccgctattctaaccagaacttggaagacctcatgcccagtagacctccatcaccgcgcgagagactcgtggctccctgcctaaacgagtataccgccatcagttactatcacagtcagtttaggcaggggggagggggaccatgtctggcagatggcggctataagggcgtgggtatgagacttagccgagccgggccatcatacgcggtttgcgaagttgagggtgctcccctggcagggcaaggacagccccgggtaccgccaaactacgaggggtctgatatggtcgagagtgactacgggagctgcgaggaggtgatgttttag
